United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 10

SEQ ID NO: 292 - DNA, 266826 bp, Homo sapiens
agcgatccgcctgcctcagcccccctagtagctgggattacaggcacgcgccaccatgcccggctaaattttgtatttttagtacagatggggattcaccacgttggccaggctggtctcgaactcctgatctcaggtgatccacccgcctcggcctcccaaagtgctgggattacaggcatgagtcaccgcgcccggctctgtgaacttcttgaggtatctctaaagattccacaattgtttctttaattttcagagtaattatgtggtaagactattttttatgcaaattttacagaagtataaaatatagaaaagtacacaaatccttgaagcgcataacttgttgaattttacagtgtgaatatgcccacatcatggcaggagacacatcatcatacacctccagaagttccctgtgtccccttctcctcctaaggagacccaatatcctaaattttaacagcacagattagttttgtctgcttttgaactttatataaataaaattatactctttaatgtctgttttctttctttctatattaggtttgtgagtctcactcatgttgttacttgtagttgtattccattcattcgtattgctacatagtactccactgtataaacaaattgctatttatccattccactatagacagacacttgaattgtttccagtttggggctcttatgaattgttctgttaaaaacattcttgtatatactttttggtaagaatactattatttcatttattctatgaatgaggaaagtgagtcttagcttaaagcatgtagctggtgtctcatagcaccagctgggccagaactgggatataaactaggtgctacttcttccaaagtcattactcctaaccatggcttttaatggtttcctactgagctgctaacattagatatatcaattaaagttgaatactttttttttttcttttttttgcaacagagtcttgctctgtcgccaggctggagggcgcagtctcggctcactgcaacctccatctcccaggttcaagcgattctcctgcctcagccacccgagtagttgggactataggcacgtgccaccacacttggctagtttttgtatttttagtagagagggggtttcaccatgttggccaagatggtcttgatctcctcaccttgtgatccgtctgcctcggcctcccgaaatgctgggattacaggcatgagccaccgcacccggcctaaagtggaatacctttaagataataattaagtacctattgatagttctggctacataatttgcagagcctagtgcaaaatggaaatgtgggaagccttgtctagaaattattagaatttcaagatagcagagcatgaaatcaagcaaaagtctcttctgaatctgaggtcagtgagactgcataggccatatgtccataaagccagccctctgtgttgaatgttagtggatctacttggatccaaatacgtaaagagtttttacagagtgtagttgagcaatggttgttggtttctcggacgtgataatcaaacgctggaattaacagaaatgaatacacattcaagacatatatagaaattacgtatgtagcatgtatcaatgaagtatataaaagcaggattaagctaggttaaatgattaattctaacgctttggttgcagaaggtctttgtgtcaatgtttttgtttgggggctggggagaaccgaagcatggatacaacatttacgtattccctccagcattaaatctaacctcctttgaaggctctctaaaatgcatactctctctccctactctaccttactgcttccacaatgtccaagcacataccctctatctagttagtatgactttacatcatatggttaccccatctcagagcttctaggcatggcctgttctctgacagaatgctgtaatttagattctgctaagtaaataaagttcaagttctaccccctctctggaatcatccccagtgacactcactccatttgttccatgcttcccgatttcattacacactaatgaaaccttgctttatttatttactaactagcgggctttcccaaccattgcctgggaaatatatccattattattaaataaaaaaaaaaacaactctgttcctactcagtctggagttactagaattgcctttttgagaagtggaacaattacgtatcaatgccttgatttcaaagcatcttgctttgtgatactggaagctactgttttctctgcccattgaatcttgaaatatatggcatgtctcccagataagcagtcacatggaccttagactgtgccccaatttcaaagaccctggaagataactgcttgtttgtacccctagtatcccttaaaacaaacaacaacaacaatatatatatatatatatatatataaaataatggcaatatttttagtcacatcatcctaaatagtttctctaaattaggtgaaaattgccctggttggtggaaaaaagtaatgttcagttggtccaattgagaattgtatgggaacaaaaatatccttaaagttacaaagtaaagaaagagaggtgtttttacaaaagtagccagaagaaaactgaggaaatatttgtcttgaaagcccaaaaaaagaatactgagttcctagtactaggaaaatggtagaatggatggtattcaaggcccacatggtttcctaggcagattaaataaaacagtctattacgtaacaaaattgtatttcattttattttttgttttttgtctcacactctgccaagtctcatgttatttaataaaatttgtattgacttaaaatacatttgcacataggacataaaagtattaaacttttttttttttttttttttttgagacggagtctcgctctgtcgcccaggctggagtgcagtggcgccatctcagctcactgcaagctccgcctcctgggttcacgccattctcctgcctccgcctccggagtagctgggactacaggcgcccaccaccacacctggctaaattttttttgtattttttagtacagacggggtttcaccgtgttagctaggatggtcttgatctcctgaccttgtgatccgcctgcctcggcctcccaaagtgctgggattataggcgtgagccaccgcgcccggccataaaagtattaaacattttataaaataaaaatataaattaaaatgtataggccgggcatggtgctcacgcctgtaaccagaactttgggagaccgaggcgggtggatcatgaggtcaatagatacagaccatcctggccaagatggtgaaatcctgtctctactaaaaatacaaaaattagctgggcgtggtggcgtatgcctgtagtcccagctactcgggaggctgaggcaggagaatcgcttgaatctgggaggcagaggttgcagtgagctgagatcgcgccactgcactccagcctggcaacacagcgaggctttgtctcaaaaataaataaatgaacaaataaataaaacaaaatatataatatgacatttctaagaaaagtcatgtaacttcaaaattataagttctactataaattttactataccaaaaaagtatgatataaaactttttgcccagagtggtggctcacacctgtcatcccaacaatttgggaggaggctggggtaggaggactgcttcagcccaggagttccacagcctgggcaacaaagcaagaccctgtctcttaaaatacaataaataaataaataagcctggcgtagtggtgctcacctgtagttctatctaggcattggaggctgctttgagctataatcaacactgcactccagcctggacaacagagtgaaaccctgtctcttaaacatacaaaactttttaattacaataaacctgtttaaaaatgtaggctgatatagcctgtgaaaagcatagaaattttatacttttacaggtatatcagaatttcaaaatgtttgaattaatccacaaactgaggattatgttagtaatactataaatttttatattggccatacagtaaacttactaaaaaatctggagaaacaaaaattaaggagataataccaatttagaataatttttagcaaaagcagaacgagaactttgcataaattaaacacttgactacaaacacttcaagaaagtagttaataaaaatactgatctgttaagggatttctaaaaaatcaatgggaagtagtttcaaatggtttcatccttcttataatagcaacatgaactccacttgctcctctgttacactcaatcccccaagaagctcatctattcttttttctttttagacagtttcactctgtcgcccaggctagagtgcagtggcgcgatgtcggctcactgcaagctccgcctccggggttcacgccattctcctgtttcagcttcccgagtagctgggactacaggcgcccgccactgcgcccggctaattttttgtataaaactcatctattcttagttgtaaataaaacctctacaaatcattccttacctacactttcaggccaaaagtgttttgagcatcagaccaacttcaaatttaacagacacaaagctggactcatctttcccccaaacaagattttgctgtactctctagtcatcaagaataatttagatcgctgggcgcggtggctcacgcctgtaatcccagcatttttggaggccgaggcgggcggatcacgaggtcaggagatggcgactatcctggctaacacggtgaaaccccgtctctactaaaaatacaaaaaattagccgggcgtggtggcgggtgcctgtagtcccagctacttgggaggctgagaagggagaatggcatgaatccggaaggcggagcttgcagtgagccgagatcgcgccactgcactccagcctgggcgacagagcgagactctgtctcaaaaaaaaaaaaaaaaagagtaccttagatccatcccatcaccttcacctcaatgcctggggctcgggctgtggcgataggctgccaaatgctttcaatactctccctcattcaactcatctattcccctatggttaatttaattcctgaaagtccaaactcctcttcttacatgctcaaatttttattagtccccaacacaaactttataatactatggccactccaggttcagagttcggttataatgtttctaacctaccttcatttttaaggaaagcaaagatatatataaacagctacacaagagaaaaacatatatatatatatatatatatatatatacacacacacacacatataaacagctagacaagagaaaaacagatgaagtcaactctgaaatgtggccctgtatgctcaacctggtcaccatgccaggctctcttgggcagtatccaataccctattacccatccatcgttgggacctgtgcatagcattataatactagctggattgttagggggaaatcttcagttatattttgatcatttgggaaaaggtgaattaatgttaaattttaacaatgttcacattaatctgtgagactttttgtacatattcacacattggaaaaagaaatatgcccaaatatttgattaaaaagaatatagtcaccataatcaaagcaactagctggaggtttggctcaaatatattctgcagggtgtggaggatggtagtcctaatgggtcaggtctgcttttttttttttttttttttgatacggagttttgctctgtcacccaggctggagtgcagctgcataatcttggctcactgcaacctccgcctcccggcttcaagtgattctcctgccccagcctcccgagtagctgggattacaggcgcacgctaccacacccagctaatttttttgtatctttagtagagatggggtttcaccatgttggccaggctggtctcgaactcctgacctcctgatccacccacctcggcttcccaaagtgctgggattacaggcgtgagccactgcacttggcctgcttcttaaagagggtagtgaatgcatggttataacagttgaggatatctctacatggtatagtcaacagtctctagaaatatgtatattcaaaggacactttgcactagcaatgagtccacaggtgttttgggtgttttgctgtgcacaactgcagtgctcttttgtgcctgttattatataagatgggcacaggagatattgtgacagtggcttatatctggctaaaccttgtaaagcaattccagctgataatataagaactttaggcattataacttaaaactaaatggaaaatgcgtaacattagatggtccctatcactagagggactgaaacagaggatgggtacatattacacaggcttcataaagcagattccagagtcaactgagtgggacaggtggatcaaatgaccatttagttctcttctaattgtgacaatcttgataaatattatcaaggcatattcgattgaatttatacatgtgtggcataatctctacatcttatgcaacttgagatctaaagatagataaaggagcagaaaaggaaaattgtttcttttttgcctacagtggctctcaacaaagaactcttttggatctcaaaagaatttttgatgacctccccacctccatgagggatttattttattatctgttgattttcaggtggcattttgacttaagagtctagggtttcttacatgaccaattccccacccatatctctgggggttggagacgtgggatggtcattatcccaaagatctgaaaatctctgatccagttactattcaatgtagggctatttaatataatatgatccagaacaacagaaacttaactttcatttatatttttgaatgagcatcttattttcctatattgtactactggggaacaagggagcgaacggtgtgatgaatgagtcttccctttataaggtggcttaattatgtgactctgggacaatgcaggtggaggcctctggtgatgagaataactaattgagggatcctcccgaaactctaccacacaacagttactcgctcccctccaatccatttaactgactttcttttccacctactaacattattgaagtttgtaaatgcttaattttccagttcactagaggattgtagagaaaccacttcttgcttcaaatgaaaaatatgaattgtaattttgattaaatatttactaattcaaaaatcaagagaaaataatttcatgtctttattatgcataaaatggaagacttttttttttgtaaaataccatattttagcatatatagatgtgtatttttttttttttttttgagacagggtctcactctgttgcccaggctagagtgtggtggtcgtgatcttggctcactgtaacctccgcctcccgggttcaagcaattctcctgcctcagcctcctgagtagctggaattacaggcgtgcaccaccatgcccggctaatttctgtatttttagtagacacggggtttcaccatgttggccaggctggtctcgaactcctggcctcaagtgatccacccgcctaggcctcccaaagtgctgggattacaggcgtgagccaccacgctcggccaatatgtgtatttttgctcttctgctcataaaactctcctgagctcaatgtagttcattgggtctacaaaaagagcatagttaatcttagaaatatttcattgcacaaggctggcagctttatcttgtatggcgaactacctcactttcaaatctaaacgtcttatcccctgctgtaagctggaacagaggcatcgataagggaaattagtgataaaaggtagtaattatacactgcaatggctgcgggatctgatttagaagtcataactgacccgagtttgaatcggggctttcctacttattagcggtatgactttgggctacttaattttaacctttctgggcctgagatcccatatcttagataataatagcagttatctcagagggttgccataaggattaaataatacctgcaaagcactcagcgcaacatcatactttcagaaatgttggctattttgactattatttctgtaaattgggcacatctcaattacagagaatctctaaagtagttctgaatcccatctcatagagttgcaaagggtttggtcaatgcaaccttatttttcccaccttttaatttctgcagtaggctactgtagcagccactagcacaggtggctattgagcactccaactgtgtctagtcggaattgagatgcgctgttaagtggaaaatacacatcagattttgaagatttaattttgaagaattaattttttaatttaattttgaagatttaatacgaagaaaagaacgtaaaatctcaatttttaaatatttgtttaagcgttgaaatgataatgtctcagatatactaggctaaatgaaacatataattaaaattaatttcacgtgtttcttttcactttttaaatgtagctaccccaaaattaaaatgacataagggactcgcattatatttgtactggacagagttcaggtaaaacctttctactcataacgtggacagcagcacctgggagcttcttagaaacgcagatgttcggccccgacccagacctatcccaaggcgatgcttacatctcgctccagatgattccgccgtttagcataatgaagagggccgatctggctcaaaagccacatacagcgaataactactaactgctttccgaaaacagcaaagtgatgaggaagaaagaagtggctgagaagaagtaacagagaaagaaaaagacactcaaattctaggaacaagaagcagaggagaaaaacccaacctgggagattaagtggaagggcactcccagacctctgcctccataaaagtagagggagatgcaaactgagataagacctacaatcaaaacccgtcaaggtccaggaaactgtccctcaaatctagtcttacccacccctcagcggcctcagctaagctaggcctgggcccgaacaagtcccaggttagggttcgacgcgaaccaccatcctccccagggctgcacggttctgtggggcatctctccacctttcgcttaaaggcccgtttcccaagacacaggacgcgtttcccggggctcacctgcctctgagccgccccaacggcctgcaccttcaccaccgccaccttccagtccttcgtcagagagcccgccccctgctcccattggtcaggccgctcgtcactcctgaagggcggggtcggactcgcgaggctgtccagaacgccatggcaaccggtctcggaactacatctcccgtcatgttccgctcgggggcggagaaagaggcgaggccccgccccaaggactaccaataaatgggcgaagttggaatcgcccggatgggttccgttttatgcaaattttagccgaagaccacacccttcctcattccaaccataggcccggccaacccctttgggttgtgcttcgcctttttcctttccacattattctctccttgaaaacctccaataattaagtcaattaagtgcatcctatctagtgtctctcacggcaacgagcagatgcaccgaaatcgtgcaacaaaatctccataaaccacgataggcaacctcagaccataaatctcctgttacgcctacatggggaggagggggagagtgctaatcctgcccccacacagcccctgctgattggctcattcggcttgtcactctgttgtcttacatttctttggctcaccctctttgggttcgcacggtgggcggggccagtggtagggggtggtgagaaggtgcgggccccttcttccaattggctggcggtttccccacccacttatgggcggagatggatggtggatggggggcgggggaggcagcggagggagatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggtgaggagagggctgcaaggcggcggcctggaccacgggcggctgcagcgggggcgggggtcggcgcgggggtctgcgcgatggctgcccggggcatccgtcccgcgcccggcgcttgtctccccggccgcccttagcccctcgccgcgcgcccgagagacggcagcggctgcccctctgccttgtccttcccgtcctcgggggtggcggcggagtggcgggcggacccgcactgggaggccgggggccgcggtgggccgtggggtggcggccgcgggacgggcgtggggatgaatgggcgccgcggccccgccgccgagcgggctccctcctctcgcggggaccccgggcggccgctccttcccgggctgacctcgctgccctcggccgccggcgaggggcggcccggcctcgcctcccgccggcctcccggggacccgcgttggcgggagcggcgccgcctctgcctggagccccggctccttcctcggcccctcgctcgcaagcctgcagaatcctgggtcagtgaagggcaggcaatgccgttcggccccagggcgcgccgcggggccgcccctgaaggcatttaaaggggagcgtcttccgcgccctgtgagcgcgtccccgggtccgccgcgtcccttcccttcttacgcaccgacacggttttgtggtgtggacccaagacacaattgcagtcccttgcttgcacgaatgcaatccgaattcccaaaaaaaggaaaccggcgaggaatcggccgcaccttcctgcgcttctgcttgccttgggattagaaaacaacttcggagattacatttcctatgggcaatcttttgttgtgattcagactcaagaaggctttgctttggaagaaatagattagcggcttctctgtggagttggaggctatagagatttttatagcctcttcaatatgaaagtttcctctagaactttgccatcatcagtgctattctgagggcagcagcaacctggaaatttagatacatgcaggctccggccagatgcgtttctttgtgcttgtctgttggcattcttctcttgctgctcctcttgatcaaaacgtacagataataaaggcaaggccaatgaagagggtagataataacagcaaatcccatacaaacaaatgcctctagaaattctcagttctgtcagcggggaggcagttttgctaatcccgtggaacggatgaaaagaaaggcacagagatctcatggattatgtagtggacaggatgtgagggcaggaactggggccaggacccagcaggccagctggtttgcatggtgccactctaaacccccaaaatatgaataggaggaatgtatttgttgggatacctttatttttagatgactttaaggttgagagtgcagaagcttaaacatccttcatagttattatttcttagtttatctctgagaacaaaatatgtttctgtttaaaatttcttttactggtgtgcttgaaacgttattttgatgggagtttccttgtaagtaaaaacattgaaaaatacatacatatgaaagaaaaatccttagtgcagatgggtttgtaaagaatccagggacttttaagtcatataaattaagaagtgagggacactaatttgatgatggtgttaaaattatttcagacacctttaagtagtccagtggagatcatttctgatagtatgatctttttttaaaaaaatggtatttctttatctaggaatgcttctgttgaaattgctacggcgcatggtaccgtcacaaaactcttttattattctgcctgagtaagagaggaaatgaacaaatttttaatgtactttggaaccctgcggattgcacagatactaagcattgtgaaatagggcataaaatgagtggtagcaagttagttctgtgaaatgtttgtcgctgttagcatttttttttttttttggcagtcgactagcaattttcttttccctaaagcttatcttcaatattggtagtagaacctctgctcaagtttatcttttccccaagtgcctagactgggacaaactatcaagcctcctgtaagagattaaggaggagctgctggtaaattcctttcctttttttttttcttgaggcagggtctggctatgtcacaggctggagtgcagtggcgcaatcttggcatactgcagcctcgacctcctgggctccagtgatcttcccaccccagcttccagagtatctgggatcacagatgcacgccaccatgcccagctaattttaaaattttttctagagacagggtctctctgtgttgctcaggctggtctaaaacgcctaccttaaacgattctcccacctaggcagcctcccaaagagctaggattagaggaatgagccaccatgcttcgtccaaattcctctactctaaattatctttttaatttgctaacatttgtgagttgtagagaattgatgacacgagagttgggattatattatgcacctcaaattcttctgccatagagctgttcccttctgaatgatcacttcctcctgaatggctccacttaactggttgggtttcttaaagtgtgggcctcagatcacttacatcagcattaatggaggcacttgttaaaaatataggttttgggcatggtggatcaaacttgtaatcccaacactttgggaggctgaagtaggaatagcttgggcccaggaatttgagaccagcttgggcaacacagggaaacctggtctctaaaaaaaaattttttttaatattctgggcttagtgactcgtgcctatattcccagcttttctagaggctgaggtgggaggatctggttcgcttgagcccaggagatggaggctgcagtgagccatgattgccctactgcattctagcctgggcgacagagagagcgagcctgtgtccaaaaagtaagtaagtaaataaatacataaaaataaatacgggtttctgtcacctcgcttcagaatcagacagctagaggtggggccctggaattggtgttgttaatgcattctccaggaatttctcctgcatagggaagttggaaaccactggcttccttctctctgagcatctcctgagactagctcctgaagtggatagaaagtttttcaagtagcagattaagttttatcccttaggctgctaataaaaaacaattgactgtgattgcgtaattttacctgtcgtacacctttcagaaggcagaggctttggttcacccctctacctccagggcctaaaacagtgcctggaggaactcaattaaacatttgttgagtgaatacgtgaattacattgcagcgaggccaatcttttaaaagttacttgtcaaattaatctatcagttagtggcatattaaagcccagcatattacaaaaaaattttttttagtagtcactgattttataaattaggagccacaagcactataccccagtgacttctgtaagtttggttagtttagaaaggagagagcctttcccaggcgtagtgtgctcaaggtgattagccagaaagaagattcagaacaaagcatttgcttagagagtcaaaatgtaaatttaagtcacagtgtagtggtaaatcatatatcaaacttatatttggtatattgtcttatatcaaaatatcattttataaaccataagtccaacatactgctataaaaattggtttctagcaaatagagaaaattgttatgttttccaatttcacttttcatactaataaaatttgacctttacaccttcttttcaagagttcaccacagggcaccatagatattatgtagttaagagctcaaactttggagaatattgtgtttgaccacacatagtcagggagtttgatctaacctctcaatgcctcatttctcagctgaacatggaaatagtaataataaagttcacatacttctaagtgcttacctaagtttttgagacacatccacttaataaatggtagttacagtgatgataaagaattggggtgtataaaaatacctaaaactcaaaagctaacccatttaattattgtactactggacttttatgatagtaagtagaaatctgttgcttaaaaaagaagtttctttggtggtgtgcgtctatagtcccagctacttcggaggctgaggtgggagaatcacttgaacccaggagatcaaggctgcagtgagctatgattgtgccactgcactctagcctgggtgacagagcaaggccctgtctcaaaaaaaaaagaaaaaaaaaagtttattgctaactccttggtactatgtataatttttttaattgaatgactagactaaacattgaaagtatttaataagctatcaaatatgtattaatataagttttgaaaataaatactaaatctcctgatctcttttaggttaaaatatagtttatgatgagcaactaatattctttgtatttaaaaagataattgttttatggtagaaaaattgaaatacagaaaagtataaagtagaaaactatgaaatacccgtaagtctactacctgcatacatatttcttcaaatccttttgtgtgtgtgcatatggctattcatatacaatttctggtaacaaaaatgggatcttgctatacatatggttgtaacctgctttttttttgcttaacatcttgtcatgagtgtcttttcctatatatatattgcattataacaattttagtaaccaaataatattccgttttatggatctatggtagttttttttttaatttttattttttcagacggagtctcagtctgttacccaggctggtgtatagtggctcaatcttggctcactgcaacctacgcttcccaggttcaaatgaatctcttgccttagcctcctgattaactgggattacacatgcctgccaccatgcctggctaatgtttgtatttttagtggagatggggtttcgtcatgttggccaggctggtctcatgctcctaacctcaggtgatccacctgcctcagcctcccaaagtgctgggatcacaggcgtgagccaccacacccagtcatggatctctggtggtttagccaatttatttttattagacattagtttgtttatttttcctccacggttacttataaccctgcagtgactgtccttctacatatgtctctgaatgtacttgtgagattattttcattaggataaatttctacaaatggaatttgcaggatcaaagcctatgctaaattttaggattttttaaatccgtatttccaatttgtcatttagaaagattgtatcattttatactcttaccatggtatatcagacttccagtctcccagccccttgtaccttcccccattttatggaatgacttaaccagtgacaaacctagtgaatttttgcttttaggaagaagaatggactgttagtataatgtgtttagtagtgtgatatggaaactcagaaatcttgtgcatgggtaatagtgatagctaatgtcgattaagttcttttgcagcatcttatatacattaactcacttcacaaaaaactctcatcttacagatgccttggaaactagggtaccagcaattagagagccagcaagtgtctgagcagatttttactgtagagtccaaaactcttagcctgtttcctagacatgttttataggcatttgggtactttttatgttctcgattgctgttgtggagtaactaagaggttctctgacatgtactaatatataaactgggtggggcacaaatttgaatccctttcactgaagagttggtcacataagttagctcagaaattagctttgggaccggtgctgtgggtcactcctgtaatcccaatacttgagaggccaaggtgggagcattacttgagcccaggagttccagactggccagggcaacatagcaagaccctacaaaaaattttttaaaaagtagcccagtgaggtgatgcccacctgtagtcctagctactagggaggctgaggtgggaggactgtttgtacccagaagttggaggctgcagatgccacagcactccagactgggcaacatagtgagatcttgtcaaaaaagaaaggggagggcagggcaagagagagagaaaagaaaggagagaaagagaaagagaaggaaggagaaagaaagaggagagagagaaaaattagcctcatcaactgtccagcattcatccttaaagtagtcttgttatcctttactctgtagtggttttcctaaagtacccctgcatgaaaaacaggattagagtgctagagaagactagtgaaatttgaaaaggcagttcacttgtgatgtggacttgtcttagaaacgcaagactgtacagaagtgtgatgagggagacagctgggtgtgtgtgtccaggtagttccatgttggcgagtttggagatagaaagtggcctaaggaagtttacttcctgaatgtgaatgttggccactttggagatagaaagtggcctaaggaagtttgcttcctgaatgtgaaggcctcagtgtagagagatatcatccactgggagatcactgaaaagtaaaccaaaacatttttattaatacatgggatggtagaatgtcactccagttttgttcctaaagttcgtagctctctaagaaagtgaattttaagcaagttaatctattttaatgcatcactgctctttcggtgtttttctagtagaattaatgataggtagcttgctttattagcttactgcccagagagaacattggtgaaattgttttggcttcagctctctggactgagtttggctgcctagctcagttttcagttggtcaccaaaacctgtcattgtttttgtgtggtatggggtctgctggagtcatgtggtagtgcgtttggcccttcattgagtggtggagccaggagttgagctgagggctgtggcagaattttgaattcaagtgaattcgaatgtgaaaataacaatgtctggccgggcgtggtggctcacacctgtaatcccagcactttgagaggccgaggtgtgcggatcatgaggtcaggagtttgagaccagcctggccaacatggtgaaaccccatctctactaaaaaatacaaaaattaggcgggcgtggtggcgcacaagtgtaatcccagctacttgggaggctgaagcaggagaattgcttcaattccctgcttgaacccaggaggtggagatttcagtgagctgacatcgcaccattacactccagccttggcgacagagcgagactctgtctcagaaaaaaaaaaaaaaaagaaagaaagaaaataacaaggtcatagcaacacagcaagtggtcagaattttacccttggtggttaaaattaaacatcctctttttaatacaggaggacaatgctcttgctcctctgttgcactggtgagcatttgatgtgttcctccttgcattatgtctgcaaatcgttctggtgtctggtggcatgcatttgcaagacatggatacagttcatggacgtggacgaggtcagctggcttttagtgtcaggctttaaccaacctagttaagaaggacgctgactcttaccataaaagcactgcaacaagattggaattggagctccaacgaattggagccattcgttttgtgtgtgtgtgtctgtttgcctgtgtgtgtgtacagggttaattacttctctgcaaggcaaatttcctgaccggttttattgttctaacacagacaaaatgttgtgtaaacacatatatcattccagtgtgttatctataataggagtgttcattgtggatccagtgtttcacaaaaatcaattcatttccgctctgaacttaagatagtagattttaaaaccaagttatctttcaatttctgaagttatctgaaactcagctgccccagtcttgcagaattggagaattgcattttggccactgatgaatgaaagctatatagctagtaatgagagaaaccttgaaaaattgacaagaaaatgagtgccattcttggtatatagcagatttcaatgaatagtagttccctttgcctttatttttcctctttcctgcacttaatataaagagctaatattaaagtcattaaatgagaatagatctgtattataggtagcactgcttatttttagaccccttcagatacagttattacaattgttgttttaatattctttaaatgattacaggaggaagaaacttggtagcggggttaccaggatgttagctccatgagggcagggagtgtatcgctgttgtccagggggctagccccaggccctagagcagcgcctgctgcctggcagacacgcaagggttatttgttggtttattaaatcaaggagtgtttgaggtccttcaagcctggaggcccgagggctctgagctggtacagagcaagtgctgggggcaagagagacaggtggggagtgaaggagagaggcccacttgggacttgactctgaatgtctgggaagtaggaagttaatgtaagttttaagcaggggagtcccatgatgtgcttttgtttaaaaatctccttctgagtatcatgtgggagtggattggaggatggatagagaggaacattccattgactcggcttccagctgtctatggatgttgacgtttctacctagccttctgctttatctttgtgatgaggataatgtggtgtactttgtgaggtctcaggaatggtttgagatgaatggtaatttgtgtaaactttccggagtttctctgaggaaaagagaaccccataaaattattactattgatcaaatgaaatagcagtgtaagacaaagatcaagaattatttagctttataaacaaattaattgaggttatgaatataggtttctataggagagattttgtttcctttttttagtgaaagaaatcttaaatgtatgggaatgaatccttaaaatagcaggcttttgcattgtctatagaagctgttctctttgaggaagatctgttttgtaaaatgctgctgttgtctgtccaatctggagttttaattagtatcaaagggagggaaatcctgcagtaatcgtaaccttactttaattcttagttcaattagttttaaaccacagtcattatctgttatctttagttgttttgatcttggtagatgaagtgattaatattacagttgtgatttggtaatttaaaaaataacatgttttttcctactacaaaaggaatacatgtttattgaagaaaacttttggaaacatatataaggaaagaagactaaaagcctaccaagatcttaccatccagtgataatgactgttaataccctgtgaaggtcaacatgctcaaattacccagcaggtgcctggtgtgaagctacttagcccgggagagttgaaggcctgttagggaccacgagcactgaaggtggcaggacggtccagggccagtcaacccagacctttgtggttctgggaggatgcgtcctggtgttactacaccttatagttatttaggagaatgtgggtttaatatgaaatcttctgatttttatgtgggccacactttttattgttaacacactggggttcaaagcatacctgagggctggattcagtcttcgttgccttgccagtttgtagcctcaggtacgtacagttttgtagcctgtgtttttcacttaatgtgttgtatttgcagccttttttgctacatcgtcatatatgtaatcagtcacttattgctggacctatagattctttgtctttttgctttttaataaagataggtaaaattcttggaccaaaagttgtttgtaaagcctttgcagcataccgctctcagatgcattccccctatcatgtaaaaggtacttgtttcctgttctcttaccaggactgggtaaaaccatctccaaaaacatcttagccaattttatttgttttaacttgcattattttctgtattaccaatgagtgtgaatgattattaaatgcctattggccttacacaaatttatttggtaaccaacttgtcttgctggaactctaagttccagcaatgttttggtcttgcattcaatgcttctcagtctttgtgattccagataatattagtactgtgttagtagcaataattagtactaattgtaggcatcgttccccaaaactgagggcatcagtatctttggcacaactataatccacttaaagtactgtgactgggaagttctttttttttttttttttgacagagtcgtgttttgttgcccaggctggagcgcagtggcacagtcttggctcactgcaacctctgcctcccgggttcaagtgattctcctgcctcagcctcctgagtagctgggactgcaggcatgtgccaccatgcccagctaatttttatattttcagtggagacggggtttcgccatgttggccaggctgatctcgaactcctcacttcagatgatctgccctcctcagcctcccaaagtgctgggattacaggcgtgagccaccgcacccagccgtgattgggaagttctgagtttagttagctgttcagtgaatgtttgagtacacgctgtatatgcctggcattgctctaggtgagtagccttgaaccaagatagaatctcagccctctaagacttctatgcttttttaaaaattctcgagtttttcatacagaccatcatgtttataaaggaccattttcattcctagaatttataatttatttttaacttgtatttctttcttttttttcttttttgagacagagtctcgctctgttgcccaggctggagtgcagtggcacgatctcagctcactgcaagctccacctcccgggatcatgccattctcctgcctcagcctcccgagtagctgggactacaggcatcagccaccacgcccagctaattttttgtatttttagtagagacggggtttcaccgtgttagccaagatggcctcgatctcctgacctcgtgatccgcccgtctcggcctcccacagttctggaattacaggcgtgagccactgcgcccggccaatgtctttcttttttttgagatgatgtcttgttatatcgcccaggatggtcttgaactgctgggttccagcagttctcctgtcgcagcctcccaaagtgctgagattataggcatgagccaccataacttgtatttgtttattggcatggaacttctaaaacagtgatgaatgcttgttaccctttaattccttccttctttccttcctctttctctttctttctctctttgtctcttctttctctcttttgtctcactctgtcacccaggctgagtgcagtggcatgaccatgattcactgtatccccaaccttccaggttcaaggaatcctcccacctcagcctcccaagtagctttgactacagccacagccacgcaccaccacacctggctaatttttttttttttttttttggagagacgatctcgctgtgttgcctaggctggtcatgaacttctggactcaagtggacctctcgcctcagcctccccaagtgctgggcttacgggcatgaaccgctgcacctggcctttgattttttaaattcactttaattatcttaagttctgttatactctagactcttagcaagagtctagaatcaacgttagttattagttccgtattttgattatgagacaaggtacaaagctgagactgtgtgatgagaacctttggaatgtatatctgacccaacacagatcccctaagtgcccttcaacctacacatccaatttcttcctacctccttctctacacaaaagacataatacattgaactcgggttgggcacctgaccaacctggcccaatcagtgttcgtttcttccctggaaatttgaaactaggctcaatagagaaggatttggccttaatatgctcaaggaccctaagtaaaggattgggagttataagcagttatgttctgctgtctggggactaagaaagatgatttatggatggggagaataaagtaactgtctaaagagaagcagagagaacactacctgactctctgacagcattaagccactctcttccagtctgttcttggtccagctgcattctcgttcttgagttcttaaggttacctccttccccttgatttaggtagctggagtttctgttactgtgaactaaacattcttctcattcttaccacaatattctttttatgatactaccttgtctctttttttttttcactatgtctagggacgttgtgaatttgttattattttctccatataataacatcaacagttaaggatagcaagaaacatggaagtaccaaaatttaatctaattcaggcaatcacaatttgattggaaaggccattttacaaatgcggactctggctcggacctgttttaaaccggtgtagatctctagctgagggaaaacaggaaggaagaaattttgaagttacttttaaatgttgcagaatttcagtggtgtcatttcctttcacatccatataaaatgttgacctcctgcaaaaaccaatactagggacattcacagtgtacagtattatgtgcatctgtatagggggtgagtctgaattctgttcaagtgtgtagccactgaaacaagattttttttttgtttgaggcagagtcttactctgtcacccaggctggagtgtgcagcggtgcaatcttggctcactgcaatctctacctcctgggttcaaacaatccccccacctcagcccccagagtgggtaggattacaggcaccaccatgcctggctaattttttttttttttttttttggtatttttagtagagatggggtttcgccatgttggctaggctggtcttgaacgcctgacccaaagtgatctgcctgctttgacctcccaaagtgctggaattacaggcgtgagccactgcgaagggccttgaaacaagactctaaagtgtactgtcgaaataccaagaagttgaatcacagaatagtttacctggggctgggcttagttcttagattagctttctgtgtcgtggtgatgtcatgtatcaggaatccttaacttaaaaaaaactcagtgataagtttaagtagtccactatctaaatgcagttgggtggggaggtggaaaaagtgatagggagagaaaaaagaggattgtaggagagagaaggaagaaaaaggaaggttgctttattgccacagttttctttattcataattgtatttgtatgagctttttcatttccaagtggaagaagcacagcattgaaatgtagtgactcacatacctgtcaagtccaaggattctgattggcctggcatgatcgtgtgtctgaacccatcatatgaccaagggaaacgtgtactctcattggctctcctgggccttgggtctaccttttcccccagttggtgagaccagtacctaaactcgtggaattaacagaaagcattaaagagaagtaggatctgtcaagaggagaaaaaaacgctaggcaggcaaaacagatggcctttactcagtgtatgatcagtgtcatacaaattaataattaataattgaagttacttttaaatgttgtagtatttcagtggtgtcatttcctttcacatacatataaaatgttgacctcatgcaaaaaccaatactacagacattcacagtgtacagtgttgtgtgcatctgtatagggggtgagtttgaattctgttcaagtgtgtagccactgaaacaagctttttttttgagacggagtctcactctgtcacccaggctggagagtgcagtggtgcaatcttggctcactgcaacctctacctccagggttcaaacggtccccccacctcagcccccggagtaggtagatcaggtctgtggcgtgccacttgttttatttatttatttatttgtttatttatttatttggcagagtctcactctatcgcccaggctggagcgcaatcgtgcgatctcggctcactgcaacctccgcctaccaggttcaagcaattctcctgcctcagcttcccaagtagatgggattacaggcgcctgccaccacgcctggctaattttttgcatttttagcatttttagtagagacggggttttaccatgttggccaggctggtcacgaactcctgacctcaggtgatccacctgcctcagcctcccaaagtgctgggattacaggcgtgagccaccatgtccggccttttttaatttttttattttaatttttagattcagagggtacatgcacaggtttgctatgtaggtttattgcatgatgctgaggtttgggcttctaatgaaccagttgcccaagtagtgaacatagcaccagataggtaggttttcaacccctgcccccgttttggaatccccagtgtttattgttcttaattttgtgtcagtgtgtacccagtgtttagttcctacttgtaagtgagaacatgcggtatttggttttctgcagaagctttcttgaccttctccttttatctctgattgtcagtttcctcttagtttcatttctttccataagcagctgtgacctcagcatgggtcatttcagctatttccttgccctgttgctctgttacatttaggacttcccaattccctttgagggcttcttatccttaaaatgttgctgtcgccagggcttttcataccctcttttgacatttcactggtcttccacggcagtcattttcactgtatttatctgtctgtacctggagcggtgtctttttttctaaccctgcatcgtgtaatgatgatgttctgataggtgattttgtctttgtgcaaacatcataaagtgtatggttgacctttgaacaagggagggattaggggtgttggtccccaacacaggcaaatccacatataagcagggctccgtggcccttgcctgtaatcccagcactttgggaggccaaagtgagaaggttgctcgagaccaggagtttgagaccatccaagcaacaaagtgagactcccatctctacaaaaattttaaaaatcagctgggcatggtggtgtactcttgtagtcccagctactagggaggctgaggcaggaggattgcttgagcccaggaatttgaggttacagtgacctgtggttgtgccagtgcactccagcctgagcgacagagccagattctgtttttaaaaaaaatcatataacctttttgactcccccaaaacgtaactactaatgacctattgttgaccagaagccttactgataacatagtccatgaacgcatactttgtatgctatatgtatgatatattctattcttacaataaactagagaaaggaaaatagtattaagaaaattataaggaagataaaatatatttactattcattaagtggaagtgggtcatcataacattcttcatcctcattgtcttcacgttgagtaggctgaggaggaggaagaagggttggtcttactgtctcaggggtgacaaaggtagaagaaaatctgaatatgagtggacccacacagttaaaactcatgttattcaagggtcaactacttatacaaaccgaggtggtatagcctactatacacctaggttatatgtatagcctattttgctccttggttacaaacccctacagcctgttactatactgaatactgtaggcagctgtaacacaagtatttacagtggtatttgtgtatcgagacatatctaaacatagaaaaggcacggtaaaaatatgctgttacaatcttacgggaccacgattgtatgtgcagttcatcattgactcaaatgttactggctgcatgactgtacctactggatccattgggcgcttaaaacttcaatacatctagagcattgctcacctgccacctttcttctgaccaacctcttcctctgtctgtatatcccatcttggtgaatgatactattatctatccttttgttcattgtttcagcagttatttattgattacttactgtgtgtcagatagtctgtggtataattttatatcattttgttcctgattcctagcacatagcttccaaaatctttggaatttcctgagtggtgggagtgtcttcttattcataatgagtccttttggatcttatctgagttcatgctaatgaactggctcctggggatgaggggctggacaccctcagaattgggggtggtccggaggaagcagtcaggaaactgcaggattggagggttggaactttcagccctccgccaccaccagctccagggaagagagagggactggaaattgagttcagtcacgtggtcagtgatctacttaatcatgcctatgcaatgaaattgcaaacgaaagccctggaactgtgaggttcggagagctgggttggtgaacccatgatgtgcagaaaggtgagtgcctatattgcacagaggaggagagggcatggaagctctgtacttcctctcccccatgctttgtgcagtgagtctcttccatttggctgttcctgagttgcacagagcttttccatgttcggtgagttgttctagtcaattacttaacttgaagtggagttaggggaacccctaaatttgtagtcagcctggcagaagtgcaagacttgaggctggcatctgaagtggggaagtcttatgggaccaagcccttgatttggggagtctgcactaactccggtagtgtcagaattgaaatgaatggtaggacacccagttagtgttggagaacattttttagaactcagtctgcctatagtatttttgaatactgtgtctatacacagtatagacttagtacctgcccttaagctagataggtgaacaagcaattataatttagctttgtaagctattcatggactaagtcagcagcctgtactttttttttttttttttttttttttgagataaaatcttgctgtgtcacccaggctggagtgcagtgagatgatcattgatcatggctaactgcagcctcaacctcccaggctcaggcaatcctctcacctcagcctcccgagtggctaggaccacagttgtacaccaccacacctggctaatttaaaaaaaaatttttgtagagatgggatctcactggtctcaaactcctaggctcaagcagccctcccacctcagcctcccaaagtgctgggattagaggtgtgagccactgcacccagcctggattctatctgatgctgaagtcggtggcttgattctgtcaattcagcctctgaaaggtcgtttgaattcaccctttctagccccactgctctggtcttagtccaggcctttatatattttttcactttactactttgctcttaatggttgctgcttcctgactcgtctggcttctctgttccacttcattttacactcacatgttgccaaaataatctttgttatgtgctgctcccacaataagatctttccccgtgcttttatctcctaaggtggtggacctcaagccttttggtatcaaaacccttgtgtcctcttaagtgattgaggtccccaaggaacttttcttcatgtggatttttgtcttatcattgtctgccagattagaaattaaaaccaagaaatttacacttaaaatagctgtaataaacctattacatgttaacataaataacatttttatgaaaactgttcacaaaacaaaaaaatttagtgaaaagtggccttgttttacattttttgcagatctctttcatgcctcactgaataaaaagatggctgaattccataactgctcctgtagtcagtttgttgtgaaacgttgttttggttgaaatagttgaagaaaatctggccttatacagatatgtagttggaaagaacaggagtcttttagtggcatttccagaaaattgtggttattttgtgatactgtaccaaaacttgacactgggtagtttcttaaggattggttgcagtgtagaatctgaagtcatataagtgaactttttatcctctgttacaataaaatctgttgatccatcctatactttgaatggctattttacccctgtttgatttgaccaatacatacaacatcatgtattggtcatttggaaaatactgggtcactgagttatgtaaatcttacaaatgttgacacatttcattaaacaatatcacaaaatcgtgtttgttatcaccacccatcttattagaaaattctttaaatgttgagaagcagtctagctcataatggcagatacaagttttccaaaattctaattttcaccccaaattcaaattttatcatgaacagcaagtactgtcagttgtttttcttgcagcatcaggcttgctttatttttgagaaactgtgccagatacccaaatctgaataatcatagttttttttggttgttgttttgccaaataaaaatcgagttcctgtaaaaaaaaaatggctagtttagctcacaactcaaatgattgcacagtgattttcttggacattgttgtttggtgtagcacataaatgctttgagtatctagtcatacaagcattaagcatgtgtactcaagggctgagatttaataaagtaataatttttcatgattcatcaaagacatcctgttgtaaaactgacttttttttttttatgtgagtgtttggcagtgaagaatccagtgaccacactggtacagtttggtgccactgctaaggtgggagcagttttacccaccattgtttttgtatcagtgtaaataaaatcacagtgaaaagagcaggtcttgcctgagtaccatcatgatgatatggtttggctgtgtccccacccaaatctcatcttgaaatgtagctcccataattcccatgcgttatgggagggacctgatgggagataactgaatcatgggggcagttcccccatactgttcttgtggtagtgagtgagtcttaggagatctgatggttttctaaggggtttcccctttcatttggctctcatttctctcttgtgaccgccatgtgagacataccttttgccttccaccatgattatgaggcctccccagccacctgtaactgtgagtccattaaacctctttttctttataaattacccagtctcggtgaaaatgaactaatacacgtaagaattttgaccatctgaacccccatgaaagggtcttaggactcccagggatccacagaccacaagagaattgctgccttgtaggataaaatctaaaccttcactcacagtttagagtgcattatgctgtatccctgttgaccttccccttttcctcttctatttctcttccatctggatctcaccatagaatgttcttttgtcactttagctttacagtttatttcccttctgcctccccctatctgtcccttatcctttaggcctaactgggtgttactgaagtgaaaatacccgtacctgccgcagctatgagtcattttccctttgatttccagcactgaacttttggctctacctctttccatctattttctagggacctctgatttaaagttccgaatttacaaatcccatcataacaggaaagcattttacatccctcttgtgacttaaacttaatttatactaatatttttcattttgaaccttcttatacctaattaaatgaaacatttgagcaaataggtgatggggtattgccttttttggggtcttctgttctgtcagaaatggtattatagttaggtctagcccagggaaaaaactgatttcctttaacagttatttgaatgatacccattttcctaatcaggaaggtttcttggtattatctaggtactgggttttatgctgccaagttcatcagttaaatggcctttagataaaggacaggttggagttgtgctcagctcatataaaatgtgctttagaaggacttctggtattatctgacccacactgcccctcatgtcacacatgtttctgcacgtacacaggatgagtactgagtacccttcatgtttcagggattctgcaggtctttcacatatgccatctaaaatttgtttttcacaattttgtgaactagatgacaagatccttgtgttacagatgaggacctcgaatttgctgccatttgtgtaatgaaaatataaatggcatagtgagtagctgaacttaaataaaaaatcattgacttaccacataaataatagtattataacattataaaacaagatttggtataaatgagctttcatcagtatagacacatctcaggcattagtctaccttgcctagaaggagcaggaattatttattgagcactgttttggatatatactgaagttccctcaaattctaatgtctcataactcttcaggcagttatagtaattgctggatataccaggaagttatgcctgtaattactgctcagaaatgaaatatgtaaactctagcattatattcatactggttttattatgagatatattaccttttagatttcttataagatctattttttagatttagcttacaaagccattaactgttataaaattatactgtaaattataagctttagttagatgggccgttaggcatagctttgctggcaactgtaaccttttatgattgcagtcaaaatgtaatccagatgctcttcgtaatagaccattgagtcagaatatcctgaatattgttttgcaggttcaaaatgttggaagagatctgaatcaggatgataaaatgacattcacccatctgattttgggcttacttctttgtgacatacctaacctggtgattaaattctttttttttttgagatggagttttgctgttgttgcccaggctggagtgcaatggcacgatctcggcttaccgcaacctccacctcccaggttcaagcaattctcctgcctcagcctcccgagtagctgggattgcaggcatgcatcaccacgcctggctaattttttgtatttttagtagagacggggtttctccgtgttgaggctggtctcgaactcctgacgtcaggtgatccgcccacctcggcctcccaaagtgctaggattacgggcgtgagccaccacacccggcctctgatgattaaattctaaaaccaagagttatttaaaagattttgtagacagtgggggttggaacttgaaagtgacccatcagctatgtagctactagcattttcctaaaaagtcctcagtgaggcagctggacaaggttgagaggcaggcagcatagccaagggattctggagccaagctgctcagctactgtcttagcccacttcgtgttgctgtaatagaatatctgaggctgggtaatttataaagaaaaaggtttatttggctcacaattctgatggctaggaaggtcaagttagagcatccggtgaggtcctcaggttgctttcactcagtgtggactcctgaatgtgatgtggatgtgaagaaactggaatcctcatacattgttggtgtgaatgtagcttggtgccgctgctgtgctaaggggagctagagagtgcagaggtcacatggtgagagaggtagtaggagcgggatgggaaggggccaggttgttaacagccagctcatgtgagaactaagagtgagaactcactcactcttggggagggccttaatctattcatgaaggatccaccccatgacctgaaaacacctcccactaagccccacctccctacactgccacagtggggaccaaatttcaacctgagatttggtggggacacatagcagttactagctgtgtaaccataagcaagctatttaacttttctgtgcctcagtttcctcatctgtagaatgaggtcgatcacagttcctgtctcataagattgttgtgaggatgttaaaacagcgcagtgcctcactaaatagtaaacactgtataagaaatgattgttattattcttatcacctgtgatccaagcctggaatttataatttaagatacgaatgaagttattatatgtagttttgttaccagttgattatatgacctctcttaatttctcagttgctctttccatcatctggaagcttcgccatttgttttaacctttgaagagatgagaggaaaagatgcatgataggcttaaattgctctcatctacttataaaaaataattagacataacgtggccaggcgcagtggctcactactgtaatcccagcactttgggaggccgaggtgggtggatcacgaggtcaggagttcgagaccagcctggccaacatggtgaaaccccgtgtctactaaaaatacaaaaattagctgggcgtggtggcgggtgcttgtaatcccagctactcgggaggctgaggcaggagaatcgcttgaacctgggaggtggaggttgcagtgagccaaggccgcaccattgcactctagcctgggtgacagaatgagactctgtctcaaaaaaaaagaaaaaaatagacataatgcaagataacgtcattaaaaagtgggcaaagacctgagtaggcatttttccaaagaagatatccaaatggtcaaccagtacatgaacagatagatgctcaaaattgttagtcattagggaaatggaaatcaaaactatgagaataccactttacaaccattagtatggctatcatttttttttaaaaaggaaaataacaagtattggtaaggatgtgaagaaactggaatcctcatatattgctggtgtgaatgtagcatggtgccacagctgtgtaaaataatttttcagctcctcaattagatagatacagagttatatggcttagcaattccattcctagctatataccaaaagaaaacaggtgttcaaacaaaaacttgtacataatattcatagcagcattatttaccatagccaaaaggtggaaacaacccaaatgtccatcaacttttgtgcatcagtggacaatgtggcatattcatataatgggatatgattcagctataaaaagaaacgaatgatatatggtacagtataaacgtaccttgaaagcatgtagaataaacatgaaaacatgtataacatagatgtaccttgaaaacatgctaagtgaaagaaggcaatatactgtatggttcctttttttttttttttgagagggagtctcgctctgttgcccaggctgaagtgcagtggcatgatctcagctcactgcaacctctgcctcccaggttcaagctattctcgtgcctgagcctcctgagtagctgggattacaggtgcccactgtcgtgcccagctaattcttttgcatttttagtagagacagggtttcaccatgttggtcaggctggttttgaactcctgacctcaagtgatccacctgccttggacttccaaagtgctgggattacaggtttgagccactgcacctggcctgtatggttccatttatatgaaatacccagaataggcaaatctgtggagacagaaagcagatgagtagctggggcagagcataggatttctatttggggtgatgaaaatgttctggaactagatactggtggtggttgcacaacttcatgattgtctgagatgtcactgaattgcatactttaaaatcagttcaacagtaaattttatgttatttgtatgatgctgcaatttaaaaaaaataaatatttcgacatgacgttttttccaagtttaccttagttgtaattttgccaaaatactttcttaaaccattttattgtaattttaggctaagatcatttgcactttatatatagttgaatgaaatatatcgtagttgttttattctcttgtaaatctagaaaagatgaaaaatgaaagccatgagagttttaagtatgtctttgccttgtgcagatattctcaaagggtattgtggagcccttggggctccttatgaccttttcaaagggtctgcaggttcaggttattttcatagtaattgttgagagttatttgcttttcaaatttttatttatttatttatttagagacggggctttgctctgtccccagcctgcagtgcagtggtgcaatgacagctcactgcagcctcgacttctgggcacaagtgatcctcctgcctctcagcctcccaactgggactgcagggaggcattgttttacatttacatgccaccatgcccgctagtttttttatttttcatagagatggggttttgccacatgttgcccaggctgatcttgaactcctgggcttaagtgatccacccccatctcggcctcccaaattctgagattacagaatttgtaagcataagccaccacacccagcctatttgctttttttttttttaaactctttttctccacaggtgtaaagtgtagttttccaaacgctctataatatatgatggtgtagtctctttgttggctaatggtctatgtacttgtatatgtctggatttttttgttttttttttacaattctctaaggtaagctctttgtgatcctcaataatttttaagtgtataaaagagtcctgaggccaaaaagtttgagaacaaaatgtcttggtaaaaaatgtatgtgccaataatgaaaaagcatatacgaactacttgtattatatatttttgaaaacagaaggaaaataaattgtaagccaaatgactcttttggctgcttagcttttatcatctttactgcttcagaggttactagatttggaaccaaagtgtactttttgggatgcggtaggtttctggttttaaaaaaggatgtctggtattgattaaatctatagttttgaactttctaatccagcagctctgtggagtaggtactgatacttggattttataaccagggcacaaaatggttaagtaacttatctgtggtccgacggctagtaagtggcaggtctggtgtttggatccatgaagtctgtttcctgagtctgcactgttcacagtatgcgatctatgtaataccgctccttatgtacattgtataataatagctccctgggaatgtatgtgtgaagttcccatttggaaggctggcatcgtagtactgcactgatagtggtggcagtgattgtgaggtgggttgggttctggtgcctatggcaggggctccagcaagcagatggttagaagacagatagggagcaaggataggaggatgggctgctataggggccagacctcctgcccaggatatttctggtccagttcgaaagttggacctttccttcctagagattggctccacttatggctttataataggacctcttccccttctggagtcctttggagcaagatgcattttcacagttttctcccaacctctttacttgagtctagcacttactgcctttgaacttctctgagggtttttactaccaactagaaatgaaagaaaaagttgaagagggagatggtattcaaaagataagtgatacaaattggagtcttttaggattcatattattgaaacgcaatttgtcaacctccctaagagggtcacatcactgtggtgtgggcccccccaaggcatgtcatcactgaggttaggatgggctctctgccatgaggagtaagccagtgcctccagctactggctagaaacagggagtgttgtcaggagatctgcactggggctgaaggacatccccgcctacttcccttttgctcttcttactatcagtctttactaccgcagatccctttctagggtccacgacctttgctggggtaaagtgggatgcagggatggggcctggggatgctctaggcagtttgcatgaaggagtggctccattggtgttaaagattaggccttctgatactttcttctccacttgtactttgagttaaaggctcttacctcaagagattttctttactctgtggccatatctgtaactgtccttaactctctgtgcatggcagccccaaaccttcccagtggaacagtgcaagctcagagccttgcaggtcagtgaccccacacttggcacaggaattccagggaaaagtgtgaaagggcagtaggtggctcctccgtcctgcttctttgaaaacctctgacctaaaaggtttttgaagctgaatatttaaagaaaatatgtatgagattgtagagatagatgcctaggcggctgaaggggatgtggcaagtggatggcctccctcagggctcctttccacctgtggtggccacaggttcaagactcctgtccaaacattctggtttgtttatgtgttccagaaacagacagagaagaaggtattgtattttttgagacagtcttgctctgttgcccaggctggagtgcaatggtgcgatctctgctcactgcaggctccgcctcctgggttcaagcgattctcctgtctcagccacctgagtagctgggattacaggtgtgcgccactatgcctggctaatttttgtatttttagtagagatggggtttcaccacattggccaggctggtcttgaactcttggcctcaagtgatccacccgtcttggcctcccaaagtgctgagattataggtgtgagccaccatgcctggcccaaactggtattatatctgcatgaaaaagggtcactgtgccaatacttttttcatttaagtttttttttttttttgagacggagtctcgctctgtcacccaggctggagtgtcgtggtgcgatctcggctcactgcaacctccgcctcccgggttcaagcaattctcctgcctcagccgcccgattagctggaattacaggcatgcgccaccaagcccagctaatttatttgtatttttagtagacatgggggtttcactatattggccaggttggtcttgaactcctgaccttgtgatccacccaccttgacctcccaaagtgctgggattacaggcgtgagccaccgctctcggccctcatttaagttttaatatgtttgtgggtagaaaacgtcttaattttttttttttaatctcagaaaatgacatgtgttggtgttgagatctctcttgagtggcttcatcatttgttcgtatgcccaatgtagaaccttattctttatcctgaattccttcctcccccttacacctgatttaattgtgcactattgatctggcttagttctggaacttctctcactctcactcaggtgttgccctagactcataggtgctctctctccagccagttttgacctctccatatctttttccattagagcagtagttgtcaaactttttgattaaaactgagaggccaggtgccgtggctcatgcctgtaataccaacagtttgagaagcccaggtggtaggatcacttgagcccaggaccagcttggacaacatagtgagaccttgcctctaccaaaaagtaaaaaaattagccaggggtggtgacatgtgcctgtggttccagctatgtgggaggctgaggtgaaagcattgcttcagcccaggagttggaggctggattgagtcgtgattatgtcatgacactctagcctggattacagagcaagacactgtcccagaaaacaaaacaaaacaaaatctgagaaattacttattccctaatttatgatttggttattaacttatttaaaatgaaaaataaacccatgtaaagttagtatacatagctttttaatgaaaatcgctttttttttttcccaaaacaacaacataaaatgtagtcggaagagtggccatcgttcacttatgtgttgcagacctccttaatgtctgcctggatggaagagtttctcatccagtgcatacatgcatgaatcattgcagccaggtctcaaccctgtcagacaacactctctttttgtagtaagtctttggtaatgcttcttttattcttaagaaatgtattcatctcagaattcaaatgaaagtaacatactaacatgataatagttcagtgtgtcagtgttgtctcagctacactaggatcacatgctcactaggtcaggtgcactgagaatgcagtggctgcaaatgcacacggtagaggtacattacttggtgattcaaatatcaagaagggcattagatgtaatgacatgttctctaaaactgtgagcaacttttggtaaaatacaaaacagtcttttgatttatgtggtaattatattcctagcaaattgaatgtgtagtgaaacttggaaaaagtcttttgtgattctgtgtgaaatggaatttggttttaggttccgataattatacatggggttttcccctacattactatctagagaaacattcaaaagtcgtatgggacaattcctcatatgggactgttctgcacaacctgttaaataaatgccagtggtgcctcccagcgaatgagaccaccaaaaataccccacggattttcacacatccattagggaatggtacatacctattaagaacactgataagtggaatcttggctgtattttttttcttgttttttgtttgtttgtttgttttgagacagagtttcaatcttgtcacccaggctggattgcagtggtgatcttgactcaccgcaacccccgcctcccggattcaagtgattcttctgcctcagcctccggagtagctgggattacaggcgccggccaccacgcccgactaattttgtatttttagtagacacgggtttcaccgcgttggtcaggctggtcttgacctcctgacctcagtgctgggattacaggtgtgagccgctgtgcccggcctgttttgtttttttaagttggatgataatttaaaaaataacttacaatacagcctgaccaacatggtgaaaccccatctctactaaaaatacaaaaattagcaggcatggtggcgcacgcctgtaatccgagctactcaggaggctgaggcaggagaattgcttgagtgaggttgcagtgagctgagattgcgccattgcactccagtctgggcgacaaagcgagactccgtctcaaataaataaataaataaataaataacttacaataataattacttgaatctcaccgttaatcagtgttaatattttgttgtatatccatcttgtccttttttgtacatttgtagtttttttccattcaaaaatgggatcatttaaaaatttaaaaagagtcgatgtcttggctgggcacagtgactcaacgcctgtaattcccagcactttgggaggccgaggtgggcagatcacctgaggttgggagttcaagaccagcctgaccaacatggagaaactccgtctctactaaaaatacaaaattagccagcgtggtggtgcatgcctgtaatcccagctactcgggaggctgaggcaggagaatcgcttgaacctgggagacggaggttacggtgagctgggcaacaagagcgaaactctgtctaaaaaaaaaaaaagaattgatgtcttgatgctacttaattttatctaattcacgtgtttttaaaaatcataacaaaatcagttttattcttcattctatcatacaattagtacaatctcaggtaagatgcaaacaatgtatactcataagtctctttttaacatgaaaactggtgctacctagggaagtacaaatgaaaccacaatgaggtaccacctccaacatgttaggatggccattataaaaaaagactgaaataataagaattggccaggatatgaagaaaagggaacgcttgtacactgttggtgggaatgtaaattgatatgaagcagttatggaaaacaatatggaaattcctcagaacattaaaaatagaactactgtatgacccagcaatccctatacccaaaggaaatgaaatcagcatcttgggaagatatctgcactcccatgttccttgtggcattattcccaatagacaagatatggaaacgattttttttttttttttgagacggagtctccttctgtcgccaggctggagtgcggtggcgcaaactcggctcactgcaacctccgcctcccgggttcaagcaatttttctgcctcaggcacccgagtagctgggactacaggtgcgtgccaccacgccctgctaatttttgtatttttcgtagagatagggtttcaccatgttggccaggatggtctcgatctcttgacctcgtgatccacctgcctcggcctccaaagtggtaggattacgggcgggaggcaccacgcctggcggaaacgatttaataagtgtctgttgccagacaaaaaaaataaattggggcatatacatccagtggaatagccattaaaaaggtgatcctgtcatttgtgacaacatagatgaacctggagagcatgctgctaagtgaaataaactagaaaaagaaaagaaaaatattgcaagatctcacttatatgtggaatctgaaataaagctgaatatgtaagaatagagtggctgagtggttatcgggggaaggggaagtgggagatgtaggtcaaagttgcagttacataggatgaataaaactagagatctaatatttagcatgatgactctggctaatattgtattggaaaatttgctgagagtagatttcaggtactcttaacacacacacgtagctatgtgaggagatggatgtattacttctgactgtagtagccatttcactgtgtatatgtataacaaaacatcgtgtcatgtaccttaaattatacaataaacaaagaagaggtgccggtttgaaggggcgaggacagagcgtggacttgcggaaagttaggtggccttggtgatttaatctctcaaaccttcggttttcttatctgtaacacgtattagagaaactgtgtcttgtcggaacctacccctcagtgggggtaatcccagctgtttgtcctcagctcatttctaactgaactgcaggcttctcaagagcagccaggatgtcaccttttcatcacctagcaccagctcaggacctggctcattaatttattgaacaaatgaatgtggcagaaaatttgctattggtgttggactgtgtttaaactttgtttcatgtttatcatggttaaacctccatcagaggtaaacaactatgttaattattacatcaaacttctgtacatcttgccccaaatgggatcatttatttgttcaggataaaatgtttttgaagtttttagcacacctgatagttgtatttcttctagattgggcttggatattgttattactcaggaatctggttgaatgtttgattgtataactctgcctttgacatatgtaattaaatgagtttgtatttaatgtgttccttgaggcagccaggtgtatttacctcagaactgttgaaggcttgccatgtctctaggactcattggtacctttaaggcatctctacaggtatgattttcttttactgtggattctttttttctttcaaaagtttttcagctgttagatatttagcagctcagtctgtttgaatgatttaatgtgttactattgaaaattactttgaaatacaatttgactgttttcaagagagtttggattctgaaggcccacagcgtataggctgaaacagtggttctcaaatctagcatgcattcactggatctgggacaggatccaacagtttgcatttctaacaagttccccattaatgctggtgctgttggtgtggggaccagactttgagaactattgggctaaagtgtggaagacaattaaaaataataatatggaggggaaatggggcccagtgtgtttgggaacaggatccctttgtgctctccacagacaatagagcagtaaagaaaaactggttttggcacctgaaaagaaggaaaatagacataaactttagaaaatactgtttgatagttgcagtggtccttaaaattaagataggagaagagatttggaaataatttaattttaaaaagtttattttaccttttttattataggagtaatgcatgttcataatggaaagtgtcataaatacagaaacatttctattctaaaagagaggaaaaatttccccaaagtatcttctgacatttttggcaatgtccattcagtatctcttttatgtgtaggacttttgtttttgttttgccatgaaataaagtttttattgtcaaaataatatatgctcattataatgaaagaaaaagaaagatcataaaggacactcactctttccagaaacaatactgataacatactgaagtttattatttggtatctcttcatgtgaatatatccatttatgtgaattaccttgaccatatggttttataacctaattttttcagtcactatcttttcatatcattagatgtaattctgaagcatcttttttaggcgcagagtatcttactctgaaaaactttgttgtagctgatgctcttcatccactggcccctcccatttctcatttctctactaggaatttgtaggtcaaagagcatgtaaaaatcttgatatgggccgggcacggtggctcaagcctgtaatcccagcactttgggaggctgagacagggggatcatgaggtcaggagaccgagaccgtcctagccaacacggtgaaaccctgtctctattaaaaaaaaatacaaaaaattagccaggtgcagtggcgggtgcttgtagtcccagctacttgggaggctgaggtgggagaatgacttgaacccgggacggggagcttacagtgagccgaggttgcgccactgcactccagcctgggcgacagagcgagactctgtctcaaaaaataaaaaataaagaataaatcttgatatgtattaccagatacccacaaagggcatagaagtttctgttctcactagtagctgtgtgcctgtacccagaccccaagtctatgctcattgccggtttaataattgccagcctgataggtgaaaatagtatcttttcattcacttcttttactgataagaagcttaacacttttcttcatgtgtcagttggtcgtttaaatttcttttgaatttctgctcttgtccttgtcacattttcttttggggttaatcttttttcttgatttatatgaactcttcatacttagggacattaattccttacatcatatgcttcagatatttgtttccaaaatttcatttgcttttaaaactaacttgtggaattttttttctttcatagaagtgttttaagtgtttcatagaagtgccatccactatgattttccttttttttgtttttttttttgtttgacatggagttttgctgttgttgcccaggctggagtgcagtggcacgatctcggctcactgcaacctctgcctcctgggttcaagcgattcctgctaatttttgtatttttagtagaaacggggtttcaccacgttggtcaggctggtttcaaactcctgaccttaggtgatccctccgcttcggcctcccagagtgctaggattacacgcatgagccattgcgcctgtcctgattttccatttttaaggatttctgctcatggtgtcaaatgagaacatcccctgtcacttcaagattttacgaatattaacctgcattttcttctacaacactttctcttttttaaaaaacgtttttaaaggtggagttttgctaagttgcccaggctggtcttcaactcctgggctcaagcaaacctcccacctcagcctttcaaagcgctgggattataggcatgagccaccgtgcccagcctctgccacacttccatgatttcatttgttcactagggtcttcaaactgtctgtagtttgttttgatgcaagcaaatacatttattttagtgtggccaaatgtaatttacatttttaaatattgaattattttggttgcactgtgcaaacattaggcaaatttaggtataaagttggaaaaagccactaagtgtcacactgttctgaggagcactgggaattctgagaaggcttaaagagtttgccatggttttctgtccttgtgatagtttgttcggaatgatggtttccagcttcatccatgcccctacaaaggatgtgaactcatccttttctatggctgcatagtatttcatggtgtatatgtgccacattttcgacagaaaaccaaacactgcatgttctcactcataggtgggaattgaacaatgagaacacttggacacagggtggggaacatcacacaccgggacctgtcgtgaggtgcggggaggggggagggatagcattaggagataaacctaatgtaaatgacaaattaatgggtgcagcacaccaacatggcacatgtatacatatgtaacaaaacctgcacgttgtgcacatgtaccctagaacttaaagtataattaaaaaaaaagagtttgccatggaagtggaggtcaggagaggggagaactgagcaagtatgtgggtatttccagctcctacttctcccaagaactgcaggcttagatgggcagctgtctagtaggcagatcttcttgggcatctaataataagctgttcaaaattaacatagccaaagcagaattcttttttttttttttttaagacagagtctcacttatcacctaggctggagtgcagtggcatgatctcggctcactgcaagcctcgcctccctggttcaagggattttcttgcctcaacctcccgagtacctgggattacagttgtgtgccaccatgtccagctaatttttatatttttagtagagacagggtttcgccctgttggccaggctggtcccaaacatctggcatcaagtgatccacccgcctaggcctcccaaagtgctgggattacagacttgagccaccgcacccagcccaaaacggaattcttgatgctgtccccaccctaatgcgcacaccccagtcctttctcgtcttagtaaatagcgctgtcaaacacccatttaggcaggccagaaacttcaaaggtgtctttgattccgctcttccaccactttatatctactccatcatgaagtcttgtagactttctgtccagaatatatcctgagtctgaccactcctaatcatttccactgttaaaacattaggccaccactgtctctcatgtgggtgttattgtggtcttctggacgttgtcttggttccactttgtctctccctgtaatctgtttcacatagtagcttctacagtgtaaataagatcatattattcccttgattaaaacctttcaaagacttcccattacatttaaaataaaatccaagccttactataaaagatccacttgtctggcctctgtgcttctccagtttcttccttctgcactccccttgtctgctttgcggtagcctaacatgtctctttctatctcttgaacaggttcttttctttcgttgggtctttatacaggctgaacctcctctagaactaactagaagctacctctgatgtcttctcagagagactttccttgactatccccaggcacatgaagaagccccacacaccccctctagtcaccatctatcttgttaaccttacttattttcttaaagtggggttctgtatgtaaaatgatcttctttatttgtttactggtttattagctgtcttcctattcgagaatgtaagctcccagaggacactctgttttgttcacttctgaatccctagcacttagccccgtgcttggcccatgacatttgtggtaagtactaggtgaccatttttggaactgttcccaccccacggcctgcattcacactttaatcacagcagctcagcttttatatcgtgagcttcagtgggaggttttgtttacagaaagttttcttggttgacaaaagcctgaagatgattttcttggaagatgaggatttattctaaggatatgtgaggaagcaaagtttttgttgttgttgttgttttggaggggtggtgggggatccgagtctcgctttgtcatccaggctggagtgtagtggcgcaatcatggctcactgcaacctctgcctcccgggtttaagcgattctcctgcctcagccacctgagtagctgggattacaggcatgcgccaccacgcccagctaatttttgtatttttagtagagacagggtttcacggaagcagagattttctgtcagtgttccatctacttcataatgtattgttgatatggttcttgattttttaacctgaaggcataagcatgaaaatagcataatgatttttcacagttcctgtccaagagtactttttctttacatgttgaattacctaccatagattgttttatcctataattagaaagattatgagattacatcatcttatatttacccttaaagagtgtttcccgaatcataagccaaagcctttgtataaccttattatgtaaatatttatgtttcaggtgtgttattccctttgtgtgtgtgtgtatctatatacatatatatgcatagtatttgtgttctcttattcctatgacattgtaaacgttctagttgatgatgtctgtgcttccattgcaactcttcactgcatgggtactctgatgtgtatggcttgctgctccccagatattcgttgactttgtgacatctgtcctaggacaatttcactattttagtttttggctactcagttaattagaaatgcatctcagttgtattttaagttattgctttctacattttaatcagtaaatacaaagagattgcctttagtttttgttatgtgtattttcaggttatgttactgggagtacaaagttttacaattgttgctttctttgtggattataggttttaggaaaataaaatttatcgtattgacagtttttgccttgaaaggcttattaaatttagcagtcctcccttttttgtgtgttttttgatccttatcctttttttttttttttttttttttgagacggagtctcgctctgtcacacaggctggagtgcagtggcagagctcactgcaagctccgcctcccaggttcatgccattctcctgcctcagcctcccaagtagctgggactacaggtgcccgcccccacatccagctaatttttttgtatttttagtagagacgaggtttcaccgtgttagccaggatggtcttgatctcctgacctcgtgatccgcctgtctggtcctcccaaagtgctgggattacaggcgtgagacaccgcgcccagcccatccttttgtttttaatctgtcattttattttaggtgcatttctagttcgcttggcctgctgtctttttcataacactttattcctatgtaatagatataatgttcttttgcattttattgtttctaaagcaaatatcttctaattaagaaaaataacttctagttaatttatttcaaggggaagcagtgggggttttattcctctggatgtttgttgtcttgtgtcctgtggaatattttctttctgtttttgttcttttctttctctaactcaggacagtgctgaggaatgttttcattggtgccgtattttctttttctttcttttcttttttcttttttttttttttgagacagggtctctgtctgttgcccaagctggaatgcaatggcgcaatctcggctcactgcaacttctgcctgctgggttcaagcgattctcatgcctcagcctctcgagtagctggcattacaggcatgcaccaccacacccggctaatttttgtgtttttatagagaaagggtttcgccatgttggccaggctggtcttgaactcctgacctcaagtgatccacccacctcagcctcccaaagtgctgggattgcaggcgtgagccgatgtgcgtggcctggtgccatactttctgcatttttctttaaggaaggttccaaatgtctgaagtccaccaaatgtctgaagtcctgcccagacttttggagagaaaacacagcaaagcaatcagtaggttaatgactgcatggtttctggaccaaattatcctcatctaccacttagaacattaagttgtaaaccagagtcagcacagccagggtggagattacttatttgtatcccttgctcgtaggttatttaatattctctgttgtgtcaaagtttagtcgggtatattaattagtcagcttttgctaaattatgttgtggtaacaatctccaaatctcagtagtttacgacaacaaaactttgtttctcagtttaaggctctttgtgggcttcatgccatggtagaacctcaaaagtggcatgtgccatttcaactcatacttcattggccaaaagcaagtcacgtggtcatgcagggcctcagtaagcaagaaatatttacccgcccggggatggacaggtaggaaagggtctgttaaggaagggcagcaaatatttggataacagtactatgtgtttgtatggagcgatatttaagaaggtttcctaggttttttgaggggtattgaagctgagaggttgggggcaggcaggaagctctgcagcctgtagcctatggtatcaagcttcatgagaacgagaattaactagttacatctttattaccatttttggcatctctgcagacagtggatctaatgcatgatagctgattaataaatgtttgttgaattaatgaacaaaatagcaagaaagtaacgtattctgaggcaggagaattgcttgaaccaggaggcagaggttgcagtgagctgacatcatgccattgcactccagcctgggcgacagagtgagactccgtctcaaaaaacaaaagaaagtaaacagattattttcatgctatttgatgcctccgcttagtttggaaccagtttttattttattttattttattttattttattttattttattttttgttttgtttttgttttcgtgttttttgagacggagtctcgctctgtcgcccaggctggagtgcagtggcgagatctgggttcattgcaagctccgcctcccgggttcacgtcattctcctgcctcagcctcctgagtagctgggactacaggcgcccaccactatgcccggctaatttttttgtatttttagtagaggggtttcaccgtgttaaccagggtggtcttgatctcctgacctcgtgatccacccgtctcggcctcccaaagtgctgggattacaggcatgaaccaccgcgcctggccttggaaccagttttatagagcagttcctacaatagctccttttatatttaaaatgaaaagtgctttcttgggggtcattttgccataccaaaagattatgtgcttaaaaaaaaaactacatactaattacagaaaaaattttaaatatgcattaaatacaagcaagtagaggttgtgttctatttggctactcaggacaactattggtgttttgttatatatcctcctatataattcctttctttcttttcttttttttttttttgagatggagtttcactcttgttgcccaggctggagtgcaatggcgcaatctcagctcaccgcaacctctgcctcccaggttcaagcgattctcgcttctcagcctccctagtagctgggattacaggcatgcgccaccacgcccggctaattttgtatttttggtagaggcggggtttctccatgttggtcaggctggtctcgaactcccgacctcaggtgatccacccgcctcggcctcccaaagtgcaggggttacaggcatgagccacatagtgcccagcctctttcttttcttttctttctttttttgagatggagcctctctctgttgcccaggctggaagaatacagtggcaccatcttggctcactgtaacctctgcttcccgggtacaagtgatgcttgtgtgtcagcctcccagtagctggcactacaggtgtgcaccaccacacccagctaatttttgtatttttagtagagacggggtttcatcacattggccaggctgatctcctgacctcaggtgatccactcacctcggctgcccaaagtgctgggattgcaggcttgagcccttttttttttccccatatggcttctgaacattgtttatatttattgtcacactaggatcacttagttttgtacttttagtagtatctattgctttatttgttatgttgccaatcggcagttgtaaaggtcgtagatgaaatagacaagtatttataagattaattttatcttacccttgttctctttttctcttcttgaatttcctccttcaaatatatgaactatttacttaaccaaacactctctttctcttccctctcaccatggcaagagtgaaagggaccagaatgatgaaaggtagacagttggcctgaggaaataaggtgccttggcgattctcagactggataatcagctcctggggaatcaggcgctgacttttttttttttcctcctgcttttactcagagatcatcttttcatattttgggatttgtgcagtcatttcaatgatctaaaagtgaagagcttgataataagttgattttagtcctactgtctttttgtgacggatgtgctagataagcttaatgtgagtcattcaagaaccaagcccctgtttgaacctgtccattgagggccctgtttatcagaggttgaagcattttttagctagcagctgatcttgggtaagcaagccattgtacaagttccccatgcctagttgttttgcatcattaatcatcttttcttcaagccatggaaacatggctgagtcttgagtcatctggctcttcccagtgctggaaatccaccctgctgaggtgaatgtgtgaaatattttttgttctcggtagagatctgagaactggtttgtctcctgcaatgaacagattgaattccttataaatatgttactaaaaggtaccttttgtgtccattttacagatatctgacatgattatttattaaactcctttaaataactcctgtgcttaatgcagtttccaaatatttgaaatactaaatgtagatttagggaactcagtgaccagttttcatttgcattttgatgaatttctctattttaatatttgtagttgctatccattttagaaatatccactctgccaagtaggttgggaatgtgtgcaagaatgacagcttaaataatgtgcttgtttgctattggagccgatgcccctaagtaaagctaccagataaagagaggaaagggggaaaaaaggaggagaatgaagccaccgtgtaacatctgttagagactcaatgtgagccctgtgagttagtcttcatttcccatgctatgttttatttttatttttcctgttccattaaagcatttcggttaattctgtataagtagaatgctgataactccttagagaaatgtgattcagtaataaccttgtttccatgtgactacttatctaatctgccatgcatctgctttaaggaaggtgtccattagggtcaactcacaggtcagacattaatcttaattgtcaaatgtctcaactcattgctagagactaaattgatcttgatggcactcatctgagtaccgattcacactaaaagacagtcaaggggttgttttcctttgtgtgttgtaattcttagcaggatcctaaaaatgaaagttttaaaatgtggaatagcatgattaatgaggacatttattaaggttaaggcagtttaaaagttcagtttaatctaaggttagcttgtaggaactgatataagagatagttaaaaatttgttaagctttacttaaaacctgtatttgggggtagaaacagttttcctagggtacttataatttcctttaattatctcagaaagagggtctcttattaggatgagggaaaaaaatgacccgtcattcttttaaatcaggtttaatttattcctgatatttatatgattcttatatgtcatgtaattcttatgacatataagagagaaaacattaatctagagtaggtaatttcctagttcagcttcttccacttgtgtgaactacagaagaactgaagagtaattgtaattgttttataactttaaagaatttaagagattaaattgctgtccttgtgaattctttgttaagtaactctcaaagaaatagtcaagttaaaggggatttactttctaaaactagctttcttttctttctgtctaaccttttattatgaaaaatttcaacatctacaaaagaaaggagagtagtatcattacccagctacagtcactgttaactctcagctaatcttgtctccatcctgccaccctccactccagattattttgaagcaaattctagacatcacttccttttattaaagcaagttgcgtttcatagtgacaatagaaaccatttactcttggcacaggtgctaaggtctgaatacaactttaaggagacagtgtctgcattgaagagcttatgttttaagaaaggagtttatgttttcactggatatactcggcgttcagggaatcagagactttcttcaagtttcccttgtcttttaaatagggacgtatttgcaagttcttatctgtttggaaattcctgtagcaagttcaggtttagtcattctgtactgctttggtggtgccttatctaaatagtattgaaaggaagaaagaattatttcaccaagagttggccttgaaaggagttagatgtattgggtatatttaggaagtaccccttcaacgctgtaataatataccaacttttaaagctacctcataatagctcttaaaaacacatttaaaacacttagaggtgatcctttttcctagccatcagtgggacaaattaattcctttttgagtaaaaaaaaaaaaaaaaaaaaaattctctttttttagtactcaagatcagcaagtattggttgactcattctttgttgttaaacctcttggtttctcaggccagtgtgtctttttgtatactttgaccttgcactttaaactgaattccttttgtcctttgagggaggcataaagctgtcagttcctgttggtgagtgtgggaaattgagttttcactcttctctataatttctgcatttcaagtggttttaataataatcataactatttctcaattttacttcttaaaaaagtagattcatcagactgaattgaatatttgttttccttctaaagctgaagccaattttgccatacttgtttgtgcattcttaagagtttagtacttaagcatagaaaactgtggggttcacatttatattttgctttattacaacttagaaggtaattgatgacttggctctgtggtatgctcaaagtgctggactgagctagttcaagaatgtcattagcagtgaatgggaaatatgtgtctacttttcttcagtagctaaacagaagtaattatatatttacattctacctatttcatagggatgttgttagaattactgtgattagatttttttttttaatttccaaatgtatttaagcttctttacagataggtgccatatcaaagcaaggtgttaatgtcatttttctcaatttgtgtttttgtcactagaaatatatatatattgctttttctcttttcctggtatatttttctgataaatgttttgaaatttgttatcttaagtttttcatagctggaatgctagaaaagcatttatgtcctatttttagtgcaagtgatgagtctggctgggtgggtaagttaatggcaaggtaattgaactgtgctgagtgctcgccgatgtatccttctggcctctccattttcagggtagagttactgtttacagtgacatgtttcacagtctgtgtgaccagccagtgtgaatcagttcgtctattgcctggctttcttgagctcaatttttgtctcatttcccctttccattttatatatcacatttcaagatggatgatctacttgtctaaccactccagggaagattggtgccatctaataaagtcaaaatgaggtcctgcatgttacctggcataaattagagaattatagaatgaatgtgtgaacagatctgagactagagctaggtcacgaaactcctcagtttttttgggttctcattatgtgtttatggatggaattgttctctttatctggtttgggtggttttgtttgtcagtggccaatgtggtggatatttcaacacaatttggacatgcttcctatatattttgcagaatggtctttttcttttggttaactttataactaatagttaaagaattttcaagcctcagctgggtacggtggcccatgcctgtaatcccagcactttgggaggccaaggtgggcagattacctgaggtcaggagttttgagaccagcctggccaaaatggtgaaaccctgtctttactaaaaatacaaaaattagtcaggcctcactccagcctgggtgacagagcgagactctgtctcaaaagaaaaaaaaaaaaattatttgggcttggtgacgtgcacctgtaatctcagctactcgggaggctgtggcacgagaattgcttgaacctgtgaggcagaggttgcagtgagccaagatcgtgccattgcacttcagcctgggcaacaagagcagaactccatcttaaaaaaaaaaaaaaaaaaaaaaaaaaaaaagaattttcaagccacattaggatgcttatcggcatgagttttacataataagacaatctgaaatgtatttgagttttgatgtttctaatctgtagaacttgaaggcctaaggattttgtagttttttagggaacagcattcctctttctctcaggtgatctatgttatgttgacctactcaaacatgttaactttgaaaatgaaccaacgttcaggaacaaatgaaatgacattttcaggacagcattccaaatacatagttagggacagttgttcgtagcttctggagtgtttgaaaatggccctcatatcatacaacttgaattggcattcattgacaatcactttgcttttaaaagatgcttaacaaagagttgtaagtaacatactttgagactgagtaaataaaataaacatgcgaacctttgatgttaagctgagtttgtttgatttttcaggctgaatatacaaagactgtttctaggaaaacttgtgctttgtacagatagaggaacctcctaagaattttgattgtggcttccaaaatagcagatttctagaatatgattacctactttatctaagatttcaaaaagctgctttgtctattttatgatataaagttttcaaaaaatcatcactgttttgtttgccttttttttttttcttgaaaaggcatgtgtttaagcatcagccttattagctggactgttatttcatgtatttctgttagaacgctggataatggacttgaaacttacatggctaatataataccatgaagtttaggaaactaagggctcatttctgttgtattccttggaacgtatgtgggttcaagatcaaaatcattatttcttctttgttttggtatttgtctctttcgggaattaaaatttgttcccaaacattcgtaggactacactgtagcaggaatctgaatagaaaacactccttgtttagttctgagtttatgtggatgaggactaagtgaccattgaaggtggaagggtgatcacagagattactcagaacttaatttattaattctaaaatgcgttcattgaatacacatggtttgtgtgctttttatgggccaaaccatgtaacagaggctgggaatgcagttcttgctctcaggggaatgtagtcttgtctgagaaacagacaatgaacatcagtttccaatagatctagttgtaggcttagagcatgcagagggaacaacagaaaaaatccactgagaccattctggggtccaaataggacccatggcccaagtttagaatggcaagaaagaggaaagacagagggagcttgggcagtgttctgcaaaggataaattcagttctctaagaatagttcactagtccttttttttttctttttttttttgagatggagtttcgctcctgtcacccaggctggagtgcagtggtgcagtggtgcagtggcacgatctcggtgcactgcaccctctgcctcccaggttcaagcaattctcctgtcttagcctcctgagtcactggaattacaagcacgcccggctaattttggtatttttagtagagatggggtttcaccgtcttggctaggctggtcttgaacacctgacctcaggtgatccacccacctcggcctcccaaagtgctgggattacaggcatgagccattgtgcctggcctggtcacttgctcatagttattaatctgaagaagttctacagtaaatcaaatgttcaggattgcctaatgttgacttactgatttagaatatcattctcttggtatgcttctataaactaccagtgctcaatttttcttttcaattttgaacttgttgatggacagtgtctacagtctcttgacagttatgtaatttgtgtctatttaggtttaagctgtcaccttcccaaatgcggcatctgtgtagccccagagggagcattctaaaaggtaaatctgagcctggcgcagtggcccaggcctgtaatcccagcactttttgggagctgaggtgggaggatcacttgagtccaggagttttagaccagcctggtagcaagaccctgtctctacaaaaaataacaataaataaaattaacaggcacagtgatgtatacctctagtcctagctaccgtagaggctaacatgggaggattgcttgcactcaggagttcgaggctacagtgagctatgatcgcaccactgtactccagcctggtagcaagggcctatctctaaagaataaaaaatagactaggcatggtggctcatgcctgtaatgctagcactcggggaggctgaggccggtggatcacctgaggtcaggagttcaagaccaacctggccaacatagtgaaaccctgtctctactgaaaatacaaaagttagccgggcatggtggcgcacgcctgtaatcccagctactcaggaggctgaggcaggagaatcgcttgaaatcgggaggtggaggttgcagtgagctgagattgcaccactgcattccagcatgggcgacagaccaagactctgtctcaaaaaaaaaaaaaaataattaaaaaaaaaaataaggccgggtgcagtggctcacacttgtaatcctagcactttgggaggccaaggcaggcgaatcacttgaggtcaggagtttgagaccagcctggccaacatagtgaaacctcatctctaccaaaaatactagcctggcgtggtggtgcatgcctgtagtcccagctattcaggaggctgaggcaggagaattgcttgaacctgggaggtggaggttgtagtgagccaagatcacacttctgcattccagcctgggtgatagagcaagactctgtctcaaaaagaattaaaaataaatgaacaaaaataagccaggcgtggcccggtgcagtggctcaccctgtaatcccagcactttgggaggctgaggcaggaggatcacgaggtcaggagatcgagaccatcctggctaacatggtgaaaccccgtctctactaaaaaatagaaaaaagtagccggtcatggtggcgggtgcctgtagtcccagctactcgagaggctgaggcaggagaatggcgtgaacccgggaggcagagcttgcagtgagccaagatcgcaccactgcactccagcctgggcaacagagcgagactccgtttcaaaaaaaaaaaattagccaggcatggtggtggatgcctgtaatcttagctactggggaagttgaggcaggagaatgacttgcactggggaggtggaggttgcagtgagctgagattgcaccattgcactccagcctgggcaacagagcaaggctctgcctcagaaaaaaaaaagtgtatatatatatatacatatatatatatatatatatatatgtatatatatatatatatatatatgtaaaagttaaaaaaaaaaaaaaaaagacccatttctgccgaaaatctttcagtgactccatcaccccaatgggccatgggcaagtcctgtttccactctcacatccttgcctttgggattgttttcattcctgctgagtatttaccctcacctggaaagcagctgtgtgaacttctcttcatccttcgtaggctggtggcctttcttccatgctcagttaatcagtttctcttctctgcttcctttgttctttggcctgctctgcggtgttgtatgaaacacactgtgccagaattgtttgtttactttctgttcctgttctaaatatgagctctttgaggcaggacctgtgtctttctttggacctttacgtttgtcgcagtaactgtcatataataaacagtcaatacttgatttaagctgagcaatgtaacacttaaacattaattttgttacatttactggattataatggtgactgaaaaaaacatttttaagttttttactccacctgggacaattctaactaagtgttttacttatgttaaaactcatttaattatctttgttaaagaattactctgatgcttgttaaaatagttaggaagactttattcaagactattgcaatggcggggagagatccagctcaattctgaatccagcaaggacaaatagagaattacagtcaagtagcagaatatggtcagtgaatggtaaattgctaagtggagacatcaaggtcagtagatcttataaaactggcttagtctgcttgggctactgtaacaaactactatagactagatgccttaagcaatcgaaatttatttcttatagttctggaggctaagtctcagatcaagatgccgacagatttagttcctggtgagggccctctttgtggtgtgcagacagtcaccttcctgctggcagaaggagagatcatctctctgatgtctgttcttataagggtaccaatcccattcatgaaggctccactctcatgattttaattacctcccaaaggctcgctttccaaataccatgaccttggggataagtgcttcagtgtatgtattttgagaggacacatttggtccatggcactgacctaacaagattgttgccgaaggcaggcctagaatgtatacatcaaaggtgggggtgaggaatttgatcaaatatcaaaggtgatcagatatctcagatgggggtgattctcactaaactgacttagcaggattgtttgtaaaactgagttaggtaggctgaagacaggaggggactggaggaggttgcggcttcgttgaggagggctcagagaagcctgagtttggtcaaggagagggtctttgtcactgttaggagccttttaacttaggtgctaattatactagcattttatagacaaagaatctgaagcttagaaagaggctaagcaactcacgaggtccgtaccagtaagcaccctacctggattctagctggcgtgctttctgttccataactttaaagcattgatcatctggaccctgcctgtgatggctcaatttgcttttgctaacctgctgtgagaatcagtgggagtttgcctctgctttaaaattactcatggtcttgctgcccttagtgctgtcaatcctgtgatttccactggagcaacatactcaggttacaacactgggtaacatttacattttagcagctttcttgaaatttaaaatatatgtgtaagtatctcatttatatgcatttctagtttctttatacaacagaataacttcttttacatcaaatttctgaatttgactaaatttagaaataatggaatctcatccattaaatatagtcatagaaggaaggaaatatgaaaattaggatttcagatgtttgaacataaaagataattttaaacattgtcagtaatctatttctttttttttttcgagacggagttttgctctgtcacccaggctggagtgcagtggcacgatcttggcttactgcaccctctgcctcccagttcaagtgattctcctgcctcaacctcctgagtagctgggattacaggggcatgccaacatgccgggctaatttttgcatgccaccatgccaggctgatttttgtatttgtagtggaaatggggtttcgccatattggccaggctggtcttgaactcctgacctcatgtgatccgcccacctcgcctcccgaagtgctgggattataggcatgagccaccgcgcccagcccagtaaaatctatttctatgaaaagctcttcaaatgtaggtgaacgctgtaagctttatgaatcaactgttttctaaatggtaatacatgaaatctgacaattttttatgtgattttattcaattttctaagaaaagtaaaaaatcagatacatagccgctcttctcttgggactagtcttgataccttttgtatttttatatagtgctttgctcatacccttcttgctgttttttgttttgttttgttttgttttgttttttttggtgggggggtgggggatggagttttactcttattgtccaggctggagtgcaatggtgtgatctcggctcactgcaacctccgcctcccaggttcgagcaattctcctgcctcagccttgcaagtagctgggattataggcatgcgccatcacactttgctaattttggtatttttagtggggacagggtttcactatgttggtcaggctggtcttgaactcctgacctcaggtgatctaccctcctcgacctcccacagtgctgggactacaggcgtgagccactgtacccagccccttcttgctatgttttagcctgcaatgctgttcccacttgtgtctatatagcactcctaatttaaatcatacacactgctattctgcagtgatttcttactctttcagtcagggttggtagcttttttctctgggctttcacagtcctgtggaagggcacagggttatcttatctgatacaatgtgtacgaaaggagtaactgtatcatagtaaaagttttatatataagtgaaaatatttacaacactttatccagcttacaagtttttgatatattttgtttctgtgtcttaaacacaatggacaaatacctcatataaagttttatatttttaattgtcatatatttcattatatggatatatcttttttggagacagagtcttgctcttttgctcaggctggagtgcaatagcacgatcgtagctcactgcagcctccaattcctgggctcaagcgatccttccacctcagcctcccaagtagctggaactacaggcatgtgctcccatacctagctaatgttttggtcttatttttgttacttatttatttatttttaaacactttgttgcttaggctagtgtcaaactcctgggctcaaggaatcctcccaaactttggctacccaaagtgctgggattacagatgtgaaccaccatgcctggctggatgtttcataatttacctaactgttcctatgctattgaacagttaagattatttaagtttttaattgttaaaaataaagtcatggtgaatgcctttggacatatatctttgtattttggattattttcttatggcagatttgcaggagttttgttattgggtaaaatggaaagaacatttttcctttattttttaagagaaagggtctggccaggcgctgtggctcacacctgtaatcccagcactttgggaggccgaggcgggcagatcacctgaggtcaggagttcaaaaccagcctggccaacatggcgaaaccccgtctctactaaaaatacaaaaattagccaggcgtggtggtgggtgcctgtaatcccagcgacttgggaggctgacaggagaattacttgaacctgggaggcggagattgcagtgagccgatatcacaccactgcactccagcctgggagacagagcaagagtgtctcaaaaaaaacaaaaaacaaaaaacagacagggtctttcactcaggctgcaatgcagtggtgcaatcatggttctctgcagcctccaactcctaggctccatcaatcctgcctgagcagttcctaggactgcaggtgcgtgccatcatgcccagctgatttctgtatttgttttttttatttgtagagatgaggtcttaccatctttcccagctggtctcagacttctggcctcaagcagtcctcctgccttggcctcccaaaatgctgggattacaggcgtgagccaccgtgcccggccacttttttctactcttgatatacttacctatgatacgctttccaaaggagttgtaacagtttgccctcccaccagtggtgtgagagagggtctctttgctctaacagtattaatatcagatatctgtattaaacttatttattttgaggccttacctctttccttgtggtaaactttctgaactaggttgacctaaagtaaactggtttagattcccaaataaaattgacaaaaactttataagatccattttaaaagttggagtgtcaaggaaataggaaaagctttgttagagagggaaatgttattcagtgaagtacatattgaatgtgtgaacttttcttcagtaacagttgttatcttttaaaaatcttctccatggtatttggaattttaaagcttaatacctctgctggattttgcaagcgtgaaactaaaacacagtgaaatttgaatgtgcaaacatacataaactggaattgtgaataaattagattataaaccaaacacattttgagtataagtgggcctttagaaagttttttatattatgggtagaaggtgaacctttctaaagaaaataagaaattgaggaaatctaggattttcttctttttattttggatctcagtgtgtttgtgatttttaacagaaacgttcttttctgtactttaatggtgcagccagatccatgtaaagaaaaggagtgaaatccccaggaaagatgaccagcagcaggattcttttcagcttttctccctttcctcaggcttgaatatatttcagtgcacctcaatcaagtgaagtgagattaaatatttgagtcatctgtctgttgccttctaaaatggtctggctttctgttggctgcagtctatttagtgttttagtgatgctaatgttattgaatggtttttagttctaaaacttctagtagtgataaatcttgtgcatagaagtcccctaggtcacttagcagagcgcagttggtttttgttaatgactgcattgtcctttgctctcattcgtgatacccagtgacttttcattgatgttgcagtaaggctttttttttgttgttggacttctcccattctttacacattggtaaataatcttcagctgtagcaggaggtagccagcatctatgtgtggatcagatttatcaatatgtacctgtgcagattgcctttatctcctgattgggcaaatacttaacagtccttagcagtctctccattgagttttccaccaactctaactggcaaaaggactcagttgtattggacaggaaaatcttattgtctttgctgtccattgtggcactaaagctgtgaagatgtcatacatgtgaagtattcactggattctcagttacttactcgttatcaaggcttacatgtagccaatttaattttgatgaatatgtttaaatgtagggcattttataattactggctcatggttttttatacagtatgtgcatatttcatttcttttactaccgtctttcagcccatatttaattcatccatttgcagctgttgcactgttttgttgaaactggcttaaaaatctggcaggaggcttccctactttcttgcccttttcggtgttatggtgttattttacacagttagtactttctatgtagtttcttctttcctaaagctgaagggccatatctctcaaacttttctctgcttacctttaaccactgttcgtgccgatgagctgataataccaggcttggttgctggctgtatttagaggtatacaatttaaatacccagagataaaggtgacagtagtaaattagtgcactgtattgtcttaagactaagtgtgatttcagttcttatgctacaacatggaagtttattttaatgttttcctttatgtatgggctttgcaatggttgaaacttgagtttttatttggaagttttggaagacaacttttagattgtctcttttttttttttttgagacggattctcactctgtcgcccaagttggagtgcagaggcgtgatctcggctcactgcaacctctagctcccgagttgaagcgattctcctgcctcagcctcccgaggcatacacgaccacacctggctaatttttttttttttttttttgtatttttagtagagatgggctttcaccatattggcccggctggtctcaaactcctaacctcaggtgatctgcctgcctcggtttcccaaagcactgagattacaggtgtgagccactgtgcctagcctagattatctcttctttagtgactgtatatatctacattacacagatgacaacattttgttttcctgtaacctaggccattacatttttttttcatgtgacaaagtgtttgcaattatttgtgaaattttaattttttcatcacttattaatttatatttgagaggactggaaagtatgtgagttgaaaatagtttaaacttatacaatctcattattaatttggctgttaatttgaatctattccataacttatatttaaaataaaattttgatttgaaaggctcttatctcaatcagtggttcttaaaattattgtttgctgtttagagttatattttttttccaggaagtacttttttagctttcaggaacttgatataatgttttattcttgatgacccactggaaaatagaaccttctagaagaaataaagtcactttattgaagctttatgaatggctctcctatctgcatctgtagggctctacaatctgatttttccaaacaaatagacaaactatggataataacttttcagatgttactttgcagttagttggtggtctggaagaagaaaaaagagcttcaaagaggggactgttaattccatttatctcttgaacaggaattgctttcctgtctttcattgctgtcccttatttttcacctttatgttgtagctaggttttggttttattagctccctgatgaattctctcttcctgccaatattaaagtaaggatgatttagaagaactgaggttaaaatctgcctattgaagctctccaggctagataccctgacatttctctttgtggaaagtaagcaggagtaaagggacaaatcgtccgaaatgccattgagtgttgccaagtgatgtgctgacagctgtacctgacagtgattgctggaccctggtcattcctgagtgtctccttttcacctcccatcccctgctgccactcccccctaacaacaacagaaattctgggaggaatgcctgttccctatttagaggacaacttgagtgatcatgatagtttgtcagatataatgtggacaatgacctttttcagttttagtaataagattcttctttttatcaggttctttatcctttatgcagttttaaaatattacttatgaacaagctgcatatcccttttaggtcatcttgttcttctacttcaaatagcacatgtagaagccacatttgaggctcagggcttcagacatgacaatagggcattgatcaggttggctatatgtttgggatttgtcagttcctttgtccattttttgtctcgctttcagtaccttttctctgtgttttaaaagggctttgtgtacctcttgcctttatgtgtaatcttacagggcagctttcttctttttcattcatttcctgctctaagagtcatctcaagataggaatctggtataagactcacttatagaacagggacataggctcttccagttgttttcattcattgcagattattttaaataagagaaaggtttccttgtatttttctttaatgttttccaattttgaattgttatagatgcaaagcctttaaaaggataatatgtggaggcagtatttgtttggggtatcttttaattgtttttctagatcaaggacagatatagatagattaatacctgaaacgaaaccctaacaactctcaaatatcagataatttttttttatgtttctgaggatgtttttatatcctttgagatatttaaaatatacacatttttatgtttctcccacatttggacatttctttcccctcaatgtttcattgatgccacatttctaccaattttaatcttgtattctatatcttactatcctatagtttcttcaagctgaaattagaccttttgagcaactttaaaacaaatttttaaaaatatttatttataaaagatcaattacacttattaccttagtaccataataaaaatctgtttcaaataaatgagtctgaagatgggaagggacaccattcagtgggtttagaaatagacctgttaaaatacaagtccagctggctgggcacggtgcctcatgcactttgggaggctgaggcgggcagattgcttgtgctcaggagttcaggaccaggctgggcaacatggtgaaaccctgtctctacaaaaatacaaaaattagccaggtgtggtggtacacacctatagtcccagctacttgggagactgaggtaggaggatggcttaagccctggatgtggaggttgtggtgaactgagattgtgccactgctttccagcctgggtgacagagccaggtcctatctcaaaaaattatagaataaataaataagcaagcccaaaggcaatttcattttattttatttagagacagtgtctgactgccgcccaggctgcagtgccagtggtgccatcatagctcactacaacctcgaactcctgggacaaaagcattttttcctgcctcagcctccccaagtagctgggattgtaggcatgtaccacacacccaatttttaagtttgttttttgtagagacagcatcttgctatgttgcccaggctggtcttgaattcctggcctcaagagatcctcctgcctcagcttcccaaagtgctaggagtatcggtgtgagccacctgccctgcttgaattgttttttttttgttgttgttttgtttttttttggagacggagtcttgttctctgttgcccaggctggagtgcagtggcacgatctcagctcactgcaacctaaacctccttgggttcaagcaattctcctgcctcagcctcccgagtagctgggattgcaggtgcccaccaccatgcctggcttatttttgtatttttagtagagatggcattttgccatgttggccaggctggtctcgaactcctaacctcaggtgatccacctgcctcggcttcccaaagtgctgggattacaggtgtgagccaccgcacttggccctgaattgtttaaatatgaagatgaagaggtctctgctgtccttactcctctggcctctaataccttctagccatcttgccttactttggaagggagggagacagatgtagttgttcacagttgagagctgctgaaacactgtgactttatggacagtagtagggagaaagcaagcctaatccgtttataaatgttccattatatacaaaataccctttctaccaacagtaggttcttaattactgacaccaggcatgctttggttgtgactccagcagcgcgggttggtggcatcttacactgaacagcctgggcctccactctccccttctgtaaattttgcctgtcactaattgtttgggcccagtttcttcatttatataagaggattataagatttttgtgaggggatggtcaataattaagtgaaaaacagatgatgtatgttcataatcaccttttagtctctaggtcattaagcctagattagcctattttggtgtattagaaatttgctgattatctggactatgtattagtagtacatgtagaagatttcttttttctgtgtgtgtgtgtgtgtgtgtgtgtgtgtgtgtgtgtgttttcttatagatgtggtctcactctgtttcccaggctgaagtgcagtggtgcaatctcagctcatgcaatgccaccaatccatgttgctggagtcacaaccaaagcatgcctggtctcagtagttaagaacctactgttggtagaaagggtattttgtatataatggaacatttataaatggattaggcttgcttaggcctgggttcaagcaatccttccgccctagactcctaagtaattggaactataggcacatgccaccacgcccagctagtttttgtgtattttttgtagagacggggttttgccacgtcacccagaacagccttgaactcctgtgactgttgtgggaaattgatctagactcaagtgatctccctgcttcggcctccaaaagtgctgggattacaggtgtgagccactgtgcctggcctgtaaatatgtttgaattacctcatttcatcttgcatgcttgttatttttaacatgccttttctccctttaatttttaaaaaatttggctgggcatggtgacgcacgcctgtaatcccagcactttgagaggcataggtgggtggatcacttgaagccaggagtttgagaccaacctggccaacatggtgaaaccctgtgtctgttaaaaaaaaaaaaaaattagccaagtgtggtggcacgcacctgtaatcccagctatttgggaggctgaggcaggagaatcacttgaacccaggaggcggaggctgcagtgagcagagattgtgccactgcactccagcctgagtaacagagcgagactccatctcaaaaaaaaaaaggccggaatcctagcactttgggaggctgaggtgggcggattgcctgagctcaggagttccagaccagcctggtcaacatgatgaaaccccgtctctactaaaaatagaaaaattagctgggcgtggtggtgggtgcctataatcccagctactggagaggctgaggcaggagaagtgcttgaacctggagggcggatgttgcaatgagccaagattgcaccacttcactccagcctgggcgaaagagcgaaactctctctcaaaaaacaaaaaaacaaacaaaaaaatttttttttttttttttttttttttttttttttttttttttagacggagtcttgctccgttgctcaggctggagtgcagtggcactatctcaggtcactgcagcctccgcctcccaggttcaagcgattcccctgcactcagcctcctaagtagctgggattacaggtgctcaccaccacacccagctaatttttatatttttagtagagatggggttttgccatgttggccaggctggtctcgaacacctgacctcaggcgatctgcccacctcggactcccaaagtgctgggtttacaggcgtgagccaccgcacctggccaaaaaaatttgaaaattttcaaacattcaggaaagttgaaagaacagcacaatgacatacttgttttaaaagaccaattacagtttaattatttgatataaagttaagttttaaattatgccagtaattaatactttagacattttattccacatggttaaattttacctttttaactattcaacttagtatttatgtgctagaacctaaaatccctaattgtttatgttttgttttgatttttattttttggaattgttgcatattttctgaataatcttcccatgtttatgatagcaaaacattggaactgaaataacaaatctgtttcaatatacttttttatcatgcaaaatgacattttaataaatattgttttagccaggcacggtggctcacgcctgtaatcctagcactttgggaggctgaggcgggcagatcacctgaggtcaggagttcaggaccagcctggccaacatggtgaaaccctgtctctaccaaagtacaaaaattagccgggcatgatggccggtgcctgtaattccagctactcgggaggctgagatggaaaaatcgcttgaacttgggagatggtggttgcagtgattgcagtgagccgagatcgcaccactgcactccagcctgggtggctgagcgagactctgtctgtgtgtgtgtgtgtgtgtgtgtgtgtgtgtatacacatatatacgtatatataaattgtatatatataaagaaagaatatatatataaagaatatatatgcgtatatatataaagaaataaagttgttttaaggatggtcattctagtttataaatacatgtttattagaggccttctacttatctatatcaacattagggattttaatgtaagtgccaaaattaaggatcatcagtattttttcttttgactttctgtaattggctcttttttcctgaagctgaaatgaagaaagattaaagacttcttaaacatattctagctttggtttaaaaatctgaacattatccaaacttgaagaaactatttacctgtttcttcattgcttaatacttagtctctatgtttttctattttttgtacctaaataaggagtgtttgtctcaataaaatatctaggtccagcaatatgtttagaaaggttttaataacttgctgaaagcatgcattttgtgtaaagtgtggcaaagaaggaaacaattgtactttcactgggaaaagactaaaaggaaatataaataccaagctgttgatagaggttgccttcggagagtggaattgtggatttttttttcacctatcttttcagttttctaaatttcccacaattgtcacctataacctttaaagggggaaagtgtaagcaatcatgatgtaggccctgttgtaaaacagaagtaaatgggactgtgcctatttgcctacttggtgctgcccttttccgtgtgttgtctcctcgccgaagagctccgggcccttagccctgaggtgctgcctctgcttggggctgagcttcctgcactcctgggtaactctcctgctttctaggccacagggccagggacctcagagagaagaatgcctttccttttctctaggtatgtttctgtttgttttcagcgtaggtgacctaccttatgctgctgaagtcccctcatagagatagaactgatttcgttcacttttttcttttcttaactgctctaggctttctgttagattttcaaaaaatgtgtgacttcctgcttacatatggtaaatgtttacacgtcaggaagcttttcctttttgtgtgtaagaagtagaagctcactggacttatatgtcagcattctattaatcttaattcccccattttgtttctgtgatctgctatgacattacaaaaaaaattggtttatctttcttctttcgttttccagtgcctttattgcatggaacagtatcccctgcacccacgcttcaccctggttagtttaccaggctaactactttgtgcctctttggtgaagttcgtattcctaaaagtatgaggttatcatcatgggctctgaatccagactctctcttccattgtttaataactgtataaactgtgttttagtctctggaagagggaatactaataatatttagtccatagctttgttaataggattaaattggctaatataggtcaggtgtacttgcaagcacttaaactttccattcgttattataagctattactattaaggatcatgccagtaaatcctcaccaaaattgacttcattattttggcataatgttattgtagactattatctttgattccgggagtaaggctaagttgtcatttgaatgagataaggacctcgaaatcagttgtaaagacaatcttggccgggcgcggtggctcacacctgtaatcccagcactttgggaggccagggtgggcagatcacgaggtcaggagattgagaccatcctggctaacatggagaaacccatctctactaaaaaaaaaaaaaaaaaaaaaaaatacaaacaaaaacattagccaggcgtggtggcaggtgcctgtagtcccagctacttgggaggctgaggccggagaatggcgtgaacctgggaggcagaggttgcagtgagccgagatcgggccactgcactccagcctgggcaacagagcaagactccgtctcaaaaaaaaaaaaaaaaaaagacaaaatgttttaatgaggagataaaaatcactgaaccagcctgttgtttttatattggatcagtatagctttgtaccgtacctggaaataaaaataaaaatttttcctgagtaaattaataagatgtaggaaagatattaaggtttatttttaagtaagctctaaatagaaatgataatctgattataaaaagaagaatatgaaaaatatttaatatgctagtgctctgactcaaaaattaaaacctacattttttctttattatttgttttttgagacagagtctcgctctatcacccaggctggagtgcagtggcacgatctcagctcactgcaagctctgcctcctgggttcacaccattctcctgcctcagcttcccgagtagctgcgactacaggtgcctgccaccacacccggctaatttttttttttgtatttttagtagagacagggtttcactgtgttagccaggatagtcttgatctcctgacctcatgatccgcccgcctcagcctcccaaagtgctgggattacaggcgtgagccactgcacctggctaaaacctacatttttttcaattctctttttaacatttgaaaattttgcttaatctaaaatatactccagaagtttaaatggaaagaccttaataaaatattcagtcaaatgctcttcctttagaaatggaggtactgaagttcatttctcctatcattctaaattgatgtttcattttgactatatatttagtgagttatggcagtaaaagcagctttaattttttttctgaaagcctactcatattggagccctttataacttgcctcttgaagtatatatatttattcatacaaatcaaacactgatgtctgtgaagtttcatatcatcttttatatttgaattttgttcatatacttattgtcacccaggctggaagtacagtggtgtaatctcagctcactgcaacctctgcctcctgggttcaagtgattctcctgcctcagcctcccgagtagctgggattacaggcatgtgccaccatgctggctaatttttctatttttagtagagatggggtttcgccatgttggccaggctggtctggaactcctgacctcaagtgatctgcccacctcagcctcccaaagtgctgggattacaggcatgagccaccaagtttttaattgatggcattttaaagaatacctcatattttatactttccagacattttccccacttatatgaaatttaaaatgagagtatagctgttatttgttacttggtcataaaggtatttggaaaagcactgatcttagaattttaataaaaggcatttattaccaaaaaaaaaaaaacactggatatattgaccttaaaatgagtaattagtattttccagtaaagcattttggattcaacatagactatgcttcaccctacctcacttctattagaaaaccttttttaaaaagaaattttctttttgtcagctttagtaaataatgtcattcaggattcctattcacaatctgagatctgccacttaacttgctcagaagccttacagtccacaccatttgttctatcctttcaattcaggttttatttgtttatttatttatttattttttttggcgtgctgttgcacaatcttggctcactgcaacctctgccttctgggttcaagtgattctcctgcctcagcctcccgagtagctaaggttacaggcgtgcgctatcacgcccagctaatttttgtatttttagtagagatggggtttcaccatgttagccaggctggtgttgaactcctgacctcaagtgatccacccgcctcggcctcccaaagtgctgggattacaggtgtgagccactgcacctggcctcaattcagtttttaacttgagcttaaacgagatattttttaaaagttaaaatctgtgttgaggcatatcaagaattgctatgtctcttgggggagagatgtgaattccatcaacatagatatgctagtttatagtgaactgttaggaatgctgtacccttgactcatacttagtcttttctttgtggcttgtggctctcttttcaacttcattaacatgtaattgaagtgtactaaatgcatatacttattttttatgttttttcaattttttattttttgtgtgtgttggggggtctcactatgttgcccaggctagtcttgaactcctggcctaaagtgatgctcccaccttggcatcccaaagcactttacagatgtgaggcactgcactttaaatgtgtatatttaaaaatgtacagtttggttagttttgacatgagcatatgcctgtgaaatcatcattcccaagagagcaaacacttctgttcccccaaaaggttcttgtgcctctctgttttgtgtcctttcttctcctcccatcttcaggaaaccactgatggggtttttgtcactataattagtttacattttctagaatttttctggaagtggaatcatagatatatacttcttttttaatctgacttctttcacttagcataataattttgagattcacgcatgttgttgcctgtgtaacagttggttactttttattgccaagtagcatttcattggatggatagatcatcatttgtttattcattgatcagttgattgacatttgggtttcagtttttggctcttaaaaataaagcttgatagtacatttgtatagaaatctttgtgtgggcataaattttcatttctcttaaccaaatacctagaagtagagtggctaggtggagtggtagctgtgtaatgttttaagaaaactatatttttaaaagtttgtacaattttacattcctctcagcagtgtgtagagctgttccacatcctcaccaacactagatgtggtcattctttctcatattagccattctagtggaaatatagtggcatatcagtgtgattttagtttgcatttccctgatgattaataatgttgaacatcttttcatgggtttattgcccatttctagaagttattttacatctcagccatttcctcactgagctgtcttattcttaaattgtaagagttctttagatattgtggatacaagtactttttctaatgtatgtgttgcaagtaagtgttttctttgtggtttgcttttttgttttcataagggttatcttttgaagaactgtttttttgttttttttattactttgaagcccagtttactaattttttcttttttgtttttttttgagatggagttttgctcttgttgcccaggctggagtgcaatggcgcgatctcggctcacagcaacttcgcctcccaggttcaggccattctcctgcctcagcctccagagtagctaggattacaggcatgcgccaccacgcccggctaattttgtatttttagtagagacgggtttctccatgttggtcaggctggtctggaactccggacctcaggtgatccacccgccttggcctcccaaagtgctgggattataggcgtgagccaccgcacccggcctaattttttcttttataaatcatgcttccttgtgttttgagaaattgcctagcctaagttcaggaagatattctcccatcttttaagatttttatatgaagcatatatggttttgcatttaggcctaggacccgttttgaattaatttttgtgtattatgtaaagtgtcagtgttggcttttctccccacctggatatccagttgatccactttgtttgttgaaagacttttttcctccagtgatttgtctttacaactttgccaaaaatcagttaaccaaacgggtaggtctttctgaactcttcttttctgttttattgatctgtctctttacaccaatcccaaaaggccttgactactgttgttttatagtaaatcttgaaatcagggtaaatctttcaactttgttcttttaaaaagttgctctgcttattctaggtctttactatcagcttgccgatttctgccacaaagcctgctgcaattttgattgggattgcattgaatatacaaaccctttggaaagaatggcattttcacagtatttaatctttcaacccatgaacttagtatcttagtaccatttatttaggtcttctttaagttttcttcgcaatattttgtagttctaagtgtagaggccttgtatatgtttttttgtgtgtttgtttgagacggagtttcactcttgttgcccaggctgggcctcccgggttcaagcgattttcatgcctcagcctcccaagtagctggaattacgggcatgtgccaccatgcctggctgattttgtatttttagtggtcaggctggtctcgaactcctgtcctcaggtgactcacccgccttggcttcccaaagtgctgaggttacaggcgtgaggcaccgcgcccagcctgtcttttgttaaatttacatttagaaattttacatattttgatgctactgtaaaacagttgtttttcttaattccactttccaattttttgcttgctagtatttaagaattcagttcattttaatacattaaccttttatcctgcagttttgttaaattcacttattgaatatagttattgttttctagattctctgggattttctatataaatagtgatatctgtaaataaggagagctttatttttactttccaatcttcatgcctattttttgcttgttgtttttcttgtcttattactttattgagtaatctccatatcagtgttgcacagaagtggtaaaagcagatatccttgtcttcttcctgatctcaggctgagaaattcagtctttaaccgttaactgtgatgttagatgtaggttgttcatggatcccctatatctgtttgtagaagtttcctactaattctaatttgctgagaggcatttttttttgtttttttttttttttgagacagagtctcgctttgtcacccgggctggagtgcagtggcatgatctcggctcactgcaagctctgcctcccgggttcacgccattctcctgcctcagcttcccgagtagctgggactgcaggcaccggccaccacgcctggctaattttttgtatttttaggagagacggggtttcaccgtgttagccaggatggtctcgacctcctgacctcgtgaaccgcccgtcccaaagtgctgggattacaggcgtgagccaccacacccggcctggttttttttaatcatgattggatgttgcgtttttgtcagaagcttttaaaaaaatatctgttcacatgatcatatgggctttctgctttattctgctaatatagtatattacattttctgaatggtttaatcttgccatttctaggataaactatttggttatattttagtatcctttttatataatattgatgttcaatttttaatttttgtgaatgatttttgtatctgtattctttagggatcttgttctattattttttgtaacgtctgtgaggttttggtattatagttgtatgacctaaaaaagtgaagtgggtagtgatctcctttttttttgtttgtaaaacttttcataatttttgtattatttcttctttgaaagaattcaccagtgaaacagactatggctttcttttgggggaagttttttgttttttttttttttcttttgagacggagtcttgctccgtcgccaggctggagtgcagtgctgcgatctcggctcactgcaacctccgcctcttgggttcaagtgattctcctgcctcagcctcctgagcagctgggactacaggcgcgtgctaccacacccagctaattattgtatttttagtagagacgttggccaggatggtctcgatctcctgacctcgtgatcccaaagtgctgggattacaggcatgagccaccgcgcctggccggggaaggtttttaatgataaaatcagcttctttaataaatataagagtattcacattctcgtatcaattttagtaagctttattttccaagaaatttgtttcttttatctacactgtcaaatttattggcataaggctttttactatttcttattttttaaatgtttgtaggattgatggggatgccccttatttctacgatttttttttctctctgtatctagctcgaggtttgtaaattttttttttcaaagaaccaaagtttgattttgtaattttctctattgtctgcatttttattcatcctgccatatcactgtaatttcctttcttctacttactgttggtttacatttctttttccaagtttttttctgttattgtttagattactaacatttaatgtaattatcggttgttggaattagacctgccatcttcctattactggttttgtttgtcctttctgtttttttttctttctttcttctgtttcttttttcttgacatctttggatttttaacattccattttcatttgcctcttgactttttggctatgtctttttctgtgtgttgtgtgtgtgtgtgtgtgtgtgtgtgtgtgtgtgtgtgttgtgtaattgctccaggtagtaaatatatttacttaaccttttattatcagcttagagttaatattttatcacttcacatagaatgtagaaggcttgcagccataaaagtccctttaccctccccccagagacatttatgttacagttgtcatatgtgttatatttatgttgaaaccctactacacagtgttacagtatttgctttcaacagtctacatattttaaagaccctaataggaaaaataaatttatatttactcagatgtttgccatttcttttgctctgctttcattcttaaagatctcagcttctctctaaaattttcatttgattctttttaaactagtttttctttctctgctgataacttgtatctttccatgcatttgtgtttgtgtttgcctcatggaaagtaggtgtaatggctgttctacagtctttgtgtgataatctcaacattttcattgtcttggagttggcatctgttgattgcaattttttttttttaagaatttgtcagattttcctacttctttgtatgtccagtagttttggattatatcctggacattgtgagtttcatgttgtatagatgttgtgtgctgttgtaatcctctgcagaatgctgtttgtttcagtaggtatctaacttggttagatctgccttggttatataccagactataaattctctatgctgtctgtggacaggggttcctttctcagttcagttttcaagaccagtgagtgctgtgcttctttgagcctgccgtgcatatccatatctcaggtgtgagcctaagacaagcgggagttaattcacacaatggcaggtcccatttctaccttctttcctctctggttttccccacactttacagcccacaggtgcctttttcattagttcctttaaccacaaagaccgtgtttctgttggagttttagtctctgcacctgtgcttcactgcatagctccctgactggggcccacctgtggggcagagttgtagagaaaagacaaaaaagaaagtttttactccatggaaaggaaactttttagaaactttttactcacctcccaaatctgcctgcttttgtctacttcttattgtcctcaagtattatagttacattttgtgttctgtctgctatagcagaagcagaactctggtttgtgacattttattttatttttatttttgagactgagtcttgctcttgctgcccaggctggagtgctgtggcaggatctcggttcactgtaacctctgcctcctgggttcaagcgattcttgagcctcaccctcctgagtagctgggattacgagtgcccaccaccacgcccatctaatttttgtatttttattagagacagggttttatcatgttggccaggctggtcacgaactcctgacctcaagtgatccgcctgccttggcctcgcaaagtgctgggattccaggtgggagccaccgtgcctgaccaggttttgtgacattatttaatgtgttggatatgtgattattctttttcaacatggtagcctttttttgtttttgtttttgagacggagtcttgctccgtctcccaggctggagtgcggtggcacgatctaggctcactgcaagctctgcctcccaggttcacgccattctcctgcctcagcctcccgagtagctgggactacaggcgcccgccaccacgcctggctaattttttttggtatttttagtagagacggggtttcaccatgttagccaggatggtctcaatctgctgacctcatgatctgcttgcctcggcctcccagagtgctgggattacaggcgtgagcaccactcccggtctcaacatggtagccttttacaaattactatatttttttcaaattgtagtaattcatacagcaagcatatataatggtaggacaaaacaccttaagccaagatgtcatctccatggtctgtccaggtagcatagaacacaaaaggagatgtgattgaaagatgttgcttcatctacatgtttctactattgtctggggttccttaggagccaaggagaacctcgctgtgattggcattggaaagacctgtggttggaagaaaattacctgggaacattccagcctcatcttttttttttttttttttttttttgagacggagtcttgctctgtcacccaagctggagtgcagtggcgctatctcggctcactgcaacctccggctctcgggttcaagcaattctcctgcctcagcctcctgagtagctgggactacaggcatgtgccaccacaccgggctaattttttgtttggtggagacggggttttaccgtgttagccaggatggtctccatctcttgacctcgtgatccacccgccttggcctcccaaagtgctggaattacaggcgtgagccaccgcccctggcccagcctcatctttaagccataatttggctattgtgttagtgaataaacctgaaaggtacatcttcattcatacataaacataatttagttttcattaggtagattccttgttcacatccagctgagaacatgacactaaagaaatcgggctttaattggggagggaaagagagagaacgtggagtccctttggttgtcacttaagagatacagatgaaggagaagtagagttggaggtcagaagggccagaaggtaaatgtagtctaatattagtcatagtgaggtgaaggcttttggagggtagagattcacctagggtgagaattatttcctaagttctagagtagcatggtaaataacaaatagtcttaggtgctttgtcaggaactgataatgactacaagtatatttgaaatcataagagttatatttatgtttgctgtgatcctctcatagtagctgtgaaatatttaaagtaaggcataaaattattatatctatatctatatctataagtaaaaatggtctattttaatgccttcagtatcatagttgagtattaagctaatgctaacttcataaaatcattttttcctaagataatttttgagatttataggaaggtagaaatgcatgcatttcctctggatttgccatttgttgcatagtattatgtataacattttcttaaacaaaaagcttaaagaaaatattagcaaatcaaacctagctgtgtagtgaaagaataacatgcatatatgaattggtctattgtacaaattctaggataattcagtatttgcaaatatgtcactataattcagaatgtaagtaaaggagaaattcattatctcactagatgcttaaagaaagcttctgaaaaaaatttagccatttcttaataaaattataaaaaataggaatagaaggaaactacataaatatggtaaataatctttactaaaatacaacaacaaaccaacctattaaaatatgaaataccaaaactgtcactgtgaaagtcacaggcaatacaaaaattattgctatcacaactattttgtatagcttagtattattgctttgggctagtaatgtaaggctaaattctttatttccagaaaatataggtctaggaaatctaaagagattcatatgtgagactattagcactaataagaaagtatggtaaagtagctggatacaaagaagagaaatcaataacctctttattttgcaacacagtaaaaaaatggaagtaaaactgaatgaacagaatgtattctcatatatattaaatatctgttttactatgcatttaaaatccagagcttaccatttttgggaaactctacaaaaagatatatgacatgttgattccaaaaggattttatgaggactaagtgagataaaacacactaaaatgttcaagagaattatcaaggttgcctatacaatatattgaatgagaaattgtcgaggaaaagaaaggcagctgcaatttctaaagggaatctacagtgagaagtagtctgattcacaaacctctggttaaatatggtgtcttgactacacttgttttctccttccctaaagtctgcaataatctcaaaggaagcttaaaaatgttaattcatagctgggcagatggggtgttgtcacctgtaatcccagctacttcggaggcagaggcaggagaattgcttgaacccaggaggtggaggttgcagtgagccaagattgcaccactgcactccagcctggggacggagtgagactctgtctcaataaataaataaaataataaaatacataaataagtgaaatcttaattcataaggagaaacataacagtaaaggagacagtgaccaaagattttaacaatttttcaaaacagaaagtgaatggagggagtagtaactgagttcacagagaaagataccacctaagtacctgcagaggtcagttatggagataacagcatgccccagggatatcttgagagagttccttgtgcttgggggctccacgtattccaaaaggctgaagtcagttttacagctcacagtggaaattccttaaaagtccatatccagatctcttagaccttcctctcctacactccagcagatgggtaactacttcagtcccgtctgctggggaaatgggaggagcgctagaaccggaagtgctccagactagagaggtgaagcacgggattgaaagtcaagtgagcctgtacaggtctgcacactgaagtgtagggccctacctccttccttcttcactcctcctcaaggcagcacttagatgagttgatcccttcacaccccacccagcagttcgttctacctggcaaaacttaacagcttcggtgaagaaacctccacattactgaacatttggaggtgtcccaatgaaaaggtaactcaatatacctgatcattttacagagaagcccatcagtcaacaagcttgccacccacgctgagcttgggcagttttttagtgcctcattattaaatatggaggcgcatccagggaccactagatatacaaggaaaaccttaaaagtgaaagagacgaccgagacaggcggatcacaaggtcaggagttcgagaccagcctggccaacatggtgaaactccatctctactaaaaatacaaaaattagccgggcatggtggggcgagcctgtaatcccagctactcaggaggctgaggcaagagaattgcttgaacctgggaggcagaggttgcagtgagctgagatcgcctgggcaacaaagcaagactccgtctcaaaaaaaaaaaaaagtgaaagagacccagtcaatgagccaatgaacaaaaaaggaacccagaggaatccaatgatccaagaaacagaagaacagagaacaagaaagtgcttttggaaatttaaaaatgtgatagttggaaaaaacttctgtggacaaattggaagatgaaattgagatgtattagggcaagagactcattttttttaatttaaatttaagattttaaatctgtgagtatttagtactcattctttttttttttttaatttttgtttttgagacagggtctctctccagttgctcaggctggagtacagtgacaccgtcttagctcactgtagccttgacctcccgagctcaggttattctgccacctcagcctcctgagtagctgggactacaggctcatgcaaccacgcctggctaatttttgtatttttactagaaacagggttttgccatgttgcccaggctgatcttgaactcttggactcaagtgatctgcccgactcagcctctcaaagtgctgggattacaggtgtgagccactgtgcccagtcaatactcatttttaactgtgcatttaccctgttaaattaaacgtaaggaaaaatattcactaaatctggatttttttgagacggagtctggctaagtcacccaggctggagtgcaggggtgcaatctcggctcactgcaagctccatctcctgggttcacgccattctcctgcctcagcctcccgagtagctgggactacaggcgcccgccaccacgcccagctaattttttttgtgtgtgtgtgtgtttccagtagagatggggttttaccgtgttagctaggatggtctcgatctcctgaccttgtgatccgcccgccttggcctcccaaagttctgggattacaggcgtgagccactgcgcccggccctaaatctggatttttgtttttagttagagaagaggactggctttttttcacatcggctgttgatgaataaataatgcctgatggagatttttggagcattagatttgtgtttggtagtctgggacagatgttagtgtaatatgcattgtttacaggatatggagttagcaggacagctaactccacagcgtttggtcaccaaacgaatgatatcgtgctaatcacgtaccctttctgattttcatttacctgatccataatatggggatggtaataatggtaacctatctcacagggctgtgatgatgagtagaagagataagacctataataaattacctagtataatgtgtagcatgtactaaatgctcaatgaaaagaagctttgattataaccatcaagtagatggactggtaattatagatggttaagaaaaaggtacagtcagccctccgtatccatgggtttcacagagtccataggttcagcctaccatagattgaaaacatttgggggaagaaattatgtctatactaaacatgtacagacttttaagcttacagaataacagttgtttacatagcatttaccttgtattaaatattgtaagtaatctagagattatttgaagtatgcaagaggacgtgcttaggttatatgcaaatactgtgccattttatatcagggacttgaggatccacggatttttttttaatccatgggaggtcttggaaccagtgttcctgggataatgagggacaactgtatacttaaaaagtaacacgtgaatgaatgaattccttaattgtagagctatgctctggctctagtattagtcctctgaccattaaagatagcatgttggtgtgtttatgattatacaggaattaagttttcataaacttaaatgttgcattttcacttacaggcgtcgattagcaaggtaaaagtaacagaaccatggctcagtttccaacaccttttggtggtaagttttcagaaatttctctttttaatgtactttgggaccagattttaaaaacttgatattatggcaaatttaaaattaaaaagtagagaaaataatataatcagcattcatgtattccatcatatagtttcattaattatcaactcatgcccaatattgtttcatctggattcttttggagcaactcccaggcatcatttcatctataaatattttagtatgtgtacctaaaagataagaaaacgtttaaagacataacttcagtaccattatcacatctataaaaatttacaataccgggccgggcatggtggctcacgcctgtaatcccagcactttgggaggccgaggctggtggatcacctgaggtctggagttcaagaccagcctggccaacatagtgaaaccctgtctctatgaaaaatacaaaaattagccgggcgtggtggcaggcacctgtagtcccagctacttgggaggctgaggcaggagaatgacatgaacccgggaggcggaggttgcagtgagccgaggtcgcaccactgcactccagcctgggcgacagagcaagactccatctctaaataaacaaacaaacaaacaataccatattattgtacctgtaaaatgttcgctacatctagtctgtaccttatagtctttggacatttccctgatagtctttagacatttcttgttatggtttgtttgtttaaattgggatccaaataagatacaaacattgcaattaggtcatgtgtttcccaagtctcttagtgaattttcccccactcctctgtttttttatcagcaagttatttgttgaagtgatggggtcatttacactttttcaaagcctggatttgaagcatgacatttttgtttgttttacttcagttaaactaaacataagtttgaaacatatcagtctgcataaaatgtgttttttgggtaatttttcctaatgttattaggaaattgttaagtgttcttgcttacacccaagttactttttaacaaaaatacttattaaaaagtacttattaaaaaatacttattaaaagttcatattaacggattactcttggaagctgtctaatcttgtcatgaagagagtaaaagtctccgtgggattctggtacagagatctgtaaacttttaaaaatcactagttattctattttatttttgtcccccttcttaattactgtacaatttctggtttttgtttatagttacagggatgaattctgacagggcagtgaaaatttcttctagaagttgcagaactgtaaggcctgtgaggaaggggtcatttctgtcttggacacccgttcatccccacagtaaatatttttccagtgactgaatggatttttactttatctgtcagtgtcatcccagacccggtagagaggagagatgcaatgtttagatgtttttgctggtgtgctgggcacattcacattttgtgtgaaacatacgtattgtgtattcccagttttgtggaaggtgtccgagcttttgaaagctttcatgtatgtaatctagaattattttagtcaatttgaggagacctaggactaaagtctgcaagatctcagtcgtgagtggacatctagtcagcctaagagctgaaactgaaggaaaacctaaaacccattctctttggctattatttcatatcaggacatcccctgcccttctttttttttaagtctgtttcctgcatactgagatacctgtttttaaaaacagctttagtgaaatataatttatattccataaaatttactagctttagttgtataataatttttagcaaattatatagagttgtgcagccatcaccacaatctaatatattaatattttaatcaccccccaaaagattttcatggatatttatcacactcaccttcttctttcataacttttgcctgtggcatttaaggcacttgagagtacagttttaggtttaagttaatttagtctgttgcttgggtttatgtaagtaaattattaatttactataatcttgctaactatgggattataaaacaagtttctaaaaaaggaatgtgtgcctcttcttttctttccctcccattctctctctttctgtttcttacattttgtgtcctgttttacacttttctaactttatatgcataacttccaaggacaagaagatgtgaatttatcaagtctttataatacattgacagaatcttgaagtgctgtggaaatagtgtgtgagagcattttgttttccttttctcactgaataatttgtttgtcttttctttggattttaggcagcctggatatctgggccataactgtagaggaaagagcgaagcatgatcagcagttccatagtttaaagccaatatctggattcattactggtaatcacagtcagcattttttcatttttacttatcagtagtgcagatgtctgtggaaactctatcatgcaaagacgagatgggcaaatatgaccaaggagagacatttacctgttttgccctaaccttgtgcctgtccttttacaatttttttacacataatggaatcataccttgtttgcaatttttagtgcatgtcaaaccacttgttttgtgcatgtaatttatgggaattggttaagatcaaaggaccaatggctcacacctgtaatcccagcactctgggaggccgaggtgggcagatcccttgaggtcaggagttccaaaccagcctggccaacatggtgaaaccccgtctctactaaaaataaaaaattagctgggtgtcgtggtgggcgcctgtaatcccagctacttggaggctgaggcaggagaattgtttgaaccctagaggcagaggttgcagtgagccgagatcacgccactgcactccagcctgggtgacagagcgagactccatctcaaaaataaacaaactaattttcctgtttgattatttttcagaattcactttataaaaagtggaatctttatttccaggggaattgttctgctaccatgcccagctaattttttcttcttctttttttttttgagacagaatttcgctcttgttacccaggctggagtacaatggcgtgatctcggctcactgcaacctccccttccagtttcaaacgattctcctgcctcagcctccgaagtagctgggattacaggcacccactaccatgcccagcttattttttatatttttagtagagatggggcttcaccatgttggccaggctggtcttgaacttctgacctcaggtgtcgttcttaatcattgttatttattctctgtaaatacttcagaagtacccagaatttggagtataggtattgggaatggcaaataactttttttataaagtgaaagtatgggtcatcagtttcctaaggatttctataaatgtgcttttgcacaatgggtagctgttcatatcttagttaatagcagattaattaaagtggaaaatctatgccaggaaatggtaggccctttttgagatgattttttgaattctaaagtcagtgctgatggattcttttactgttgcctatgggcttatccttggacttttataatgcactcaactggtatttatagtattaccagcctctttgtaaattttgtaattttgctattacaggatttctgtcagctgttgtttttttttttttttcctgaaactttttctgtttaatttacaggtgatcaagctagaaactttttttttcaatctgggttacctcaacctgttttagcacagatatggtaagttggaattttacatgaaattttacataagcataaggcaaaataaaatatcgttttgttctatttggtaatatgatttcttatgttataaaaggagaacatgtatctctagcctgaaatatcttgttacttcttaccagagagttatgtctgaaaagtgtctttctcatatggaactaaaacaaaacaacaaaaaaagtggtgacatttgaatgacaacactgtcaaaaagttgaatttccatggagacatctaaattttggtgttccttcaccaattagttttggcttcacccatatcacccacatttatttgaatgtcccacatttcttgctttataatggaatgattttttatctttcattgactgaagaataaaaggtaaagaaaatatttgagagttagtgcatggtaaatccataacattaatagataatagtgaattatttgactatcacaaataggcattcaatcttttaagccacaggaaatacagagagtataataaaaagggtggcaaatacagttttggattcttggctcatggctttggagagccatgctgaattctgttgtcctctaagatgtctcatttttttcaccaagggtgcttaatacttcacttccctgagttaattagtgatacgaaggcagctcgctatgaagaaagagcatgtaggctgggcgcggtggctcatgcctgtaatcccagcactttgggaggccgaggcgggcggatcacgaggtcaggagatggagaccatcctggataacacggtgaaaccccatctctcctaaaaatacaaaaaattagccaggtgtggtggcgggcgcctgtagtcccagctactcgggaggctgaggcaggagaatgatgtgaacccaggaggcagagcttgcagtgagccgagatcatgccactgcactccagcctgggcgacagagcgagactccgtctccaaaaaaaaaagagcatgtgatttgtagtcgtacacctgagtttgattcccaggtgtaccattttcagtgtctctgatttggagatacagttaccctctttgacctcaagttttctaatctagaaaataggaatggttatagttttgtgagagttgttgagaggattccagaaaaaccaaggacttattgtggctcctgtcacataataggccctcaaagtaaaacccaaaaaggtatcatctccaggggctgggtattctacataactgaattttccagctaactactttgtcctcttaaattaccaaacttttaaatttataatcttgtggaaattaataaaggttgatacagctttttgtttcttttaagcacagtctacagaacacaatctaagcttttcttgatgaaatgtcatcattatgaaaattagtaactgtcctgaaatagcaaaactttcacaggagattgtgtgtgtgtgtttgtgtgtgtgtgtgtgtgtatttggatatatttgaattgaaacgaaatgataccagatctctgtgctttttttgggtatctgctttattttctttttcctggttgtcagcatattggccgccagactgtctctaaactagtgtgcttgctcctctgaagccattctaattctaacttctgatctattagagctaaaaaatcagataaccaagcggttttggaattacagtttaagtaaagtaagatgctcagatgaagaaacagcctgcaagaaagaagtcatgtgcaagtgagcacagaagccctgttctgtcagttaaatgtgaaagtttaaacgcaagagacctgtggcacctttgtgaattttaacaagcttctgctttgcagctcatacatgatcatgtctcataccatcaggacctctcgctggaaccttcttccgcagacttaacttcctccactggattatgcttttgtgttatattcccaatttttcaaagttcatttattctttcaacattgaaaaattatttatcagatatctcctgtgggccagggactgttaagaggtgctgcggatatagcaatgaacaaaatagacagaatccattcttttactgaaacggcagtctagtggagggagacaataacaacacaaaaattgtcacatggtggtaagtgtggtggagaaaaataaaatacactctaatgaatttcattttttttcttctgttttttgtaaaggtgggatcttgctatgttgtccatgctggtctcgaactcctggactcaggccatcttcctgcctttgcctcccaaagtgctgggattataggtgtggccaccatgcctggcaaagacaactgtcttaattgaaaaaagtgacatttggctgggtgtggtggcccacgtctgtaatctcaatgctttgggaggccaaggtgggagcatcgcttgcgcccaggagtttgagaccaacctgggcaatataatgagccctcatctttaaaaaaaaaaaaaaaattttttttttttgtttttttttttttttttttgagatggagttttgcccttgttgtccaggctggattgcaatggcacgatcttagctcactgcaacctctgcctcccggcttcaagcgattctcctgcctcagcctcctgagtagctgggattacaggcgtacaccaccacgcctggctgattttggtatttttagtagagatgggatttcaccatgttggtcatgctggtctcaaactcctgaccttgtgatccacctgcctcgacctcccaaagtgctgggattacaggcgtgagtcactgtgcccggccaaaaaaattttttttaattagctgggcattgtggtgcatgcctgtagtcttagctgctagggaggctgaagtgggaggattgcttgagccctggagtttgaggctgcagtcagctatgattgtgccttctagcgtgggtgacagagcaagaccctgtctctaaaaaataaaaacagttgtcctaactttctaaactatttttacctgagtggcccaaagtcaggtttttataatgactatgtatattaattaaagatggtaatgtggcaatcttagattgaatgaatctttaatttttttcttacgttttgctaaataaatttgtgatggcgtattttactatcaaaaatgtctgtaactctcttttcccaaaagaaatgtctttgaaaagtcattggaaatttcatgaaccactgatatcctgcccagatgatggaataatgcagtgcaaattatgagtttagcaagatctgcctttcaactgagctgatttgatacttattcacatagtaaccctgagtagtacttgatctcttaaagcctaggtttttttgtttgtttgtttgtgtttatgttttgagacggagtcttgctctgttgctcaggctggagtgcaatggcacgatcttagctcactgcaacctctgcctcccaggttcaagtgattctcctgcctcagcctcccaagtagctgagattacaggtgcccacgaccatgcccgcctaacctttgtatttttagtagagacaggttttcaccatgttggctagcctggtctcgaactcctgacctgaagtgatctgcctgcctcggcctcccaaagtgctagaattacaggcatgacccactgcagccggccaagcctaggtttttaaaattgcaactaataatagctgatctaaagaagcagctccctccaacccccatactatttttatgttcttctgtgatttttctggtagggtcccagggtaagtccttactccttttggtagacggaagaatgggtttgactctgaagttttaggcagtccttgtgtcagtcatctggggaagaagataattttttgcttttttgtttgtttttgagacagggtcttactctgtcaccaagactggagtgcagtggcatgatcatagctcactgcagcctcaatattctgggctcaaacaatcctccggactcaaacaatcctcccacctcagcctcctgagtagctgagtctacaggcatacaccaccatgcctggctaatttttgtattttatgtagagatggggttttgtcatgttgcccaggctggtcttgaactcctagattcaagccgtctgcccgcctcagcctcccaaagtgctgggattataggcattagccatcacatccagcaaagaagagaagtttggattaagaattggaaactgtgtctagtttctctctctgagctttacttactttgttctggactttgtttcaaatatttgagtgatacgaactgatggacagtatatgttagaaacctttattatgttttatttccatgtagaaactatattccagttaactaatttgttaactttcaactgtaatctgttaatgctttggggactccttgtctctcctggctgatttccaattaagaatacaagaaaaccttaattctcggaggatggagtcaagtcagtgtgtgtcatgccaaattataaccgtggccaaagatggtacatcttcctagaaattgtcttattaataaggagctggaaggaggttggcagatatccttttggcaattgaagtgcttagaattttttcaactttgctatgatgtggaggggaggagaataaagcagtgggaatagacaagagccagaaggtacaggaaggaagaagagacggggtgaagaggctggatgagggctctggaatctgagacggagggccagcagaaatggagagaaaagagggagtgagggagcactacctggaaatgggccctgagaggaaagaagggagccagacacatgaaggcaaggattagatcaactttgtgatctggttcagaatgggtgtcagggcaaacagccatatagtcatagtttgtactttcttaagacactcctgagtatgtgtcagaagggccttcagccccaacaagatcaatttgctaaactcatacaaaaaaaaaaaaaaaaaagaataagcaccctggactcttgatcccctctcctccatccctcattcctgagtctttaccatccagtagctcatggcgttgaactaagatgacatcttagttacctggctgcccaaaccaacacctgggcaccgtgcttgatttccctcttttcttcaccctgcatacccagtccatcaacgtaattgcatttacggactttatccccaatctggccacttctttcctactgctaccatcctaacctgtcatctcacctgggcccactgttcgagcatctggactgggttctctctttcacacttgcccctttagagtctagtctccaaacagcagctggaattttttttttttttttttgagacaaagtctcactctgtcgcccaagctgggcagtggcgcaatctgggctcactgcaacctctgtctcccgggtctaagtgattcttctgcatcagcaccttgactaactgggattacaggtgcacactaccatgcctggctaatttttgtatttttagtagagacggggtttcaccatgtcagccaggctgggctcgaactcctgacctcagatgatccacctgcctcggcctctcaaagtgctgggattataggcatgagccaccgcacccggccaggaataatcttttgaggagtgcagtggtgcgatctcagctcactgcaacctctgcctcacagcttcaagtgattctcctgcctcagcctcccgagtagctgggactacaggcgcgcgccactatgcccagctaatttttgtatttttagtagcagggtttcaccatgttgggcaggatggtctggatctcctgacattgtgatccgcctgcctcggcctcccaaagtgctgggattacaggcttgagccaccctgcccagccttcttcctgttctttaaatgggccaggtttctccttgcctcagggtcattgtacttagtgtttcctcttcctataattcagttgctctagttcctcacatcgcaggttcattgcctttcaggtttcagttcatatgtcacctccccaaagtggcattccctgaccagctagtgtaaagtggtcccctctgcccacctctttccctttaccttggtagcacttatcaccatgtaaaataatctggtttgttctcttgttagttctgcttgcactaaaatataagctctgtggtgctaggaactgtgtctttttcatagatataaccccaatttccagatagatgcccagccccccactcccccctgccccataattggtttttgaatgaatgagaatgaatgactggattagtctgcactgctgctgggtctcacctccagcccaaggggcagcaggtgagagatgagcagcctgaggccaggctttgtggatgaactgggctcctaaaggaatctgtaggtgccaacactgcagggaatgaggtgggacaagaggagcctggcctcatcccttcatcctgtaacacacacaaagtagtttcagaattgttacattcacctccactacaaacaacaaatttaggcccagtgcagtggctcatgcctgtaatctcagcactttgggaggtcgaggcaggaggatcacttgagcccaggagtttgagacctgcctgggcaacatagtgagaccccgtctctactttaaaaaaaaaattatccaggtatggtggcacatgcctgtagtctcagctactcagaggatggggtgggaggatcacttgagctgaggattcaagcctgcattgcgctatgattgtgccactgtactccagcctgggcaacagagtgagaccctgtctcaaacaaacaaacaaataaaaaaaaaaaaaagaacctagtaagtagtgtaaaccaaaaagtatctgagacaagaggtctcaatcattttaggagtttattttgctaaagttaaggacatgccgggaggaaataagcacagaatcacagaaactgtgcttttctccaacgatgattttgatggcttcagtatttaaagggaacaggtaggctggagggcaaagagggaggatatggtaatccatatattgccagagaaaaggagcaggcaggggaatagtcagttaggtaatagtaaatcagtaaagtgctcagtaagtcggcactttacataagataaaatggaacataaagtagcctgtagaggtgtttgaccttttatttgtagctccctgcttaggaacaaagggactcagctttcagggactcagctttcagcttacttttctaccttttgcatagtgaattgaagtcctgcgtttttattttcctttcacagtagatttcaagattactttgtagttccttttgtttttaaacagaggacatataaagtactatgtgaagttacttggactaggcttttttttctacctcttacgtggatatgttagttatttataatatgattaggtttattttcatttttatttaatttagatatgcctcctcatctttgtggacttaattttattatttaaatacataacagattaaaaaggttctaaaaaccgaaactaacaaaaaggtgtgctcagacaaggtcactccctcttctatccctttaccctgtttccacccattgtattagtttcctgttatccttcatttatttttgttggaaaaaagcaggtacataatgtatataacgtgtatgtattcatatttaaattacttcctttcctccttacattaaggtaacctgctataaatgctctctgttcttttttttttttttttttttttttttttctggagacagagtcttgctctgtcacccaggctggagtgcagtgacgtgatctcggctcactgcaacctccatctcctaggtttaagcaactctctgcctcagcctcctgagtagctgggattacaggcacgtgccaccatgcccagctaattttttgtatttttagtagagatggggtttcaccatcttggccaggctggtcttgaactcctgacctcatgatccacccttctcggcctcccaaagtgctgggattacaggcgtgagccaccgtgcccagcctgtttttttgtttttgtttttgtttgagatggagtcttgctccgtcacccaggctggaggtgctatcttaggtcactgcaacctccgtctcccaggttcaagcaattctcatgcctcagtctcccaaatagctgggactacaggcgcccgcgtgcccagccaatttttgtgtttttagtagagacagggtttcaccttgttggtcagactggtctcgaactcctgacctcaggtgatccacctgcctcggcctcccaaagtgctgggattagaggcatgagccaccgcgcccagccgtaactaccatatttccataaatttcttagaattttcattaccagggattccccacagttatgtttattgagaaaagcgttttttgagtatcacgacattttcaactaaatgttgggattgtcgtatgtggtttaaagtcaagtccctagaacctcatggttaagtttcttctcctcacccatgaaaacacttctgtaggacacctttagagtctaattaagccattacctaaagtcttctcccctaacctactcattatcccacactggatattcctgtttctcaccagagaccatactgggcagtggtgtggggaacagggagtgggcacctgcctgactgattgattggttttagtgtgcatgttgatgttgatttttattaatgggaactcttccccaccaaaccgttttaaatagttgcgtatcttttaaaaaactacttagcaaaagaaggaagttcaccatttcattttatttacttagtttcctttataaaacctgaaaggtagtacaaaaataaagcaaccagaagccagtttcatttatgagcatagatccaaaaaagtcaaaatcttagcaaatagaatttcacaatgtatgaaaagaatacacaatgaccaactttatgccagaggtgcaagattggttcagagtcgaaaaattctatcaacattagtcattatttcagcagataaaaggaagaagaaaacttgtgatcggattggtaattacagattaggcacccgatgaaaaatacagtaaccatttctaataagtagaaaggaaactacttaaatatgtgagactactatccatgaaaagagtcaaactctgtaaaatatttgaaaaggtttattccaagccgaatatgagtcaccaatggcctgtgacacagccctcaggagatcctgagaccatttgcccaaggtggttggtatataacatggttttatacattttagggagacataagacatcaatcaatatatgtaaaatgtacactatttcggtctggaacaatgggacaactggaagcagaggcttccaggtcatacgtggattcaagagtttttaattggcatttcattgaaagagttattatccaaagagctggaatcaatagaagggaatgtgtgggttatcataagtggttttggagaacaaagttttgtcatgcgggtgaagcctcccggtagtagacttcagagaaaatagatggtaaatatttcttatcagactttaagagcctcctttatcagtcttaaggcctgtgttgatgctaatgctggtcagctgggcctgaattccaaaagggaggagggtataatgaggcatgtctgacttcctcttcccatcttggcttgaactagtttttcaggttaattttgaaatgcccttggctgagatgaggggtccattcagatggtggggggctcaaaattttgttttcagtttacattactttccagaaatcactaccaactgtcattctaaacaatgaactctattaaactattagctctagtaaatctactgtttcatttaaactcagaactgagcaagaacgcattcagtaatgtcttagaaggcagtaagaccaataaaaaagattggcctaaatattggaaaagaaagataatgctcatttttttctagttatgtgattgtatacttagtacacccaagagattttagttttaaaacattaataagaacttgtaggagtctggtaggatagctaaatacagcctaaataattttttaaaataaaaaatgttctctgtgcttgaaataagcacctaaaaatggaaatggggggaatgtttcatctaaaatctggcaaaaatgataaaattcttcagaatacatttagcaagaaaagcatattatatgaaaaaagtgatacaattttattaaaggaaatagtatatttgaacaaccggaaagattgtcttttctttggttgggtaaactattggtgcaaaagcaattgtggtttaatcaattctccaaaaatccccttctaaggcagtttttggatcccagtagggttgtttgtataacagataaaataatctaaatgttcataggaaaatagacacccatgaataaccaagggggaaaaaaaaccttcccagaccttcccggatcacaatataccagagagccagtgtgatcaaatcattgtaatattgacctggaaattgttcagtcagaacagatagtccagaaatagttctcacttcatatgaacatttgatacatgataaaaatgtatattagttcagtgagaagaagagggattgattaataaatattactgggaaagctaggaatccatgtagaagaaatgtgattggaccctggaataactcccccacccctacccataattattggtttaaggattgaaatgaaataaaataatacaatgttagaaaatcaaggactaacaaccttctaatcatatgataaaagaaatattttatatacaaaaatttagaatttttatgccgtacatatacataaatcaacaaataatgaatttttaaaagtctttcagcagtcagcagataaacagttaatttgtgatacactatgagctcttataaactaacaacaaaagacatgcaatatatagaaaatttggcaaaggatttgaataagcagttcatagaagtgcaaatccaaatggccacgaaatacagaaaaatgatgctcaggttcacaagtagtgagaagaattcagattctgaattctttgctgaagggcccatgactacaggagaatggggaactcctatctgaggcaaaaaggtttctgcaaccacagagctttgtttcctgcgttatgatccttattttctaaaatgtgccaacttttacaatcttgatcacttttagagatttttttatctttgtcttatgccatactttttattgtgttacatgttttctttctttgagttaattccagctatgcagaattgttttctgtgtaacttaattttcttttgtgaacactgtccggatatggctcagtctaaaagatcatggtattttaattgaactgtcttatttagatctttcaaatacatttttcataatattggtttaaaaaaatcctcatgcttttaatatctggattaaaagaaataaaatctgaataaaacttttttatgcagaagaggttaagtcatgaatatgcacagttttgatgatataatgtagtttccagttacaaggacaaacttttgcttacttgatcttagccaaaaggccgagaagcgattccttttgcttactcttctttgagaaaatactttacattaaagctcattacagtttgcacttggaccgtgtatatttgagtaccattttcaaatagcagacacattttgtaagctaacttacaaaattgttgagtgatatggggcatgattctaaagaaaagttagtttcaagagctttagaggtttagtagcattatagttgagtaaccctagcatagcataagtaggtagcatagcatactgtgtcatgttcccacattgaggtttgtagagctctacaaagaatgcaatctaagtatctctagcaatattaacattccgcttctaaatctttttcttttctaatagctttattgtgaaagaattcacataataaaatttactcgtttaaagtatctaattcattggttttagtttattcacagagttgtgcgacagtcactattagctaattttagaatgttttcatcacttcagaaagaaaccccttttgatgtctaaagtacaaatcctcacactgaggctgaaaattacctgctaaagtggcagagtgaaagatattttatgtttatataaaacttggccagtatttacaggctattccccatagtttggtaaacagttatgttttctgttgttgtctctaggggtaagagtgctaattattttgttttcgtgttggtgggagtggtggttttggaaaggttcttttatggtcacagttgttctcaggccatgctgttggtttgcagggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtaagtctgaaaatgaattggtttctgtattttcttgtatattttaaaaataaatgttttcctttttttccctctcggtttataacattatgaaattctaggaggtaattctgtctgaaaaatgatggccccctgcaggaagatagtgctggggagaagaaggagcatgttcacatttgaaccctgggatgtaaagtaatcaaaatgaaagcagagatgcaggccgccagtcaggggaaaaggaagaaacttacagtccgctgctgcagcttctgggtttttttttttttttctcttccattatccttcaggttgttgcatacttccttttgattttcggtttccataatgtctgtttctccttgtgcataaacaattcctttggattatggcatctagaaatatatatattttgaatcacagtactgagtcacttggccacattaaattctttcttagaacaaaatggaatagagaaaaaataaacattgttatcctgattaaaaacctaattccagccgggcatggtggcttacacctctaatcccagcactttgggaggctgaggcaggtggatcacctgaggtcaggagttcgagaccagcctggtcaacatggcgaaatcccatctctactgaaaatataaaaaattagccaggtgtggtggtgcgcacctgtaatcccagctactcggagaggctgaggcaggagaacctgggaggcagtggctgcagtgagccaaaattgtgccactgtactccagcctgtgcgacagagcaagacttcgtctcaaaacaaacgtgattccataaaaaattatctttcaaccaggtatttttcttataagctaattgattaattagttgactgagatcagtagttctgatttctgttctcattctagactttaggttaatttgaagatcacagtaataaaatctaacatctgattcatggggaggttctttaacagtttaaaacaaaacatgaaaattgtggctagagtttcttttcatctcttcatcctcagatagctgatgataggtgataaagtgaaatagatttcggagggggcagtcaacagtaattcagggtgtctctgatataattaatgataagctaagatacagaaatactctggttttacttactaggtttcctattaaaaacaatgtattgcctttcttttagtaagttttagccacaaggctggtttttgtaaggggaaaggttttggaagatttttaggcaaataggatagtggtccaagaaaagaaagaaaaatccatatatgagcaaaggcgaggaagagcagaagtgaacactgcagcagcctccacatgactggggccgttgtttgtcttgtccagtgtgtgctcacaatgtttagcctttagttaaccagctaatttaagtggaacttgctctgaatccctgaagatctctgtagccaatctttggtcaggacccaggcgttaaaataattcaagggtgtttggggtcgaacacagtggctcatgcctgtaatcctaatgctttgggaggccaaagcaggaggattgcttggtcccaggtgttggagaccagcctggcaacataacaaggcctcgttgctactgaaaatttaaaaattaaccaggcatagtggtgggtgcctatagtcccagccacttgggaagctgagacaagaggatcacttgagcacaagaggtcaagcctgcagtgagccaagatcacactactgcaccccagcctgggtgacaaagtgataccctgtcttaaaaaacaaaaacaaaaaacaacggtatttggttttcttttggctttcttccaatgctacaagaagaaatctcatagtggagaaaaggtcaaatgactagaggcaccccatttctcctttttctctcaaacctggggtcaataatttttcctgtaccatttaattcattttctcttattccattctgccatcagaatttcagttgtggagctattgctgatttagtttcaggaggttgtgaccttactgctgagaaagttttacagtcgttaagtaacctgctactgttaaacctgccaggatttctgacctaatactctgccaggcagcccatcactcttccccccagacttctccctgtctttcctcaccacattgatgttctcagtaaatgattttgatgaggctaaaccatgaaggatatcagaacataggagaagttaccagtatatgatcttgatcaagtttacttaagtattttctagttctacctctcagctcaatctagggtaaaatacatatatatattttatagtttgttgagccacttgagaataaaataatttattactattgtcattgttttatttatttatttatttattttgagacagactctcacttagtcgcccaggctggagtgcagtagcatgatcttggctcactgcaacctctgcctcccgggttcaagcagttctcctgtctcagcctcccgagtagctgggactacagggacatgccgcaacacccagctaatttttgtatttttaatagagacagggttccaccatgttggtcacgctggtcttgaattcctgacctcaggtgatccacccacctcagcctcccaaagtgttggcattacaggatgagccactgcacctggcctgctttctaattaatattgaaaattattggttaggtgtggtggctcatacctgtaatctcagcactttgggaggccgaggtgggcagatcgcttgcgctcaggagtttgagaccaacctgggaaacatggcaaaaccccatctctacaaaaaatacaaaaattagctgggtatggtggtgtgtgcctgtagtcctaactgcttgggaggctgaggcaaggggatggcttgagcccaggaggtggaggttgcagtgagccaagggagatcgtgccactgcactccagcctgggtgacagagccagaccctatctcaaaaaacaaaacaaaacaaaaatctgactctgcatttccttgcccttatatatagtatgtgccttcacatataatatttgatcacaatgataaccctaaaaagtatgcagactgtattagccctgttatataaatgagggaactgagattctcagaaattgaacattttgcttaaggccatatttctaacaaaggagatagaacctgtccaaagctaccatttatctaaaggcgagatggagtctcactctgtcgcccaggctggagtgcagtggcatgatctcggctcactgcaacctccgcctctcgagttcaagcaattctccttcgtcagcctcccgagtagctgggattacaggcacccaccaccacacccggctaatttttctatttttagtagcgacggggtttcaccatcttggccaggctggtcttgaactcctgaccttgtgatccacccgcctcggcctcccaaactcctggcattacaggcatgagccaccgcacccggatggctttaggttttttaaaattaccttctccgtgccttcattatcaccaaactaactgggtgacatgacgtgtcactcttccatggttccttgtctgcatgggttttttgttttgagacagggtctcactctgttgcccagactagagtgcaatggcacgatcatagctcactgtagcctccaactcctaggctcaagcgttcctcctgcttcagcctcctgtgtagctgggactacaggcatgtaccaccacactgaagtaattaaaaaattttttttatagatagagtcttgctcttttgcccaggctggtctcaaactcctaatctcaagtaatcctcccattttggcttcccaaagtgctgagattacagcataagccatggcaccaagcctcagatattttttaatgtagttgttaacacactatagaattaaggctcagactggagtctgaacaatgattttgttcaactcccctacagagaagagagaaaaatggggtgcagtgatactgtgacttgccttagagcaccctgaaaatagaattttctattgtaggaaattctatgggtagacttggtaccttctttcaccagtgtgcactcagcataattcttttgttctggacccagcttatacaggaggagtctgtttttcttttgcttggtttttgttttgccagagtacatggttttattggattaaaccagtgttttgtaagcccctactgtgtgtcctagttgctgggaacatgctggccagcaagacctcatggcttctaccactgtggatcttattttcaaattgtggggagcaaggaaataaatacttttaggtgagaataagtgcaataagttcattaaaacagagtaatagtagagagacagagagagagaaaccagtagaacaagatggccagggaagaattctttgagcagatgacttttggaactgatgtagatgatgagagccatgtgaagacctaggggagaggccttccaggctaaaggaactgcactggcaaaagtcctaaggcaaaaactagcttggggtttggaaggtgtgcgaggggcgtcgtagctgaagcatggggagaccataaggaaaagcaagcaaacaacagattaagcagaagagtgacgtggttgatagacttatctgtgttatctgaagactggaatgtaggggacaagaatggaatcctggagatcagttaggaggcttttgccacgggcaagaggcaatggtgatttatatctggtggtgataatcaatgtggaggacagattagattcattctagcctgtattttgggaaaaaagtaaaaaggacttgtcagtagattggaaataagaaatgaaaaaggagtattaaggcttttcacatgaataactagatggatggtataagtgtatactgagatggggataacaggaagaggaatggttttaaaggagaaattaagagttttggtgattttgagagtcctagtagatttccgagttgggatgttaaggagacagggatgactacgtttgactgaagctcagaggaaggatcgatcagctctggggcagtttggatatggagagcatgtcttaggggcaagcttagctataaggagtacagtgtagacccaagccttgatgtgatgtgacatttaaaggtcaggcaaaagaggagaagccagaaactgaggctgacaaaagtgaaatggcagaagattggtgtcctgctaccaagaaaaagtgtttcaagaaggagggaatgctccattgtttgagctgcttttgagagatggagtaagaatatggcagaacagtgctgattagatttgatgtgatgagcttttgagtgaccttgacaagcagtttcagtatagtgatagggacaaaatcctgattggaggcttggaagaggggagagaatttcaagaattaagacttacacaggaagaggtgatggcagccagaatacggcttctggtagatgtatttatttagaaagtcattcattcagaaaaggtagtcagttgtcaaaaggatgatagtctttttgcagtggctatttaaagcacagtaggccaggcacggtggctcatgcctgtaatcgcagcactttgggaggccaaggctggaggattgcttgaggctcctagttcaggaccagcctgggcaacatagtgagatcctatttatatttttttaatgtaagtagatagatagatagatagctaataaatttttccttttctgtaaaatggaaaaattattatgtaagagaagatttctaacaaatttggaagcttaaaagatgcttttaccagtctgatgattaaacagtatttttaaacttggccttttcctcagtgtctttttgaggttagcctccttttaggttaggggtctgcagcacagatggggtacgtgtcttgaaggttaactggttgcgcagtatgctgtgtcaagccttttgaaagtctgaatgatggctcatgaaaacttttggtttgtttccatctatttttatttgttgcttgagtagattgacattcttacttaagcaaaaaccaggatttggagtataattcagtatagttatcaaaagaaccaaatttttaaaaagaaaaacacattaaaaatatagttatcaaataatcttagaaaattttggaattctaaaactgacaaggtaaacctgatacatgttgctatgtgtggatatgtaaagttaatctgattccaaatgagatgtgtggtaatgtgcttgatagtgtgcacgtgaactgtaaaccagtcatctagatgactataattataaacttactcagtaaagcccaagttagaatttttttcttctctttgttggattttcagtgtctataaacattgtttttaaaaatgaaaataggccgggcgcagtgactcacgcctgtaatcccagcactttggggggcccaggtgggcggatcatgaggtcaggagatcgagaccatcctggctaacatgatgaaactccgtctctactaaaaatacaaaaaaaaattaaccaagcatggtggcgggtgtctgtagtcccagctgctcgggaggctgaggcaggagaatggcgtgaaccctggaggcagagcttgcagtgagctgagatcgcgtcactgcactccatcctgggcgacagagcgagattccgtctcaaaaaaaaaaaaaaaaaaaaaggaaatagtctgattttcttactgtataagtaatagatgctgcttgcgagtcaacaatgcaaaaagacttaaaaagtaaaaattactattaattctgttacccagtgatgaccactgtgttcaacaacactatttttaaaatcttttttttttttttttgaggtggagtcttgctctgtcccccaggctggagtgcagtggcaccttctcggctcactgcaacctccgcttcctgggttcaagcgattgtcctgcctcagcctccccggtagctgggattacaggcatgtgccaccacgcctggctaatttttgtatttttagtagagacggggtttcaccatgttggccaggctggtctcgaacttctgatctcaagatccacccaccttggcctcccaaagtgctgggattacaggcgtgagccaccgcgcctggccctatttttaaaattttacacaagtaatacatgctcttagtaaaaagaaatacaaacaaaacagaattgtgtacatttgtaacagtgcaggaggaagagggaagaattagggtacctggtgcacttgaaacaggagaaccccaaaatagctaacaggtatttgcaagaaagttcaaccaggctgagagcagcaatagaaataggaaagggttatgctctctgcagtactgagtgagtacaaaggatctgagagatttggagcagtccagcccctatgaactcaaaagactggcccaacaagccttccttttgggacagggcttcatactcaggaaaaatgactgggagtggaatcaaaattgagcagtatagggacatggatacaaaggaaagagatggtccagacaaaagtaggggaggagaatggagactggaattcctaagaagcaaggctcacataaaaatgagcaacagaaagtatcaagcaaggtcaaatccactgcagaaagtgtcaagcaaggtcaaataacacaaagttattattaggaaaaaggagaataaagggagaaataacacccctgtggacagtgaaagcacaccagtaaatcactacttcaaaacaagctcaaagagaataagaaaatgatacaagacttgaaagatgaaaatcagagtttttaaggctcataaataaggtgacagaaagaatgagaaataaaagaaaaattcattctagaaatgaggatgcaactagaagcaacacaggggatactaactgaagaaaaatagaagttacaaagaggaaaaaaatttaaattaaaaggaaatgaggctgggcgcagtggctcacgcctgtaatcccagcactttaagaggccgaggtgagcggatcacctgaggtcaggagttcaagaccagcctggccaacatggcaaaaccccgtctgtactaaaattacaaaaattagctgggtatggtggcacatgcctttaatcccagctactttggaggctgaggcatgagaatcgcttgaacccgggaggcagaggtggcagtaagctgagatcacaccactgcactccagcctcggggatagagtgagactaggtctcctaaataaataaaaggaaatggaaaagatataaaaagaatttgagaaacagtaacaagtatttaagacaaagaagattgaatgtatgggcagcaggagtccctgaggaagaaaactaaaccaatggaatagaacaaatgataaaaatgaattcaagacaactttcttaaaataagagattctaaactatatttaaaagagtatcatgtggccaagaatatcaatctaaaaagtccaacactaagatatattctagttaaaggagaaattatttagacatgtagaaaaagaaagcatatgacttacaagggggaaaattagattatgttcagatttttcaacagcagtgctttctgctagaagaaaatggagtaacatatttagaattctcagggaaagaacaagccaaggattttgtgtccagaaaaactgactttcaagtagaaaaaacagacaaaacgttaccaatttataaggcttcggggtatattaacatgagcctttcttaaggaatctattagagaatgtgcttcagacaatcaaaatagctagacctaggtcatcataaggactgatggtgagcactaaatatatagttagctgtagagctaagactgaaggaaggctgaggaggagagagtatcggatgtaattcccatgcactgtcaattggatacgataaaactttaaggggagcaggactgcatgcaaaaaaataatttaatgcattcagaaattagtattagtattgttattctgaaactgttgtctgagatatgtggtaaaaacaaataagtaattacggaatagtctaattctgtcattttctatacctttgaaatctgtattcttggtgtggaagaaaggagataacaaatataatagtatcaaatgtaatgaaaaagcagtatagtcttggatttgaattttcaaattgaaagtattaatatgaactcagaaggcgtctctcaccacaccccccattctcttcatctatccatctatttgtctcctagttctgttcactgaaaagactagatacaatcatctaccccagcagcactgagcatccttagcgtccagattgtgaacttgaaatatcatttctcaccaaaagaaaccagagtttcttggagaaatggctgaatccaggtctagatatgaaatgtgaagagcttgaaggacccatcttgtaatactggtcagcaaggaagttatcaaagcatagtaggaggatatcagaaattctcagaagccaacccgaagaggcttacattggccaaagagaggacagtttgaacttcaagaatgataatgtgccatgaattaaaactcaataaatatttgtaaatttatgactcaataatgatttaataatgtatttaacaagaataatttaccttaagaagatcctaagaaaccagttcattaccttgaaaacaggtaaagggaaagaatcaggcatttattatgccttttgtatatgagctgtacaactggatagccaactagtatatcctcattagaagcacctctttataaaattattacagctaataaatgacaaagacatagtaggattagaacatcactattttcaactccccataaatgaataaatataggcgttaagcatcaatgactgccaagatcacaaaaagacagctacattttgtgtgtttcctgtagtcttgccaaagagatccaccgtcagcttgatccattctttggatgtagctgcgtatttgcaggaaatacagaatatagagggaaatgttgaaccgcaccatgagaatgcaatcagcaaaatccagactgggaaactccacaggtcacatggcctgggtctttcaacagaaaagaaaatgaaaaggatggagaggggactgtggattaaaggaaacctaaaagacatttcagcagtgagatttccgaccatgcctgagttgagatgagcaaattcttccctcaagggcagaattgacagaataaccatttcagtgctctggaaattaaccaaaggtatataacatctgagaatcatttatgcctgaaaagctgctgagcttcagatatgaagcagaagtctgttgcattctttcctgggcattttcctatcccccaacacttcagcttggtaatgtggagggacaggttgtaaatattagcagtcttaactgctgtcactgaagggggcttacttgctttgggagtgggaagtcatgcctgtgcccagcagctttgtcagtggaaatgacaattctggccacagaagagcaggtatgaccagccactctattatcctgaactcgtggtcatggccagggcaagtatattcttggctgaggctatgcacatgtgtcgcggagaccagggtgggcccgagtcagctgcaaactcctgactagccctcaaactgcatgcacgtatagagaatatgcagaaaggccctgtgaaatgttaaagttgaggaagactttaaaatggtctgaactttgaatgcatttttgtgctgacagattgtcagagaaaggaagccttactgacttgaggtgtttgagcacaacttccgtcccatcattggctgactactgtgctacaaagatgcaggtgcaatccgtaaaaagccaggcttaaagataaaaacgaattttttaaaaacccaactgagcagaaccatcaggggctgcacaacaagggaagacagatttttctgaattagcctatgccggttactaaataaagatagaaacaacaaccttcagggggaaaatcagagccagagtagctacaatgtattatctgaatgtccattttcacctaaatttgagacattaaaaaataacaggaaagtattgtctcaccctcaagaaaagaggcagtcagtaggaactatctctgatccagctgttggattcatttagcagacaaaggcttcaaagcagcaattacgttcaaagaactgaagaactaaaggaaaacgtggaaatgaatcaacagacagacactctccaaaaaacaatagaaattacaaaaaagaggaaaattgaaattctagaaaagtatgacaattgatgtgaaaagttcaataactggccggccacagtggctcacacgtgtaatcccagcactttgggaggccgaggcctgtggatcacctgaggtagagagttcgagacccacctggccaacatgatgaaaccccgtctctgctgaaaatacaaaaaattagctggacatgatggcaggcgcctataatcccagctatgtgggaggctgaagcaggagaatcccttgaagccgggaggcagaggttacagtgagacgaaattgcgccattatactccagcctgggaaacaagagtgaaactctgtcacagaaaaaaaaaggaaagttcaataactaaggctgggagcggtggctcacggctgtaatcccagctctttgggaggctgaggtgggcggatcacccgaggttagaagttggagaccagtctggccaacatgacgaaaccccgtctctactaaaaatgcagaaattagctgggcgtggtggcagatgcctgtaatcccagttattggggagtctgaggcaggagaataacttgaacccgggaagtggaggctgcagtgagccaagaccacgccactgcactccagcctgggcaacagagtgaggccttgtctcaaaacaaaaacaaaacctgaaaagttcaataactaaaatgaaaaatttaccacagggtcttaatagcagattcaagatagcagaagacagagtcagtgaagttgaagattaatcaatagaaattattcaatctgaagaatatggaacaaaaagattgaaaaaaaataacaaagtttcagagacttatggaacaagaccaagtttaccaatatgtgtgtcatgggagtcttagaaggaggatcatgagagaaaggtacagaaaaatatttgaagaataaaagccaaacacttgccaaatttggtgaaaagcaatagtctacacaatcaaaagctcaacacacctcaagtagggtaaatacaaagagatctacacccagacacatcatagttaacctacggaagccaaacacagagataaaaccttgaaagcagcaagagaaaagcaactcatcatggataggggagcatagatataaataacagcagacttgtaattgaaaacaatggaggttagaaggcagtggaatattcaaaatgccgcaagaaaaaattcaacccaaaattctatattcagcaaaactatcatttaaaaatgaaggtgaaataatgactttttcaaataaacaaagactgagagaattcattgctactagacctaccttagaagaaatactaaatgaagactttcaggatgaaatgaaatgacaaaaggtggtaactttaatatatggaaagaaatgaagagcatcaaaaatggtaaatatgtaggttaatttagaagaccacataaatctatttttcttcttttctctcaagtttaaaagatataagattgtataaagtaataattataactctattattgggcttataacatattataatgtatgtgacagtaatagcacagaagaggagaaagggaattgagctatatttgtgtaaagtttctatattctgccattagaagttgattatgataaattaatttggagattttaatccctacaacaaccacatagaaaattacttttggatgcatacagtggctcagccctgtaatcccagcaccgtgagaggcttgaggccaggagtttgagaccagactgagtaacatagcaagaccctgtctctacaaaaaaataaaaacttagctgcatttggtggtgcgtgtctatagtcccagctacttggaggctgaggcaaaagaatcccctgagcccaggagttcaaggttacagtgagctgtgatcacgtgactgtacttcagcctgggtgagagtgagaccttatctctaataataaaagaaaaaaaagaaaattttaattactattattatgtaataatactcttttcagttagctctctcaggttgaaaagaaaatttacttttaaaaaatagtaaaggtcagacatggtgactcacgcttgtaatcccagcactttgagaggctgaggcaggacgatcacttgagcccagaagttcgagacgagctcaggcaacatagtaagacctcatctctaccgccccaccaaaaaaaaaaatacacgtatatatatatatgaaactgggtgtagggatgcacacctgtggttccagcaagttgggaggctgagctgggacgatcgcttgagcccagaaggtgaaggctacagtgagctatgatcatgccatttcactctagcttgggcaacagagtgagatcttgtctcaaacaaacaaaaatatttaaaaaaaatcaatagggggcatttaaacactaaaatttatttactccacatgaaagaaggtattaaagttgggacagagaaataaaaaagaaggtaagcttttttacttttttttttttttttgagacaaggatctcactgtattgcccaggctggagtactgcggtgtgattgtggctcactgtagcctcaacctcttcggcataagtgatcctcccacctcagccttccatgtagctaggcctacaggcgggtaccaccatgcctggctaatttttaaaattttttgtagagatgggattttgctatgttgccctgtctggttttggactcctgccctcaagagatcttcctgccttggccttccaaagtagtgagtttacaggcataagccactgtgcccagctggaaacatttatttttgttttatcatttcttctttattggttagaatatttttgtataaagatgcttccagggccaggcacagtggctcatgcctgtaatcccagcactttgggaggccaaggcaggtggatcacctgaggtcaggagtttgagaccatcctggccaacatggtgaaacctcatctctactaaaaatgtaaaaatagccgggcatggtggtgggcacctgtaatcccagctattcaggagactgaggcaggagaatcacttgaactcgggaggtggaggttgcagtgagccaagatcacgccactgcactccagcctgggtgacagagcgagactccatctcaaaaaaaaaaagaaaagaaaaaagaaaagaaaatgaataaagatgctttccccatcaaacatgtggtttccctgaggtataataaacataggaaaggcaggttgcagtttgatttttctaccttttatttactagttttcaaagtagtaaattgattgccttagtgtcctccttttttgaccagttaggattttatttatttttaaatatcattttgaactcatggatttaattatatttgagcctttaagtccactgcagttattattctttttgattctcatcttgtttgttctgtcttcaggttgagtcttgagtccttttgatgtgatccttgacataatttttgttactctttaaaatgattaacttgaagccctattttaattggaatatattacagctggaaagtgattttctttaagcagtactgggttaattattattcagtgttgaaatgtgattggatgtgaatggtgttgagctgttttttcttcataggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctggtatgtgacttgctgaaaccataggctgagtttttactacttgtattttgctgttcattattaaaatattttctcttcacgttctgattatgtttaaatgatattttagtccagaggaaaatatctttatttttttcacttgatttcacattttttccactgtattaaatgggatatgttagtgtggagagagtcaaagagaattatagatttctgggtaccactgtggacaaaggtgagctcagcagtgaaagccacaaatgtaattttctttcaagggctgagaagagcaattgaagttgaactgtagttgaacattttctatttttatgtatcagttactacttttctttagccactatgaattgctaataagcaagccaatcccctaggaatagaactatgttgggggttgtgggaaagaataaaaaagaacagtttatactattttatggtattacatgcctgcttaattgaaggaaaggatttaaaagtttctggtttaattaattccactttgagactttattaagtcttttttcctttagttaaagtataaaactgtagatgtagatagccttggtctaacatcttaatgaattcatatcaatatggaaagtattatttttaaagtactttgactacatctaagtaaattcagtattgacgacatgggttttagcatcatacttgaaacatttctgcgcctttggccccctgaatttgttgtatatttatcaggatatatatttaagttatggccaaataagctaaatgtatctcctttttttagattttttcttgtcacatgtagttcatcttgcatatatgaccatgactgtggacatgatggtagcccagaaagtgtgtgcagttgtttttccaggagcataagcaaatccacacactctgagtcttctattcttttgtgactaatggcacatgttgcaagtcatttgccatcaggcaagagtgagggaatgtggctaagacgcagtgttttttttctgacactcaactaaccaaccccagtgataatcagacacaaaagctgaccttccctagtgtcacatgttatctggccaagactacagtttgtgacttcttggctcttacatctggaactaatacttcagctccttcagtgcagtgaataaaataccattttatatatttaagctgttacctctttaactgttggaataggtcctataaaatgtgatacaaaatgtttaatgaagagtaaaattttatggaaatcagcattactacatagtaaggtgattttcagtagaacaagtaaatctagaaacctttttggcaggaggacagagggtaaggagggaaaagctcttttcagtctaggctggcaagaagggggaattatttctgcctcagatttgttgactgtgcattttaatttttgtaaattggggaaagtttcttatctttgtagaattaaaattattcaacatttatttttacagcagccacattgccaaagagttcttcctttagtagatctggtccagggtcacaactaaacactaaattacaaaaggcacagtcatttgatgtggccaggtaagtttgcttgtttttaaatgggaagtttggttaaggccattacctgattaaatcataaatttgaccatgaatcatctatattctttttgttgttgtcatcttttttgtaggcttttgtagagtgctaataataattttcttaatttctggatagtgtcactagtttttatcattaatttgttgcagagatgagagaaatcaaggacataacatttccttaaaggctttgtgtatttttttttttttaaagaggataacaaatggatagtaataaaatgtttaaaaacagtaagataaaattctgggtataagggaaaaaagcaaatgaactattttatgtgtttatgatttacaagtttatgtataaaatttttgtatgaagattggagttatagttggccttatttttaattctatctcagataatcttgtggagtttatatgggtaattagtaaaatcctattaaagacgatttattatgaaaagaattatccagatagtggacaattcacattaatcaaatgtgtggctcaattttattaaagctgacatgacattattgcttatgttttggccaaccttggtttcaattattacctttcatatttttattttactcctatgttttacccttgcatactgctacattaagaagagaaattaagtctcttttaagccatctcagaacttttgggccgggtgtggtggctcacacctgtaatcccagcactctgagaggctgaggcaggaggatcgcttgagctcatgagtttgagaccagcctgggcaacatagggagaccttgtcgatacaaaaatttaaaaatgagatgggaggatggctggagccagggagatcgaggctgcagtaagctgtgattgtgccactgcactcttgcctgggtgagcctgcctaaaaaaaaaaaaaaagcttttggaatttatcctgtcttatgtcaatcctcactagaaattgttaagtgaatcaagtcattttcccactttcaagagaaaagcatgttgaatataattcagtgatgccttcattaccttttaaaaatgatttaaagaaaatccataaactgaaaagcactgtgccaaaagctttacattaactcattcttccccatgagatgattctgttactctctgttatagatgagggacaagctcagagacattatgttactcgtgcaacagaacgtaactcataagtgacagagctgagtcaaactgagatgtctgattttaaggcgtgtgttcttaactatgcaagttttctctaaaaaacttaattgtaggatacaggtatttatttgtgttccatttaattgcggttttacccttaagatgcctcaatatgtattgggcatctactttgccaggcacatcattaatcctattcaaccccatagctacctatgcagtagatgtctcaagatggtgcatgaggaagcacacccagagaagctctagtcctcacccatagtttacagcttagtgcatggtggagctgagagttaaacctatatcatcttacactaagttcctttttaaaaaaaattctcctgggctgggtgcagtggctcacgcctgtaatcccagcactttggtaggccaaggtgggcagatcacaaggtcaggagttcgagaccagcctggccaacatggtgaaaccccgtctctactaaaaatacaaaaaattagctgggcgtggtggcgggcacctgtaatcccagctactcgggaggctgaggcaagagaattgcttgaatccaggaggtggaggttgcagtgagctgagatcgcggcattgcattccagcctgggtgacacggcaagtctctttcttaaaaaaaaaaaaaaaaaaaaaaaaaaaattctcctataccatgctgaagttttgagtttattatgactttgcagaagcaattttgaaatctgctttattgatttgtgacattagaatgaactatcagtattagtgaacattagtgctattgaaacaactgttttatgttgtcacctttttaataacttaaatttctagccaatttttgcaatgcagtattgaacttttgggtacatcttcatgagtttttagtctatttaaattctcaggaatttggcagaaaactctgatgtgataagtgtaatctgggacaacttgtgtatgtaacacccaacattcctggcgtgtagcaactagatagttagcttcttgacaaataggtgggagttggaatcagcaaaatattagttagttaacatgagagggttggtgcagaagtacccacagcagaatagatcatggtaagtgttttttattaagaaattcataaaaattgaaaaaggtgaattcatataagtacttctcgagtgtttgggaggtatttcctatacttgaactgtatataatagatataagtgcatagataacacatggaaatgatgattaaaaagttcagtatttcagtaagattgtgcttttacatgtttgaatagatatttttgttgaagtgaaattgcagacagagcattagctgtaatctgtcctggaaggggaatgccagttttactgtctgagctcagccattgggtttaattcagatgtcgaagcttaacaagccattggtaccagtgtgatatttgtgtggacagtggcatctgaggaactaatcactaaggaagtgtagacgcagcctaactactggcaagtgtgtccttgggccagctcaggattgtggcacattggcaaggagagatcagtattggattgtagtcgagaaagtgaagctgtctccattcccactctgcttatgtgtgaccatggaaatgttctgttctctctctctctgggaaactgtccaatgggtctgaatttaaacttaccagaatggagtaatttcacttcattaagaaatgggtcctgtatattcacgtatagaaagttaaaacattttggagaattagtacctttaaaggcagttattggtttgcttttagcattgctttttaaccaaaaaagaagtgttttagaaattagaatagcctggacattattgttttacctcagttacaagaggtttttcatacttttatagaacctttaaattattatatatacaacttgaaacagcctctcagtctattgtgtttatccatgattctggaaaaataattatctatttgagggaaatgtttatgatcttaaaaatgggaaatacccatggcaaaaaaaatcagaagtagtgataataaaatgaataaaatatgaaagttagagatgattatctagagaagttcttagtttactgtcattaaggaactttaccaggctgttccttatggataatcctctttctctcctttttcttttccccacagtgtcccaccagtggcagagtgggctgttcctcagtcatcaagactgaaatacaggcaattattcaatagtcatgacaaaactatgagtggacacttaacaggtatttacaaataaaaattagtgaaatatgatctttgttttcaatgtaaactgtttctagatattgggtcatagatattttccatgtctgtgtgcttatttcttggcagtgtttcctttgtctctgttatctcatgttcttatccactgataactctttacatagttatatcattctctcatgccccattgctttgtggtaaaatggaatatagaccagggatactcctgtacgctgaaagccactgatatgcaaatcaaggcactagcaaagaaacacttctttgaacaaaaactagcttcaacttctgaagtccagctttgaacttgatgaacttgaagctgtctgttcactaggttagagttggaggcagcaggcagggtaaaagcagggagttgagaacatggctctgtctcagataactgcctagatagggctcaccactttggatatttctttatctattaatataaaaggccagagttaacttaggtgatctcaatggatttttttaaaagaagaatgattctgttatctacgtcagaaggatagacaggaattttagcatactgttcaaaatttttctcacgaaggtttaaatacttgttagaaagttataaagaaggctgggtgcagtggctcacgcctgtaatcccaatcccagccctttgggaggctgaggcgggtggatcacctgaggtcaggagttcaagaccagcctggccaacatggtctctactaaaaatacaaaaattagccgggtgtggtggtgggcacctgtaatcccagctactgaggcaggagaattgctggaacctgggaggcggttgcagtgagtcaagatcatgccactgcactccatcctgggctgcagagtgagactccgtctcaaaaaaaaaaaaaaaaaaaagaaagttataaagaaaagcataactttaatgaaagaaaatagagacctctgatatgaatattaaatgttaaagggaaaaactaactgccctctaacaaatatgaaaggaagggaaaaaaattaggtttcctgtgtggtggagtggggtaaggggaggattataatccaaaacacttttaagaaatgattcttactattttttccttgctattacttaaaattgcaatttttactcccaaaagaaaaaaggtatcttatgtttaaaaatgtcagagttggacgagattttgaagggttctaatctaatcttgaactctggtccctttaaggatctcagcagtcaccccaaataagcatgtatttatgtttgaatgggtgaatagtaaatacacacagattctcgatgtgtcatactgcctcataaagcagtagctgtcaaaaccagcctaccttatgcaggctctgcttttttttttgagatggagcttcactcttgttgcccaggccggagtgcaatggtgtgatctcagctcactgcaatctccacctcctgggttcaagtgagtctcctgcctcagcctcccaagtagctgggattacaggcatgtaccaccacgcccggctaattttgtatttttagtagaaacagggtttcaccatgttgctcaggctggtctcaaactcctgacctcaggtgatccacccacctcagcctcccaaagtgctgggattacaggcatgagccaccacacccggcccactgaaggtatatttaatagcatatttttaagtactgttttacatggtttgtttgacaccagtgctccatacaaacccagaactacattgccaatgaatccaaaaatatttcttgaaaacgttggtgtttgctgtgagttgattaaaatagtattcaattgagacattgattgagaaattctctctttcttggtgggatgtgtgttttatgaatgaaatgcagtatctacattccaaatataatgacccaggcacttgagcatttagaacttttaaatatctgaggcagaaagtaaaatttgaaatatactggaaagaaagcagattttgatattgtttatctgcatacttattgctactttgatccagcaagaatttaaggtgggaattttacttttgagccagacctttgtatagtcatgtcaagtagaataatttattacagtaaattttaaaatgggaataaacaatagaaatttaattttttttccctttatgtacttaggaatcaatatgaagtatgttttatactaaattagaatgttgatggaaacagctgatttgttgaggtggatggaacataaaggtcattgtcttgatcacaattataaaaataattttatgaagtcagaatccccaaagcagttcactcagctgcaggagaagcaaaatatcaagaaagttgagaaaaggtttcagtatataacatggcccaaaagaaatatataatttatatttgtaatctcttgtttttcatccttcttgcttttgttttttgtgggtttttgttttcaggagctaaaaagcacttcttttctttctttttttgaaacagagacttgctttgttacccaggctggagtgctgtggtgcgatagtagctcactgcagccttgaactcctgggctcaagcaatcctctcaccttagcctcctgagtagcagggactacaggcgtgcatgcaccaccacacctggctaatttttttaaaaaagttttctttagaggtgggatctttgttgtccaggctggttttgaactcctgacctcaagcagtcctaccaccttgtcctcccaaagtactgggattacaggcacccaggctgaagtacagtgacataatcatggttcactgctgcctggatttcccaggctcgggggatcctcccacctcagcccccaagtagctgcgactacaggcatgtgccaccatgcccagctaattttttgtagaaactgggttttgccatgttccccaggctggtctcgaactcctgagcttaagcgatctgcttacctctgcctcccaaagtggtgggattataggcgtgagccaccgcgtctggccttaatagtggcactgtttaccccactgactatctgggttgatttagccgatacatcctgttggacaccctgttcttccttcatggcttgatgtgtaactgttgcatgcccttaaaagagactgccttataaaatagagagggatcattctttaattaaggttatgtaagaagctctagaactctggtattcctgttaataatgctagcccttcttctcaaagaggtattttattgttgcattctgaaacaatgaatatgctatttggtaattcatctattaatcagaaaagctaaagtcttagtcattgttttaaataaagctcatttcatgtagttactctctcctttctagccatacttccctgcccaaacatggatgccagaagtggggtttgtgtgcttgggatttctggttttattcctatgttcccttataagccagtactccaaaaccgatatccctttatgtacctaggtttccacagaagagttctgtgcactcaaagctcaactgtgtgttgtccaaatgtgctaagatgctatcttagctgttgctgatctatttttaatattttgcaacattgatttaggacatatgtagacaaatagtagaattacaagagataattgtgatcttctagtgtggggattggcaaacattttctgtaaagaatagcacaataaatattttaggctcataggtcatatgttctctgctgcaactactcaactttgccatcgtagcatgacaacaaccatatatcatgcttatatcagtggatatggctgttttaataaaactttgcttaccaaaacaggcagtgggccagatctggcctaagggctataatttaccaatccctgttgtagattattttcctcatttcacagatggaagaacttcattttagaaagttaaagtagttttgttaatgtcacatgccattagggagtcaggactagaatccaagtcccctgatatccaggtttagagctagttcttcacatttattgttaggctttttatgtgtaatagataaaatattaacttccttttttatagttctggagtaagggcaattgttacaagtgtaaattaaatcacccactaaagttttgttaattctactttgttaccaacattctagatacaatgttacagactaaagaaagtgatgcctgaactttgctcattccattgtaccacagtcctttagaatcttcacatgaattcagtagattgttttttattcttagatgctcccaaaacacacacgtgctcatgtatgcacacacatccagcaggaatgtgttcatatattcaccaaaagttagaatgctcactattaatagtagccctaattgaagactaactgaatgcctatcaacagtataatggacaggccgggcacagtgactcatacctgtaatcccagcactttgggaggccaaggcgggtggatcacgtgaggtcaggagttcgagaccagcttggccaacatggggaaaccctgtctctactaaaaaaaatagaaaaattagccaggtgtggtggcgcatgcctgtagtcccagctattcaggaggctgaggcagaagaatcattgaacccgggtggaggaggttgcagggagccaagatggcgccactgcactccagcctgggtgacagagcgagaccgagactccatctcaaaaaaaaaaaagaaaagaaaagaaaacagtagaatggacaatgaattaggatgtaatgacacaatgatacactccatagcagtgaggattaatgttctacaactctacacgacaatatattgagcaaaataagccaggtggaacagcggacaggctatttggttagaagttaggctaccttggtggtagctgagtctaaaagagaggcaaataggggcatctggggtgcgattatactctctttcatgacctccatagtgtttgagtattttcactttggaaaattaattcagctgtgtacatgtgcacatgtatatatccacatgtatccgtatgtgtgcttttctgtcaggattttatatgtaaataaaagttgaactattgtcagtaatgttacctgccattagagcacctctcatgtgctaatgtgatgctaagctcattgccccaatggatcatagactggtttatctgaaatgagcaaactaggatccagactacctggcccagtcactcagcaaagtctagactaagccaggactagagcctacagctccttggttccctgacctctactgctggccatgcaaaaacacatccagttttgtggtttttgatgaggtgacgtttgaataaagaaatagcaaaaagcaaaaacatatacaccagaatcttcccaacaaaattgccacagccttccattcctctgtccagcagtcttcctgggaccacatcttgagaggcagtgctggaaaggaagacgtatttatttctccctctctgactgtagtttatttaaactgagtctcctactgtgcgtttgtctgatgtctaaggccactttcataccagaagtgaagatgtttatgattattttaagaaatgagagcttattttgagagaagagtagaaattccaggaattcttcttttttttttttttcttggctaacataggaaatgtgttttgttttgtttttttaattgagacagtgtctcactctgttgcccaggatggagtgcagtggcataatcttggctcactgcagcctccgcctctggggctcaagcgatcctcctacttcagcatcccgagtaactgtgaccacaggctcatgccaccattcccagctaattttttgcacttttggtggagatggggttttgccatctggtcttgaactcctgagctcgagccatctgcctgcctcagcctcccagaatgctgggattacaggcacgagtgaccacaccaggctggaaatgtgttttaatcctggctattagcgcttcctgcaactttttttttttttctttttaagtctgtttagtgaaacagtttcccggagatctctccgaggtcccttcctcctctaagattctccgaatcttccctgaatttgcctgaggttgagcagggtggagacagcaggtggtagcagcggcaaaagatgttaaacttaaagagaataactttcaagtttgtaaataaagcccaatacaaataaagatggtaatgtggacaaaaggtcaggttatattttgaaactctaaatctttcacatggtcattctttatcaaacatccatttaacaaaaatttattatgtgtcagatgctgtgctctgtgtttctcctctttttcattggggcttaatttcctttttacaaagccctgcggtagtagcaaatgttatttaaagcattgtgattgcatgaggtcatggagtagtccacatacgcagaaccctggtcctcctgtacagtgagtatttgctgactcatctgtatgtccttttcctggttcctgtttaggtccccaagcaagaactattcttatgcagtcaagtttaccacaggctcagctggcttcaatatggtaaggaatgaaaagttctttggtttggataaagtggaaacttggttagattggtgtggcctcatgggttttagattaataccgttttttatgggggaatatgtagaatttgcttaatttcagtgagttgtaatgattgcctcttttataatactatttcccctctcaattttgaaaaatacaaaagcagattaatacaataaattctgaaggagtgataatacaacttaacaattctcaactcgtgaccagtcttggctctccctgtctttgatttctttttctttttttttttttgagatggagttttactctagttgcccaggctggagtgcagtggtacgatctcggctcaccgcaacctccacctcccgggttcaagcgattctcctgcctcagcctcctgagtagctgggattataggcatgcaccaccatgcccggctaattttgaatttttagtaggacagggtttctccatgttggtcaggctggtcttgaactcccaacctcagatgatccacccgcctcagcctcccaaagtgctggaattacaggcgtgagccaccatgcccagcctctttgattattttaagccaaatcttagttattatataatttctactgcaaatattttagcttttatcttcaaaagagagggattttcctttttttcattcattattattattattacttttgagatggagtctcactctttcatccagatggcagtggtgccatcttggctcactgcaacctccacttcccaggttcagcctattctcctgcctcagcctccttagtagctgggactgcaggcatgaacccccacgcttggctaatttttgtttttttagtagagacagggtgttgccatgttggccaggctggtctcgagctcctgacctcaggtgacctgcccacctcagcctcccaaaatgctgagattccgggggtgagcactgcgcctgaccgactttcttcttagcacagtcataacagcaatagctcacctaagtttttcagtagtcatccttatcattaaattaatcagggaatgttcacattccttagagtgcctcagaatgtttttatagttcatttgttcagctcaggactgaaataagcctgtattttgcaatacttgagttttccatcttttatgtctcctttaatctataaatttccccttgtcttgttctctgcttcttttcccaagtcccccaggccgccccccaaccaaaaaaaaaaaaaaaaaaaaaaaactccgttaaaaacaaaccagatcatttgtcctgtagtttcttaatggcttaacttttgaagagtgcgtcactgtgggattgtctaatttgtttctgtatttcctgtaaattgataattagatctagagcaaagtttcccaaccccagcactattgacattttgggcccgataaatctttgttgttgggggatgtcctgtatactgtaggatgttcagtagcatctgtggccactactcactggatgctagatgccagtagcatgagctccacacccagcatgacaatcagaaatgtctccagactttgatagatgtgccttggggtacaaaatcttccctggttgagaattgcggatcagatttgatttttttttttgttttgttgttttgtttttgataagactgtgccagagaggtctctgtgtactctcctcaaaaggcacataatgtctctattgtgtaatgattttgaatagctatcgatgagcattgcctgggtcctacaggcttccttaaatttaaatgttaactagaatggtttcttaagaagtgtgcatgttatagctgtatgttggtgattgtccctggaaaataaactttgtctacaagactcactgcaaagttcgtgattttcttgcaggccacattgatagggttgtttcacaaatgatcaagctctaatgcagcttcctttgcccttctcttcccttctgttttgtatgaaagagcttgcctttggcagtagaccagaccagttaataaacatcttatatctttgacacacccagaactctttaaatcagggtattgaacagtatcctagggccccctgaaatataaacttaagatctaacattaatggaggttggttgacaatttattaggttgttctcatgataccagattatattgaaatatttattttaaatttctcatttataacttatcctatttgagaaaaacgcttgaggcttcttctgttagaatgttatattctggtgctacacactaaaaaagatattttaattaaatgcttataatcataatttaggtaagtgtggtgaaaaaacaagaatttcagccaccttctaactggtttacctaggactggctaattgtgagacacaaaaaggaacagaataaggaagagcgggcaggggtttcattttatttcatttgcatttctttttaaaactgggtatcttgcatatgggtatcttgcaaaactagaggaacagaaaaaagatcagcagttgccaggggatgggggcaaaggagggagttgctacaatcagatgtggaattttaggtagagctgacactattctgtatgttgtggttcatgtttgtcaaaactctcagacctatactctagaaggtgtgcattctactttatggaaattataacaaaaaaagtttatagcacctaaggaaatttcagaattaagaaggtttcttaatttttggcattggcaaaaccagtttcccattgcatttgtcctgttgacattctagtgaatggatgtgttgtcatgtatcttcttttgatggtccagaaattgtttagtaaaatcacattcttggacttgccaggagaatgtttgctgtaattagctacttgggcaagttcattatgaagaatgatggagattgaatcctgagattgaggaagaggaaacacttagactctgtggctggagttcataaagatccactgtgtaggcctagattaaggggtggccagctctgcccagtgggccgaatctggcctgcatctgtttttgtgaagaaagtttttatcgtacaaatagccatgcccattcatttatatgttgtctatggctactttctgccaaaatgacagaattcagtatgataaggattgtatgtcttataaactgtaaaatatttactacctgaccctttactgatagtttgtcatttcctggtctagagcagaacatttaacaatatagagctgggtatggtggcttatgcctataatcccagcgatttgataggctcacttgaggccaggacagatcagcctgggcaacacagtgagacccccatctctacaaaatattttaaaaattagctaggcatggtggcgcacaccttgtaatctcacgtttgggaggctgaggcaggaggatcatttaagcccggaaaggctgtggtgaactatgatcttgactgcagtgaggctgcagtgaactgtgatcatgactgcagtgagtctgcagtgagctgtgatcatgactgcagtgaggctgcagtgaactgtgatcatgtcattgcacatcagcctgggtaacagtgagagctcatctgttaaaaaagattcatggaatatgagtgtattatatgttaaatatgcaaaggttggggaagagtatcattataatcatagcatttgttgaatgaggaacactgtcccaactacctgtaattttatctttgcagcagtataaaataggtactattttgacaaaatgagggacaaagagactcagttggcctgtggtcaataagaaaacataacttttaaatcactaatgaatagtaaaaagcatgaattttcatgaaaccggattacagttaactttttgttgaataggaatctttctgacattgatcaagatggaaaacttacagcagaggaatttatcctggcaatgcacctcattgatgtagctatgtctggccaaccactgccacctgtcctgcctccagaatacattccaccttcttttaggtaaggaacatgggctctgatcaggaattgtatgcggagtatatgaattccaaacttggctttattgactatgtgtcttacctgattttcatccctgacaaggaaactaagtatccgtgaattctagagactctcatctaggtctatgttaatcttgggcccattttgttcttcaaagtacttgaagtatattagtgaaacaatgaagtaaaacatcaatagattgttgattttctaccaacctatgtcatcaatgcttaccagaaattttcacaacagatgccagcagcaagagagaaactgcatgagcctatgcatagagaagaaaccaaggagatcacacttgtgaattccacacatttcagtggtaacaaaagctgctagcaatgtagaaattataatcaggaagacaaagaaaattaccctggactgaaagacagtctcagtaaagatgtcaagagagtcacctgaggtccagtattgtgactggcatcctcatttacatccatgcatgcatgcacacgctgtccaggacagctctgtctcctggctttgaacataaaaactgaatatgagatcttacaagtacaaaggagaatgaaagaaagattaagatttctgacctgagtcctcaaactgcaggaaggactggggcaaaatcccctttaaatgaagagaaatagagccattactgtcagcacacacgtggtacaggagcaagctgaggaaactgtgactatgtaggaagcaacagatagctgaggcactttgcctgtgaaatcccacaactgcaacattggaagctgataatgaatgcgtaaaaaggattgggagacggtttaaacacagcaaagttaaaagtgtaaagtggggagggtggtgcggtggctcacgcctgtaatcccagcacgttgggaggccgaggcgggtggatcacttgaggtcaggagtttgagatcagcctggccaacatggtgaaaccccgtctctactaaaaatacaaaaattagccaggcgtggtggcaggtgcctgtaatcccagctactcgggaggctgaggcaggagaatcgcttgagcccaggaggcggaggttgcagtgagccaagattgcaccattgcactccagcctgggggacaagagtgagactttgtctcaaaaaataaaataaaataaaatgacataaataaataaataaataaaagtgtaaagtggaagaaattagtaaacaaagtgatttgttttacgaactatatagacattgcatgtgtttcttagggggtgaaatggagagatgggaaagggaagagagatgctcctagtgagctgagctgctgatcttcccttggaggaatttaaggttacttgagagggcaatggaaatagcagctcccacttagtgctcaccatgtcccaggcattgttcttaccactttttgattattaactactttcatcctttggaattgtttcaattttggtggtgattcttaagcttggcactcagagtctgatgacattccaatattcattaaaaaactctttgtaaatagagaagaccaaatctttatattttccttactgtaaatgaaatttgctccatggcatggtaaaatctttaaaaatccttcttcataacttgtccaactccacccagacagctctgtgtgaatctatttttctttttccccgcaattgcagaagagttcgatctggcagtggtatatctgtcataagctcaacatctgtagatcagaggctaccagaggaaccagttttagaagatgaacaacaacaattagaaaagaaattacctggtaaggcagcctttatgttgagttaaatcatttagattaaacgaaattagagatttcctatctctaagacaaagatagaggtaaacataaatttagtttttgacatttttgccttgtaacttaactgaccttagttggagataattgttaattaagcttgtggatttgggtctggatagagaaataagaacattatgcactctgctaatgcaccgttgttctaacttgtaacttgaaatctgattataaactgctaaacaaaaattatgtaaatgttatccatagaatatacagcactaaaaactgatgagtattaaggtgattgcttaataccaccagtgcagaaatagaaaatcaaatcatctactgttgttttctcatgttgttataagagaattggaaactccttaattgcaggaacctattttaaatttaatgtgaacctattttattttatttattttgttttttgagatggagtctcactctgttacccaggcaggagtggagtggcgcaatctaggctcactgcaacctccgcctcccaggttcaagtgattctcctgcctcagcctctggagtagttgggactacaggcacatgcaccacgcccggctaatttttgtatttttagtagagatggggtttcaccatgttggccaggctgatctcaaactcctgacctcaagtgatccacctacctcagcctcccaaagtgctgggattataggcgtgagtcactgtgcccagctgaacctattttaaataatactcatttacaatgataaatccatcatactattaaaatattctaaggtggctatgaattattaatgatgagatgataatgatactaagaagcaaatgaaattatggagtcttttatgataaatactttgtcagtgtcattttgctgcatttaagatgctcagcagttaattggtctggtcagaacactggctgtcccagtttattgtctaaactaaattaccttttgttcactgatgaaatactattggaaatattttacgtgcaagcctgcatgttgagcaaagaatctaaatgttaatacatggttcatactttctagaacctttaaaatatattagaggatttaagacatccatataagcaatcacttcagcagtatgtgagtgggataaattcctggagagtattatagatgcacaacagacctcacttatggttggttggtgtagactggggaagatatgaggaattaaatgtctgtggaagaggtcacagttgagttgagagttgaagatgaatagggtcaccacaagtggaagtgagaatagttcaggttttgataacaatgagaatgaaatttcaatggcagataaggacaggaatgcttggaatgcagaattttctttttctgtttttagtagacattcatttaaaattttgaacaggaagcaacattatcagagatttcatttgtgcattcattccttcaacagccgtttattatatgcctcctacatactaggaatattgccagatgctggaattaaaaagatgtatagagacttggagagttttttaaattgagatgagattcacataatacaaaatgtacagttcagaggctgtcttagtctgcttggactaccataacaaaatagcatagaccgggcagcttgaacagtgggaattttatctctcaccgttctggaggctggaagtccaagatcacggtgtgcagatttggttcccagtgagggccctcttcgtagcatgcagacagcagccttcagtttttttgctcacatgggatttccttggtttgtgcatgcagagggagacagatctctcctctctctgttttctctatctctgtctctgccttttttttttttgagacggttgtttcgctcttgttgcccaggctggagtgcaatggcgtaatctcggctcactgcagcctccgcctcctgggttctagcgattctcctgcctcaacctcccaagtagctgggactaaaggcatgtgccaccacacccagctaattttgtatttttagtagagacggaggtttcaccatgttggtcaggctggtcttgaacttttgactttaggtgatccacccaccttggcctcccaaaaagtgttgggattacaggtgtgagccactgcgctcggcagtccctgtctttttataaggatattaatttatcataagggccccactctcaacggctaattttttttgttttattttgtttttgagatggagttttgctcttgttgcccaggctggagtgcagtggcgcgatcttggctcaccacaacctccgcctcccgggttcaagcgattcttctgcctcagcctcccgagtagctgggactacaggcatgtgccataatacccaggtaattttttatttttagtagagatagggtttctccatgttggtcaggctggtcttgaactcctgacctctggtgatctgcctgcctcggcctcccaaagtgctgggattacaggcgtgagccaccgtgcctggccagctaatctaatcttaaccttccagaggctccatctccaaatatcacattagggtaattagggcttaaacatatggattttggtgaggcgacacaaacattcagttcctaacaatgacatttagtgcattcacagtgccttgcagccacaacctctcttgtcccaagatactttcctcacctcacaacaaaactccatatccatcactccctccagcccctggcaaccaccaatctgctttctgattcttgggatttacctgttgtggatatttcatataaatggaatcatatatgactgtttatgactgacatctttcacttggcacaatatttttgagattcatccaccttgcagcatgtatcattacatcatccctttctgtgggagggggactttgaatttttttttttttttttttgagacagagtctgctcgtcacccaggctggagtgcagtggcgcaatcttgtctcactgcaacctctgcctctcagctttaagcgattctcctgtctcagcctcccaagtagctggggttaaaggtgcctgccaccacacctggctaatttttttgtatttttagtagagactgggtttcaccatgttggccaggctggtatggaactcctgacctcaagtgatctgcccacctcagcctcccaaagtgctgggattacaggtgtgagccactgcacccagccaggactttgaattttaagatatcagagtagaggataccatctcctctgaaatcaccaaaggtgagcaagaaaaccaaaacatacttgcccgctttcatctctaatcgctgactacagtacgtgaaggaagtctgtctaaagcagtgaagtccaaacaggaatgtgggaagaagccaaagatggatgctcacagctgcagatctcaaggcagagtgagaagcaatggttcttagatgtggaccagggactggcatgctgcacagggtggcaatgagtgctcccctggccggcgttggtaccaaggaggattgcgtgaggccaacacagaaatgaaatagacactgctgaggacagtaagggacaaggatgatgggattgtagaaaatgaagaaataaaatggacataaagtattagaaaaaaaaggatagaactgagtaatcattctaaatttataattgatgtgttaaagaaggaaactgaataatgggttagaaaaaattgttgactgactgtgatctccatagggatcagggcacagcttgttcttcagtgtgaaaagccgaatgctcacctttcactctgctttgagaaatcttgttagaatagaggactcatcagcacggttacaaggcaaagggaaggagggagagagacagagactcatggtccagaagagagggggttaattcctagggcaagctcatgggaagaagggaaaggatggagtaacagggaaggaaaggagtctggatggtgatgtagaactgctagataaggatcttttagaaacagtgtttggcgtggaggagaagatataaacagagaggttaggcaaagggggttttcgttgtgctcattaacaaggacacagaagcttagggagttctgggtttgggtttgtactacaaatttcaaatacattggtgagttttcctttgaaaagagtccgttgaaaatcttgagttttcatagttgctgtgttccttgtctgaagtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggtaagcaggcgagagtggagccacccggagttagtgtgcgatcaccccttttcagaattatccaagtgatctattcacgccatctttgtctttttacaattcagtagttttagtatattcccaaagttgtgcaaccatcgtccctaattccagaacattttcatcactccagctctttacccattaagcagctactccccatttctttctccctccagctcctatcattaattttactttctatctttctagatttacttattcaggacattttttataaatggaatcatcaatatatggacttttgtttctggctttcatttagcataatgttttcaaggttcatccacattgtaaaatgaatcagtcctttattcctgtttatggctgagtaatatttcgttatatgggtataccacattttttaattcattcagcagttgatggtcattgtggctattataaacaatgatgttatgaacattaatgtacaagtttttgatgatacaattttgtaacaaaccactgataccagtaaagtgtttttccagactgttttctctgtatacacctatataaaaatataaaggtttatatggcggagagtgtaagggctgtataattttttaaaaaccactgtaatagtatcataccaattacattgttctgcaatcttcttttttttttttttttttgtttgagacagagtctcgctctgtcacttccaggctggaatgcagtggcatgatctcagctcactgcaacctctgcctcctgggttcaagcgattctcctgcctcagtctcctgagtagctgggattacaggtgcccgccaccacgcccagctaatattttgtatttttagtagagatgaggtttcaccatgttggtcaggctgatctcgagctcctgacctcgggtgatccacccgcctcagcctcccaaagtgctgggattacaggcatgagccaccgcgcctggcccatgcaaccttctttttaaactcttttaaaaatatgtctgggacatcctccctatattctatggaaggcttcgtaaatttagcgccatacctggaaaggggctaagcaaatcttgtctctctttccaattttagtacattactgcagaagcaacacatggttctttcatgtgaatgaaagataaaaatgaggaatttttcgatgtaaaaaaatagcctgagtgctgtgcctcaagcctgtaatcccagcactttgggaggctaaggagggatgatcacttgaggccagtagttggaggccactgcattccagcctaggtgacagagcaagaacctgtctcaaaaaaagaaagaaacaaaacttatagccataactcctttttttttttttgagacagactctcgctctgttgcccaggctggagtgcagtggcacgatctcagttcactgcagccttcacctcctgggttcaagtgattcacctgcctcagcctccggagtagctgggattacaggcgtgagccaccatgcctggctgatttttgtatttttagtagagacagggtttcgccatgttgcccaggctggtctcgaactcctgacctcaggtgatccgcctgcctcggcctaccaaagtgctaggattacaagcgtgagccactgcgcccggccccgtaactcctttttgttcagacagacactaacaaaattttaattttcagaatgaacaaagataggcaaacttttcttcaacgtaccaaaaaaatgatattctagagtatttattcagaattatttaatagacatttaccatgtatcaggtgtagttggatgacccatgagtcagaggcaattcccatagactgtcagatgctctgatatgtactctatctagcagtcgtcagagccagtcgttggagggagcaaaagcttttgtggtaaaaaggaaatgaatgattaggaagtggggagtcgcagacttttaaaacgagttaagtaataatttctcttttggtggagtaaaatcaactcttgtttgtttttgttcaggggtgttttagtttgattttactacataaattttccttcttggcgtgtcagtaaataagaaggagcatttttagttagcacatcaagcattcttgaaggcataaagaatggaattctaatggggaaataatcctgtcatcttacgtaaatatagtattatgtaaatataatacccagttctgtgtattccctttattcccatagaaggaatactgtatttttatgtaattttttgttttctaatgtgatttcttgtaatgtttaatatttcatccctaaaaggaaagacttcctagatgccatttttgtgaaaagacattgtgtagtgtaagaactgaaaaattagtaatttgtctctgtaaatgtcacaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctagtgagtgaagtttggttatactttgaaaatatactaagatggaaccattaaaaacagtaataatttttattatctttcatttgttcaagaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggtgaggaaatatgcctcttaaaagctattatattaaactggcatccttttctctaattcatttcatttacttacttattcagtaaacattaagcaactgtcttgtactaggcactgggaagcaaaaatgaagtagacagggtccttgtgtgaaaagtagcctgtcaaggagacaaactcagcaaatatttactgagcactgcttcgggccaggtgcttttgcagtttctgaggctacagcagggacagacactctgtcttctgggagcttaccctctgtttgcaggaggaacagagactaacaaaataaagtgtgtactgtattagaagatgaaaagtgctatggagagtgagtagggaagggaatagagagtcctagggataggaaatgttgtgattttaactaaggtagccaagacaggtctttctggatggtgacatttgagcagagacttgaaattaatgacaggctaagccatgtgggtatctggcagagcaagatctaggcagggaaatagtgccaaagtcctgaggtcgtagcaggactctgagatgccagttacagcaaggagactactgggtagagcaggtgggagctggatcacacagaacctgtagtccaccaacaggactttggctttactgtggtaattacaataaataagtacacttaagtattttagggggtcatatgagagctatatgtatactaaatagttggagacatacagagcacttttagtagttctgtcttcattttaaagcctatccaaagttgttataatatcacctggtttggtatcaagtgctgaactacaggggcatcaaattcatgtaaatattgcctgtggatgatcatatttgcctgtgattcctttatgttaggctttttctcagcatgatgtttttgagatgtgtccatgttactgagtgaatgactcttttgtttcttttcatcactgagtagtgtttccttatgtgtccattcacctactggttgatattcaggttctttccagtgtggaacttttatgaataaaactgcagtgagcatttatgtacaagtctttatgtggaaatggtttatttctcttgggtaaacttttaggaatggaactactgtgtcatgtaagtgtatatttaaccccataagaaactgtcaggctgggcacagtgggtcacacctgtaaacccaatactttgagagggcaaggtaagaggattgcttgagctcaggagtttgagaccagcctgggaaacatagcaagaccccatctctaaaaaaaaaaaaaaaaaacttaaaaattagctggcatgggggcgttcacctgtagtacctgcctgaggcaggaagaccacttgagcccacgatatcgaggctgcagtgagctatgattgagccactgactgcctgggccacagaatgagaccctgttcaaaaaaaaaaaaaaaaagagagagaaaagagaaaggaaagaaagagaactgacaaactgcaaagagtttgtaccattttacattctgatcatttaatttgtatttccctgaaggctaatgatgttgggaatcatcttacatgtttattggcgagtattttttactgtgcatcttcgttgaagtgtctgaacaaatcttttgcccattttttattgggctgtttgtcttactatttacttgtaaaagttctttttatattcttaacaagtcctttgtcagatacgtgttttgcaaatattttctcccaatctggcttgggtttaatttttgttagtggtattttttaaagggcagaagttttaaattttgatgaagttcagtttaccgttttttttcttttggtgttcatgctttttatgttctatctgagaaatctttgactaccccatgactgcaaatattttattttcttctagaagtttttggggcttaaaaaaataatttttacaagtttttataaattgaaaaaaacttaaaattttaagtttcatagttgtatcttatatgtttaggtctatgagctatttcaagttgatttttgcagatagtataaggtaaaggttgaggtttatatttttacatactgatacacagttgttatagcaccatttattaaaaacactggcttttttcccattgagttaccttggtagcttgttgaaaatcagttgaacatatttgtaatggtctattctggactctattctgttcttttgatctgtctgtcctttaccagtacctcaccctgttgatacctaatttttgaagtcaagtgatacgaattctctgttattgttctttttagaattgtttttggttattccaggtccttaacatttccatgtacattttagaatcagcttatcagtttttacaaaaatgcttggaattttgttggaattccattgaatttataaatcaatttgggaagatttgacatctcagcaatagtaaatctatggcataaatctctattttggtagttataaatttctctcagcaatgttttgtagtttgcagtgtccaagtcttgtagatactttgtaaagtttatccctaagtattttgtggcttttgatgctattgtatattgcatatttttattttagtttccagttgtttggtgccagtatatggaaatagaatttatttttgtatattgaccttatatctgtgattgcttaactaacttcctttgtgtgtcttactttgttgaccagaacctcccatactatattggatagaagtgggaagagccttgttccctctcgatgaaggaaagctctctcaccatagagtatagtgttaaccagggttcttgtaaacaccttttatcaggttgatggacttctccttttgctgagggtttttatgatgaatgggtgttgaaatagatcatatgttttttccccgcatctattgagataagtatgtgttttttctttcttattttgttaatatgatgaagtacatggttgccatttgaatgttaaatcagccttccattcttgggataaaccactcttggtcatggtatattaccctttattaaaatatttcactacattccatttcccattattttattaaggatctttttaaatctgttgaattcaattcaacagagatattggtttttagtgttcttctaatattcttgtctagttttgatatcagggtaatgctggcctcagaaaatgagttggaaaatattccttcctcctctattttctaaaagtgtttgtgttgaaatagcatttcttctttaaattttggtggcattcaccagtgaaggcctctgggcctggagctttcttgaagacttaattataaaattcattatgcagatatagggctattctgattttcttcttctccttgaatctgttttgattatctgtcaatgaacttgtttatattatctaaattattaaatttacttgtataaagttgtttataatattctctttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctataatattctcttattgtatgtaagtctgtagtatctgtagtgatgtctcttctttctttactgatattggtaatttgtgtcctctcactctgtctccgtgcttccttctccttttccttcctaaccccttcttctctcctttctcctactctatctctcctccttcttcttttcttgatcagtctatctggagtttgtttatttttaaaaaataagttcttggctctattgatttttttttttttagtaagcccttggctttattgattttctctgtggtatgtctgttttctgctttatttttgttctttttctcttgtttcttccatttacttatttggggtttaattttcttttctcaagcttcataaggaggaagtttagataattgattttggacctttcatcatttttgatacaaacattttaagctttaaatgtccatctaaacactgacattgccatatcccacaaatttttaatatgttgcattttcatatttattcaattcaaaatcttttttaaattttctttgtaatttcttctaattctttcacctttattgagatttatggctcagcatatgctctgtcttggggaatattctatgggcgcttgaaaagaatgtgcatgctgttgtaattaggtagagtgttccctaaatatcagttagatcaagttgattcatggtggtcttcaagtctcctgtgtcttgactgattttgtgactacttttattagctactgagagtggaacactgaaatcctgatcattgtggatttgtatatcttcctttcatttctgttcaattattgtttcatgtactttgaagtcctaagaaactccttatacatttgaaatttgagatttgtaaaggaaaaagtaccagaagttgattgctggaaattattttaaaatattacaaaatgcatgcacctttttaaagtatatttttcttttcttttttttttgagacaaagtctcactgttgcccaggctagaatgcagtggtgcgatctcggctcactgcaacctctgcttcccgagttcgagtgattctcctgcctcagcctccccggtagcagggattacaggcaagcgccaccacgcctggctaatttttatattttttgcagagatggggtttcaccatgttggccagcctggtctcaaactcctgacctcaggtgatctgcccaccttggcctaagtgtatttttctatgtgttaactctctttatgtgtcttttgttaactcttgaggtaaagtttcataaaatattctcctggaaaatttagggatgaaggccatgtgtttattaaactaagtattatcacctaatactatatgaccaagtacaatttttattaaagattgatgtttagactgttcacttattgataatatgataaaaatcaagattcccaaaaatgtaatgaagtgaaaaataaaacattctttgaagaaagaaaagtatgtagtaggtaatcagatattggttccctttctgtacagggattagcagatacttgctttggagataagtcagatctgatttgtgtattctgttttatcaagatttttttttctggtatggattattcataggagaagatgcttctaaattctagctattgagttaactctttctaccatttagacatgcattacacagagatttattccacataagccagtctgtatctaaaggtggttattccaaaatggactggtttttagcttctgatgaaaaattttaattaaggcatttttagtttttcaaacaaaaagtcaatacatagagctcattttttatcaaggtaaaaataaaagtcaaatattctttattataacctaggaaggctgccattttactgaaacatgcagaaactatacaggatattttcggctaaatttaagcagatactgttcttggcaagttaaccacaaaaattccaaacagcctgtgcagtgtggcttaacttttttcttgtgtcagttaaaaaaatagttgcttcaaaacttttgtgtacctgtttaaaattccatccagtgtggtggaaaaatatatacagcagctaagattctagttgttaaaaatctttgatttctgtttctaacttcaggtatacggtaaacctaagttcagccttagtaagtatcaaagttcaggatagagtaatagggtagctcctatttagaccactgagttagtttacaaacagtaggatcactgcatttgcatttgatcccggtgccattggaagatcattgcttcaatttatctctgtggagtagtacttaatgtacattttttgaagcttataaatatccggtaagtcaacaaaaatataagaaatatcagggaagctataactgtgtagggaaaagcatttggcaaacagagttaatttcttggaaagaaagcaggagccacacctaattaataattaaatgcagcttcaccatgcaggatttgggaagagtctgagaaaactgacttaagctctgcctggatcttaatgtagatgtggtagccttccctgtcattcattactattttcctccttccttcccaggaatctcagcaaatgcttggaagacttattccagaaaaacagatactcaatgaccaattaaaacaagttcagcagaacagtttgcacagtaggtgttttatttttaaagttgaccttttctttattctttctttttttgacatggagtctcactctgtcccccaggctggagtgcagtggcgcaatctcggccaactgtaacctccgcctcccgggttcaagattctcttgcctcagcctcccaagtagctgggactacaggtgcatgccaccacagccagctagtttttgtatttttagtagagatggggtttcactatattggccaggctggtctcgaactcctgaccccaggtgatccatccactttggttccccaaagtgctgggattacaggtgtaggccaccgcacccagccttttcttattttttaaccagcaagaatttccttaagtgaaatgagaacattaaaaaacattttcctcactgcaaattaaagtttttcttatctttgcgacgtttttctaaaataggagattcacttgttacacttaaaagagccttagaagcaaaagaactagctcggcagcacctacgagaccaactggatgaagtggagaaagaaactagatcaaaactacaggagattgatattttcaataatcagctgaaggtaactcttctatgtgtgcctgcatgtgtgtcctacctttaatttttttaactgtccaaatgattagttgctatttaatcacaggcagaaaaatttattatgccattgtgagacaatctaaattgcacttttctccttgaaaatataagaatgaatttggcatctataaattagggctgaatgagtggccccagcatgacatctatttttaacctgaatcatattttgacacatctccattcttttgtctgtttatagtcacatcaagttgattccaaaagctttatctttcttatgttctttgaatactactaaaagggattgttttcttttttaaaactaagaatttttctgccacttcttatcttcattgcgcttaaatgtagatctttattttgttacctcatttttaaatcttactgttttagtggagtaattgcttttgtctcttgtggcagaagtggtgtatggttttgtcacatttgcacagtaaaattgggaaaatgccaaaactctgaggaaatgtaaaatggttagatcacagcctttttcagatttggtgtttctgatttaactttacaactgtatcatcttaagaatgttaattcttggccgggcgtggtggctcatgcctgtaatcccagccctttgggaggccgaggcaggcggatcatgaggtcaggagatcgagaccatcctggctaacacggtgaaaccccgtctctactaaaaatacaaaaaattagccgggcatggtggtgggcgcctgtagtcccagctacttgggaggctgaggcaggagaatgatgtgaacccaggaggcggagcttgcagtaagccaagatcacgccactgcactccagcctgggtgacagagcaagactctgtctcaaaaaaaaaaggaatgttaattcttaaaatcagaacacaaacagtttatttcttataaacaatcatatactactttagatgtatgtagatattagcatttttgttattcttataagaaattggatgttatacttttttcccctccaaatatttgttttccttttctaacataaaattctttttaagccaattcagcttttgacagtgggaagaagtaaaactcctattctataattctaaaaacaaaattaaaaattagcatatttgaaacttttataatagttgacctttggattgagattctaggccaaattgtctagacatctgagtttgaggtatgtgtgctgttctttcagagtattaggtaatgatcttttctcaattgtacgattccaggaaagtgctcttaggggaaatattatttgagccaacttagtgtttttcttcactttgctttcatgcttacatggtgtgtgtttgtgtgtacactatatatgttctatattcatgcatatatgattatgtgtggtatgtcagtattggaagtacagctgtaaattaaccatctctagaataagtgcaattagaaacaaaaaaacaaaaaagaataagttcaattaaagtatgctcacattaactttcattgtcacttgtctcttttataagcaaaaaaaaaaaaaaaatagcactgttgcaaagcctatgttgctttttaatagtctcttgggatataaactgttaaatattaagctctcttctgaacccaggcagtagtccagatttgtgccttcacattgattctttttctagaaatttgactcccctaaaaaaggttcaggtattagaaaatgatactctagtgagaggcttttgataaatgtctagaagattaaataattttggtgattgaatttctgttgccattactaaagagaacacccttaatatgtggcgagtcacccctactttgtttaattgactatggctgctttcagtatcacagagtttcttacataaaggccaattttagcccccttttccactagccctttttccaaatatgcttatttttaaataagagtatttcttcttgttttttaattttaattttggctttctcttattaactttaattaatatgatgagtttaaaaaaaatcacaggtcaggtcgggtgtggtggcatgtgcctgtaatcccagcactttgggaggcaggtggatcacttgagcaagtggatcattcgagactagcctgggcaaaagggtgaagccctgtctctacaaaacacacacacacacacacacacacacacacacacacacacacactagtcaggtatggtggcatgtgcctgtagtcccagctacttgggaagctgaggtcagagaatcacttgagtctgggaggttggggctgcagtgagccatgattgtgtcactgcactcctgcctgggcaacagagtgagaccctgtctcaaaaaacaaacaaacaaaacagtaaacaaatcacaggtcagtataactatattgttttgttatttaacacgcatttggaggacttagtgaatatgttgtgttatggttattatctctagtattcctctcaaacctgataaagccaaaacaaacaattaaattggagaatcaaaagatttatagaatttgattgagacaactcagagatggatttatcatttagtctcttaagtgtcacttgcccacttttctttgttgtagccacactggaaaatgaaatactttttttgtaactttagagcatgtgtccattagcaaccatgttttcttggatgaagagataggccaggaggagccagtctcctgactcttggggtttcttcagtgcccctcttgatcggcagtgcctttagagcatccacgctgttgatgcaaaaattacttctgccttcctgggatgtgtcatttcacacatctaacctgatagtgtgaatttgttgtatcctaaaccttcctttccctaaaggaagccagctggagagtacagaaaagaaattagggcttcctgttcttttgtatttcatgttcacgtagattgttcacctggaagaaggaaatgcagttccctcattataggttagtactgtaacactggaggaataccttacagagtacagaattttaaaattagttgatcaggatactaaatctatattaagtggctggctccacaaatgaggataacatttaacaaaaattgattctcactattttgggtaaattgcaataagtcattcacctactttgatgcatgctcagagttatgtccagtttcttaggtataaaggtaatacagggaataatcgtaccctggttcagcccagattctgagttataagacagtgattaggaagtataggaagcgtatttagtcaaaaaactaaatacacttatactttccttttcttttaacatacaatctgatttagttctttctctagaatgtcttgctcagattaatttgtcttttgtgggtttctcccattttcttcagttcaggaagaattccttccttccctacccaaaatctgataagcaaagatagaaattctcaaagcattaattaaagaggaaaaagttacaggttaacaggtatttgtctcgtataggaagcaacctgttgaaaacataaggcatacttataatcgtgatcttctgttaaatggctccatattcaaagtcgtgggcctttaagtttctacctaatccatggaaattgaaggctcattttttgttttccaaaaaaggctgtttttccatgcgttttaatagatatttaccttttaggtgtcatatttatatattcaaaaaaagatcctaagatgtaaatatctttctatttaccacccaaaccaataattacttgagaaaggaaacaggaatcttactgtagcaaataaactttgcttttgggttttaaataagtctgtaaaaacagggagggtgggagaagaggagaaacgatagcaccctgaaatattgaagctcttatcctacaaattccccaattggcagcctttgtacttatgctgcccttgctatgcatgataaattttaggtttttgattatcaaatgaaatatttgaacagtgaattaaccaggaataattaattttgttgtgattattgctagcatgaattagtacatcttaaaatagttttaattcagtgggtaaaatttatttaccattaatttctgcttttaaaatgtgttctgtatgtaacaaataccttattaagaaatcggtagtcttctcagatccacgttctagaaacaacaatttaaaattattatctatgacttctacttcagtttacatgaaaattaaaactcccaacttttttggagactctgtgtaccaaaagggtagtttttcttacacacagtgcttacctataggcataaaattatgattcaaacaagtgttaaataacattactgctaggactttttggacagtagcacctgactttaccttgaccttggcgatgtcagtagttactgtagcagttttccttggcactgacagcctaatgttccatattttaatgtcttagctctaagatggagcagcagcacaaagtacagcttgtagttttccaggctcctttaagaggtcaaataaggagaatccaacacccaacggagctagattttatgtttcatgttgaaaagttgagtccttgttggttcctgtctagtcagtgtgtactggacaagtcctaatgtgaatggccgtttacatttgagcatttctttcttccagtcagtggcaatggaggaggcagtgttgcagtgcctggcagttctcctgggctgcgtcatccacttagacttctttctaaaggtctccatgccctactcaggcaatgcacatctttctcagactaagaatgatgaaccatctccagctctgtgcttcagtttcccctgcgcagatgagtgctcagtgtctaagatagcatttaccatgaagtactaagccttctttataaaagttaattactagttattattaatcgtggagtatgattgattctttcctattgacgagttgcgtgtgtgtatggtggtgtaaactgaattacaggctggacaaggtactgtatactgtagtcttgtctttttaacaagcattttagatcattgaatttgagcttgtctgcaaaaatgtgaaagcgctcagttgttatttgggtcatgtgcatgtttccatcatgggagacatactgtgatcagtatactattccaaatgtgtatagcattttattttctagcaaagtttgaatatttaagactaattcacaattatgatttaattccttagtatacttgggaaatccaggcttctaaaattagacacaagaggctgttagaaatataaattctccccataatgctacctgttctaaaaattgctcttagaaccgaatcgatgttgaaatgagaaggccagttgtagtaaatgaggttgtttgcttaactaaagcctttatactcttggtttcagacactagctttcatgggaggctcattcattatgaaggcagtgaaaggcaaaatgtttagcaaccagaggaaaaaagaaaagagctggagaaagaactgcagaacagagtaagaagtcagggaaaaaaatgcttgtgaagggaaacaatgaaggaaggagaaagactcagaaagaggaggcacagagacagtgagagaaatcagtatgaattcaaatagccatgttgctttgtcataattagtagaataatgtttggttctttcattctgttcaagctaaaattttatttttacctatatgatcctttggaaaagacctcttatgcacagaagtaataaagtgctctaactctcattctgtcagattctgtgccataccagtaggctgcttggttgagttttttagttacagcatgggttttttttctttttaaggttgtaaaaatttaataaaagataatttgggaaagggttaagaagaactcagtcttttgaaaaaatactttcttctcttaatggaatattgctttgtgactgaagcagacactttgagggaaattcagattttcaggacaaaatggaatcagttttctctttctggtaatgcttcccaagggtacttcccaaagcctcatggcagagggtgtctgattacctattactattgcagagaggacaagagcttctagctcttctgcccacctccttccacacacacaccttgctccaatctcccttagcacttgtgacacattgactaccattttgtgccatgggaaatagtcttattattttgttaaatactgacttcaaatttaaatttttgaacatgttttcaaacagtatatcccatttcagaatttaaataaccagtcaggccaggtgcagtggctcatgcctataatcctaacactttgggagttcgaggcgagtggatcacttgaggtcaggagtttgagaccagcctggccaacatggcaaaatcctgtctctactaaaaatacaaaaattggctgggtgtggtggcatgcacctgtaatcccagctgctcgggaggctgaggcaggagaatcacttgaacttcatcacggcagaggatgcagagagccaagatcatgccactgcatcccagcctgggcaacagagcaagactccatctcaaataaataaataaatgaataaccaatcagtatatatttttctgtatagtcctctcagttttaatgcatcgagaatgaataaatgtagcctggtacagtgacatatatctcaggaggctgaggtgggaggatcacatgaagccagacgttcaaggctatgatcgtgcctgtgagtagccgctgtactccagcctggacaacacatgtctctaaataaataaattttttaaatgaatgaataaatttataattttatgataaatgggctatcagtttaccttgatttgggtatagtttctgtgttctgaaatcgttatttttcaaaattttccatacaggcacaagttctcacctcatggggtttgttaactggccttctttaatagctcttcatttgtttcacaaccacttaatttgaaaaagttaatgtattttaaaactccaaaggccttctataaattttgataccgtatactacatattatccctaggtgagaaataatgtttatttacagaaaagcacttctactttggactttttatggatgtgatattatagataaacacctgaaatttctgatgctggtagctacatcattttttaatgaggtcaatttaatattaacagtatgaagattattataaatgttatatgtgagctaaataattttatcttgatttatggttttgagttcatgaaatttaagtaattaagttatgtttgtttttgtctctcatttccaagagacatcctgaggcgaaccaaaagcaaaatccttcaaaaaagttaaatatctaaatcagtaaatacatttccattaactgctggtctcctttcatagacccctgttgctatttttttctcttcatatacattatgcaaagtaatgtttgtgaaaaggaatcctatatattgttcaggcgcatgctactttatatttcaagtaatattgtttcacataatacatgtatttttgagtgtctctaagaccagatgaaggagaaacagtcacagttattaaatcaagtgattctgtgccttttagcttagcaatagaacaaacttcttcagtaaacctgagccacatttctcaggggaaaaatagttggattttcttgggtattcaatttgtcaaacagattgcttttgaaatactttggctctgtgccataggatgtccaaagatgttttatggttcaaatatcttagttctttaggggaaataagtgacttttccctctttggtctagggaagaaaattaaaagcaagttgattttcgtttatcttaactaatacaaaacagaatcttgatatgccagtaatttgttattgtggttcatgagctgtgcttgatcaaagaccccttgagactaataaaagctgtgagctttctccaccagaaaaatgcccatataccccaagtctgcatgcaacatagtatccacagggctgaagcttattcatggaacctggttaagaaactctgtattttcatgattctgcataaattgtgattttttaaaaaaaacttattttaatatttaatattaatatttaatatatgtgtgtagtatatatactacacattttatagttttattttttctgcataagtatttgttacatgcagctacaatttcttgactacttaataatttcttatttaagaaagtactgtaattatgttttattggaagataatatcaaattattacatactctacctagtgtaaaacatgtcatacacttgaatagaattcataaaagaaaaatcaacaaagttgtacactccgtactatattgctagattaatatccatccaagaaacaagtttttgtagaattactggttttagaaaaaaaaatcacttaactttaggaagaaccgagtgagatactgacttttgattcgtggtaatttgtttgttttctttctgttataatagcaaaataactgtgacaaattccatgtggatttaatagaatttgcagggtcatttaaatcaagttgcctaccaggaaatgttgatactttcagtgtggtgaaattttccttagccatttcccccaataatttgctcatttcctagatatgtaatttaatggcactagatttgtttgtcactttgaatttttttctttctgaaggagttaaaaggatacttcttaataactgtaactgtacttgagtctctttaatagtatggagaagaatgagagaatagtgtagccatctgctcccctatgtgaaaggactgggtattctacaaggactttgttctggcaaaggaaggagagtcattcactcatttttttaagagtatatatttcttcattctatagattgccttctcggaagttcaactttttaaaaagcttatcaacttagaaatcatccatgttctgcttatgttgattcatgccatagtaaactctttaagtccaagaaaagagaagacccagaatgcctgcctctgggcagcatgttgatttccttacaactgtgtatctcagcagtgtttgacttggatgaaggaaatgatagaaaaactttgccatcttgaaatctggatcataaggtgccagagccttctgttagcttatttgtcgtctgttattttatggttcctgcaagctccattccttggaggtgcttgaaactgcaacttacataatcagttcctaagatcggttcaaatactgctatactcaaaaacaagtgtgtttaaaaaatttaagtatcttttttcatgtatttgatacatttaaaaattatttttgaaactgtgtcataggtaggttttttttctgtagattcttcaaaatcactttttcttacaagcttttcaattttatagtctctcctaatgtattactagctttacttaaatccggtaatcaatgatctataaatccatatccagttacaagagcctagtatagaaaggaaatgtgcggtataattcttggggaaaaatgaaaaatcttcatttgtgcctatgggctatctattatagtatgttgatacatcatggccagtgtccattctggttgtgcagtacctgttgttgaatattttgaatatcactcatgaatacattttttcctggatgaaataaggacttttctttatttaatatataatcagattcctgaacatcaagctgaaatgttatttctcttccggcatttcttactcctttgtagggtttaatttcagctcagggttattttgcttatgcttttttcacttattcttgcagttaagaataaaattctaaataaaacagatactgaaataaataaatactttatttgtttgttagacattgtgatgaacaatgtctaagatttatcagatcccaaaactagaagaacacctaaagatcatccattctgattcatctgccagctcatatcagggacctgagattagaatcctggtttcttgattcccagttctgtaccttttttattttttatttttttgagaccgattcttgccttgtcacccaggctagagtgcagtggcgcgatcttggctcactgcaagctccgcctcctgggttctcgccattctcctgcctcagcctcccgagtagctgggactgcaggcgcctgccaccatgcccggctaattttttgtatttttagtagagacggggtttctccgtgttagccatggtggcgtaacttttaagtatagtcttttgctgtaaattattttttctgaacctatttaagaatttgatggtcttgaaaatgaaattttcattcatattattactgattatttattcttgattccaggttactatgaaaaccagtactactgattttttaacacattaaaattaagttttacatcccttggtatggcagtgagaaagatgatgaaaaatggacttctttctccctagggttgattttctgatctcagcactttaaacagtcagtgtgaggctgcatcattgctttccagtcttagccttcttttccccttccctctgttccacatgtcaggtctgctgccatagggaacagtccaatttgtgccttacaaaggtaccttttcctgctgtgtcctgcctggatgttcccagtgtcatctgctaggttccctactgaagccccttcttcctttctttttcctccttcccccttccttcctttccttttttccttcttcccttcttctccattttccccttccccttttcctccagtaccttcctcttcctaagtacctccccccagacccctatctccagttaaactttttcttttatctcattgttcttttaaagcctctcagcgtcacttacagtttataaaacatttgtgtatggattttaactttaaccttagcaaaattagtaggaaaaggttagcctaacccttaggatttttttccaataacaagtgcattttaatactgactttctacagacaaaccgtctacctttgttgttcaatctctgaatgaatctaaaggtaggaattttagggcctggaagaaacctacctgcccatctagtcttgccagtgagaaaggtgatagaagacgacagggcaaatcttagtccttaactctccccatagagatccctgggccatgtactgggaggaccagccctggttagatcaagaaatcagctggaaagataccttggctctactgggcactttgactcatctgatttatcgctggcccacataagacgagtttcagtgactcaatctattggtgaccatttgatttctatggaatcagggagtttcttcctcagcagacgtttccttattcttcctattttcaggtgtctaaacttgtgacttgagtactttaaatatcatagaatgcattttattttcagtagcctgctaaggaaattactgctattcctgcagctagtagtatcaagtgaggaaattggatccaaggtattcatcatcaaattatagctttttacttttaacctgattgctggtttagtttggggcagttagcgacttgaaggatagatttagtaagaaaagatgctctggaagaggagcaacttgaagaaaaatagaccctggggggaagaattgaggtcaaagaattgaggagcaaagagatgtccatttgttctaaggcagcttagtgaaaggtggaggtgaggtttgaatggaggtagtcagtgaagaagaggcatctgtattttcaaagccagtaaaggttggtgttgattgataatcaaaagaagcttaagttttattcatgatcatcgtcatatcttggaactggttacgttccattatgattgctgagcctttagcagcagagctcacctcctgcccttcgctagcaggtttcttctagagcagatcatggaaaatggtataatgtgtatggctcattagaatgtaatcttaagtggcctttggaaatcagtcatgtcaaaatgtggtgtgattctagctttccaagttgactttttccaactctgaaacgttatctcctaagtgtcctaggcttcccactatgaaatgttgcatgctgataaatagttgatgtacctgtcactcatgtcgctacatgaactgtttctcggttaattataggaactaagagaaatacacaataagcaacaactccagaagcaaaagtccatggaggctgaacgactgaaacagaaagaacaagaacgaaagatcatagaattagaaaaacaaaaagaagaagcccaaaggtgagtcttctttggattgtggactcatctggaaggaactttgaggatttactattctttgcttggcttctccaagtagttactgcaccagaaagagccttcagtctttagtgtgcatgtgaagtgtgagtgcaaacacaaacacgtgtatatatgaatctttgcatgtatcagtaccctctgaagtttttggttggttcccagagctctctcaagctactactatgtagataaatggaattatacaaggaaattgggacacttggtgtgctcatttgcatgctaatggccagttcacagccttttactaacagctaacaggggttggagtgcctggtttaaaatccaagccactgagctagtgccccacacagggcttctccagcagggtcagggtgggcctcttctgtttttcaactgcaaattaaactttagtacaaaagggggaaatttgccaccgctgcttagtgtgtaggatacagacatgtttttatctgtttttgtttgaagatttatttgtgatatttttatttttacttgtaacttactgtagtaaattgtagaaatttgtgtctgattttgttactgggtatttgccttttaaatgtcagttaattttagactccacgaaacaaaaatgaccaaatgtcccaatgacagccccgtaaattataaaagttggtaattgaaattagattaaggccaggcatggtggctcacacctgtaatcccagcactttgggaggccgaggtgggcggatcacgaggtcaagatattaggaccatcctggccaacatggtgaaaccctgttctattaaaaatgcaaaaaattagctgggcacggtggcacgcgcctgtagtcccagctacttgggaggctgaggcaggaggatcacttgaacccgggaggcggaggttgcagtgagctgagatcatgccactgcactccagcctggcaacagagcaagactctgtctcaagaaattagattaaaaaggcgaagaaacggatacttgaggcaagtcattgactttagtgggctgagttcagttaacctgccaagagctgtgcatactttcttatgggtatatagagtcttctgtttgtttttcagtgccagtggggaggtatctggggtcccagaccaatttacaggattgttttatggttttcttgggggtcagactaaggatctcctccttggatgttgattaactccatccttttcttacccccagagtttataaaatgcttttattattcacactataccacactgaactgttaaattcctacagtgtagaaataaacataaaatacagaaaaatacataaaatagcataatacagaaaatagcataaaaatataatatggaatatgtattccaattatatagataaaaactgcaaattaacgtcagaaattagatggttatacagtatatatggtgaccttcattggtagaaaatataaagtaattcttttttttttttttttaattttttattttttgagacggagtctcgctctgtcacccaggctggagtgcagtggcacgatctcggctcactgcaacctccgcctcccaggttcaaccgactctcctgcctcagcttcccaagtagctgggactacaggtgtgtgctaccacgcccagctaatttttatattattagtagagatggggtttcaccatgttggtctagaactcctggctggtctagaactcctgacctcgtgatctgccctcctcagcctcccaaagtgctgggattacaggcatgagccaccgcgcctggccactgtttttattatggtttttttgttgtcatgaataaccatatccttacccctccaaaaaatgtttttatactttcttaaaagacattttaaaaattgtaaataaaatgtttaagatttaagtttaaagacttctgcattaaaatatcacattcatacagagtagaaataaatgtaattttttgacaatggagaataaaagtataatttgtttcaattatgttcccgtggcagattcctaattctagccgatgacctgtgtgcgttagccatgtcacaggatggcagttcagggtggagactctgggaccaggctgcctgggattgaagcccatgcatgtatggctgtgtgacgtggacaagtcatttaatatctctgccccagcttcctcatttgtaaaataggagtaatactaggactaccaacctgattcgcagtttaaaggagttaatatatggggagctagttattattatgtcatttgttattacatattagtttcatttaaagtattttctgactttataaagtattatggaatgagaaaaatcattctcagtcttttactgtgggtttcaggttgaggccatcaaaaatttcaaggcctagatttaattacaattatctatttgtggtagctactttgaaaaacaaaatcaaagtagttgaagtcaataaaacaatcccttgctttcaacttcaggtttggggagcaatgtgtgtgcatgtaaatgtgttgttccctttgctggggggaaatttttacagtgttgggtgtattttatttttatagaagttatgttctctgtgttttatggctttgtttgtttgttttgtcagtttaataccagctttattattaagaagtatttttcttattcttgtaaccactttgtaaaatacatcagaaattttctgtgttttcctaaatcatgtgatttcttctcattcagaactggagccctgattcagttgccccatctgaacaacaatgttcccttgatgttcccatcccatttactggatggagctttttttgtgaaaagaggcaacagtagtgttaacttagagttgctttcttgctgtaatcaagcgtgtttgttggcagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcaggtattagaagccaaaaataattatagaaaataagtcatcttctctcccagagcctcctgaaaaatgcccctatctcatcagtacctgtcttggctacattaacagatgagaacgtcagtctcttattttgagcatggccagctcttctttccccagggtcatttgagatctgtgtaattctcccaccaccatgccagcctctggcccacgttacactggcatccacgagtcctctacggagctaacaagtggcgtgaagttccagtggtcttatatgctgcaaaagaacctgctgtttctctggtttgttatttccctccctggaatttctgagctgtttctgcaacagaaagtggcacctttcacccttgcctccactgatggggcattcgctgtcttcggtctgcattgcataaaactgcttttactttttgaaaaatgtaaaagcataatttgccttttctttacttctcttttctttcttctctttccttttcttttttctttgagacagtgtctcactctgtcgcctaggctagagtgcagtggcacactcatagttaaatgcagcttcaaactcttgggttcaagcaatcctcctgtcttagcctctcaaggagctgagactataggcatgcaccaccatgcccagctaattttttttttttttgtagagatggggggtctcactttgttgtccaggttggtcttgaactcctggcctcaggcgatcctcccaccttggcctttcagagtactgaaattacaagcatgagccaccatgcctagcctaatttgccttttttttttaaaaaagggataaatgaaagactgaacaaaaagataaatgaaagaccaatctaatcggaatagctagaaaaagctatcctttataatatctgatgtgagctagaatgtatttaagattcttgtgtggttgtgtgattgtacagttttgcaaataatgttcagtggaagcaagtcattgctttttctttgtgtggtaaattataccagttttgcttggtcatccatgtgcttctttagtgcttcagtatacagaaagaaaagaaagaaaaaacactttcaagctattctgtaaaggtttactggtccccagctacatagtgggcagagatgggcgtgaggtatggagttgcattaggcacctacctgccttcagatgcatgcagtccaggggaaagactggcaggtcatcagacctacagagtagcaaccatgtcataggaggggcaaattaattttttgatagttttttttttaatctgaaaataatttcaccattgatcttaggaagttagtttaagttcttcatgcgtcctcctagtataagatgaggatttatttttccccttcagtcagtaggaaatcttgcatgtcatacagttcaaaatcatgtggagataatacttccccctcgttgcttttcagataagataggtatatgtcaaaatacttgtagctcttgagtaaaaatgcccaaaggtctgttactagtttttgctaaccagaatccaaaatatcctccgctcatgtgcatttttaaacattttatttcatgtaaaatctaaattattttcatctaggtttcatccttaggctaattatttcccaaagaaatgtagaggaagagtgtcttcatcggggattatcagtataaccaaaatcagcacttagtttttatatgaccaggttaaagagcctaaaacatctgcattttcatgtttcagtatggaaactggtgcctctgttccctcccaaacaagttgactccttggctgattcagactttgggtcatatcctaactgctacattgtactcaacacactgggtagggaggagggcgggtattgatgctttacagatctgcactgctggagcccaaggaaagaggcagagacaagggacctttaggcagcctcgccgcacccaggcttggagtgacctttgtttagagagagtcactaatgaactctctcatgggtttttgttgctgacgtcagatttggctgtgctttggcattcagtatgtgtttcagaaattccttgaatggagggaaatagttcagaggttaagataggcaatagaggagaggttagttgtttggcttgttgtcatacatttgtgttctctgtaattatttatttttgtcccccccacctttttttgtaaacagaaaaaggtccacttaccatttctgcacaggaaaatgtaaaagtggtgtattaccgggcactgtacccctttgaatccagaagccatgatgaaatcactatccagccaggagacatagtcatggtaagaaagactccagtgagagggtcatttctgttgaagattagcctctgtcctctttttttcactttattcaacaattgtgagattgtcagtgagtatgaaacccaataatccagcatctagatttttaaagtataagctcaatcttctttcttttctattaaaatgaaagatggcatttaaaaaaatgtatcctaacatcattttaaaattgagttgataaagacagtgtgttcttatttttaaatctataaatgtctgataatttcagagtttagattactacttatatactatgagtatacatatatatgtaatacatatattttatatatgatgtatagacaatatatatactagtgtgcgtgtgtatatatatgtgtatgtataatatatactagtgtgcgtgtgtgtatatatgtacacatatatatacacacacaaaaggatcctccaaggtggaaggaggccaggagtctttaagaaatagttataagtgcaaaacactctatcaaatcattctcataattgcaataacttttgtatctttgcatcaaagcatcttttttccctttaattatgtgaacttttaattatgtaaaaagagtaatgaattatacagttaatctgctttcctactttgtaacagaaaatagtttagaattttgctttgttattgtttctttccttgaactaataatcattttatgatgtgactaaaactataggaaccagtttaagaaagaaaatcagacatggttgatctaaatcattttctaaaagaaaatagtagttccttgttctagttactctctttagagtcttagaagtagtcaactctgcattactcttaacattttttttttttttaaagataatttagattttttttttgttgtggttgacacaagttctcactctgttgcccaggctggagtgcagtggtgtgatattggctcactgcaacctctgcctccctgcaacctctgcctccctgcaacctctgcctccctgcaacctctgcctcccgggctcaagcaaagcgattctcccacctcatcctcccaactagctggaaccacaggcgtgcaccaccatgcccagctaatttttgtaatttttatagagatagggtttctccgtgttgcccaggctggtcttgaattgcctgggctcaaacgatcctcccaggtcagcctcccaaagtgctgaaattacaggcatgagccaccatgcctggcctagaatttgtaaagaactgtgaaagttaacaattgaaacaaacatgtttcttacccaaggactgtatgtctttgaagtataaagggtggtgtacaggtgattttactattactcatgcattcatcttgccatatacacatcatatctgtggatctttaataggctaaaatacctagaaataacaatatgtttggcacttagagaaatgaattcctgtgtccccttttttcctaatagctgctttctctgtaattaccatgggctagaagaagcaaggccaaacatcccaaattattttttcttttttttgagacagggtctcactctgtcacctaggccagagtgcagtggcatgatcttggctcactgcagtttccacctcccaggctcaagtgatcctcctgcctcagcctcctgagtagctcagaggcgtgtgccaccacaccgagctaatttttatttttttacattttgtagagacagagtctccctatgttgcccaggctccagatctttaaaagttaaaatcaccttaacagtagcaaaaacctcttcaagtatactccatggcttcattcagcacacagttattgactgaaacatgctgggtgccagccttactcatcctttacagaaagaactgttggtttgggcatgccactctgtacacacaaatggtaacttgagccagcggggtgtgtttctgtcagctttcctctgacttcaccacctgctgtttcctacaccgtggtttctgatagcctgaagctactttactcatactgcctcatatttgaagtagtgtatcctgtaaagcagattaattgtaaaatatgtaaacaccatataataggaatctaaaatttctgaaaatacaatgtcacatcagtgaggacctcattacaattttttttttaatgttaaacaaaccagcctaatatttttgaaactggattttgttgcaacacaaggtgcagagaagcagctcgctctcatcctaaagtaagggaatgttatgaaatgtgatgatgaggaaatgttgcaggtgatctgtatcttaatgagaaagtgttgctctttttcgggaacatatctgggcttcacttgtaatcctaggcctgttgaaaccttttcctcgaattggctagttaaccaccagcttgatgagatgcgtagagtttagatatgctgtaagaataaagcatgtcattaaacatatattttgccttgctttcaaacctttgctttcctggtggaggttaaaggggaatgggtaagtgttgcctaactgtcaggaagtctgcatcttattcaatgttttgtccttttaagtcacttgaattctgtgtaagtacacgtatctctgggtgttgttgcggcagtaaaaatgtgtttgagtctgtgtagtaggttgtgctttttaaaaaaaaagtaagtcgtaagtcttctcagtttgtgtactgggtttctttttgttagattccttttaaggactaacttgaatgctctgtgtttggcaagggattaggtcaagtctccatctcaggccatagacaaaaaggagttccaagtagattaaacataaaagataaaattctgggaaaaaaatttttttaagcagactattggaataattttctggctaagaaaggccttttgaagctataaaaaccagaagtcgttaagaggcaaaaatggacagtcaacaatatgcaaaaattaaaatgtctatgtttcaaaatatatgagaccaagggttacataaagggttacccctgttacataaagattccgaacagttcactttgaaagacacccacaagccttaaacaattggcagagggtgggaagggacattcacagatgaagtaaaaagtcagttatttaaaaaatacatgaaaagatgcttagcttcttgggtgatcagaaaaatgcaagttataaaacaaaatagcattgttcctctgtcaaatgagcaagtttaaaagtctggtaatatccagctttgtcaagagtataggacagtggatataatatacattgttagcatggttgtataaattggttaagcgatttggaaggcaatttggcagtgcctgtttagatttaaaattctcgttccctctgccccagaaattctatttttctccttcctctcattcttctccttcctcttttgggcacatgcacaaatatgtgtgtacatggatgttcactgcagtggtgttggtaaaagcaaataaacagcccaatgtccatcagtaaagggatggcttaaataaattatgatacagctaaaaaatacaatgaagattaaaacttatgtagatcacatatacacataagatttccatcaaaaaagcagaatatgtgcagcataattgcattttggttcgaaataaaactatatatgtattcatgtgtttatgtatagttaacagttttgaaatatatatatcaaactgttaacaatggttaccactgggcagtaaagaaggggctttcgtgttgaattttatagacttctatgttattttcatttttataaatgtatctaatttgtaatttttaataaaacaaaataaattcaaggacaagtatattagagagtatctactcaggactgtaataatgtttattatatctcagacctcccaaatatgtaatgaaatgtagaatgtactactaggcataattcgttggcttgcagaagggacagcagtgtttcgattttgtactacaaaatgcattgtgatactccaggtgccattcagctgtgttatctttgtgaggataacagtcaatgcaaaaagatagatattgacatctaatagcaacaggtttgtatttttttaatttcatgaattttgcagttaacaaatgatgagcatgagacatgtagtacaacattactgtcagtctccctaggttgaaaaatccggggttcacttatacttttgtgggcacagtcatcagattctcagattcctcaaacgtctttgggacatagcttactataatatgttcgatttttagaagtctaacattgtgacagtgttttttaatgtaggcagtcttagccttaaaaatattttgtttttagaaaaacttagcctggttttatccaaaactataatttttcatgtttaacaaaaatttaatgtggtaccttgtatatagcactattctcagcactgtagataatagaaaattatcaagtctgccattcatatgtttaaaatctttttagaaaaatctagagaaacacatgaaaaggccaacatgtgatgaagttctcaataaacattcactaactctgctaggaatttaaaagaggagaggaatcagtgtaaagtgatgtgctcagggaagaccaaatgctttcaattgagtctgaccttgatggctaaggcttagatgcgtagaaaatacatggcctctcttgatctggaactcccaatacttggagggtgaattaaatcaaatttgacatccgtaacatgttagtagaacataagaaatgagaagacctatgctcactgctgttttgttgaagtttatcttgagaacacaggctgagtgtctaaatcagtacaatcttttggctttcatgggccacattgcaagaattgtcttaggctgcacataaaatacactaacactaataatagctgatgaacttcaaaaaaaagcttgcaaaaaaaactcataatgttttaagaaagcttacgaatttgtgttgggcctcattaaaagctgtcctgggccacatgcagccagtgggttgcgggttggacaagcttggtttaaatgcttatccttggactggtacaggcctgaatgcatccagattgctgagggagcttccaaaaaataaccatgccagggctcatccccagagattctgagaactctactgcatatacagccttcagaagtctgaccaggtggttctgttaggtagtcaatttcaggaaccgctgatctaacctaatctctttttcacgtcaggactaatcctaaatcatttctagaaaatatcctcttaaaaatatccaaagaagaatggacttctttagtagttatcagtcattagccagtcagttcattctggaaattgtttgtcttagtgttactcttataacaatttttaactcattcttttccttttcttctcctgacagacatttttttaaatgtagccaacaatacctttttcctctaccttccatagatttccatagattaaacatcagaaagtatctcatttagtaacaactggccataatatcactgcagttttgagggaccagtatacacgattacagggttggctcaaatctggcccaatcactgcctgttttataataaagttttattggaacacagccaggctccttcattcacatattgtgtgctacagtggcggatttgagtagttgcaacagaggtgaaatttgccagcctccaggttggagctttagaaagagtttttttgtttgtttattttttgtttttgagacggagtctctctctgtcgcccaggctggagtgcagtggcgcgatctcggttccctgcaagctccgcctcccgggttcacgccattctcctgcctcagcctcccgagtagctaggactacaggcacccgccaccacgcccggctaatttttttgtatttttagtagagatggggtttcaccgtgttagccaggatggtctcaatctcctgacctcagaaagagttttaaggccgggcgcggtggctcacgcctgtaatcccagcactttgggaggccgatgtgggcggatcacaaggtcaggagattgagaccatcctggctaacacggtgaaaccccgtctctactaaaaatacaaaaaaaaaaaaaattagccgggcatagtggcgggcgcctgtagtcccagctactcgggaggctgaggcaggagaatggcatgaacccgggaggcggagcttgcagtgagccgagatcgcgccactgcactccagcctgggcaacagagtgagaatccttccaaaaaacaaagacttttaatatcctcatctaggaatttggggagaaaccttatatttcaaaaccggcaaatccatggaaaatgttttactacctgcactcctcaacacatcccatgcagccactgtcagctggtctgaatacacaggctaaacctgtttgctacacttgtttatcatgttctatgaggggaaaaaggaatttctgcttcccccctttgtgacaaggtcagagattttagaaatattaatcttacctaatgaagatggcagccatggagcatataaaaattgagaaaagaggtgtaatatcatcggcctttgccaaacggacttgaagctgaagtggctgctgtgtatatttgactgttgcatcagcgagctacaatatgcagtgtgtaattactaacatttagtagagcagctctgtaacatagtcccagaaatgtgagcaatatctggtgtttgtacttcgcttaaatgatgtttcactagaattacccccaaatacgttggggtgttacagtgtgcctgataaatgaaattgtattgagaccaaaattgttaataataacatctcccttatagcccccagtaggtaaatgtacattgtgtaaaagtccacgttggaaccagtcatattacaaagcagtttgtgttcctatttcttggtctgccataatcttatgttttccaaaattggattggcattttgggtagttttccaaatccaagaagaaatatttttcattttcatatgttgacctttgtgccctttctaagtggttaatttaatttaggtgttaagaatgaaagtctcttacagcccctgaaccttaaaatgtaataatttattaaaattgatgtatacttgtaagagtaaattaagctaattgagactattgtttggggggctgttgagaccaacagatttctttgcttaaaagtgaaatgctgatttcactgttatccttagggatgggagaagctcttgcttaaggggataagaggctgatatggccccctccttcactcctaggtgtacactgcaccagcaggctttctatcacatctgaggacaggctgggtgttatcagtttactggagggggaggacatttccccagggcttcaggtcgcattccagatgtccaccagtgtctcgctctgttactcaggctgagtgcagtggtgtgattttggctcactgcaacctccgcctcccgggttcaagcagttgtcctgcctcagcctcccaagtagctggaattacaggcatgtgccaccacgcccggctaatttttgtattttttgtagagatggggtttcaccagcctgaaactcctgacctcaagtgttccatccaccttggcttccagaagtgctgggattacaggagtgagccactgcacctggcctaaaagtcttattaaccagtcaataccctgtgtttcaagggagtaacaatagatcatgggacataattaagcaaagcagctgacctttgaggaggtccaaaatgagcagacgagtaggagttcccgtcgatcaagggatccacttgagcccctaaaggattgcttatggcaagaaggtaaacctagagggagcagaggaccaggcagttagagcagggaactcctgaacagagaagcagattgttacctagagtgaaggtaaagtcaagaccaggcttttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcatgaacccgggaagcggagcttgcagtgagccgagattgcgccactgcagtccgcagtcccacctgggcgacagagcgagactccgtctcaaaaaaaaaaaaagaccaggcttttagaataggacagaagcccaagtaggagaactacagcgcaacatcagagctggacagcagaagagagaatttaaaaaaaatatctggcctggcacggtggctcacgcctgtaatcccagaactttgggaggcctaggcgggcagatcacctgaggtcaggagttcgagaccagcctggccaatatggtgaaaccccatgtctactaaaaatacagaaattagccaggcgtggtggtgggcacctgtaatcccagctactcaggaggctgaggcaggagaattgcttgaacccaggaggcagaggttgcagtgagctgagattgtgccagtgtactctagcctgggtgacaagagtgagactccatctcaaaaaaaaaaaaaagctaacacttttagtatgccaggcattggtgtaaatatttgtcagtcctcacagtgagcattataataagacaggtatttttattatccccattttacagatgaagaaacaggtgccacgagattaaacttgcccaaagtcaaccagttaatagattgtagaactagctcctaaattgagacggtctaactgcagagccctattcttgatcattacactttgcagtcttgacactaagttattgtgtgtttggctcaagctcctaacccactcctgcctgacatcacctttggtcctagaaccaaggtggctgatcttgactattgaacctactgagaagtctggcaggacctggcttggatagagacagctatgtttccagtgtggagcaaagttataatgtgtcaccatatcaccaaaatgtaaacaaggaaggaaagacatctagccatttgagttcagcataaaagaagatccaaatgggggaaaatttatcttaaatcctcatctagagaaacagttggggctgcccagaaaaagaacagtaagaacaaaacaatgactgcaaagtggctagtgtgttcatgtgggtgtaagtgtgagcagaaatgatagaactgtgaagccaaaaattcaacctttggaagtgttattgcattttatacaagggaactccttttttggttgtttggagaattctcagctttaaaaattgcttttatctgtgacaataaagattccctaaagtggagcagcaagcaggcatcccctacttgctgaatatattgtaaataacaggtagaaatcagaagtaagccttgccttgcattctgttttctccacctctaccccaaacatttgttaattcaaataagctaataagtattgaaccctattactcactgtccactgagtacatacagatagatgtttggtttgtttaatgtaatcattttttgctttatttttaattaatttttactgaatacttgaatggattagataactggtatttttgtcagatttttccaaaatcattgttaagaccctgcctactcatgtctgatttctaagaagcaactttaatttccagtgaagtgtttgatgttttactccttaggcagcataggaaggggtaaaaataagatataaggtttcataagataagacccttataagaattatagtaatgaaaataaaattttttttttgagacggagtttcactcctgttgcccaggctggagtgcaatggcatcatctcagctcactgcaacctccgtctcctgggttcaagcgattcttctgcctcagcctcccgagtagctgggattacaggcatgcgccaccatgcctggctagttttgtatttgtagtagagacgaggtttcactgtgttggtcaggctggtctcaaacttccgacctctggtaatcccccgcctcagcctcccaaagtgctgggattacaggcatgagccaccgtgcccagcccaaaaataaatttcccaatagcaaatgtgattgtcctccaaagtcattctcctgttgctcataaaatagtagggacaactcgtaaagaaaagtagaatcgttttggccattttggatgatccatttgagtcagaattaaaatgcaaaccttaaaagcatttggcgtaataaatggcctctgtgaaatttttaaacagtataatcctggattttcctgtgcactgaatatgcaagttaaatttatacaaaagaaaactacaggaccttaatacaattgattattgctgtaaataatgacttccttaattttctcatcatgtgtctgtggagcttttaaatgcctaaacacagcagcagtcagctttgcttctcgtggaaaccatttaaggccatggtttttttttttaaatcttccttgtccttatactgaataaatactacttagttattggaggttttcagagtactgaatttatattgattgcaccctttgctttcaactttaagtaataaactcaagtcaaattatttttaataatgacatgactttctgatgaagcctgttaagtcacttcccaaatcaaaatatttaaattacatgcctcaggactccaggcactttgtctcaactgccattattaggacagttatggggtaaggcttttttaaaaagtgcagagaataagagcttgaattatagtgcattttttttttcagcattactgcttagactcttttcccagacacttggactaagatgaagagattcctatgccatatgtcaatctaaagagggcagaggcttgggacttcactgtagttgggtgctgggtctattcaggggttaatttagttctacttaaagctgtgactttttccacaggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtacgtgttggtgggctctttctgatgatttttgaaatcccaatttgatcatttcccccccacccccttaagtattttcatagtcttggattgtccttctatgtgagggagctggctcattttcagtactcctttctctagctggcgaattggagattacagtccctgaactggatttaatgatatcattgtctaacagtgacttaccatggtacaaaatgaagcctgttatcttgttttgttcaataatgtatttgtatctatcattcttgtggaagaagtggagaaatacagtttcctaataatctattttgacatccatgtcagtcagcaaattttcagagttatttcctgcatgcaaatagcacttttttttgccaggcagaagcaaaaattgaattcagtcatgtggttctgaataagatagaaagctgtttcctttaaagctttccactttcattaatcttatacaaatgtacagtagaatgaagaggtgtttgcacttggccagttagttctgtgccctggttcatcaggaaatggcattttaaaaactgtgtgtaagcagaggtttgaaatgatagatgaaatggttgttcagacttccagttatagggccatgacctagatgagcaattgtctaaaaatattttatactaggatacaagtatgagtgatttgaataagaagtgtttaaattttttttcaagtctaatcatctttcagaagaaacaaattgaaggcaaggaatccagatgtattgctggagaaggatcagatggaacaaatagagggaagaaagaataattactcagggcgggaggaagtggagggaaggatgtaaggaatagcaagtttttcatactttattttcacataaaaggctgaaggcgctaaagaaggtcccctcatctaatctctgctttaagaaaaaaaagccttccattagcttgacttccaagttgaaacttttccttactcttttggtcttgactgaaaagttctgagtttttaaactaaagcttaggctaaaatagaagactaataccatattttccaggatttgttttgctggggatcaaatcagtatgcctcttcttcaatatatgtatggtgtgcagttctcttgctataattatgggcaccttattttccaaatgaaaaatcaggaattattttgattttcagatttgtttgtatatcttataaggatgtaaaaagtaaattgcctttagatctgcagtcacacagacatgtttatctaaaattattttttattatttattattattttgagacagggtctcacttcatcacccaggctggagtgcagtggcatgaccatggctcacagcacccttgacctcctgggctcaagcaatactcctgcctcagcctcctaagtagctgggcctacaggtgcatgccaccatgcccagctaatttttaagttttttgtagagatgaggtctcactatgttgcccaggctgatcttgaactcccgaactcaagtgatcctcctgccttggcctcccaaagcgctgggattagaggtatcagccaccatgcccagcctgtttatctaaaattattaaaatcacaaaactagaactgtccctgggacccaggacaactggttgctgtcaggatgccacttgtaattgctgtggcatctaggcatactaccaggtacttgctgtagagtgcatgggtctgagaaatggtgttgagaagctccagctccataggtggcatgtagcttttttttttctcatttaactattgttattacaaatgataatgatcatgtgaggatgtttctccggggctttgcagttacagagtatttccctagcctgtatttcatgtaccctcacaactaaccttaagtggcacagtattgttcccattttatcaatgaggaaatcaaatgccttttcctctcctccttgttcttttatttatttttctttttgagacagagtcttgctctgtcacccaggctggagtgcagtggcgtgatctcagcagctcactgcaacttccacctcccaggttcaagcaattcttgtgtctcagcctcccaagtagctgggattacagactcaatgccaccacacccagctaacttttttttttttctttttgagacagagtctcactctgtcatccagtccagagtacagtgatgcgatcctggctcactgcaacctctgcctccgaggttgaagcatttctccttcctcagcctccttagtagcttggattacaggggtgcgccaccacacccagctaatttttgtatttttagtagagatggggtttcaccatgttggtcagactggtctcgaactcttgacctcaggttatccagccacctcggcctcccacagtgctgggattacaggcatgagccactgtgcccagcctcctccttgttctttcactgtagaaagccacattaagtatactaggtttgtgttgcacaggctcattggttgccatctttttcttttttctttttttcctcttttatttatttatttatttttttggtactttactgtgggtaaaaagctggcatattagggagtgcttgcttttttttttttttggtactttactgtgggtaaaaagctggtatattagggagtgcttgttattcatggtgttgtgcttttccctccaggtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccaggtaaaggcagccagtgagagtgtgaagacttagcatgctatctagtgccaaaaacttcagcaaatgctttttggcaatgtcattttgaagcaagccttgttatgtgtgtcttggttggctggcagtatgggaatccagtgcaggagccagaaatctgctgtgaatagttgggagttgggggtgggggtgggacacagtcaacttctcctgcctgggttgatgaaggaagcttcattgcagaagtggcacttgagctgcatcttgaccagtgggtaagatcttactagaaaatggagagagcctgcctgtcagacagaaactgctgggaaggctcgaaggcagacagtcagaatgtatttaaggaaaatcacatacccctccatttgtctagaccattgagttttttttggaaaaggtagaccaattaaaggttaatgggaggctctgaaatgccctgctcggaaagaataatgtctgaaaggataaaggtggttattctgaatagttctcttttgcttaatacaataatgataaaatactcaaatttctatcaataatcatgccaaacagcaagtgcccatctgggaggcactggaggttccagcatcatttctgatctgagaacacccagatggaacacagggtctaggcagatccatctggaggagcggtgtgcaggaagattagagtggagggccggcagggcggtgccaccagtcagggggctgttggtgtcacccagctgagacctagggcaggcctggacccagctgagttcatgttcaccaagtagggaggtgccggtggaagcagaagaggcgagcacgtgggagagactgcagaggagagtgaagaggttggagtcacaatgcctatgggagccgaaggaaaggaaagagggctgggattgagaataagggcccaccttaaagcgggaagggagaaaggcagaaaatgaaatgaatgcgcagttaaagggaagagttgtgttttagttgtgttgagttgaaggtgaacgtgggaccctgtctggcaggctgtcggaatatagatctggaggatggaagagagcacgagactgggattatagattggagccattcccatagagaacattatcggatatcaggaaatgtgtgaggtcatccaaggagagggaatacagggagaaaatagcaaatccacaggcacgtgtgtgttctgtggtctggaagaagaagaggagctactcagcaggaaatggtactttcctttgcatctgtcctagctcagcatttagcacgtgtcacatgctcagttaacagtaactcagtgatggggtgggggtttgttccagagagtggaggtgggggatgggaggttgcttatgttactaagtaccgtggtcagggcaaagaagagaccattcattgtgacaggtagagctttgtaacctgggaaggagaaggatgaaaccacactgcaggggcgtaaaaggaaatgagcagcaagaaagtggaaagatctgcaaaaggaaagagaaggaccagagtgaggggcctcgggaaagcaagaaccagccatgttgccagtggagatgggaatggaaaagtgaagtgtcagaggatatagttggtataaggcagaaaacattaaaagcacagaaaagacaggagtctttttcttctggatgaggaagagtgaagagattggagaagataaagccaagaaaaatgttcaagttgggctgcatgatattgttctcagtgaggagggagcctggaggggctgcggagtgtagaagaggtttgggagcaggcgaatgagggatccgacaaagaagaatgaagaattgggccggcgcggtggctcatgcctgttatcgcagcactttgggaggcaggcaggtcacctgaaatcaggagttcgtgtccagcctggccaacgtggtgaaacctcatctctactaaaaaaaataaataaatacaaaaatcagccaggcatgacggtgggcgcctgtaatcccagctacttgggaggctgaggcaggagtatcacttgaacctgggaagtggaggttgtggtgagctgagatcacaccactgcacttcagcctgggcgacagagcaagactgagttctcaaaaaaaaaaaaagaattgcctggcttaatttaacctgagtccgtaatagatcattgcacattgcctcagctttctctagcaatgcttcacagcttgggactaggaataataatagttatatagctcaccactgttatttctatcatagcaatactgtgcatggatcttactaaacttccttccccctccccacctacacacatcttgcattaccatgggattgctaaactttaatagccttttggagaaagtatcatctctactttacagatgtggaaatcgagattcagagagattaaacagttgccaaagccagaaaattagtaagtgacagacctgggattcaaacccagagtccacatccagcccaggctggggtcattagggcccatcaatgtgaaaaggttgacaaagcagacacggggaagatttctcagggggagagattctgaaataccagtgagggcacagttgaaaggccaaccctggggtccatacgtagagaaatcagtgaagtggcggagaggattagacagtgcagaagggctgtgggatgaggagctacgcgggcagcaggtccactgcaagagggggaaaatggaaggtcgagaatatacaatcttaggggtgttcgaaatccagggaaaccccctcagctctgagggacttgaaggagtgaatgtacagctaagtggaaggaaataggatagggatgttgtgggtttaagaaggcaagaacccatgaagaccaggaattagaggttatcaacatagatgctgaaactatttgacctgttgtaaattctctgctcatcagacataatcataacttaatgtcagtataatataaatgacttctaaaggcatgtacaaattggttctgaagtaactctctctaggcattatcttttgttcttgtccattcatatatatgattgaaagttggtgtttcattttttactaaatgctttaagatactgtaatggtttaatgctatagcttaaaagataataaatgcctcaccctgcctttccagcctgacttcctcctccacccctccatgagactaggccacatgcagccccggattgtgcttctcttcccggaccccctgcagtgttccacctcgaggcttttgcccatgctgcgccctcggcctggagtgcccttcctccgaagccctagctgtcaaagtccttctcatccttcaaggcccatctcagatgctgccccctctgtgaaatttacgctgatgcccccaggcagaattcatccctgttttctctttattcctgcagtgaatagtaggaactcctttttagtatatttcattctgccaggtggtacacttggttgtttttatctctgtcttccccattacttgtgaattacctgctagtaatactgcccatctttatagtgctttgtggttaataaagtgcttttccctaaattatctgggggaggcagagactgtttttttcatctgtaatctcatggggcagtgcatgtagatgtacaataaatggtaattacaatgaatttatgctaaccaaatccctgttttctctgaaaaggaactaaaacaagcataatccagatagggcctatttccctgggtctacctaatctaaaatgccagttaatgatctcatgatagttcataaaatgtctgctccactgttaatcctccactaaaaatgccagtcaaattggaaatggggaggtgtcccgggcaacttgagagtgaaaatagaaccaaaatataaagggcacacagccagatgcaacagaataattgtgacctcctggctttttgaaatagagagttctagatggtcagacaatgactttgtgaagaggctggaaggctttggcctccacttttggaaataaacaattgttgggaaacagtgaagcatccagccctcctgctgtgctgcctcagggccctttgtggctgtgtgtgcttgtctggcctgtgcttgttggagaggtgccatgctcacgtctgccctaattgataacaaagcgcaacataacgagaggtcctttatgttattccacacaagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaaggtatttttgtatttatctgcttgtatttgatgaaaacaatattaggcgttatattactgtttgcactagttaagattcacagacaggagttgcgggattagtttgtcttctagatcttttaactgcaaaagttatagtatatagagtaccaaaagggagcctcttatagataagtgcattctttcttctctcatgaaaacctatgtgccttgtttttcattgccttatgcaagaaggaattcagctctgagacctggaacactcttgtgcattagttggagattatgactctctttatgcttattacccagtgctgtaccagatatatgtgaatacttggaaacccaaaggatctggggaaatgatcagaaggacttaattgtctttttcattagggtcttatagcatggaacctaaggttgttaattcctccaaccatattgatgttcaaaacaaattatgagctttaaaaggatgaaaatagcaaaaatattcaatgagcatctctcagtcagtcatgccttgaaataaactagtacataagccatgtgtccagtatagcaaagtgctgaaaaataagaatgcgagcttagagtcatgcctctgtagtaccttattatgtgtttttaacctagctaagtacaactatttcagctgtgggtcgtttaaagttttaaaagttaagcagttttaacagaaaaatcagtgtcattgtacgattttctttgaagataaaaattaaaatactctcttcttccattattgcagcatggattctggttcttcagagagtcctgctagtctaaagcgagtagcctctccagcagccaagccggtcgtttcgggagaaggtgagggcctgagttgtattatgttcttcagaagggtcaaggacattgtgtaaatgtttgaaatgagattgaatttcatcttaagatagactgcatttatgatcagtatattaaactacagtaaaatgtaagtttagctctttacagaatcggagtacttcatggaaaatactgtcaggtatattaatcatcaaaaactgaattttctaattatattttattataagccctttgacttttaaaagagacccattcagttcactaagaatcgagttttccgagcatctctatagctaaactatggtcattgcttcacctaacatagtctagtctcatctgacttcatagataagtatttcgttttaaaagtaactacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaataaaataaaataaaataaaagtaactacacagaccactagagttctcatagtaacatgaatgccatctgtaccatcccaaatgaaactgaaactcaatttctgtgctccatgaaaacaatcaaaccagacaatttaggactaaaaaaaaaaaaatcattttgagtatttattatgcaaataattgccttctttctcaatctccacttggtgacataatcctaaatattgtatggatgccaactgaataaaacttaggtaattcaggccctcatggtaaaaatctcacatcttttttacattcaatacagccatcatcacatcctaactggagagtgctccctgagttagatgggttttctgtgtagacatctgagcagtgttgtagttaacagatgccataactaaccaattctatagtaattctttatgggttccttgaatacattacaggagaatagaatgttttatttagtttgtctgccataatgagattgttaacattccttagaaaccttgcccagtgaaaaacagaattattaaaacagctgttttaggtggagacagcaaggattaaggtataatggtatttcagactcacagtaacaatgttcttttttcaagaggttttttaaagtaagaattttttttagttcatagtatagctataaaaccttatcactaaacaaatccagcatctaatttttgctattaccatgaaaatgattaacagagttccctttatacattctcattatcttaatgactttttatccactgttagggtaacaaggcaaaaagctcctttaaataccacatgcagtcagtttagtaaaaagcaacttatgcacctcaccaaaagataaagaaaaaaactttggtgtgttacatccaatcaaggctcactggagggctggagtttgtatcttgactcacccatctagtaacagtattattttgtttatgccttagcttctttgtctgtaaattggccgtgataactaccccttgaggtaggaaattattacaaggataatgagataacatgcagaaggcttttagaacaaagctcagtaaatgtctgctacttttatgtcgtttttgcttcattccctggattagtgataaagccacataaagtatgagcatcctcatccaatagcagtatggaggagtgtttgtttgttttgagacatgtactgaggactcaataaataggtcacaagtgaaccatgcatgtacttaaaattgggcaacataatagagttaaattctgatcttagtttgtatttattacagccaattttgaaatgacttagttattagaaatatttggaaaggttgctggctttgtgaaggggtgggaggacattagaaattctgagaaaagctatttacatatattaatgagccttttgtaaataccacattgaacataatcaaatttaaagtaaactgtaaaccagataaaatagatgattggcttgggttgcttttaaaatatttaaaatattggcttggggatggccagtgccctctgtggaatgtttcctgagaaggggtagctaaagaggaacctctgcctatccatcatcatgtctctgggtttcattgtcaccctaaagccactctcagatgtctttgtgcaaggcaggcagggcaaggccagcctcagtcttcccagtctcctttatattttatactgcaataccaagttcagccagagttcatgtttctgaagtttcttaagcatttggaaagttacttcaaaatttggatcaattttaaagaaagtaactttgaagttgaggaatcactggggaaagtattgatggccaaggatcctgtcttaaatggccaaatatgatctaaagaacagtaacagggagcaaaatgaaaagggaagggtgagagtatggagaagtcagaaaaatgagtctgttaatgaagaaagaatgaccctattaaagccaccaaactttgatttccttgtgtgggaaatcatttttccaattttcactgtggaggtatgtgttaccagcgcctcagggctaaagacagagagtcttctgttttccctgggacgtttgaatgacctgtgtctgccatggggcccagtgctctccaccagcaattgctgctggcctcggcgctgacaggtcaacactggcgctgaaggaggcccttgttgctccaggggctgcccacgtgagcacaagagttagaggtttttgtgtttttgtctgtttgttttagttttcattagtacctcctgcagaggctctgataatcaaccgaaggagttctccataaaaaattcctacctcttactcaacacgaggctcgacattaaaggaacatcatctgaggtttagagagaaacatacattgtccatcataaaaatgaactttttgggtaaatggtgatttttctgttgctttaaaaaaatacatacaaaagcctaggataaaatggagaaaaaggggaaataagaaacctgtgcatctttctgtaaatcttttatcctgtacctagaacctccatccaggattttgtgtctggtgatctttctgagagtgtgatttggttctaagccttaataaaatccaccaagagtgatgcaaagttctacatctaattaaaaaggaaagtttcttctgtaatgcacacccttcaaattcaagacacaaaggaacattagttcttatcctttaagactaaattacatgaataataaaatgtgataaactgtgatttgtctttttaacttgttgaaaggctttctgggattgggttagacattccttttatcatcagtcctctctacctgtttgtgctcttgaatgacaactagatgcccatttttaactaaacaatatgtgtaactcattttgtgttctaacagcttcctatcatattgtgtatatggcacaataggacataagttttcaggcacttcaataaggaaaagtatgtcttatttaatttatgcgaaggatatatgctatctaacaattttttaaaaacctgtgacgtagtaccctcaaaactgaaatacacatatttaatatgcttaccaagagcctgcatatgaatgcatctgacccagtgctcagcacagagtaggtattgtgtaactcttagttaaaaataaatgtaaaaaccattttcattcaaaaagaaatcatgatgctaaatggtagatcactcttaaatactcaagtgtcggtaaacatgcagttgggttttttattcctgtgtctgggtcttcccaggaattgtctccctgtctgcagctactgaacttttatgtgcactgggggaatgtggagcccagggcattctgcagctctgtattttatctgtgactagcctttctcttgaatggatcttgtcctaacttccttattcgtaaacttgcttttgcaaagctgtctgggatttctttaaacaatcaagctctctccgtatctcaatatttctccccaccagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagaggtaaacccacattaactgtttcctctccctttctgtgcggtgattctctttgtggggagtcacgatgtttgacagcggaactttgttgggttttgctaagttctggaatgtgacagtaaatccagtgtgacctgtcattgtttgatcttgtcatttggcactgcgcagtaagcactggcttcccccaagcagaatgccatcagggctaagtggaggctgagtgtgatggggctggtccgcatcagctgggaggataatgttcagtattaagctctcttcctgcctgtaactgacttacgctttggagtaaactttcttgattagatcattatggtcattgatttttaaatgcccaagaatggtagcaatattttgcctgtataaacagaagtattctggtgataatcgccccagaatattggatattattagaaagtttttagaatttctggttttgcccacacagtagaaagacacaagatctaagggatgggtacacttttggctaggccttagaatctccgttgatcaggactgaatttaagtgctgttatccgtatgaattggaagtgctctcactgttgttaaatagagccctaaaaatttgatcacataaactgtggtcttaagatagtgcaagttgaatggaatggtggggtggacctaccacagagcatgggagtcagtcttgtaggagccacttgcacgttagtggagagtttcagggtataaatggagtcatttaacagatccaatgcacatttaaaaaaaccaacaagaattaactccttttttttttaagtgttgacagtcaattcacagttattttctttttctcctcatacctcctaggtactgagagagaaaaggctggcagggagcctgtaggggccgctttctcaggagtgagcaagtggacaaagttctctctctctttcaaatgccagtagtagagtgtatactgggctcttacatgtgcggctccgtgtactcggagctgctctgggagcgaggctgggcctggtgccctgctctaggagtcctgcccttggcctgctcacctctcctgcagctcccagaaatgattttatttgcttgggttttgtttttttaaggggtggcattgttttgctttttggtttttcttgctgcggtcttgagagcagctaagtggaattcccatggatggatttacataagtctgcccacccttggagaatctggcagaagcccggaagaaagtaattttgccctgcgagacagctggcatattggacttttcagacctggaaacagagaattcaattcttctccaggccagcaagtcgagtccaatgagagtcatacagatgatatttcaggggaattgggtaaaacactaaaagccaaactcaatttctactaccgtgcatgaaaactcttaaagtgactttaccttttggatcagttaaaatacgaaagccattacttgtaatgtattttaataagttacagttttctactttaataaaaccatccgaaataaattttaggaaaacacacagtgacttttttttttaaggtaagtggagttgtaaggtactttcttaaccacagtcttaaattattagccacagaagaactagcagtactagaaatttttagatatacatctagctatactattcaataataatgaaaaaaaaacctgaaaactcagctctttcgtcctacttgaatacagaattcagtgtaaaagcaaaatatccgacccaacctaacaccagacccagcttcagataccagaactgacgtctgggcatggggagagtcgtcccatcctgcttcccttctctgtatgggcaggtctggggcacagtctgggggactttataggtgcagggaggacagaacatggccttctgaatccatctcagcttatggggctggctgtggtttttcaaagggagcacattgaaactacttgaactctagggtactgccaattgccttgttctttttatggagtatagggagtagattctaagcctgtactaggaaagttaactggtcactggagtcttgtttcattggtattcctttttttgatatgcagcctattgaaaaatagtgagagattgcttttgtataactttgttcgttaataaagcagaatcagagtaaaaatttaacccgaacttttcctggtaaatgtttcttaaatttcaataagcaaaataaagagactgtaagttgtgttcctggtagataaatggcatatttttattctttcagtaactcatgttttgtttattaagccttttgttttgttttaattggaatgcttaatttactgcaagatagactcaagcataaattaatttagaataaagtactttgtaacaacagattccgttctggctcctgtcctgcctctcgtggtctctgttgttggcttacttggctggtttaaaattccatgagtatcccagagaggaattcaaccccagagcactttttaaacacttgatagttgggaagaaatatgctctgcctctatgcattgatagagaaatttcaatgtataaactctgtgaaattgggtggaaaggccacacaggacagccactgcctctttggatagagaggggtgaataggatgggggaagagaggttccagttgtccctgttagttttttaaaaaagaaagctcctgaagcaaatgtgcaaaatattaatattttaatgtgttaaaaccgggtagtaggctcgtgagttatattccctgtactttttatgtgtgaaatatttcataattagccatgtgaaaataagtccgagcttagtgtttaggatgtaaactaacagtcttcctagcctggaacctcctcttagatttgaccaggtccgagaagtgcctgtgcttggagccctctgggctcttacaggcgccatactctgctgtttttttctcttatagaaatgagtaaaagccacatgttttaattatttttttccatgttttcctgatctatatccttgtgtcaggtgatacagtgctatgttttcccagaatgaaaagtggggctttggggctcaagcgggtttgtatcatcattaatcgtttttaaagttgcatgatcaaaacttcagcatgcaaatgagaccttttgctctgttttaagggctctggaactgctgggaaaacagggagtttaggaaaaaaacctggtaagttacaaaccctgatgcttacttttcaatgttttgaatgtaattgatagttgctccccatctttgtgtattagggccagaagcctaaaataaaaagaatctttcctaagagtggtgagagtaagtcctttccttggaatccattaataattttacttggttatgagatttgtctgttgcttcacacatgaagagtggagacgttacctaacagaatgttctcttgggttgtcgagaaataattcaggtgaggccaggcacggtggctcatgcctgtaatcccagcagttttggagaccgaggcaggtggatcatttgaggtcaggagtttaagaccagcctggccaacaggggaatcccggtctgtaccaaaaaatagaaaaattagccaggcatagtggcatacacctgtaatcccagctactcgagaggctgaggcaggggaatcacttgaacccgggaggccaaggtggcagtgagccgaggttgctccacttcactccagcctgggcgatagaacaagactctatctcaaaaaataaaataaaataaaataaaataaatatatagataaataattcaggcaagatgctgggaagttataatacatggagctgtaggattatgggctcagctgcttctccgtcttcctcttaggcttggttagccctttttcatttcataacaatgcattcccaggacacaaacaatggagaagattagagtgtaggtcccattaatgtagaagccataggatggttttcctcggtacacattgaaggtacaaaattgtagtcatgcctctgaatccaaagtgttttagtttatttcagtaaaatcacatgtgctataaatagcacgaaaaagaaaagaaagaagcggatgtgaaataatacggtttctgtggcacgtcttcctggtctaggtcatttgaactttttggctatcatattcttagaaaattataggttgaaacagtcactgaattgccaagagacggatttgcttgtctgtctggtgcccagctccaactgggcttacatggctagggaaaagaagggaaatttcacgtagtctaggattttattttagtcagataaatactggatggagtatttagtcagataaatacagtggatggagatacattggaccaccccaccaaatctccgttttaagtgtaagttttctaagttttgtacacttgtcattccagagggtccagatatttcatagatgaagcccaggtgggctttgctttgcactgaaactagcaagaaaggacacaaaagactgcagagaatgttggggcagattgctggctgcgtatgccaggtcccttgaggagcaagaacatccagtgccaaataggacactagtttggtctttctccaaaccataaactcttggaaccaagagctggtctttggtgtgttgcaggagagtcctcatcccagcgtagacatcccagctggagctcccagtcagagcctaggctgggccagtagaccatgctgtggcctttcttgcttgccccaagctctgcaaagcatcaggcagggccaggcctgcaccatgaccgccaggtgcttctatcctggtggccgacccctgatagcatgcagaacagaatgagagcggcttgcttaagggccagagtcttacttgttccctggagtgagtagaaaagtaggaaatctcgtcagaacatgagacctttttgcgttcttcctttccattcttctttacttcattccctctttcttcttttttttctgtccttctttccttcttttctcctttcgttcacaaaccacacttggagagcaagggtagaggagcagaacagtttgttctctattgcttctagaagttcagaaagcagtagttgcagatgagccagaactcaggcagagaagggttctgtctcttcatactcagtctcctgggcccgtggaaatggtgtgtttcagagcctggtctgtggtaccgctggagtttttcccatgggacttttcacattcaggaaaagtacagaactgttcacatttttttccctgtgctgaattgtttttgcataaagttcccttcttaactccaggtccctcctgtaacgtgaaataaaaagaaagaaatttgccctgccatgatttgcacctgatattcagggatcactctcaaaatgtgagccataaagaagaaggctgtgtcgttgggagtgagaatctgcagcaacaacatagaaataagcccctgccgggctcccagtggtttctgaggaaaatgggcttctctttctactgtacttggcagctagaaaagctattgagtcctttagtcacttcaaagtagcactttagccattgggtgctactgtgctggggtgggtggtgaatgaggccccacccttggcctcagggcattctgggtaattatgggaggggtgtgacagaaggtgccaggagtgggcaaggagcggacttcgtggagggaagttggtaagtaagtttcacgggatgacaagggagtctgcagcccactgagggctcaaggatcagccaggcccttgaatgccgtgtctgcctggtagctctgggaacgggcgattcagggagccttactcgttgggtagaaatccagctcaatacattggttttgatgtgttcatctgtgaacctgggaggcgcctgcatcttcttggccttttctcctgctgactcttaacagtgcactgccgtgtttgatcttgtttttcagaaattgcccaggttattgcctcatacaccgccaccggccccgagcagctcactctcgcccctggtcagctgattttgatccgaaaaaagaacccaggtggatggtgggaaggagagctgcaagtcagtgtcttttttgtttatttacaattctccatccaagtttcaatacacaaaatctcaaagggacgctattttattgtaaagtacaaaccacccctcaccacctaaattctgtatttggatagtgagagatgccaaattttctgtgtttgtttggttcctaagtttcagacagccggtaacagatttctgagagctaggagcgcatacgaaaacatatctttcccattcctgaattcagatagagtcggcatagtgagaactcatatgacgagggatgcctgcatatccttatgtgccttggcattagagagtggagcttttcatcagtggtattagaaggtgtggcacaagagcagatttctttgcattcaaagccacatccatacatcacagtatttttagttcccgtgtgtgtgcgcgcacgtgtgtgtgtgtgtattgttaatcatatcatcttgtttacacattttaccattccagatacttcctataagtctcatttccagagacaaagatgctttaaaaagattactgttacgcagttctcatggtaaaacttcttagaatcattggtggatgcccaatctgcaagaaaattttcagtaggagcagaaaatgtgcatggtcttgaagtgacccccacagatcactcatgatctgcaggggaaaacacaataattatagagtggggaactaggacaagacctgaatgaggtgatcagaatgatgagcagtggggagaccagaggacatggtgtgtgtacagctgtgccgggagggaggagggagggagtgactggtcttcaaaaccgtcaggatcataaaagacaaaacctgtcgaaagggggctaaagaggcgtgaggactggctgcagtatctagactcagtgcagtatctagaccctgtgtgaaagaaaaccacgctgtcaaggacatttttgggataatggacaaaattgggttatggacactacattagacaaaattactgtaccagtgtaaaatttacagaaagcaataactgtactgtggttatataagagaatattcttatttttaggagatacgtgttgaagtatttaggggtagagttaagatgtaagcaacttgcaatcagatgaatcaaaaaaagaacttgcagagaagagggtggggggggagggagggagaacgcgcacaaatgagggagcagctgctgccaagtgttgacagtaggtgaattcgggtaaagggcctatgggtgttctgtgtgcttttcttattcttgccaattttcctgagtttgaaatcatttctaaataaaaagttgcctttaaaaagttactactatagcagttacttgagaggtaagccagctgacttttcatacagaaagtgtgtctccctccccgcatcctcccccatccaaagtgaagatcagcctcagactgccaggcgggcacctggccacctgcttcatagcttagtgaaggacagggcttgctccctggcttgcccacatggggcctatggaaggactgaattttccagcagccgtccgtctctctggcgtttgttgaacgtgggcctctgcgtaacacaggggggcctcagtaaggcttgaacggatataggaaggaatggtttctggaatgctttgtgaggaaggggcccatgggaaccctttggtggctattagtgggcctgtagactgacttacccaatctgctggtatttgtctgcccatgagcaggacggtatggaactacgtaagtttgagggggaagagggaggcaggaaacctttgccatgcagtggactagccacggaagacagaccctcaggtgctcctgaggaatggaggttggaacagcaggagcaggaaggaagaaggccttgctggggaaggcctcgggtctcacacagtcccgtctaccactctgtggaagtgagcctgaggccaggacaggaagagccacactggagagctgaatatataagaaacgcatcttggccagaatagaaggcacaacctggagtgtaactaaagatgaaactttccctggagagtttgctgatggacacccataaatgtccagatactactcactggttaaggaatctgacctctggaggcctggaaatccactcctttttgtcagcatgccttctcctgtgctggggagggagaggcctccttagaccctcgggtcccactccctgcttagagttgtgctgtatcacccattggtccttccagcatcatgcccctgtcctgttctggagacgtgggagactcccatcgcctgtcctccttgcctgccaggggaaggcttcctgcggggcccctctccccggtgcagcctcacgtcttaccgctgagcaatggcgtctccactccagcctctttgaaacaccagcaccccctgctctcctgccttgctgcctttgttcatgacatttctcaccagcggccaaccagctccaacctctccactttcgcaagagctgggagatcccacttctggaagctctctgtgaccatcccaaccagaagcaccgtgtccctcccctgagctccagcactggccccgtgccggcaccactctttagtattttatattactttgctttctgtgcacatttcttacttccacatgtagctgactagcaccttggaggcagcagccgtatttttcagtccccacacctctagcactgtgcttaagtgagtgtttgagtggttcttaggattctcaataaagtggctgagttgccatgacccaggagagctcctggcgctgtcaccagagtgactctcagcgtggatccacaaatgaggaaacaccagtgagttctgtgctgtgctgcagaggtgtgggaaagagtggtgtcattgcgagcagaatggtggtatactcggtagataaacgtggaaatttgtaaccagatggcttcagtcatcggcaggttcactgtaaacataaaagctttagtccttgagccaaggggatggaatctatcagacctcaaggaaagggaaacctgctctgtgttctgaaaatgacctagaggtatccctcttgataaactggcaggtgggagggcagaggtaatgtggtggaagttttcttttcttttagttttatttccttattttgggaataggtaattatagtcacatggtttaaaattcaaaagttacaaggggatataaatgtctccctcccaccttgtccccagaggtggctgtttcgatcagagccttgtttctagacgtgtgtgtgtgtatgtgtacgcatgtgtgtgtatgcacaagtagttttgggttctcttttcttggtggtgtacagaagggtagtcaaagcccgactcatgatccctaactcgagtcttttaatgggattgtgtcctaactgcaaaacccgcctcaccaactttgttataaactccccgggtttatagggacagtcatctactgtcccttcctaacagcatggtgcagaaacactccataaatgagtcttgtgttgaatcagattgaattaagtgagaaaggaatggcggtgaaaaatgtggctttagtcatcacatgggcctacgggtttgtgaaagtaacattgagtctccttgtgttctgtgtgtactgcatgtatgtcatcttgcatctaaggatgtatattacccataaaggagcatgcagacacatgagtgcatcttggcttgccactaactgcctgtggccttggggctgtcactcaacttttcatctggaaattgagaataataatactattatccttctggaattgtgtgcataaatgcacagggcctggctcataaaaagtactcagtgagggccgggcgcggtggcgcacgcctgtaatcccagcactttgggaggccgaggggtgcagattacgaggtcaagagatcgagaccatcctggctaacacggtgaaaccctgtctctactaaaaatacaaaaacaaaattagccgggcatggttgcggtgtgcctgtagtcccagctactcaggaggctgaggcaggagaatggcctgaacctgggaggtggagcttgcagtgagccgagatcgtgccactgcactccagccggggtgacagagcgagactccgtctcaaaaaaaaaaaaaaaaaagaagtactcagtgtgtattggtggccattattattattattattattattcctaaaacccatatacagtgttggcattaaccataatgtctacattacctgaaattaacagctgagtgctagcattacatgagtagaatttcctgtcccaggcaatccatggtatatcttaattttgtgatccacacagtctagccgaagcaaaaacattctgggctttgctgaccagtgattgccacaatttgaatttttagctatggtgttttacttttgtgacatagtaatccatagattttaccgttaatgtcatttgtttttcagttatatgtaagctttacataagtgctctgttataaagtgagctgtattataaaagatgcgcctttaaaaatgtttgatgtaattattttcttactaggcacgtgggaaaaagcgccagataggctggttcccagctaattatgtaaagcttctaagccctgggacgagcaaaatcactccaacagagccacctaagtcaacagcattagcggcaggtaaggagtttcgcatctctaactggaagatggtctgcatgccacttgagtttttccacttgattttctcattaaatatcttaggttgtttttcacatgtgctttaaagcacttcctgtacttgctgggactgacacccaactaatgtgatatggaatatgtctttcaaaaggaccagatatctaagtggcttttctgtgctggatacaacagaacccttgttggaatgctcttcttgcaggagtcatgaatgctgtggcattaaggccacattttcctcttgatttccttccagccatttaaattggggtttaggctagggggtgaggtgacagaaagggacacccaaaaataaacggctggggtctcagtaggtcatgagatggagctgggggccacgggggttggggggctataatgtggtgttcactgaagaccaaaatagctcccctgtgacattcactgtgggcagagggggcttcgctgggcaggcaggatgttgtactcactttcctggaggactggaaaagaacagagcacagcagttggcccagttggctattttctgattgaagggaccaaatgagatgcttcagcaagatctgagagaggtgaggtcagggggagcagatttctgctttaggtctttaagccatcattcttggttggcttttgtggaaagtgtagaatttttgttccaataccttgtggttaaatatctgtgctgtatgtacccagtgagataagattaaaaactggcagccttctcaagaaattaaaggatgggcaaactttgtgatgagccgcagtccccactgggcctctttgcttgagctgtggccttgtgtaggctgaggaatgtggttcccgcagggtttgctgtcccctggagagatgtgtcagtatccctccacttccatgtacagccccttcctcaggcccgctgaaattagttgctgaagtgattgaattagctggagaatttaaaaagcctaaacctatttattaataggttggttaagaaagattcatagggactgtgacctgttggtgcagactcatctgaagtagaagtgccaaagaatgagaacaattttacctcctgtaagcttgagagaaaatgagaaaagaaaaattgttcttgagggtggagatttctttcaggacaacattttgagatgcaaagatacagcagcagaaaaatcttttgaaacactgattttaggcctggcatggtggctcgcgcctgtaatcccagcactttgggaggccgaggcgggcggatctcttgaggccaggagttcgagaccagcctggccaacatggtgaaaccccgtctctactaaaaatagaaaaattagccaggcgtagtggtgcatgcctgtaatcccagctactcaagaggctgaggtaggagaatcggttgaaccctggaggtggaggttgcagtgagctgagatcgtgccactgcactccagcgtgggcaacagagcgaggctctgtctcaaataaataaataataaataaataaatcactggttttagttttccctaagatttggaattcttggaggtcaaatgatgattaccttccactttaaaccaaaaaggaaaaatgatagtaaagtccccatgatacatagctgtcctgtgcagcagaagataggatggggttgggctggtctttccagagtcagcagtaggaaggagttccgctgcactcaaaacgaaagccctcgattagcactgtacattttctgctgacaagtaaacatgaaaaagaggacgatatcataaaaactaaagacttagtgtgaaaattttgttgttgtcttagtttttaattcttcacctttattgcccacactgtaaaaagcccaacagaacagttccacctactgtcaccctcttctgaaaggacagaaatagtagctgggaatgttgaatggctgcgcggtacccgttgtgcattctccggcgggtgtgcagccgctcacccagccctgtctcctgcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgtaagtgccctggtggctctgtcgcctcgcctctctggtatcttcccgtaaaacatgcagcattgctctgattctgctgagctttgtttgcagaacttaaagctagaccattgctgcattcgcagtcgtctctttgaagaccttctgtaatgcaagagtttatctcatggggttttatttctctttaattttcattccttctgtagcatgtcccctccctcccctccctcctttttcctttttttttttaaatcattttggcaccatgctgtttacatgcctgactcattttcctagcttgaattttgctcattgttttgttttgcttatgtgttgttttcctcctttttctaggaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagttagatggaaatgtctctgtgttcttgatgttggaacctggcagtggtggtgaggaaccaagcagactagatgtcagcaatgggcctgctgcccacgtgtcaaccatgacctgtgctctttgaaatacagacattatcagaggctcgccgagtctttgttgaacagccctccctctccccgtgctctccaccttccctgatcaatatgcaaatgatcattccttataataccagtttcgaaacatagaactctaccacccagtttagcagttcagtctcaccgggcttttgatataagttgtcgacacattgagggtgtgtgatttggctcagggtacaaaccatttgtccaaaagatgtatcgtaatgtactggtgaacacccccaaaattatgtgggtaaagacagaaacttgcacatgccccacgttgtctgggatcggcttctgcctggcacactttgcagaaataaaccagcgtccacattgatgccactgtttgctacaatgaccacatgcttgattccatcctcatgagcttcacttattggacctctcctgccattcagtggaaaagtggtttccttcctcaattcagcagatatttggtgggggggatgtctaccatgagttgggtgccccattggcttctgggaggagtgtggtactccgtggaaacagagtccctgtcttcatggagttcatattgtaatggaaggaacaaacagaaaaccaaactcctgcaatccatataaatatgcacggtatgtgtgtgacaaggtgacaagttctgcactagaagtttggatatgaggcaccactgagcagactggcagggccaggggagggtggctgcagggcaaggatcagagaaccttcagggggtggggcggggagtgccatttgagctgagacctgaagagtaaggagggaggagccagatggagtgggggaagaggtgtggctattgtagatggagctgtcaggacaagcaaaggcccaggggtgggcggggagatccttctcactgtcccccaggccacccccgtgtggagcagtggttgagtctgcaagtcccatctcttccccaggatcccttcagctgtgtaagccagtgttgcttctccagtcttgagtttggctggaagggatgcagttgtcaaggtgggtactactccataacactctacctaattcactccagatgccccacgccctcactgtaggccatttccccaggcttgcctccagctttgtgaagttgacatgggttgttccccaggaagctgtgctttcccctacaaatcattgagtttgcatttggttgtatccattggaccccatgattctcagccagtgggagtgctgctggtgtctcatggttagagtcagggatgctgctcctcatcctgcagtgcacaggacagtcccccgcaacaaagaatgatctggccccagatgtcaccagagctgaggttgagaagcgcaggtctcaccccactggccactgtggttaatgttcacctggttattcaccaccagaaaggctgccccggtaactcctgttgaataaatttaatcacctaagctcatgtcgtgtatctgcagcatcaaacgtatctcagaaccttggttttatatttcaaaatcttattcttgtttattatcccccatactctgcactttggtactagattaaactacttcagtcatattcacaagagaatctggttaacagaaaattgagtacaagggaaagaaagcatctttcttctaataaattagtgaagggatactaggtatctcctatggcctcagagtttaaaggtgtcaggttttggtttgtttgttctttagctatttgttttttgttttttaatttttttttttgagacagtcttactctgtcacccaggctggagtgcagtgtcgtgatctcggctcactgcaacctccacctcccggatacaggcgattctcctgcctcagcctcctgagtagctgggattacaggcatgcacgtgggtctggctgcattttgtatttttggtagagacagggtttcaccatgttggccaggctggtctccaactcctgacctcaagtgatccacccgcctcagcctcccaaagcactgggattacaggtgtgagccaccgtgcctggcttactttttgtatttttagtagagatggggtttcaccatgttggccaggctggtcttgaactcctgacttcaggtgatccacccacctcggcctcccaaagtgctgagattacaggcgtgagccactgtgcccagtctgttttgttttgttttttaaactgattattaaatcatttaatttcatattggtctgtgtaaatatatttgcaagtgaactttgggtacagttttgctccagtagcattagacaagatgagtccaaatgagattgtcttcattgtgcacttacgaatcactctcctctggccggctgcctctccacactgcagagcaggcctgcagagttggggagccatggtggttgagttccccaagtggcccaggcctcagactgcctctgcataaaagggtgtctgggagaagccgatctaaagcagtaactcggccctatgttaagtcacaaaatatctaaccattacatgcatggtagaaactggtatcttccctgtttctggaaaggaatctgggcagacccaggccgcaaatagtaacgattgggttatctatgctttcagcgatgccatcagaagaaatagtaacactagcttaggaaaaccctctaaatattaggtttaaccatatgaaattgtcaattcttacctataaaaacagcaatctataattcaacctagtacaatatatcatcacctggcacatggtaggttaggttaaaaaaaaatgcctattgaatgagtgaatgaaatcaaccggtgactatagaaaacaccagtctcagcttttgacacagaccacatcaccctcagagaggagaccatgctgtctctccagtttccttttcctttagatgtgagcttcccaaaaacaacagtggccttggaaggggctgctcctggagtctcttgctcatttggtctaagaaggaggctgaggaccagggaccgttgtctgagccaagtctccactccagcacagggcgggggcaacaccccacccaggtaacagttgggcaacgggcacagcaaatcgcagtcctgcttcattaatcctattcattctctttagttccaaaaatacccaagagaatttttatggaaatgacattggatgccaatggtcccaaaaatgcaaggaaaaatagctccttctttgaaatgtctggtattcggggtctggtaggatagggagacgtagtgaagtccaagatcacagtagccttaatgtgaatgttccgcttcagccagagttctcttgggcacttttttttttttttttttgagacggttcacccaggttggagtacagtggtgcaatctcggctcactgcaagctctgcctcagcctccccagtagctgggactacaggtgcccgccaccatgcctcgctaatttttttgtactagagatggggtttcactgtgttagccaggatggtctcgatctcctgaccttgtgatccgcctgcctcggcctcccaaagtgctgggattacaggcgtgagccaccgcgcccggccactcttgggcacttctttacgaaaaccccacataggaaaaaccaggcttccagagtgtctcctgacgtctagttagctattccatttcagagggctccatagcctctcaggaagaatctattctttaaattaaaagctccccaggcatttttaagttgtatgacctgattctcaaaaatgtttcatttataaaaaatgagcatcagctataagatatatatagtgtccgtgcaacttaatgttgggcataccacctcttagaagctaccagctaccatgctgttgttttatgatgtcaacggtgtgtgtgtgtgtgtgtgtgtgtgtgtgtgtgtgacaggcagtgagcagcaactttcaggtgacttaactgcctacatctgtagcttggtgacagtaggtcaaacggtgagttcagggtacagccagaaggcagataaataccgctgtatagaagattctggcagaggctgacagctgctatttccacatctgcttggcacgtcgcttctgagtgatgttgcaagcctcaaaagagatgttccttattttgactcagactatcatgtctttaaaagctgaacagttccttctcttgatgccgtttctctgaactctgacccaggagaggggagaacacttttgatctgccagttttcatcaaggacgctgtttccctcagtgagaggatgaaacccctgacgcccctgctttcccctcccatttcctatgctgtcctgtccccttctgatacctgtccccacacactcatgcacgctgatccactgcgttgcttcccaggccccacccagaaagtgaggaaaggcctgggctgcggtggagcgcaggatgttctctgcggattattcagtgaagtcgagatcttagagaacattgagcataaggcctgcacctatacagctgagggcactgagggtctcgggaaacacagtgatgttctcaagtcagcttttcaaattccgacaagtcctcgttctaggcgtaccatttgatgcacagatctatggacatgtgtgtccataatagccccagagctcctgcctccacagaactggtggctgcatctttggaaagatcgggaaggggcccctcttgcctcatgtgatttcctcactggtggggttaccatgggagtttggagccattggtaaggattccaacacattttcaacgcacaagcttcatgctgacccgccccagccctttgtccttctctcctccactgggcgagtttgccaggcgctcaggcttacttaagacaccctcagtctgagccaaatgtaagaacatgtgctgctgtagcttcccaattttcattcctggcctccagaaaaacatggtgctgtatataacaacacggcttctctgcaagttcagcctaatattttactccatttctctcatcattttggaacattctatttccctgtagaccacctgcctataggaagatagtgattcagacggagcatccacataactgcatctggggaccttatagaggctaaggagcaatccaggatggtggctcagagcacgggttcaaatcccagctctgctacttactagtggtgtgatcttgggcaagttatgtaacctctttgtgcttcagtttcctcatttacatatggagagataatgatgacatctagcagaaaataagcagagaataatagctttgttgctgttgtttttattggagagaaaaggcatttgtgcctggtcagtgagcatcatggaatccaatcaagtgccttctttcattaaaccaaaacagcaggtaggttgtgtgcatttttaagaccttttagaaagtatgcttttatagattaggaatttcagagagaaaagattggacagcttccctaaaaactttgagctatctcattgcaagatttgccctaccaatccgtgcacgaaccctggcccccttcctgatagcaggaggcccaccggtggaagcaagcagctttttaaacgccttcgctgcactcctgcaatgtgcagagacctctggaccaaagaccagagcctactcagcagactcttggttgatgtggacaagctgcctgtgtttcacacggtcgacggtggggaggccaccagggaaaatggaatgtgcagggcttttaaatgtcacgtctggactgtgttggcaggcccatgcagcgctccacaataaacctgtcacaaatgcattgagtcactgggtcctttatttctcatcacggcattctgtggccttgtgttctcttgccagcaaagaatggaacgttcagccccctagacatgccggctgctggattttttaagcaatcatccagcttagataaggggcgtgggctgctggggaatgctgccccaaagcgctgtctccagagcagctgccccaggcatgcttaattccctccctgcccactgtgtgcacccccaagatgcctctcaatatccagacctgcagttccactctgtttgttaggccccccaggagagcgagcctgcagtccgccccagcagaggggaccaggccagggatgcctctttcctctctggagtgttaccttggagtcctgaggccccgtgacaagaccccacacggccgaatcctcagtaacagccctccactgacttggtatccagtgggattcctccctccatcccattctctagggggcagaagcacatctgcccgtcctgtccgcctccccttccatcctgcatcctgtcttctcctctccccgcctcctgctgtgtggcccatgagcccaggagggacccagtctactctgtttacctctcccgctgcccactgagagtcatggctgaggtacatggaaccggcctggtcatagggccgtgctcagcagaacacaagcagaggagatgcctagaactttcaggagcaggtgacaagcagcagagaaatgagtgggggttccagctagtgaaggatggggtggcacagagcatgactgggggccagggatccagccgagaggatggcccgagaaagctctctgaagaggggggatggagacctggctgcgggggaggcacgtccaaagatcaagggggaggagctttctcggcccaagggacagcaagtgcaaaggccagggctgaaggagctgctcctgcccctcacagaaggatgactgagtcttcgacctggtctctctgcacccactctctccttccagcttcccccacgctgcaggcagagagctattctaaaaacatcacttcttatgcttaaaatcatccaggggattcccggtcctccgagataaaagacccgaatctacttggtctgcaaaccctgcctgatctgcccccttctccagccctctaaccttccctctcctcatttattcctatttgtgctgaattttagcacggctcagtcgtcacctcctcgaggaagccttccctaacccatgcattcttctgtgcttgcagaggggaaactgggctgactggttacggagctgctctacaggagcctgctcagtgttctttcttctgccacctttgagtccccgtcatgacccgtcacgaaagtccaggcttttgttgcccccatggctttccaaatggccctgttgaaaacatcccctttgaccctccaaaccactttatggaaaggtccattttcatcatgggagtccctcctcagagagagtcagaacccacatctggtgcccactgtggcatcgtgggcccacgtcagcaggaagggatgggggtgcaggcaggcagtgtgggcaaggagcctcccccagccttagagactgaatgactcaaccccccttgtctacctcccagggatcttgtgtgcccacatgtccaatagggaggtggtgcttgggtccagggacttccttcatcatctagcctcactctgctgtccagtctcacccaacccagaaccttccctccatcatgtcagcctccaccaccaccccagaattcttgagtctcatttaagccactggtaggccccagctgcaaatgcctttgccccacctcccctgcctttcctgcccacctgccttcacctctcccgatttcgctgccacctctcctgctccattaacttgtaacaactcagctcttttctgaattccttatcacacagaaagatgactagatagaaaggctgatacagaaatacatagatactcttacctccccagttagactgtgagctccttggaggcagggcccaaatcttgtggtttgttacatccccattaagacctccatggtaacaacactaatgaacagcgatggtaccttgccttgtgtagttgtcttattgcagggcaccctgcctccctgctgattacaaaccagagggcagggcctacctcccacacgtgcatatccccatggcgcctcactcttgccagttgctcaggaagtgctgtggcagacagtcctgggctgcccttctacctgcctgttgttccacaggcttggtccttcctccccagctaggctgtgaggggcaggacacgtcacagtgttcattctccctgctgcgtgtagcctggaacccagcacaaaacctgtgcttgagtttccctccccaggaggaaaggaaattgtaaacgaggcaccatcgtttacaaaataagttctcatgaaaagaccccaaaacaggaagtgagcttatgaagcataaggattgttcttcatcgttcttataaccaccttcagtactgtctatttatgtatgtatttggttttctgtctcccctaccaaaatggaagccccacaaaagtaggggcccctgcggatctatgcagccgctgtgaatgagcaggaaatgtcatggctcaggttgcctcttgggttcctatgggatcagtttgttaagttaggagagaccgaccccagggagcaggctatgggtgcttagacccttctgaagaaagttccattgagatgagaagtccacctgcccctctggacagctcagagctggtctggcctccagagcttcctgtgggctggggctgtccaggaaccggtcagccaagggtcattttcagagaaggcctggctgccttggcctagactggccactgccatcccccaccagtccccaccagccctgcgctccaaggacaagcacaacctctcagcctgatcttgcaggcatctgctgagagagaaaagcttaaggaccaccctcaggcctgccctttgaaaagccggtggtttcctcctgattccatttcctgacatatcaccagcataggttttattcttgatagggaaggtcaccgtacatcgctgggatctgctgttccattcataagatgagggcgttgagcagagagagtagcctttgaagccatagcccatggctgggggtcagtggtggcagcgtggcctgaggtgcagcttcagagggcccgaagagtggagtgtcagatggtctctgggctcagagagatggcgttctgtggttacagccattgagcctcttggacaatggcttgagtgacctgccatgggctggattcagctcagcagttgtggcagctctcatgatccctgggcctggacggatcagtttccaaatcccacccgcttttcgcgccaggtgtcttgatttccaggccatctttcctctgatctcctggctgtacatgggaaccacacgggagctttgccgataacagatgcctggaccccactccagccagtccggtttagttggtctggggtacagcaggggcactgggatttttaaaaactccttgcgtgaccccagtgtgtggccaaactccagggccacagccccgtccatgccacacacagctgccgcactgatcccctgaaacacagccaagaccttcccagctccgcagccagcgcctcctcgactggacttccccacctgttagggctgaactgtgtccctcagattcacacgttgaagcccaggacatcagaatatgacttcgtttggagataaattctttaaagaggtgatgaagtgaacacgaggctgttagggtgagccctaattccatctgatgggtgctcttaataagagggggaaatgtggacacacagacgctggagatgtgcatgcacagaggaaagaccctgccgaggagagaggcctcaggaggaaccagccctgttgtcaccttgatcttggactttgtatctttagaaccatgaggaagtatatgttgtttaagcggctgggtctgtggcctttgttatggtcgcctgagcagattagcgcaccagcgaggaggaagaggcctccggggaagagcatgagctctagggtcagactccctctgccatttatcaactgacttacccgccctgtgcctcagtttccctgtctgttcagtgggggataacaacagtatagctaccgcataggattcctggtgaggattcaatgagtttgcacatgtgcagcacccggcattgtgagctctgagtggcgttccacctgaacgcccatgactcaccatcacgcagagactgcttccctcctctgcacctgcccccagggctccacgcccccgactccaatttctatttactcccattcttcctccctccatttgaatccctcaccgctgcctgccccctcaccaccgatattagcctgctgaagtccaactcaaattcctcctcccctgctaaatattttcaaatccttctcatcaaaacaacaggcccccttgaattagacctagtatttggccgagtgtggtggctcacgcctgtaatcccagcactttgggaggccgaggcgggcggatcacctgaagtcaggagtttgagaccagcccggccaacatggtgaaaccccgtctctactaaaaatacaaaaattagctgggcgtggtggcatgtgcttgtcccagctacttgggaggctgaggcaggagaatcacttgaactcaggaggcggaggttgcagtgagctgagattgcgccactgcactccagcctgggtaacagagcaagactctgtctaaataacaaaaacaagaacaacaacaacaagaaaaaccctagtatttggctgggcacagtggctcatgcctgtaatcccaacactttgggaggccaaggcagacggatcacttgaggccaggagttgaagaccagcctggccaacatggtgaaaccctgtctctattaaaaatagaaatattagctgggcgtggtggcgcatgcctgtaatcccagctactcgggaggctgaggcacgagaattgcttgatcctgggaggtggaaactgcagtgagccaagattgcaccattgcactctagcctgggcaacagagcaagactctgtctcaaaaaaaaaaaaaaaaaaagacctagtatttgataccacaacagagcaactacaatagtaatttaattgtacatttaaaaataactaaaacagtgtaattggattgtttgtaacacaaaggataaatgcttgaggggacggataccccattcttatgatgtgattattacacattgcatccctgtaccaaaatagctcaggtgcgccataaatatatacacctacaatgtacccacaaaacttaaaaataaaacaaaaaccaacaggctcctccttcatattccaataaaaatgcatttgtactttcattataacatgccagtctgcctttgtacccaaaaaacttattaacaggagctactcatactacaggagagggcacagtgagagcaggaagtcaggggtgggacatagaaggggcctggaatgagctgaagcatacctaccacagaggatgtaaagctgtgccaggaattccagtgcccattatgaagctatgaatgatacaccctttcactctctgaaatgtgcatatttatggaaaattaagagatgatttatccctgagaagaatttgatcttcaccacttctcagcagtaattaaactgcctggcaacccctgtggactggattcccctccttgggagaaaacaaagcttatttggagttacattggcacttttaagcatctgggttacatctgaatggaagcctcccgaggacccagctacatggggcaagatgtgtcaccaggacaggctgggtgggatacctgagctctgctggacccacgagggtctctggtgcctttgggggcattccttcccctctcacctctgtgcccaccggcttctccagaccccattaaaaatcgcatcttgaggatttgcaactccgaggtctcaaggactgataaccgcttggagtgatgccctgtgcaaagtgcctgcaactcagcaaggatccaagttggcctgggactcccaggtctagcaaccagcaggctcccaaaggacaaggacccggactgcctccttctcactgaaccccggggccgagcgtggatgctgcttcacagcaggagtacacaacttcatggcttggagaacgctggggtttcagacatcagctgcagggtaaagggacatagtgtttggccagagaactttcttcacgtcatatccatgtggcttcatctgcttttcctacacgacaggccaccccacacctaccaggagaggcccagggtgttgaagggagtgcagttagattaatttgcccaggagaagccagtgcagctctggggtgcatgggctcacctggcaggagagacttggtccatggggagaagcctgcagtatagatgggacctccaggagcccaagtagcatagaccctgctgatccggggccattgagccagaggatttgggctgaatgtccccagagacaaaagggaaaggtagatcctttcccttaaagatgaaagccatcgcccgggcttgcttattgctctctctcctggtccttccacatgttgtttctgaacatttgttctggcatcacaatccccgtcaccctgtcatctggcccttcccacctttccaccttatctcttgcagtgtctccgcgtcgacctggcacctgggtgaaggcttgctcttgctggtgcccatagcccccagtgtatggtcttgacctccccagccatatggagacccagcctcaggagggcccctcgaggaagcctccccttagcacgaggagttgctcccttctgaggtcctactgtctccaccatcagcacagcacacgggctcttttttcttttcttttttttcttttttttttgagacagagtctcgctctgtcacccaggctggagtgcagtggtgcgacctcagctcactgcaacctccacctcctgggttcaagcgattctcctgcctcagcctcccgagtagctgggattacaggtgcctgtcaccatgcccagctaatttttgtatttttagtagagatgaggtttcaccatgttggccaggctggtcttgaactcctgacctcaagtgatccacctgcctcagcctcccaaagtgctgggattacaggtgtgagccactgcacccggcctgggctctttttttaatgcttgctattttaatttcttttttttttttctcgttttttttcttttcttttcttttctttccttttttttttttttttttttcctgagacaggtgctcgctctgttgcccaggctggagtgcagtggtgcgatcatagctcactgcagcctctatttcctgggctcaggtaatcctcctgcctcagcctcccaagtagctgggattacaggcatgtaccaccatgcatggataattttttaaattttttgtagatatgggtgtctctcactatgttgcccaggctggtcatgaactcctgggctcaggcaatccacccacctctgccttccaaagtactgggattacagacataagccaccaagcccagctgcttgctattaatatttttaatttaattttcctgttgtgtctctcccaagattgtgagtttccctgaggacaaggacagtatcttgcttatttctgcgtctcttggacttcagaggaacttaataaatatttatggaccaccttattgcatattttggcccctttcatacaggaacaaggtctgtttatttgctttgctcaatgggcaacttgctgtgggggctggcttcgttttcaaaattctgcttctcattgggaaaggtagaataattggaggtgtggagatgggtgaggtgcactttttaccctgaatgctctgtagcccttgaaattttaataatcagcatgtgtttatgtattacttttgtaataaaacaagttcttgaaatgatgctgttcatacaaatatcagttgagggaagcaagatgaccttttattggtaaggtttttttttccccgtgattttctccagggcctagactcaaaaaatccttccagaaggccatcacatctctctccatttcgtaaatgtgtctaactaggcaacatctaagggacggcacacagattaggaattttatgtgggctataataggggatcatttgtaaccgcctggagtcatttgcaatattatttcagctgtgtgtggatttcagttagttttgagaatccttctgtcacaccaagatgttcatggaaaaccatttgatgtgttttctcctctcgtttttccctgggaaagggggccagaaaccatgtttatcctaggacccaaaagaggaaaaggccacgtccctccacccctaaagaaaacgcttttatttgaaatgtcttttccatttaccctactttgaataatggagtttttaaactcacttgtttttctaaatattaaattttcaaaggaagaatatttttgagttcaaaatgcctatttcaaatctttaatggttctcttggtctggcattcaccagcaagttttaaagcagcctcccatgggtcaatttgatggctaaaaagatgattccaagccaacatcattggcacataatgtaaagaagactctccccacaaaacttttgcttttcattgtgttctgcagtggccatcagggccatccccctgtctccaggcagggtggtaggtggacctgcgagaggtggaatttggtgggggcaagcagcccagacttgcccagcgcttcccctgacctccaagctccatcagctctgacttgggccttgcaaagtgtttggaccagaggccaacgctacctggagcaggaggccacgcagcagccctccagcttgtccccaactggccccaggctcctgggattcttggacaaatggcccaaatttaccctgaaccttctgctgttgctctggctctgagcttcttcacaacctgcaccgtgtaaaacttgaagactcagaagagcttctgaaatccaaagcaagccaggacttttccccataggtccttctttccgattcctcatcattctacgcgtgtctgctggtccctcgcacctccatgctgcagactggaactctggtcgggttgtcagtttcaagtaacactagtgtttctcaacagggtgctcgtctattggcatttggggtgggcagttctgtgtcctgcatgttgtgggtcatttagcagccctggccagcctgccagattccactatgacaaccaagaacacactctcagccctgggactggagtgggatgcagggcaaacctcagcctttggggagtggggacagtactgacctcaacatggtggggaagagcaccaccttcagcggagggtggggcagtagcaccgcctgctgaggaccaccagtcccccaggttcttagctatgccctggagggcaggagtctctcctcttctgtcctgaatccccagcacccagagtggttagtcctagcctcatagtaggacatcagtaaatatttgcccagtgaatgaataagatctatgaacagtcttcaaaagggcctgtgaacccaatgaaagtgtgccctaaaggtgtgcattgtacacatgtattcgctgcagcaagaacccataacttccctcagattcttcaaggcaactgtggggcatccttaaagggacattcagaaaactggtccagccagtggccactacgggcctgatgtttctgtagctgcaaacatcaccgcaccgtgtttgtgcagtgacttttagagctaccactctgtgtcaatattctaatctccctgcagaagggaccatcctgaacgctccagggactctgcttccgtgagagggcatccaagttgcctaatgcaggggctgcattcagcccttcaacaagaaatggcctgaggcccgggccctttcactcactcacaggagagtggggtaaaaagagggcaggaacaagatatgtttccccccaaactcgagtgtttcttgggtgaccttcccaataaaagtcaaagaactcggagacatcactcagcttgccacaaacccaagctcacacagcagcttggctgaactgaatgagtgagccccgtggcctgcctccttcctgagagttcattgttggtgcagctgttttaataaaagacaatctatgccctgaggcaggaagaacagttgggccaaacccgtggctgagcagagggctcaagctcagacacatctgcagacctgtgcaaaagtgcgagctcaccttgcagccctggagaattctgcttgacctcagggcaggggactctgagtgaggtcgagggtgttgatataatgatgactcatttctgctgctttcccagcattctcctgctggtcttgggttgttcctgtcccagcaagagaagctacagcatccagaaaggacaattggcccagagaacggacaaaaccaagggctggaagcaccacaacccgagagttaacctctaaagcagcaaagcatttgccaagaaatctctgatatcatttggcccagagggatcatacaatttgcagaagctttcagcatataggctagatcagtcatgaccccagataactcccttgagagaagatggaaactcgaggaacccctgctaggccagagcaggcttcttgaacattagtgcgccaaaaaacaatcctctggagagcttgttacatcacagatacccagcccccaactccagagtcacttcagccggggcatctctagcaagctcctaggtgacgctgatgctgccagcctggggaccacgctttgacaaccactggtccccagcagggggttttgcactgtgctccattgtgcccccttgaggggaacagaagggatgggaagaacaagtaaaggggattcagcccggactctcccacctacattcgggacacctctgggtctgtcttccaagtctggcttctgtgattaaataaagaacctctgataaaaaagagaggtgggtccaggcctgcacatgggatgctcccaagaaccaagcctccctcctgctcattccagtgtgtctggggcaggaggctcaaatgttcaaacaaaaccccaaataacaagctaagtgggcagagtcatgagtgagccccacttccagtgcaggcaccatctcagggcagtggagtggcccttcccgtcgggcagccttggcctccatgatggtcttgtgccaggctctctgcagtgggaaggactaccctctctgtggcaagcatgctgctcagctgccccaggggccaggcagcagctttgtccaggagagtgtgcccagtgctgtctggaggcaccctgcatctgcctggtccccaggaccatcagagcctcagcacagccacctcatcctccacaaaccaacctcgacatggataacccatggcctcctggagctcggggatagagcacagcctctgcagcccaagtctcagggtttggctcttgccttcaccacttccaagctgagagacctggggccagtcaacctgtgtaaacctcggtgtcctcgtctgtgaaatggggataattctagtataatacttgagcattaaatgcagttcaccacctgacatggtgtgagccctccagagttttggccaatcgtcattgagtgttttgttttcacattattttcgtgtttctgatgaagcaggagtgtgccgcctgtatcagtttctagggtgccctaacaaacgaccacaaacggggggacttaaaacaataagaatttattgccatacattcctggaggccggaagtctaaaatggaagatgctggcaggtgccagcctcactctgagggctcggggtgtgtcttggtttggaaacacatcactccaggttctgcctgtctgtctctgtcttcttctcataaggacactgatcatatagggtcaggacccaaccctgagtatgactttatcttaatttgattatatatgaaaagactatttccaaataaggtaacgttcacaggtaccagggggtagggcttccacatattactggggaggacacatttcagcccatgaccccactggactggagcaagccctcaggacccagcagccacgaggatcttccgtgtgaagttgtgtgggcttccccagactgtgctaagttctcccaaatggttgtgttttccagggtgttcagacttacatctcttggatatgttgaccccaactgaaagaaagcgacaaggatacatccacgagctcattgtcaccgaggagaactatgtgaatgacctgcagctggtcacagaggtaagggagctggtggggcagggggcacggcagggggcgatgacggagggagaggggagggttccgtcaaggaggtctatgtcctgattctgagcccaagaaactttctgatgtttgaggagcatctggatggcaaatgctataggagattgcgaccgcagagacggttcgttgcttatccatggccaacattgagtcattcccacagagggacagagatcacttagccaagggcaagtgagtccctgagcagttgatggatggagtcatgtgaactgagagtctggagtccacgctctactcagagcagctgcagctcagccaccaaccaggaggtgccatggagccagccacgccgccctcctggcccgcagtgttggcatctggaaatggggggccatctggctgctgtctcgagtcattcctgccatatgttaccctgagacaaacctgtcactgagaatggcaacgtttcctcccaggcccccacaaaagcccctgacctgagtgatgcctcctcatcttgtcagtcctcccagaagggccctggccacctcatccagaactatggggagatgcggagcccggcgctcctgctgctcagcaggccttttgtccacgtccatgggaagatgccatattgggagacagggatttgcagagatggacctgcagtttggagagtgctgtggtagtctggcaaccaccacaccaaacgggtgtgaaaccatcttgtctgatagtcttaacatccaggaaagacgcagcagggctcgccgctgttggaggagtacagggtgggttgttagctgcaggaccaccattaatacttaggaagcattgatgcaaactcaaaaaggtgcccctttctcaaggtgtttgactgttattaaatatgcagttcaggatgtccagggtgcaagtgtcactccttagatatggctcctttttgcactctgcaaaacgcaccaccatatgtggttgccctggtacatgccgggttcaacgtcggcttaaggactcctgtggaataggactcccagggagcagccgcagcccagccaagtttatgtcgaagatgggctgtccccttccctaaagagccttcagaagcgcctcctgtgggagaaaatgacctccttgcaggcgggggcttgcaagtggaacacggggttccactgagatctgtgatttactgagagttgctcaaccacacagagcttggaggggctcattcattttccagagcccaggaggagggcagcactcacccccttgtagcgggcctgcaagtgctgggtctgtccagggtcagcccaggaggctgaggacacagcgatggagtcagtcaccgaggtggccactggcttattagaggagctgccgcctgggctgctcctctcagaaggccctcggtttacctatgcagatgaagggactgtccacagccaccggcacctttaagccccgcttttcacaccggtccagcccctcccagtgcgcaggtgagaccgcttagcctgcgtgcatgacttggtaccggcctccctgcttgtctggtggagttaagacctgtctcctggagacttcagctgccctccttcccctgtaaaacaatgcaggccctgctggggacccccctccggtttccagggcagaggaggggctctctgcttcagaaactgcaggaaagcaggcgttcacctctgggcctctcagccaaggtacagacacctgagccctttccctgctctcagcggatcggcgtgtgagtgtgtgagttttaagctaactgctttctgaactgcttcgttttctgcatctgtagatttttcaaaaacccctgatggagtctgagctgctgacagaaaaagaggttgctatgatttttgtgaactggaaggagctgattatgtgtaatatcaaactactaaagtaagcctctcctctaatccccagcctggcttggcctcctcggctctcatgcactcgcacctctgtgggtctgtgtgtccttcttgcatgctgccctgtgcttctttctggctttttttttttcttctcattgccactcacaaacaccatcacccttttgtgccttcgtgctttctggaaacgcactccgaatctctcattgcaagagtaggtttcctgggcaccccagagcctgctgttgggtgaattactgtggttgtgaatttccagggctagggcgacgctggctcctgatggtgctggctccatgctggggcgtggggctgccccctctacgctttccctcggacgcgggatcccatgggggattattggtcttttgaggcattcttggccctgcagatggaaaaatgtggaactgttcactgcctaacatcagcagttcctcaggatcactccgggaagctggccctaggctggtcgtattttcttccaactttagtttgcagaggcagctccagggccaggagtcaagagacctgggtttggattctgacttactcactgcctttcctttttgagccttagtttccccatctgtaaaatgaaagggttggattcgatcatcacaaagtctcttccaattcttagaaaaaaaaaaaagtcaaaaaccaaaatctgtatccaccacgctctcattgtaacatcacttgctagaacacagattaagtcacagcctgcagggcgcgtgatattccctgctgggaggaagggccacccacttcctgggcccgaggatggagggcaggctccagagccttgcgtccattcctgatcttcatccgtgtcattgggaagtccccatttcctaaatgtggtctctgcattgttcttataaggtaatttcaggtccccactttcctgagcgtgtgtttgggagtggatggagggatggagaggaggtgtggagaggtggacatgaagaaagatacataatgtctgctggcttggtgctctagaagacgaatgatccaaggtgacatcaggcaggcttttagagaaggtctggactccgttgcccgcgccccctgccacccgatgccgtggaagcctttcgaacttaggtctggtgtcacacccttgggctcacatccgctattgcctctggctgtgtgtcttctggcaggtcactttggtccctgggcctcagtgttctcgtctacatagacgatagctgggcacagtggctcatgcctgtaatcccagtgctttgggaggccaaggtgggtggatcacttgaggtcaggagtttgagaccagcctgggcaacatggtgaaaccccatctgtaccaaaaatacaaaaagtagccgggtgtggttgtgggtgcctgtaatcccagctactagggaggctgaggcagaagaatcgcttgaacccgggaggcagaggttgtagtaagccaagatcgcaccactgcactccagcctgggccacgggagtgaaaccctgtctcaaaaaaagaaaaaaaaaaaaaaaaagaaaagaaaatatacctgtaagttaaaacctttttccttgggcagctatcagtgggggctgggggaggcgggagatgtttctgagcttcccaagtagcccttagagagggcttcccccacttcagggttggcctgagggaaactggtgctggcctcagctccccatacctctctgttgtcttttaacccccatctgggaagaagcagcctctttcttgagctgtgtggggggccaggcctgcgtgcttcttcctcctgtcggctctgacttgctccacagttgtggaggtgggaactgacagccctgttacggctgaagcagcaaagctcagagaggctgagtgacttccctaaagtcacacagtagggtggctgctctgtggatgatgcctaggtcccggaatagagactccgcccagtcctgcccccgtggaaaaaaacatgggcccagaagtcagacatcccaagtttttgtctgggctccggccccttctaactagttttgggcattaaggtggcagtcatggtgcttgtcctgcctaccatgcacggtcattctgagagcaagggaatcaggtgtcccaggggcacgccgtccatcagggggctgatgtgtacaggggctgctggcttccctccatcccaaggttctctatccccgttcctctgattcccggattagcttgtttggactaactggctcatgtcttcatcctccagataaaatcttatgttgaaccgtagccttctggggacctgatttctttttcttcttttctgcattttactagaaaaaatctcaaacatacagaaaatttgaaagaattgtagagtgaacacccacatcataaactggacaaaaaacattgtgctgtatttgggtggctgcatagacataatttcttcatgccaaggaataactgtgatgaggggagatcgagggctcctagcagccgagagagggaggcatttgaggataagaagttaaggcagcaatccctggagtgccaccagtgagcggccatatgtctgctactcctgatcctacagtccttgtatttggggggtggggcagggggtagggcagttatcaaacaagtcaacaataaataaataacatgaaaataaaaagggctaactggaacacatggacttcctactaatgatgcctcattgagggttagagcaaatggctggctctcttgcgaggaagctgagacctgagaaatgtgcctttcatagacaaggtagggccagacaggtctagaacctttttatatccagagcctggagcaggaccctcaggacagctgtcagaaatgatggcagaagggccgggtgcggtggctcatgcctgttatcccagcactttgggaggccgaggcgggtggatcatgaggtcaggagattgagaccatcctggataacacggtgaaaccccacatctactaaaaatacaaaaaaatagccaggcgtggtggcgggcgcctgtagtcccagctactcgggaggctgaggcaggagaatggtgtgaacctgggaggtggagtttgcagtgagctgagatcgcaccactgcactccagcctgggcgacagagtgagactccgtctcaaaaaataaataaataaataaataaaaaagaaacgtcatctctactaaaaaaaaaaaaaaaaaaaaaaagagctgtgcgtggtggcgcatgcctgtaatacaaactactcaggagtctgaggcagaagaattgcttgaacccggtgggggcagaggctgcagtaaaccaagatcgtgccactgcacttcagcctgggcaacagagtgagactgtgtcacaaaaaaaaaaaaaaaaaaaaaaaatgatagcagaagggaagcagaagtgaggtggggtgaccaacccaggtttggggaactgttttttatcaagaggctttcctgtcccctcgatggaaaaagaaaagaaaaaaaaaataagagcttgtcccaaaacagtgtttttcttaaatatctgactcatcttctttttaacttaagaagaatggattccattttatcttgtttaagcagaaaatgaaggaaaaataaaaaataaaaatcagtttggggtaatgacagatggtgagaaagaagaagaaaaggatgtggggttgggagaaggagaagagggaaggagagagggcatggagcagatggtgggaagtccagcagggcgggaagtgcagaggctgaggctgggaccagcagggaaaggcttgagggcgagatggcgggagcagggcagccgcgtctgggaagatgggcaggtgcccagagcagcttggaggcagtcgtggcgggaggtgggttggggcctctgaggctgtggtcccaaccatgggctctggagtcagacctgggttccagggttacctctgtcacctattagctctgagacttgggtcaagtcactgaatttctgcatgcctgagtttccccaataggaaatggggataataatatatgtaaaactctgtttgacacataggaagcattaataaatgctagttccatgactgtccacttggtctgcagacttcagagggttacagacactcatgtgttcagcaatcattgagcgctctttgaaacatttgttagccagttaattgccttttgcagttcaagtcctctcatctgtaaacctttctaggagactgccgatcagctcaccgcaagcagagtactcttagggctgtggctgcagcagccgagtcacatgatccctgggcctggtaacaccttgcggtcttcataagtctttgcctatacagtagaccatcctggacgaagacccatgactgaatctaataggtgcctagtccatagtaaatcaggctttaattttaggcctgtctgctggttgggtaactctgttctacaagtgtgggtctgcagaacccaggaactaattcctcaagacaatcactgtctgcagatgctctttcttcttttcttttcttcttgtctccttcatcctttaataaaaaacaggccagcggccggggccgggcacggtggctcatgcctataatcccagcactttgggaggccaaggtgggtggatcacttgaggtcagcagttcgagaccagcctggccaacatggcgaaaccccatctctactaaaaaaataaaaattagctgggcatggtggcgggtgcctgtagtcccagccactcgggagactgaggtggaggttgtagagctgggattgcaccactgcactccagcctgggctacagagtgagactctgtctcaaacaaaacaaaacaaaataggagaaggaaagggtgaaagtactttttattcacttgttaaaaaaactactcctcataggaaaatgatggaatgatggaatttcttcctgtttccattcattgcaagtttataacgtggctatccagggctctcatccccccaaattattggtgtcatcacccttgagcacatttttgctcgttgtggtatttcacaccaacccctcaatggggcagtggcctttgggccatcctgaggacaccaagctgccactgctccccacaccccagaggcagccagtgctgatctccccatgagggcatccacttcaggtggaatcgctgactgctcacaccacatcatttatggtccctaagtttttctccttggcttgcccggtccaagggactttattttagccaaaaatgtgggagaaagaaaagaaagtgatctgaagtttttaaagcctaatataaatattgcagagcttccttggaattcaatagcccgccccgtacctcaaaggcttctccaacatgaccatgaaagcagccaaaggcattcaatagggacatcctcccagccttgtgttaaagtcataggttataccattttgttccatctacccatccatccacccatgatcactaactaggatagctgaacacacccatggcttcatgttgtggtcctgccatgtagtaccttgctgtccttaccgtgtataagctcagtgccatgcccttcttccagatgctggtgttaagggttcacatgttgaagttgggagaggggaagcacagtcctagttaccatagctctgagcactcacactgcaggcagaccccagaacacacacttcccagtcccatcaacacctctcctgaattccaggatatacattttttgggttcattggcccattatcatagtaatagacctcttttccgaactcctcttaatttagttaactcagctctagcaatgaagcagcgaatcacagagatacttcaaacagtcatttatacctggcttttgctgaatctcatgggattattttgccaaggcatttgttttgccatcttaattatgttctttttagccaaaaatcatccttccccatcctctggcaatagcaacttcccttgggcagaagtgtctcctggaaataggatcagtgctcaggccacatcaacctggggctttcaccaccgataatctgtgtagtgaggcatcgacacaggggacccatttgagttgttcaagaaaaaaactccatatttctgcacaagaaaaacaaattgtaacaaacagccactctgccaaagaaaaatgctctggtgctacctctctgtagccctagactcatttctttctccattccttgtctcccaaatagatcctttagtggcccttaaggctgtgcccctcacacacattctgtttctgtgcaacctaagtgtgctgtggtgctgtcagatagcgtgaaagcagggggctcacctcccgtgtttccgtgcagagcgctgagagtccgcaagaagatgtccggggagaagatgcctgtgaagatgattggagacatcctgagcgcacagctgccgcacatgcagccctacatccgcttctgcagccgccagctcaacggggctgccctgatccagcagaagacggatgaggccccagacttcaaggagttcgtcaaagtaaggagccaggctgtgcagagactgggccccagagtggcgatctttgggcagctggatgtgtgaggggctaattcaaaagtctgcaagagtgttcccactagaggccaacagggcctagggtcttggctaagccttaggggactggcactcactggcaagtgtggctgtcaccaaaggggtgggcttggagaggaggggtgaaccctgggcttggaagctttgaaagtgtctttagggatctgttttccagatgctattggtgttatttggatgcatgtttaaatctttcatttcatttgcaaggcccaggcaggtcttagatttcctcttgtgtttaatcgccacatcctcagttctttgctggtctctgcccttcacttgcagagggaatggccaggactcccagtggccccttcattcctttcgcagttggttctgcttgatgtgctcccgccttagacagcctgtgggagtcagtgtgggatgccaggacctcttccttggaggtagcagggatctggagagttgggagtccaccaggggatgtttggggaggtaatgcggatactgctggaagacctgcagctctgggacttggccttggccagtgtgggtctctgctggccgtgctgggccattcaaacagcccccacatctcctggagaaaaaaaggaggaagagaataaaatagcttctgtgaaacaggtatcttttgatgaataaacaacaaaataataataacaggcatatctttggatctcatgcattttggagacaggccatcctcacctgtcctagagtggtgcttgtggaatcactgtggtgaggcacaagcgcagcctcttcttggtcagagcctcatgtgagcttgttgtttctgcctctcatggtgtttctcagcctagacttgccagccaaggcatggggcactctgaggtcattccaaggggagaaagattgctaagaaggaggccttgggtggatggagacgagagagcagatgctgagctgctgggcgccatggaccacctagggtttcagccaagggctgggctcttcctaggcccgagcaagatgagttcattgttggatgcacttgaacttcaggaaagtgctgacaccagcccagagcaggggcctcattgtccctccccgcccctctcctcttcacctctccccacctcctctcagtgggaatgtggcacgtcgttgccagctgcgaggtgttcctggaatgatggtgtccacagctggagcaggtcccggtccctggagacagttatcaggtctcagggctccagtcaatgcagctgcccgtttctaaggcattaaaccagaccacagcctttgacagctaagtggccagaccctgaaactggagtcttgacccccgttgtctgagctcctctttctcagccctgcctggagttcccagaggcacgtgcaggctccactcaaaactagacaatgagatttagcccttccagcagttctggggtgtaaggggaatttttcctctaaccgtatagtcttgtgactcttgttcctgggaatgttataaagtttctgcagacatccagacgaaatattctgtgtaaagccagaatctcatctctgtgcataaggaaccatgcatgccatggagggtatgctgaatccagagtgcagggcttaaccctgctggctgagtcacatctgtgggtctccattctccatctggaaagtgtgtcatcctggacagggtaactagtcaggcccttccaaccccaggtctctcagttgtcatccagataaatgagataatgggtggagagtcctcactgacattagtattgatgtcactaactttggattttgcaagtttcttaagtacatttaaaaacatctcatttcagagattggcaatggatcctcggtgtaaagggatgccactctctagttttatactgaagcctatgcaacgggtaacaagatacccactgatcattaaaaatgtaagtacctgtcttgccttttcaagcaggggacggctttctctgcattggagagggctggggtcatggacaagattcccagtgaacatatctggtaactgttgtgtagaaagcacgagacaacaaggtgtcacagaggtctgcttggtaactcagaaagaaaagctggtttatcacgcaaagagctggctgggcacggtggcccgcgcctgtaatcccagcactttgggaggccgaggtgggcagatcgcttgagcccagaagttcaagcccagcctgggcagcataatgagaccctatctctattaaaaaaaaaaaaaaaaaagagagctaatactgtgtccggaattggtgggttcttggtctcactgacttcaagaatgaagccgcagaccctcgcggtgagtgttacagctcttaaggtggcgcgtctggagtttgttccttctgatgttcagatgtgttcggagtttcttccttctggtgggttcgtggtctcgctggctcaagagtgaagctgcagaccttcgcggtgagtgttacagctcttaaggcagcgcgtctggagttgttcgttcctcccggtgggctcgtggtctcgctagctcaggagtgaagctgcagactttcgcggtgttacagctcataaaagcagtgtggacccaaagagtgagcagcagcaagatttattgcaaagagtgaaagaacaaagcttccacggtgtggaaagggaccgagccggttgccactgctggctcgggcagcctgcttttattctcttatctggccccacccacatcctgctgattggtagagcccagtggcctgttttgacagggggctgattggtgcctttacaatccctgagctagacataaagattctccacgtccccaccagactcaggagcctagctggcttcacccagtggatcccacaccggggctgcagctggagctgcctgccagtctcgcgccatgcactcgcactcctcaggccttgggtggtcgatgggactgggcgccgtggagcagggggcggcgctcgtcggggaggctcgggctgcacaggaacccacggaggcaggggaaggctcaggcatggcgggctgcagtcccgagccctgccccgcgggaaggcagctaaggcccgctgagaaatcgagcgcagcgccggtgggctggcactgctgggggacccagtacaccctccgcagccgctggcccgggtgctaagtccctcattgcccggagccagcagggccggccggctgctccgagtgcggggcacgccaagcccacgcccacccggaactccagctggcccgcaagcgccgcacgcagccccggttcctgctcgcgcctctccctccacacctccctgcaagctgagggagggggcttcggccttggccagcccagaagggggctcccagagtgcagtggtgggctgaagggctcctcaagtgctgccaaagtgggagcccaggcagaggaggcaccgagagcgagcgagggctgtgaggactgccagcacgctgtcacctctcaatactgcacagccttcagatgtgtgaccaagtggcttctaccttgtaagtcagaaaatgagagcttagtcgttgattctttttttaatttttttttttctagaagaaaataacatggaatcacagaaacagtctgtggtctgtgcctttctcccttgactctttcttaaagacaggcccagtgcctctaggccttgattttcttagcagaaaagagaaagaaacgtaatgctacgacctgtcttcagaaggccattgtgaaacactgtattagtccattctcacactgttgtaaaggactgcccaagactgggtaattaataaggaaagaggtttaattgactcagttccacatggctggggaggactcaggaaacttacaatcatggtggaaggggaagcaaacacatccttcttcacataatggcaagaaggagaagaatgggagcccagcgaagggggaaaccccttacaaaaccatcagatattgtgagaactcactcactctcactagaacaggatgggggaagccaccccaacgattcaattatctccacctggtctctcccacaacatgtgggaattatgggaactacaattcaagatgagatttgggtggaggcgcagccaaaccatgtcagacactgtgtgttgatattagatgattgttcttctcctgtcactttgagaaagccgataccaaaagaaaaaagaaagaacaaaattagggtttcagtgtccccacctgtaaaatgagtgaacagatttagatgtcctctgagcctatgtttgtaaaaccacagggagtatagctcctggaaagaggttttagatctggttccttttaatggaaaatggtgtttagaaactcagatgtgggcactggcgtgctcattgctactggggtgattttgttttgtgttcctctcggtggcagagctgggaaatatatgaatgtcttttcatgcacacatatttacatatgccaatgtatatacacatatatttatatttatttctagatccatctatccatgtatattagaactcatgaattcacaccagtacctcctattctaatccaatactgcagaattttttccagcctttccccttctgcctttgtaactccctactctgtgaagagcctggctctcattatcctcaatgtgtttccttatttgctcagtcttcttacatgtgacaaaactccctcccacataagccatctcctcagtccagccccagctcaactccacaaaatacactgtggatctttggctgagttaaatacttagttttgaagtaagttttcaacttactgttttctctcttccaacaccacagttactatttaattagctcagtacttctcttttttctcccaatgtttaattgcaaattgaagttgaaaacaagcttttaaaataggtgttctatatctagccaatgggagaaaaactaaaacaagaaaaggactgcatggcccaaatatttaaaagggggaaaaaaactcattatttgcagaaacacgattgatttcttccagagcacccacaaaaatgaactgaaaaccagctgaactaagaagagaattgaaaacagtggtcagctatgagatacatatgaaatctgctaaagtactaatactaaatatttttatgatactgatgtggagaaattcttagcatggtctcaaagacatgctaatcctaaacttaaaggatttagatcatagcaacctaaaaaatacccaaactttcatctgggcatagtggctcacacccataataccagcactttggaagaccaagacgggtagatcacttgaggtcaggagttcaagactagcctggccaacagggtgagaccctgtctctactaaaaacacagaaaaaattagccgggagtgatggtgtgtcaggtttgaggcccagctgaggtctgaggggagtgggtgaacgtggggcagggagctggaagaacacttgagagacagcaggtagatgggacatggcacagaattgtgcacctgcactctaatccccctgagtcatgcaggctgtttacatctgcgtatgcctgcctggttgcagcacagccatgttccctacatgatgtgtatctgtaatcccagctgctcgagaggctgaggcaggagaatatcttgaacctggcaggcagaggttgcagtgagccaagatcacaccacagcactccagcctgggtgacagagtgggactctgtctcaaaaaaaaaacaaaaaacaaaaacccaaattttattctggggaacaacgtatatgttcattaatgggaatggttaaataattatggtagatctgtactatgaaaatatttaaaaagatacagagcaacttctactcatgtattagtgtggaaagacactgagaaaatgctgttatgtgaaaaagcaacactaaactcactgagcaatcctatggtatgatgcattttgcaagaagaggggaaagagctatgattgagtcactgcactccagcctgggtgacagagtgaaactctgtctcaaaaaaacaaaaaaaaaaacaaaaaacaaaaaggccggatgtggtggctcacacttgtaatcccagcactttgggaggccgaggcaggcagatcccgaggtcaagagatcaagatcatcctggccaacatggtgaagcccgtctctactaaaaatacaaaaattagctgggcatggtggtgcatgcctgtagtcccagctactcaggaggctgaggcaggagaattgcttaaacccacgaggtgaaagttgcagtgagccgagatcgcgccactgcactccagcctggcgacagagcgagactcagtctcaaaaaaaaaaaaagaaaagatagaatatagaacttgaagttgctgagaggcagtaggcagtatggaatagcagtgaagagcacatagcctggagccaggctggctggggtttgaatcttgctacttaaccactgtgtgctcttgggcaagttgggcctcagtttcttgtctgtaaaatagggacactgatagtacctactgcatagtgatgtgggaattaactgagttaatgtatgcaaagtggctcatactaggcagtatataaatgttagttttatcattgagaacacttatgcgctaaatgtacaaaaagttcacactcacaggtaataaaagaaaatacataacaaaacaagaaaatactttgattttggcttgccagatgagcgtatattgaaaagattataggtcccagtgttggcaaagatctgggtggaagttaaattgatacagccttttttggaaggcgattatagatcaaactataattcctctttggctcagcaattccacctctaggaatttattctaaggaaataatttaagaaatattgaaaagttggaagcaacataaagttttatgggaaggtaactatttagacgcattgtgctcaataacgtgctcaatgaatattggggtctaccccaataatgatatattataaaaccctcaaaatgataatatgtatgaaatggacatggaacattgtactataaagcaatgtatgaaatagtacagtataaaatggtagtttttgtaaaatggtagtatgatccaatttttatttttatttttatttacttttttttgagacagagtctcgctctgtcacccagtctggagtgcagtggcacgatctcagctcactgcaatgtccgcctcctgggttcaagtgattctcctgcctcacccttctgagtagctgaaaccacaggcaggtacaatcacgcccggctaatttttgtgtttttagtggagacggggtttgaccatgttggccaggcttgtctcaaactcctgacttcaagtgatcatcctgcttcggcctcccaaagcaatttttattcttgaaataatggggagattattagtgatttttaggttctttataactttttgaattttctaaattttgtacattgtacaatattacttttgtcattagaaaaattgataaacctgtttgaattttgaaactaaacaaaacaaatgaatttactcaagccagctgggtgggttcctagcctgtagtagtggttctcagatttgactgcatgttagaacatctggaaacctctagaaaacccctaagcctgagtttcaccctccagggattttgatttagtcatggatgaggcctcagattttccaaaaggattctaacgtacagtcaggattggcccagaggttggggttgttgcttggaattgatttgtggactcacaagacatagaaaacagtgtgtgtttttctccatttgagcatctacttaggactttaaaccacggtatgcctttgggataagatattcagagtcagggccatttacattgtttgtatgtggacaaggcctgggcaaatatgccctcggcattctcctggtacacttcaaaggtggcttagggtctttcttcattctccagcacagggtgataattgtttttaggggcctggaagtcctttgaggatctgatggtaatcactgttgcttattgagcactttctaagggccaggtgctttgccaagaggtccacgtgtctcatttagttctccacacaccatataaaggaggctattaacctctccatttctcatgcgaggaacctgagactcagaacatttatgtgggccaggcgtggtggctcacgcctgtaatccccgcactttgggaggctgaggcaggcagatcacttgaggccaggagtttgagatcagtctggccaacatggcgagacccccgtctccactaaaaatacaaaaattagctgggcatggtggcgcacacctgttgtcccagctactcaggaagctgtggcaggaggattgcttcaacctgggaggcagaggttgcagtgagatgagatcgtgccactgttctccagcctgggtgacagaacgagacaaaaagaacatttatggctgggtgcggtggctcgcgcctgtaatcccagcactttgggaggccgaggcaggcagaacatctgaggtcaggagttcaagaccagcctggccagcatggtgaaacccccatctctactaaaaatacaaaaattagccaggcgtggtggctgtagtcccagctactcgggaggctgaggcagaagaattgcttgaaacccgggaggcagaggttgcagtgagccgagatagcgccactgcattccagcctgggcaacaagagcaaaactccgtctcaaaaaaaaaaaaaaaaaaaaaagaacatttatataaccaacccaaatcatgggtggtctgtggtggggcagggatttaaattcaggaggtccagctccggagctggcattcttagccaccaccccaaatggtctgcttagaaaagcgcacacttgctctgatgcacccgtctgcatgtggttccagaggcgcgtggacccaggaaggagccacccttgctgcagccaccgctcctcttatgccccaggctgcatgctaagcatagactgcgctgtccctgccctgccctccaagggcacctgttggctcttagaccctcatcagtgggttgatggaacactgcacatcaaatgccagaattgcattgtatgttccccaagtgagtgaacaggtgggaaaatagcacggaactgggcctgggatgcctgggctctgctcctggtctcagggactagtttattcctctgtgaaacagggtgaatattttctttttctttctttttttttttttgagacggagcctctctccgttgctgggctggagtgcagtggcgcaatcttggctcactacaacctctgcctcctgggttcaagcgattcttctgcctcagccccccgagtagctgggacgacaggcatgcgccaccacgcccagctaatttttgtatttttaatagagatggggtttcaccatgttggccaggatggtctcgatctcttgaccttgtgatctgcccaccttggcctcccgaagtgctgggattacaggcgtgagccactgtgcccggccaagggtaaatattttcaaagagaaactctaagggccccatggttatatgtacacactgtgatcctgtgagtctgcatgtgtggcttggggtccaccctgcgatgttaacattttgccggacagatcacatagcttgccctggacattcagggtgtggggctggactgagacctcaaggatgggaccattcactgcttcccgcaatgccacccactggagccatcaaggagtggccgtcatctgctacgtgattgccatgtgggtgctcagagctgcgattgctcaagtgggcgccgtccatgaaaggatggtgccctgccccgctgggcctggtcctgcaggaccctggatcacaggcccgcccacattgcctaaaaggaggtggttgtttttattctcctgtgtagatcctggaaaacacccctgaaaaccacccggaccacagccacttgaagcacgccctggagaaggcggaagagctctgttcccaggtgaacgaaggggtgcgggagaaggagaactctgaccggctggagtggatccaggcccacgtgcagtgtgaaggcctgtctgaggtagccaaccttggggctgggccctggtctcccccggcagagcctcgcctgccagcctggaggaggacaaagaaaagcatgaaccattctcctccccagccgatagcatcctcatttccatccagctgcttctcatctgctgtttcatccacccactgagtatttatttatttatttgagatagagtctcactctgttgcccaggttggagtgcagtggcaccatctcagctcactgcaacctccgcctccccggttccagtgattctcctgcctcagcctcctgaatagctgggactacaggcacacgccactacacccggctaatttttgtatttttagtagagatggggtttcccgtgttggccaggctggtcttgaactcctggcctcaggtgatctgcccacctcggcctcccaaagtgctgggattacaggcatgagccaccgcgcctggccatccactgagtttctaatttaaattatatcatttcccattgccagaagttctatttattttctcctgtctgctgatttctttctttctctttctccctttttctttcctctttctttctttccttctttctttctttctttctttctttctttctttctttctttctttctttctctctctccctctttctttctttccttccttccttctctctttctccttccttcctctcttctttttctctttctttccttctctctctctttcttctccttccttcctctcttctttttctctctttctttccttctctctctctttctttctccttccttccttccttccttctttccttccttcctttctccttctcttctcttcttttttcttttctttctttcaacaggatcttgctctgtcacccaggctgctggaatgcagtggcacaatcccagttcaatgcagcctggaccacctgagctcaagtgatcttcccacttcagcatcccaagtagctgggaccacaggtgcatgccaccatgcccagctatgctggtttctttcttgtatcttgttttttgctcaaatgttaatccttcttatttatttcttaacacattttaaacatagatattcctggccaggtgccgtgactcacgcctgtaatcccagtgctttgggaagtggaggcaggaggctagtttgtgttcaagatcagcctggaaacagagtgagaccctgtctatacaaaaaaataaaaagtaaattagctgggtgcagtggttcacacttgaggtgggaggattgcttgagcccaggagttcaagggtaaggtgagctatgatcacgctactatactccagcctgggcaacagagcagaatgtgtctcaaaacaacaaacagatatagatatagatgtagatatagatatagatatagaacccataacctgaagttatgggtgttattgttttgtctgttgtttctgccagctcttgctaaacttactaccttgtttcttgtattacgatttttgactgtgaactaaatgttccttagaactttacctgtgggcaccttttttttttttgaaatggagtctcgctctgtcacccagggtggagtgcagtggtgtgatctcggctccccgcaacctctgcctcccaggttcaagcagttctcctgcctcagcctcaaaagtagctgggattacaggtgcgcaccaccatgcctggctaatttttatatttttaggagagacagggtttcaccatgttgaccagtctggtctcgaactcctggcctcagaagatccacctgcctcagcctcccaaagtgctgggattacaggcgtgattaccgcacctggcccacctgcaggcatctttattgtctgaagttgtattccttctggaaggactgttattgtgattatccaaaactatgtttagaggggtttgggcatcacagcccttgtgtgaatcgtggttgtaaacttgcgtgagagctacctgataaagcacacattctcagggcacgttttccttcactacaccaaggtcaaaaacagaaatgttttattgctcatcccctctgagcttgagtttacctgtcactcctcctctgggttcatctttttgtgaagatctcctagtagacccctcacgttggctctggatgcacctgtttctgcaccctatgtagtgagtaaaatgcaaggtcagcgtcagcagattcaagagagaccctcaaagctatagtggcactggctttcggtgatcttccaaggttcctattttcattctgttttcagcctctgcaaatttcttactttgtttctattttgtgtgtgtgtgtgtgtgtgtgtgtgtgtgtgtgtgccagttttcttggagttaaaaagtggatttttgcatttttctgtttttttaaagtttttgttgggtgagtcattctgagtatctagtccactctacttccagcaacagaagtctctctctgtctctctttctctttctctctctctttgtgtgtgtgtgtgtgtgtgtgtgtgtgtgtgtgtgtgtttgttttagtcagggtctcactctgttgcccaggctggagtgcagtggcacaaactcagctcactgcagcctcaacctcctcgagtgattctcccatctcagctttccaagtagctgggactacaggcattggccaccatgcccagctaatgattctattttttttgtagagacaaggactcaccatgttgcccaggctggtctcaaactcctgagctcaagcgatctgcccgccttaacctcccaaagtgctgggattacaggtgtgagccaccacgcctggccagaagcctctcatttggtttctaattttcttcttttcacttaacctttcctttggtctcattcattctttttgcccattttttctctctgtttctgtatacacatgtgcttgtgcctgtacacacatacatacatgcatgtatgcacacacatacaccattcactagggtttcccaaaatgaccagcgagaatgtgtctccctcatccactcctcctgtggtttcttccctctcataagctgcaaaggccatcaccacctgagggagtcaccatgactggttcctccacggccccatctcctgtccaccttcagtgttggtgtgggatgagcaaaggtgtggaagcagccccgtggaagccgagaggacagctgtgggctcccattttgggattttgtgttgctctgctgtcagtgggtggctcatttattcgctcatcatcattcattcaataagcacttagtgagtaaccacccatgtgccacggctcagtactaaaccctgggacataaaaacaaataagatgtgactcccactctcgaggagcttatggtccaggaggaagctgggggttaaaccaacatttacaacaagatgtgaggggtaaggaggcagagctaggtgccaagtgctgtggcgacatgtgacaggagcaagggacagttgtacgggggactctcgggccctggaggtgatgcttgactgcgtgttgcaggatgaagcattggaggcaggccaagcaccgtgtctcaggcctgtaatcccagcactttgagaggccaaggcaggaggatcccttgaggccagaagttcaagaccagcctgggcaacatagtgagaccctgtctctacaaaaaatgtttagaaaactaaccaggtgtggtggcatgcacctgtagtctcagctacttgggaggctgaggcaggaggatcgcttgagcccaggagtttgaggctgcagtgagccatgatcgcaccactatactccaacgtgggcaacagagcaagaccctgtctcagaaaaaaaagaaagattgaggcagggcattaggagtggaggaccattctgagattctgagcagggcattggtgaggattgcagaggaatgatgggccacagggctgcagggcaggctgaggcccagccgaggaaggcctgtgtataatgcaaaggaacattaacttgatcctgaagacaagggactcaagcagcccctgcactgccacgcagaaatgccgacacacagtcatgtgcactttagaaagggcccttccccgactctgacagctgccatcagagggacacagtgaggccgggatctgaagatgttaaagtaaaatcagttgtcatccttctttttttttgagacagagtctcactctcttacccaagctggagtgcagaggtgcgatctcggctcactgcaacctccacctcatgggttcaagagattctcctgcctcagcttcccgagtagctggaactataggggcccagaaccacacccagctaatttttgtatttttagtagagacggggtttcgccatgttggccaggctggtctccaactcctgaactcaggtgatctgcccacctcggcctcccaaagtgttgggattacaggtgtgatccactgcatccagcctagttcttgtgctttgattttttcagcttacatcccccctttgccatcagatggctgtccttcttggtcagtcttcctggctatcatgcacagcgtcgttgttgtcttgatgatgttcatggtgatgggaaggggatgtgttgacttctgtctcctgacctaggatcacggtgtggaccatgcgtggcccaggtctggacacacaccagtgattaagtttcaaacagatgctgtttttggcattcctgtctgaagatagagaagtttaaatactgttcccagttcatgcatattcagtgttatcttggccaattagaggctttgagtatgaatgaacgagagcacctttatgtcattggatccaatgacacttgccttctctggattatttgcgcccacgtggcttgaaccctgtcttggcaagcaggaagggctggttggtctccaggctcctgcctggagtgcagaggtgaagaatgttctttgaaggttcctgttgtggcaccaccttcggtctttcttgggctctcagaccctccacaggaggtcagaggtcatctttcctcctcgtggctgacagcagagtgcagtggcccctttccagctgcctttagctctccactcacagaagtgccactgtttctcctgtattggagatggacaggtggccatcagcttcttttgggggacacatgttacgaacctatcactccttcacaaatactctcttcagagaggggtccatagggctcgtagctcaggacagagctccggagcgccccccaggccaattgtgtgggcagatggggagcgtgaggggctggcctcggactgggtcatcttactcctggcgcgcagccatggccttgctatccttggcctctccccttgctgtcaaaaagggggcctctgtgggatcatctccacctcagtgccctctgccccttcagaacctagtggaggtgatggacccccgagaggtgttagagccgcgtttcagcgcccaccgtgtctctaagggtcagtggagggagggagctgttcccttcctgtttgctgagcgggtgagtcgggtgaggtttcatgtgcgcagtacagtgtctgttctgtttggcactggagggtcgctcaacaccactgatttacagctgggtatggtggctcacgccggtaatcccagcactttgggaggccaaggcaggtggatcacgaggtcaggagattgagaccatcctggctaacatggtgaaaccccgtctctactaaaaatacaaaaaattagccgggcgtggtcgcgagcacctgtagtcccagctacccgggaggctgaggcaggagaatggcgtcaacccgggaggcggagcttgcagtgagcagagattgtgccactgcactccagcctgggcgacagagtgagactctgtctcaaaaaaaaaaaaaaaaaaaaaattaacaccactgatttgtgcagtcacacacatgccaggggcccggactgcagttgtgccttggaaggcagcatttgtccatggaattggagagagacgggggctgctgctttccagaagctcaaaggactgtctgaatctgtgtggggttttctccctggagctgtttcatgcacagaccctgcatagagcagggagtccccaaggtgggagccaggtgggcacttttctttctgctgccccatttccccagtaaataaaaaagagaaatggccaagcccagtggctcacacctgtaatcccagtattttgggagcttgaggtggaacgatcgcttgaagtcagaagttcaagaccagcctgggcaaagtagggagaccccatctctacaaaagtttttttcacatgtgttggggggctgagatgggagaattgcttgaacctgggaggtcaaggctacctgaactatgatcacaccactgcactccagcctgggcaacatagtgagaccctgtctcaaaaaaaaaaaaaaaaaagaaaagaaaaaacacaccagttgcaccataagacactggcatgctcctagaggaaaagccttagaaattaccattgagactcttcttgatacttggaatcccctgaactgtgcctttgtctgactttgatctcttggctccaaagtcttcaaagctatccttgacttttgcctgagatccgagtctgctggggcctggcctctgattctgatggagcccatgctttcagatgcggagaaacaaaaatgctacactttgggttttgttttcctttctcagcaacttgtgttcaattcagtgaccaattgcttggggccgcgcaaatttctgcacagtgggaagctctacaaggccaagagcaacaaggagctgtatggcttccttttcaacgacttcctcctgctgactcagatcacgaagcctttggggtcttctggcaccgacaaagtcttcagccccaaatcaaacctgcagtataaaatgtataaaacagtaagttggattctagattttgcattatcagggttgacgtgtttggggaggaagaagtttccaaaaaggaggtagagttttagcagggtcaggggctgtggcatgcaggagaaggccaggagttgaaatgcgatttagggtgtccggagtggaggacgatccatatcccgccgcagtgtcagtgacactcagtgctatcggtggaacatattggctgccaaatggctgctgtggtcccctgggatgtgacagaggcatgctttagcctgtaggagcgaagtctagggtacagatgaggcaggtgtgaaaaagctcgggagaagaggtgcaaaacagcacccagggcccaccgtcgcctccaaacagtcctaagtcccctgccagacttctccaggtagcttgaaacatccgagccccctcctttctagcaaagtctctctaaacagttgatacgtggagaatttccctcagctgtttatatggtctgctcatacgtgcatggctgtgtttgtgtgtctttgtgtcacgggacgttgtttttctaaatttgtctgcatgggggtgtttttacagaagaattttctctgaggcagcagttagctttattatgggaaaaaaaagagctatgtagttatatagttactagaaacttcatgtgaaaatctttggagggaattgcttgatgtaaagtggatgaaaactgctgtttagaatacaccaggaaaagcgacaccagccagatcttattctgaaagacttaaaacatacccgcaaaatcgtgggcgggggaacccatatttatcatatttataatttgtaatatgtaaaagttgatgctaacccaaaattattattctgggattctttactggaaaacacacacgcccttagtctggtttactggaacacacccagaaacacacacacatgctcagtctaggttactgaaacacacgcacgagtgtgcacacacgcgctgacttgcagtctcgtttactagaacacattggcataagtgtgctcacacactcacggtttaccggagcacacagacccccagcctcgctttgtaatgcctgtgtgttactttccagcctattttcctaaatgaggttctagtaaaattacccaccgacccttctggagacgagcccatcttccacatctcccacattgaccgcgtctatactctccgagcagaaagcataaatgaaaggtgagacctgccgcctccccagcatgggccccagggctccacggctctaggacacacaaggggcgggtgattaatcaggtgccaatgtttcccaagtggcaatgccatcacccctagctgggagtggggatggggctattacttttttctacagcctctcaaaaatctgtcacatggcatgccctttccaaaataacatggattcaaactaattttgcttgagtttttttttttttttttttttttaaggcagagtctcactctgtcacccaggctggagtgcagtagtgcagtcacagctcactgcagccttaacctcctgggctcaggtaatcctcccaccctagcctcccaggtatgtgggactacaggcatgtgctaccaagcctggctaattctttatatttttttgtagagatgggttcttgccatgttgcccaggctggtcttaaactcctgggctcaagggatccacccgccttggcctcccagaatgccagaattctgggattacaggggtgagccactgcacctggcattgttgttgttgttgttgttgttttattaagaaatgtttcgcattctttgaggtaaacagagcatctcaggtttcccctggcttcccaggtggcagaaaccaataggaaagtaatttcggggttaataggaccacgcaaacccaaacctctcctcaccttggctgacttaaatgggcattctggaacctagggctgtgggtattttgcttcaatctgtcttcaagacactgccctggagccaaatgaaatagatcattttctgaagggtgaacttgacacaaggccagcatcattccaaagagcatttgcaccaagcaagaaaattggctaaagcttttgtgcatatggttctcagaaaaaatgaaggagaaaaccgcggccacaaatgccttcccccaaggcgttttggtctttcgtgtgaagtggttcccaatctgggaagtggtttttgttctttctttgcgtgatttcataagcgagatccttctggctttgttggattaggcaaatatgtgctgctcttcggtaaggaaggaagaggagtcgtgtcccgatgttgcctccaagacagcatctatcacagattttcttccccggggacatcatcgcaggtcttgaggacatccatggaaatggccctcatgcctttcttatcgatggcaggaataagtattagcgtcacgtgacataaaatcagattttctttcccgagcctttgttgttaaaatcaaatgaacaaagaaacagagtcctggcaacagtgtttgaacagacctgaagcctttttcctgagtttctgtttggcaactttctgtctttttctgtccaaggactgcctgggtgcagaaaatcaaagctgcttctgaactctacatagagactgagaaaaagaagcgcgagaaagcgtacctgggtaatgcatggccccgcggggtgtcctgcacagctgggcaggagggagggccatttggctgggctgaaaatcctcagaatagaagaatcccctggacctagaggaggggcatggaatgagatggaagtgagcttggggtgggatgcagatggggatggagggcaaattccaggagcaaggaagcaagtgtttaaggagagggaagaattacttttgagtcgggagaggtacatgaaatgcattgtgaggctcacagagatgggaaaggtgtggcacgttcaaatgaagcattttgtgtttttcctgccgtcatagtccgttcccaaagggcaacaggcattggaaggttgatggtgaacgtggttgaaggcatcgagttgaaaccctgtcggtcacatggtaaggctgtgaggcgcccccggctcctgctttggggttgggagtagggtccgggttccccacacccccacctggctctagatcaaatgtgctatttccatactccctgatctccttccagaattggtttaactagcacttgttaaaaacctggaggttttgtgtttttttttccatcctttctaccattctgcttctccgagggatctgagtggctgcattcacagtggatgtgacacaagatcaggccaaagtaacgagacaggaagggcctagtttcaaagcccactcaattaagtatttgtttttagtttaaggatgaagctgacttctgggagtttccacccggattctccaccgaatgacacttattaagcatagcagttattaagagtggggagcggccgggcatggtggctcacacctgtaatcccagtgctttgggaggccaaagcaggtggatcacctgaggtcaggagtttgagaccagcctggccaacatggtgaaagcccgtctttactaaaaatataaaaaattagccaggcatgggggcagccacctgtaataccagctattcattcaggagactgaggcaggagaatcacttgagctcaggaggtggaggttgcaatgagctgagatcataccactgcactgcagcctgggcgacagagcaagaatccatctaaaaaaaaaaaaaaaaaagagtggagatcaaaatgaggtgtgagttccacctggcgaaggcttttgttccctccaggaaagagcaacccgtactgtgaggtgaccatgggttcccagtgccacatcaccaagacgatccaggacactctgaaccccaagtggaattccaactgccagttcttcatccgagacctggagcaggaagtcctctgcatcactgtgttcgagagggaccagttctcaccagatggtgagtggaacgcggccctgtggttattcctccttccctggcactcgtttgcgtgggttaatgttttcttacctggggacttggtgccaggattccttcggtttccctcctgagagatgaggctggctggcacaagacgaggctctgtctcccctggaggagtcttctggaggcgtctcattgcatgtggacagagcatgcttggtctagaattgtgccagctgccctgggcaaacacgtccatcttctgctttccaaagcaggtgactgtggagaggggtgtgtttaagagcctcagcatagttcttcagtccttggcaaaaagctgtgctggcaatggatgaaactggccaatggaacaaggatgttagcccacaacaggagccgcagaatgggccaggtccctttgggtggcatttttgtaccacttattaagtaggcaaagggatgcagtcatgttgaatgaatcatttcttcagccagccttctgtttctgcttgggcctggaaaagaatagtctcagcccaatgattccaagaaactacctgtctctccctcaacccaataaaaatcaccggtgggcatggtgctgcaggcctggaatcccaacactttgggaggctgaggcaggaggatcgcttaagcccaggagtctaagaccagcctgggcaacatagtgggaccttgtctctacaaaaaaatacaaaacttagccaggcatggtggcatgcacctgtagttccagctactcgggaggctgaggcaggaggattgcttgagcctgggaggtcgaggctgcagtgagccatgatggtaccactatattccagcctgggcaacagagcaagatcctgtctccaaaaaaaaaaaaatcacagagtaagttaaaagattatggtctcaacttaattataaccgaagaagtgagggtcaaatgctagcattatctgtacaaggtttaaatggctccatatggccttcatcttttagtactttttatatgaattatctcattgtgagttaggtactcgttgtggtagctggttaaatgtttgagtgtgactggaacagtttggctcccaagtctgggctcttaactactatgtgtactgtcaacttctaattcttttttctttttattttttttatttatttatcttttttcttgttgttctcgctctgtcactcaggctggagcacagtggtgcaatcacagctcactgcagcctccacctcccaggctcaagcaatcctcctgcctcagcctcctaagtagcagggatgacaggcatgaaccaccatgctaggctaatttttaaaaattttttgtagagacagggtctcactctattgcccaggctggtgtcaaactcctggactcaagtgatcctcctgcctcggcctcccaaagtgctgggattacagacgcgagccactgtgcccggccaccttctaattctgagagataaaggttggggttgggtttttttttttatttaagtaatgaaataccatgacacattggcaactccgctggggagcgagttggaaatcctagtgttggtttacatcagagcccagagaagaagggagagcataacagttcatcagggggtccccaatatgccagacatgtgcctcgaagagagggaatggtccctcttaggagggtctgtttgttctcttttcagattttttgggtcggacggagatccgtgtggcggacatcaagaaagaccagggctccaaaggtccagttacgaagtgtcttctgctgcacgaagtccccacgggagagattgtggtccgcttggacctgcagttgtttgatgagccgtaggcagcgggctcagggtgtgctcagcagggtcccagcccacggccacacatgctgtctggaaattgtattccttttctaagaaaccaccatttggtattcagtcacagggatatgggatggcaaagacaggcccctcaaagctcctaggaatcattctcgacaatcctccctgccccgaaacaatttcctgtttcatgaaacaaagctgtgttttcctttgtcctcactacaggtctcattatggcttctagggtcgctgaaatcccatagccctcaacagggtgcagctgggagtctagccccttcccgggcttgagggatgggtctggttactataaaatagatttataaatgcaatgtctatatttttggagaactcatgtaaccctcctgtttcttacatccaccagtccccaagtagacttcttggcctacaatgcccagtccttggtgtgagtttagaaacaattatgacggtcctgtcattgcttcagaatcccatctctcctgcagggaaatgctgcctagagctgatcactcggtgagacggtctgatcaggccctggcttagctctttgaagagctggtctatggaagtttccagcatgtgcaccgttatagccgttccttccccctctaggccttgtattaatatatgtcaatgaaaacacactggtgtattgttgcgtggattcagttctgattcccagcatgcttagaatatggtcacagaaagtcattatctagaaagtcacccctctgctggatcagatcactacaggtcactggaaaggcaactttacaatgttgggtcactgggtctcggttggcagccatgttggaaaaatctcttttggctcggaggcctgtgatatttcatagcagcagtcgttgctggtgacctgttctgtgcttgaatgtgctgaatcctgattgttgtaggacatttcaacagctctttttggtacgttccccaaaaagccatgtcctagatccccaaggcgtgaaaaggaaaaatatcaagctggaggttgggaaagaaaatgaaggcagtccattatgtggtgggtgaaagaccctaggaggatgcaagccccgcacatcccggggcaaagacctaagacacttttccaccctccaccaccccaacctcacataatatgcttgttgcaagagtcaggactttatgactatgtgccaagctgtttggtttgagttctttaatttttttttcccttaaatgccaggagatcatctggttagttagatagtaacttgatttgctaatgaaaagtgggggccgtgttttgtttgcatgttaatattctcataatcctagtttgttgtggtcatgaaatgtcctttgcatgttctgttggtactggagtctagctttcctgtactagatggtgttctctttgattgtaggtccttagactttaattagggttatcaaagtgctttctaaatgatagcatcagcgttgtggcagagtacctcctttgctgggaactgaatgtgtagtgttatcatttcccatgagagcccggtcatacttcaagcaatttttttaaaagtgtgtgttggaaaggacaacaaagtttacatttcatacttttaagaaatactttattatttatttattgaagatagtgtagaattttgtatcaagaacaacagacataagtattttttgaaacaagcaaatataccctgtagttagaaactttcaactgaacatgttagagaccaagtttaacttcaggcatgcatttgtttaccatttcccagcagaaaacatggttaaaatactttaagtttatattttttgatgttgttaagaaacttttaaattaaatctataaatagacatgcaactcatgctttcctatttctataaccaacaccgtttgtttagtgtatttatgaaagatatgctaccatggtagaaagaaaagtattcaatgtgtaaatggggtagtgtgggtcaccattccgatctctttttgttttctgtcctgtcttttcttcattgactttatttgcgtgttaatgttggacatcattgttcatgtaggtagcgtatggtatgcacaatgacaaacaatcgttttaggtcccaggtcacccactcatagtgtcctattattggaattaatgtagcatgagaaagcaatatgtgactctttttcctcaagtgactctgttgagcatccttgagatgctcctgccatgtagcaagttctggattagtgtccttgtatttactggtgtaatttgtaatgtaaccaattgtccgtatggaggagtcgggctggccctcggacccagctgtgattcatgagttgtgtcacagggattgagaaacatgggtgatgcatggagtctcaaaccattgggcctctctgttccttcacctctaccttcttgaccacctgggctatatttcatagaaattaaatgctccttgccaacaaggagtctgtctcctagctctttgttttctaaatataggagttctctaggccactgcatcccggcatcctgatcccagccttttagacacccctgcaagcgttcctctgctctgagccacactgctagcttctcctgcacactctgatctcctttagcccaagaaggggctgtgctggtcatagggttatgctgtaaccctcagtcttccctgagaactgaactatcctgggacctcttgggctgagccttcttcacagagcagttctctagaaggcagagtccacatcctggtccctctggggcagggcctgtctggctgctggcatcaccctggcaggtggatggacagcatcatctcctggaaccaggtttgctgtgaccatgagagcctgaagatgtggctcattcggatccaggcctggactaatctggaaagagggactttctaggtgcaggtcaccagggatgcttgagaaactagagccagacttccttgtttgtttggataatatgtccctgtcctctgatagcagaggaaagagctctgctcccaaagaacattcatgtaagaggaggcatttttttcttctttgctttttttaaacaacctaaagtatgacctaagtgtatgaaactaactgatttctttgggtagagtagccctgaatttaactggggaaaaaatcccatcagactatgagtaaattgaccacccacattaagtcttatctcggtgacctggtaccaaagcccaggtgtcctccaggggagtattctggggtggcagggggattaggtgctagcgccagcagggaaggacacttgcaggtctgccttccaaggctaagcaggccggctgtctctccaggaactggctaggacaagtgtaaagccactgaccacacagaaccaggatgttctagaatctgatggggctgaagatgaagggagaaatggacaaggcacttctggctttattgaaaaggtgaagctcttggagtatattttagagtaggccagtaccttgtataagcagaaaaagacttctctatctccactccaagtcgtttttttctagttgattgggcctttttgattgataagaagaaaatgtgttttgtacgtgtaacaactttaagaatttccattggaaacaaagtatgatttgatttgatttgatttctaagttctcccttccttttcaaggttagcgatgtgctttatagcagacactagcacttttacatgaatacctggtgtgctttggatgtaacagggtcattttgggctcgaggtgagtgtgcaattagcagcaggtctgcttggtccagatatgcttgtttacaagtttagagcatcctatgccagaaagtgagatgaaaacaaaggcacctggattgctttgttttgcttttagataaaagagctttagctcacaccaggcagaagcataaccagtagccccagaaaccggtagcatgatgaagccctcagacagtatagtctgagccaccataagaggcattagggaaaactaacacctccttctttttgcaccgtggggtgctgaaattcctgctagagacttccccttacttccatgaatggcccaggggctgcttagtatatcattagaatgttcattctcctccttttccctggagtggaccagtgagaccaaatgcttgtgtttctctatgttttcagttcatttgttcaaatgacccagaagatgaatccatttctgggaaggctgagctcagatgaggattgctaggccagcctaggttctggggcggatctcagggacagaaacaggcttgtattaagtatgagtggcaggtacttctctagaacagccctaacctgcactagtgaggggggctcaggaattcccatgacattgatctagcagcctcctgcacgtagacactcagttcattttagggacgttcaatgcttgatcaaatggggggcattttctttctttctttttttccccagctacagtgtaattgcctacctgcctgggccccttctagaggaaggtgggctttccttgtccgtcaggctgcactcatgaggtgatatcgtaaagcagcagaaagactgagggtgcaaagaaaccacagctgccattcacggggcagctccctctagctcttctgcccagtgaccttacaggctttagaggagcctgatgagagctatcctgggggccaagggatgcattccctgcagcttcctcctgggggacccacaggtcagcccattccaggagaagcagtcttaggcccgtttgcatcccctgccactgccatgtgcctgccagcccggtttctgatgaagacgtggctcagtccctgctctccttgtcgcagtggcttgtacttcatgtgcagtagcccagggcccgccttctagagtgaatgtttccctcgagcccttggatatttttattctattttgaatggttccgatcaattaatgttgctttgtgtggggttcttcagagaaataatgcaaaccggccaggtgcggtggctcacacctgtaatcccaacactttgaggggctgaggcaggtggatcacctgaggtcaggagttcgagaacagcctggccaacgtggcgaaaccttgtctctactaaaaatacaaaaattagccaggggtggtggcaggcacctgtaatcccagctactcaggaggctgaggcaggagaatcactcgaacctgggaggcggaggttgcagtgagccgagatcacgccactgcactccagcctgggtaacagagcgagagtccttctcaaaacaaacaaaaaaagagctaatgcagacctcttctggttagacctgacacggaggaagtaattggctggtcaacttaatggcgccccacagcttcctctggatcctgcttctttgtacttggaacacagtttatttgagctagaggaaaggaaagttctagaattcctgtttcctcagcctgcactgtatcagatccaggatatgtctgcatttcatcaggatcaagtaagatacataaccttatatctgtaggagccagaaaaaaaaaaatctattcctgataggcatggaaacttagtccacatgaaagacagaagacatctaacagctgtctgtcttgggagcattaaaacccagacaccaagacacactagacagtccatctctgggttgtgatctctcagaaacatcttagtagttaatgcactgttcatttagggagtccccatcctggtccaggccaccctcctagaagctgggcggcagctggacgggcctgccttggtggcattcaagcaagcctaattggattaggttggtgcaaaagtgattgcggtttttgccattgcttttgatggcaaactaactttaagtcattaaaataagacccaacgcttataaaagagttcatatccacctcccaataacttctttagttccatgcagcctcaatcagttcctccattcaaaggaaccctctttaccctggccctgggggagccatattacacccacatcataatttttctgacactatgtgtgcttgtcaaatttcagggtcagtttccccttattggatgtcaggggtgttttgtgagttgtgttttaataggattctgttcgattttctataccagcctatattgttactatcatctgcctagtatgaatattttagtattcaaagcccaccagataaagctgtgttcagaagtggactttttggtcagccttgaaaaaaaaaaaatcagcatttctctgatatttcctgaggattaaccagaaactaaggtttctttttaggcagtggtaagaatgcgtattttcttcttccagaagttctggttttatacttttatcttttgaaagaataacattcctgtgcgactctgcttctcttcgcttttgcatttctcttttttaactcaaatctcttatttcctgccgttcctgtatctaaacagaatgggggcctcaggcagacaggaaccaaagaaagggtgtagtggctttgcagcgttgggtgagcagcagccgctgccattctgtgcactgtcaccggcgggggtggagggtctccctgtaggaggaggaaactcgctgttttcactggcagatttcaaggtgccggctccacctaccgcagctgctaggcattgctcttgtgtagatcgcagaaggagttattggtgatgtggggtgtaggggaagacaggaaaacggactcagagctaggaatgtgggcctggcagagaccgaaggctgggtgggaaggaagctcgcggcgagcctagggttcaagcctagcgcgccaggggtctccagtgagaccttgctcttccctgccgctgaggctggggctgcacggaggtcctcaggcttcccaccctttctgcatcagctttagtgtctgtcggctgggtggactgcagggcaggtgacctggaggaggccctgctccccagcaagcgttctaggagttacggtgtgctctattgggattggattacagtctctacttgtagactttgacttctggaattttaggtggaagggaatttttgttggtgggacgcagcagctcagtgcgtggtgtgtgcatgcgtgtttgtgcgtgcgtgtgcatgtatgtgtttgtgcgtgcacgtgtgcgtgtgtgtgcatgggtttgcgtgcatgcatgtgtgtgcgtgcgcgtgtttgtgtgtgcatgtgtgtgtgtctacgtgtgtgtgcacgcatgtgtgtgcgtgtatgtgtgcgtgtgtgcatgtttgtgagtgcatgtgtttgtgcgtgtgtgcgtatttgtgtgtgtgcgtgtgtgtgcgtgtgtatgtgcgtgtatgcatgtgcatgtttgtgtgtgcgtgcatatgtgtatgtgtgtgcgcgtgcgtgtgcgtgcatgtgtgcgcatgcgtgtgtacctacccacacctagggggatgcatggctctgtgccttggagagggaaacaggaaatacgttgctccacagtcctgtcatcctggtcaggactagtcgcgtggtttgcggacagagtgcaaaatgaaaatgcgaggccccttgttcaggtgatgaagcatttctagacagtgagaggagagcattaagccaagctcaggtcccttctgagtgcatagccccttgtggctgccaggcagcacacccaggaggccggccctgaccacactgttctctgctggttcccgaagctgatgggctctgtcttaggtcttcttactttgaaaggtctcccggcaggctgtggcaagctgcgcggatacacttttctaaacgtctgcatttatttcctaaaagcacaaatggcctggactagctagtgggtgtggaaccgagcccctagttcacagctgtaccccaaggctggagagggggttgccggtggtggcaggagctctgggctcccagttcaggatgggccacagggcgtcaagcagctgtgagcctttaccattgagctcactgcttggaaataaaacccttcctctgggccttgggcatccactgggagcttttctcccctttcctgggaggacagcaagccttttccaaccttctgccttcaaagagaagcagggtcatagaagtgctcagtgtcccttccccagtggctggacacttgctcctccagccttcaccccctggagagaaggggagtctgcggagccagtgcctccctgcccagctgggccacacgatctggtctgcgggtgtctgggaggaacctgcttcggagaggctgcgacctcccagctagactctccccttaggatcccatgtatggggatggtaggagagaaaagatccctctgtgtaagtagcctcaagttctagaagaccatggccccgggaggcagctgaccatgaagctgggcttcctgttgttgctttctttcacgagcttttacttttcctgggctggacgctccaaaatgtttgcagttccatttgctttttgcaagtaggtccccatctccatatacattgagcaataatcctcactatgtttcctgattctgtctgggattatatttgctaagtaaaaatgttgacagaaattgcaaactcatctcacctggatttgattgagtcaccttgaatgacataacaaattatggctttgttttcatgcgtcatgcaatcttccggactacgggaagttctgcaagtgttctccaggggcatttcattaatagcgtgtcagcattagttttaatgaatgaacatttgaggtacattctataaatcaatatccttaaaatgtcatctgctaaacattcactgtgacagaaagtagatattttagcaagatctatgttaatgctacttaattttagacatgcatttaaagcctacatggccaatagcccaagtatctttgaactgtgaaatcaacctcagatctcatctgctgtagccccgcaagccggagtctgtgccctccatgacccttcttatcccttggtggccctgcatagataggggagttggcccctgcccaccccgtgttgtattgccttagctccatcagctttgtaccctcacacgtataggtggtgaacttatgtgtaaatacatgtgtacagatgagaaactgcaacaaaaatgtcctgtggatgataatcagctcagtttccggttttctacattctgtgctgtttccagctaagaaaaaggcgaactcccactatataaagggaaaaggttgtattcatttcatgttcctcatgaaatctctgctgtatgtttatggaatggccatgactaaatgtatatatggtatgtaagaggccatgctgttaaatgttgcataaactaacacagattctgtagtcaaaaatatttaacttgttattgtaaaatgtgatttgtcattgagagattatttttctgtatgtatatgagagtattttaggaatctaatttaagtgcataaaactatagaaaaaaatttaaaacctattccaagagtagaaaatgcttaatgagattacttgggttcaactcaactaaatttcttatattaaaaaaaaattccaagttgtatatgttagaaatcaaatgagtcattttttttcctgcaggaaatatgataaatttcagtgtaatggatggtggcgtgatcaaatgaaaagtatcctgtagctatgacctcgcatgggaccttggtgttgcattaaaaatggatttttgcagatcacatatctgagagggtacttgtgtcaggaaggatgagaggatagggagcctgtttttcatcagatccatgtgccacgcaggcttccttgggttctagtggatttgttagggatctggggctgacgcagctatcccactagagaggccactctctgacttccaggtcgccctttctacttctgtatctggattgattcagtttatccctaattagcgtttgcgttttccatgaaatttcctgatgcatcctcactgtcttcaactgttgcatagccaggtgggtggatggatggtttagggtttctgagttaagccgttttggggcaggcttctggatgcccatgtttccatggagaccccagggggaagatgccttcctcccgtctgcattcccagaaaaggatcagaagtccaggctgcttctggggcacagactttctgtacttggccaccagaagtgccccttaggccacctaaggaggattctgtgaaactcaatgtctaaacccctgagaaaggcattcagaaatgatttcaggagggggcaaccccaggagtccagcctcccctggcagcctggaaatactgcagtaacaaaaagagctggtttctggtgatctgaatgcattgtgtttgggggtgacaccgctggtggaaggttgagggcctgtggtctgaaaagacatctgaagaatgtgttaggttttcaacatttctttgaacaggctgcgtgcatcttaatgctgtcaaccagcaactggagccccttttttgagaggcccgaaccagtaaagctgctgacttcaggagtatgggaagctgtgatttctggaagcttcctggaatctatttaggtgcatgaataatctgcaaatcacttagaggcactgtccatgtggtccataactggctttattcccaaagatggagctgttcagagatttctttgttcaggcgcagccttggaaggccacctaaggcctgccagcagaggagatgagctctggtctaccaaccccaaacaggccctgactctccttccttagaacgatgccctctggctggggtggcaagagggctgtgagtggaaacaagtcagccagtcaactgtcccttgggccttggttgtttcaaaaaagtctggggacaagaaaagctagaacatggggccctcccttcccaggagtgctagcgaaccctcccagatagcctttgcctgtttggaaaagaatgtaatccatcagaacgtgagctccttgtgcttcca

SEQ ID NO: 293 - DNA, 38228 bp, Homo sapiens
gggcctctcctggtggatgcaggataggacaggacatatgctccacccttacttctgctgcagcctccacaggatgaacacaccaggttggatggagctcccagaaacctcctgcagtggggtcagcaggacaaagaggtagctaggtagcgcccaatgtctttccaatagtgtccaacgtggaggggactagaatgctctagaatgctaaggaccagtcacggtggctcatacctataatcccagcactttgggaagctgaggtaggaggatcacttgaacccaggagttggaggctgcagtgagctatgattgcgccactgcactccagcctgggtgacagatcttatctctaaaataaataaataaatacaatattgaggagcagagaccaggttgttccctcttgctttatgttgctataaaagaatactaaacaactccatcccggatgctaatctgcagtgttgacttctgattaattccagttccaggaaggtctctaagatttccagtttatctattgttcctcgggtaagaacagatacttactgtaaatcctgcccttgggtcatacaaccttgatgttaatcctacttcagttttcctgcacatcccttccaaaccacccctcccctacggtaataagccctgggtctagggggtaactgtgcagggatccaccatcttgacccactgctgcccaagatacagacatggcttctgtttgtaagtccctattaaatgttcctttctaagaaactggatttgtcggcgtctttctttggcttctcagcttcctcagatgttggggtaggtttgcatagacctgtctaccatgaacactaggtaatttataaggaaaagaggtttcattagctcatggtcctacaggctgagaagttcaagggcatgaccctggattctggagggggctttcaggcttcatcaaaacacagaggagaaggccaaaggggaaggagatacatgggaaggggggaaaatatgaagggtatcttggctttgaaacaacccactcttgcgagaactaatccattcccaaaagaactaatccagtcttgccagagcaaaaactcactaccatgagaacagcgccaagccattcatgagggatccacccccataacccaaacacctctcactaggccccctcccaacacggccacactgggcatcaaatttcaacatgagctctgggaacaaaccatatccaaaccacagcacccctcaagacagcccagagctttaagcttcctccgtgtattcgtctgttctcatgctgctaataaaaacatacctgagactcagtaatttataaaagaaagaggtttaattgtctcacagttccacatggctgaggaggcctcacaatcatggcggagggcaaatgaggagcaaaggcacatcttacatggtggcaggcaaaacagcttgtgcaggggaactcccatttataaaaccatcagatctcatgagacttattcactaccatcagaacagtatggagtaaaccactaccatgattcagttatctccccctggccccatccctgacatgtgggaattattataattcaagatgagatttggtggcgaagacccagccaaaccatatcactcccctaacctcaccctgccctgctccagtcctgtccaggttttcaaaagaatcctggtgagcattggagatacaaaaagcactgggacaagcctggaggctgccagacctgggtctggtgcttgctgcctatggggcagtgtgcaggggtgtcgagcaagcctatctgcatccagccatctccctggcttcctgccacgtgcccgctcccaagccatcttcccctttgcaatacttgccatattctgccagcccctaatattatgtattactcctccttatctattttcaggggcatttttttcacattttaacatatgaaattggaatgcaccttgcaaacaatgatttcatgtcatcactatagactaggtggccattgtaacatagttgtcattgcctgaacatgtgcaaacttggttgaaattcctcacgtaatgactggacaacagcaatccatcaacgcctacttggcatggaagaaaatgcttcccagtcaccccttgtaccaccagcaggagcatccagactttggggaattttgctctaaatcaccaccacagtctctcctgcctccaccccagcagaccagctgtttttttcttcctggaacaatctcccctccatggcgaggtatctgaattaccccctttccagttatttgttgctgtgctgtcttaaaacttagcaggatacaataaccattaaactatgcttgcagactctaagggttgggaaatggcacagaggagatagcttgtctctgctctatgatgtctagggctcagctgggaagaggcatatggcttggggctagaaccttccaaaggttcattcatgtgagtgcccagctcctgggctgggaagactccttatgagggagtgccaggctcctgagtgctccagcaaacgaacagaagctgcatcgctgtctatgacccagcctcagaaaacccatagtgtcacctctgccataccctactcaagcctgccactcaaagggaggagcatcaaagcatttgcaatcattttttaaaactgccacacccttctttacctttgatctgaacctgtgacatgtgcctgtggttctccacatgtcacctaacatgacacactcctcacagttattgctatttattatttctttttttttagagtcagggtcttgctctgttgccctggctggagtgcagtggcatgatcatagcccactgctcactgcagcctcccttgaagttcagggctcaagcaatcctcccacctcagccactcgagtagctagaactacaggcatgcgccaccacgcccagctaatttttttttttttttagacggagtttcgctcttgttgcccaggctggagtgcaatggtgccatctccgctcactgcagactctgcctcctgggttcagcaattctcttgcctcagcctcccgagtagctgggattacaggcatacgccatcacgcctggctaattttgtatttttagtagacacggggtttctccttgttggtcaggctggtctcgaactcccaacctcagttgatctgcctgcctcggcttcccaaagtgctgagattacaggtgtgagccactgtgcctggccgaatttttgttagagacagggtttcaccatgttagccaggctggtctcaaactcccgacctcaagtgatccacctgcctcggcctcccaaagtgctgggattacaggcatgtgctatcatgtctggctttttaaaatttctttgtagagatagggtcttgctatgttgcccaggctgttctcgaaatcccagcctcaagcaatcctcctacttcagcctcccacagtgctgaaataacaggtgtgagctgctgcacccagtgtatttattaatattacatctttaattgtctaggactgtgagttcctaaaatctaactcagatcatgtcactcttctgttcaaaaccctccaagggcttcccatttcacccataacaaaagcctaaatcctaacgacatccggtaaagccctacaagagttacccccaagttatctctctgacgtcatcagcttctactccccagcttttgctccccaccaccaaccacgatgacctctgtgctccttctttagatgcccagcacacctgctgttccctgtgcctggaactgtcttcccacacatggccccatatgacttactctctcacctccttcaggttgcagctcaggtgtcaccttatcagagaggatttgagcactccatgcaaaccagcagccctcaccacacacacatatagcaccattgtcccccttcccctgcttgagtcataatatatataacaatgcacataattttctaatttcctgtttcccgccactagaacatgggcagggatttgtgtgtttgtccactgcaaaaatcgcaccaaaatttgacatcatccttcatccatacccaagccttctgacatgtgacttaaagcctctcccatcaagtaatagattctctgtcagctgccgtaactcattcctgtaatcccggcactttgggagactgaggcagggggaccacttgaagccaggagtttgagaccagcctgggtaacatagtctgggtaacacttctccaggcatcggctacatttccaaaaatgtgggtgccatctccctctgtgttttctggaaagctagtgaaaatgcaaaaccctggccaggctgctggctggtagctggacctgactccagaactactgaatcgaaatatccagaagcagtacccaagaacctatattttaagaatttccacactgcccacaggggtccttggacacagaaccggaagggcagcctgtgccattaccagcaggtgagtggagggttggaataaatagattctgggacagagggaagaacagagagtgtagcttgagacatttaactgccttatctaaccatcactacctcctggggaggtcggttatcatactgtgaaaggaaaataaatctcaggatcccaaaatcactaagccaaagggaaaagtcaagctgggaacggcttagggcaaacctgcctcctattccattcctaaagaagatggctagtaagataaaaaagctacatacctcctcacaatttgtccacaagggattttcttatggactcaggacagacagaactcacagtcacccctccgctcactgagagaaatgcatatctgatggattcctttggaaaggctaatcagaaactcaaaagaatgcaacaatttgtcacttatccacctatgacctggaagccccttccctccttcgagttgtcctgcctttccagaccaaaccaatgtacatctcacacatattgattgatgtctcatgtctccctagaatggataaaactaagctgtgccccaaccaccttcggcacatgtcatcaggacctcctgaggctgtgtcacaggcccgtccttaactttggcaaaataaacttcctaaatcgactgagacctgtctcggctatttagggttcacaatacctatttcatgaagacgacatagaagttaagaagaaatcacttatgcagatagccttttacccttgtaaaaggcctttctttttcatgaaaagcagccccaaatcattttctaacaaagagcagcctgtaaagttgagctgcagatatagacaagcaagctgggagcttgcatgggtgaatgagggcaggaactaacaactagacattttcaagatggtggctccatcttcccttctctgccagccacatgtactgtaagaagcagacaagatggcgctgatcaactggaaagcccatttgcataataagattagggtgaggtgactagccttctgcacgcactatgtaaacgtcacacttgatctaaccaatctatgagccccatgtaaatcagacaccgcctcctcaaactggactataaaatttgcgcatttgctgccaaccagtctttcccactgagacaccccttcctcgatagaggaagctgtttctctttctctcctcttctacctattaaacctccgctcctaacctcctcatgtgtgtccatgtcctaaattttcctggctgcaacaatgaaccccagggtatatatcccagacaacatagccacttcagaggtggacactgaggctcagacagaaagtatcccggtctgccttactttatgttgggggctatttgcttgtaccccaggggaacccactcaacaaaacacctggtattttgctctgagtcttcacgcaaggtcattttaggcttgctagctcccggctgaaggtcacatgctgaaatgaaattgaaagcacagaataactaagtgagcagaccctccacctggaaaatccaggtggcatcagtggaagagccaagacatgggaggttttcatgtctatttttaagcaattgaagtaaattaaatgtctctttcatggccaagctacacgttgtttgcaagtttggagctttgtttgtatgtatatattttaaataaatttgataattaagtcacgaatgctcccagcacacttggatatatttaaattacaggcttctgatcaaatggagaaaaatcacaaatatgggcctaaatgatgcctttttctgttcagtggcttttgcagcattcaaatgggtctgtcagcttaatggccaattctaaggctgctgggaatgacaggaggtggagggactggcaaagagactacaggaagtgaaaccctgtggtgaaaaattgtggttcttttaagaaaacatttcatctgcgcctgtaattcatttcaacaagccagttttgaaaacacaaacaagctggtaaaaggggtgtttgtctctgcctgactggcagcactccatacccaccattaacagccagttcctgaacactgtggcttctggaatcagggggtcccaggtcaaatctcctttggtccttgctgtggtgcctgtctgggcaagttggagattctagtgcccgccctactgtagtctctgtagagtaactgcccatccactgtcaaaacaaattcagatctagtaaagagtggcttttcccatccctatgtcctgaatggtattgcctaggttttcttctacagcttctatggttttaggtcttatgtttaagtctttaatccatcttgaattaatttttgtataaggtgtaaggtagagatccagtttcagctttctgcatatggctagccagttttcgcagcacgatttattaaatagggaatcctttccccattgcttgtttttgtcaggtgtgtcaaagatcagatagttgtagatgtgtggtgttatttctgaggcctctgttctgttccattggtctatatatctgttttggtaccagtaccatgctgttttggttactatagccttgtagtacagtttgaagtcaggtagcatgatgcctccagctttgttctttttgcttaggattgtcttggctatgcaggctcttttttggttccacatgaagtttaaagtagttttttccaattctgtgaagaaagtcagtggtggcttgatggggatagcattgaatctataaattactttgggcagtatggccattttcatgatattgattcttcctatccatgagcatggaatgttcttgcatttgtttgtgtcctcttttatttccttgagcagtggtttgtagttctccttgaagaggtccttcacatcccttgtaagttggattcctaggtattttattgaatgggagttcactcatgatttgactctcggtttgtctggtattggtgtataggaatgcttgtgatttttgtacattctactataaagacacatgcacacgtatgttttttgcagcactgttcacaatagcaaccaacccaaatgcccatcaatgatagactggataaagaaaatgtggcacatatgcaccatggaatactatgcagccataaaaaaggatgagttcatgtcctttgcaaggacatggatgaaaatggaaaccatcattctcagcaaagtaacacaagaagagaaaaccaaacaccacatgtcctcaatcataagtgagagttgaacaatgagaacacgtagacacagggaggggaacatcacacactagggcctggcagggggtggggtcctgggggagggatggcattaggagaaatacctaaggcaaatgacaagttgatgggtgtagcaaaccaacatggcacatgtatacgtatgtaacaaacctgcacgctgtgcacatgtaaaccaaaacttaaagtataattttaaaaaaataaaaaagaaaaatcctatttgaaggaaacaaaaaagagtggctttatttgaaaggattattgcaaggtgcaggagggacttttttttcttttttttttgagacggagtctcgctctgtcatccaggctggagtgcggtgtctcggcccactgcaagctccgcctcccaggttcacaccattctcctgcctcagcctcccgagtagctgggactacaggtgcccgtgaccacacccgggtaattttttgtatttttagtagagacggggtttcactgtgttagccaggatggtctcaatctcctgacctcgtgatccgcccgcctcggcctcccaaagtgctgggattacaggtgtgagccaccacgcctggccaggagggactattataacaggggaagggagacttgcaaaagagagtacactgtggccacaagggttaggccaaaaagagcttttctttcataggaagaagaaaacaaggctagaaagaacctggaagtggggtgaaagggtgacatgatgggttagtagatcagagaatatatcaacctgaggccagcctattctgaggaggggctgtctgctggcccaggcccagggtgagccaaagttcaggggcctggaggaaggaaagaatcttaaccaaagtggttgaccagcgttttataaggattgattagtgggacaagcagttcaggtaatcacttataagacaatgaatgagaattggagggtctgtgtcctgtttacctgctctcacaggtaaacaatgggggtggtgtcttggagtcttatctaaattctcttgtgggggtggggggtgattctttgcagtaaacttttttccacaacacaaaagggtgagagcaattcctttttacttttttccggggacacaagactcagggaaaattcaacattgtcactactcaagggtggaaacttagtgtagcacataaccatgaggattctaaacctgtggctgctgagttcaaacaccagcatcccagtgagcctggtgggttaggagatctttctgtgctttacttgctccctccctgatatggtttggctgtgtccccacccaaatctcatcttgaattgtagctcccataattccgtgttgcggaagggcccagtaggagataactgaatgataggggaggttcccctcatactgttctcctggtagtgaatatgactcatgagatctgatggttttataagcggtttcccttttcacttggttctcattatctcgtcttccaccatgtaaaacgtgcctttcaccttccaccatgattttgaggcctccccagccatgtggaactgtgaatccattaaacctttttgtttgtaaattgcccagtctcgggtatgtctttatcagcagcatgaaagcggactaatacactccctaaaatggggatgagcatgatcattacaatagctacgatcctcatatttttaaagtattttagcaccgtacctagaatccactaatctatgaactgatcctgagcaagcctgtttcctactcagaccccaagctcagtacgaacataactttccatgcctctgtgcaatgctgcaaaaggcgtgcatacttggagtccacaggagtgtgtgctcaaaacacaaaagtcccagtgaccacgcaccactcggcatcaaagcaaaggtggcaggagtgtgtcccctggccacttgccttctcactcgaacagactgtggatgcagcacttgctcgtgggtaattgtggatctgactttccaaaagtacaagtatgtggccactttaatcactgagcctcagtttcgctctctgtaaaatagggagaactaataatcctagctgcagagattaaatggtggatgcaaacagccttgtacgaagttgttatctgtgcagaggaaaaagcggtatcactagcgtggaaggacccagaggatacagccaagcctttctgtcttctccatcccccggccttttaaacagcagtggggcggggccacggcatcgatcactcggcgctcctccaggcactgcgtcgtgatcagacgagcggtgagcgatcgatactcctatgctagcctctggctcctcaggggacacagccgagtggtcggaccaaacgcaacgagtcttcgccagcccaaaggcgactcgacaccgtcccagctgaagagaggttagtctgagcaactcgagagcggagtcagctccagttcctcagaagtggagaggccgggttcagaggcatagaccgcgcaggcgtcatgtgaagcagccaagcccggcctcgcgcgtgcgccttggaaaaccccgagggtggctcgagttgccgcatgcgctctgagaatgcaatttagctcgtcgccggcctgccctgcgggaggataaagggaaaggttccgcgcgtgcgtatgctcgtctcttggcagtggttttgcgcatgcgtgagggcaggcccttacggcgggctgctgtgcgctttagcggttcttggcgtcgcgttggtgtaggcctagtgcgcctgcgcgggttttatactctgctatatgtgtgtccgctgcttttaggcaaccagccgctgcccctgggccgcaaggcaggctggaaacgattccgccgtcaggtcccaaatatgagccgcgagaaatgcagccccggggaaggcgctgaggagggaagggggtctgaggcctcggggctcaaggccagtgcggggtacgggggaccctctggggcctgggtgtgtgactgccctaaggaaaggtgcttgtagctcggtaggacttaacgatgggcatcggtgcgtttcccggcaacggtaggaatcgccgtgctcaggaggactcgggagcaagcccggggacaggaggtgcgcaggcgttggggccacacggacgacccaaacacaagactgtgtgccccttagagagccaaagggatccctgtgccatgaattaaagctttctggaaaatgttccaaactttcctgggaagttttacgaagctcttgtttttgcacaatttttgtggaatactgccataataacattgaggagattagagaactggaccgcctgttcccagaaagctaggtgtaggctgatctgtcctggaagccccttttgggaggctttctcatgaccagcatggtgcttgcagagtgcccaccctgagaccctctgcaaatcacagtgaggctctcggagaggccattccacccagccaccttaaagaatactcagggaggtgctttagaggagttgatgtttaaaaataatttaaggctgggcgcggtgcctcacacctgtaatcccagccctttgggaggccgagacaggccgatcacttcaggtcaggagttcacaagaccagcctgaccaacatggcgcaaccccgtctctactaaaaataaaaaattagctgagtgtggtggtgcacatctgtaatcacagctgcttgggcggctgaggcaggagaattgcttgaacctgggaagcggaggttgcagtgagccaagattgggccagtgcactccagcctgggtgacagagcgagactccgtctcaaaaaaaataataaaaataatttgagagaatcctaggatgacagggcagtggcttccaagagggatatatcccataacctaccagggacctactttgccagtttgcatagtgaattctgcctggatggtgaatttataaagtccaggcctgagtctattccggctgttttatacaggttatacttggctcctttttgtttagtacgaccaacaagaaggcttttataagattcattttagtcttatttataaatccaggagaaaaaccactcagaggttagcacataacagcctatattctgaccttctttgcaagatcatttcatacaccagcagacaagactttatgtaaggagcatttaggggctgaatcaagtccactcaaaagctgttttatgcaacccacacttgatctccccctgaaagctgttccaggttatgaggccagttcacaaagccaggacataagcccactcaagctgtttctatacctgaccgcccccctccccacaaaaataaataaagccttctctgggccgggcgtggcggctcacacctgtaatctgagcactttgggaagccaagcagatcaccctgaggtcaggagttcaaaaccagcctgggcaacagagtgaaaccccgtctctactaaaaatagaaaaactagccaggcacagtggcgggcacctgtaatcccagctactcagaaggcagaggcaggagaattgcttgaacttgagaggcagaggttgcagtgaggcgggatcgcaccattgcactccagcctgagtgacagaaagactctgtctcaaaaaaaataaaaataaaaaaaccttctgtgatcaacaagaggtctttgaaggccaatacctgttgagctctgggagactgatttgtaaagtgaagatacgaggccactcaggctttttgatatggcccacatttgggttacggtaggtgtcagtttgcctagaataacaccagttttttactgatgcagacataaatattaatagcatcttggtttggatgacccacctatacctggccactagaaggctatctgtacaactcccaataaacccttttatgtagagctctcgaaggccagtctgtggcaccactctcaaagactgcttcacacatcttttttcttcttgcagggaactggcaagtcacacatcttattcttgactccctcctttggaagcctgtttgtttaatgtaagccttttgtgtgcgtgtgctttttttttttttcgggagggacagactcttgctctgtcacccaagctggagtgcagtggctagatctcagctcaccccaacctctgcctcccaggttcaagcaattctcctacctcagcctcccgagtagctgggattataggcgtggaccaccacgctggctaatttttgtatttttattagagatgggttttcaccatgttggccaggctggtctcgagctcctgacctcaggtcatccaccctcctcagcctcccaaagtgctaggatgacaggcgtgagcgatgcacgtggccttaatataagactttataaacagcaattcagtgaggagttctgggaagccaatcaataaagccaggccataaggctactctggctagtcctttcctctagaaaacctcttgatacaacaagaagcctttttatcagaccagtatatgggaaatgccagaaggctgatgagcctggacctgaggccattcagaaaggcagtgacctgtggctcgcacctgaccttcccaggagggccatctcaagtggttggtggtgtgaaggctgcttctcatagcccatgaggccagtgaccctggaagattgtttcatacagccagcaagagagtgtttccccagccagaccaagactccttctgtaaggccattttgcatggctaacaggagccaatgtgaggctgctcccagcggggtagatggacacaacaaacaattctttcctggcacaatgaagaaaccacagatcgatttgtaaaactaagacaaaatctgacttcacctggtcctcagacaagcccccatctataggaaggccagtttttaaaacaagttacaagggccgggcgtggtggctcacacctgtaatcccggcactttaggaggctgaggtgggtggatcacttgtggtcaggagttggagaccagcctggccaacatggcgaaaccccgtctctactaaaaatacaaaaattagtcgggcgtgatggcatgcgtgcctgtggtcccagctactcagaggctgaggcaggagaatcacttgaacctgggaggtggagtttgcagtgagccgagatcgcatcactgcactccagactgggtgacagagcaagactccatctcacaaaactgctttggaagactgcttcctataccaggatgtggctgtttgatatggtaactacataaaaggccaaatcatgagaggtttggggaagcctatgcaacaaggcagaagactgatgcggccagaatgccacttcaccatgctgccaacataaggccttgtaggaggctatagttttattttttgaaacagggtctcactctgtcacccagatgggagtgcagaggcacaaacacagttcacttgcagccttaaactcctgagctcaagcaatcttcctgcttcagctcccggagtagctggggctacaggtgtgtgccaccatgaccagctaactaattttttaattgtttttagagacagggtctttacatgttgcccaggctggtctcgaattcttgggctcaagcagtcctcctgtttcagactcccgagtagctgggattataggtgccctgctgggggatagtgtataataatcttgaggcctttggggaggccatttcaagtggcttatacagaggcaatctgaaaagccattttgaaaacaaacttatacagccatcctgaagcctctgtctctggaaaaccatcatatattgtcaacgtaagtatctctgaaggccttttgataaggccgttcattgaagaactctgcattaaagaataatcataaggctatttcatgtggccaagagcagatagttttgtacagccaactcacagtattaggaggccatctttcccagaaggctgtgtccattggccttcaacatgaggtctccaaggccgatttgcaaagtagcagataggccgcctatgaagaccaaacatgaggccaccctgggaggccaggtgacaaagcagacacggggccactgggggaacctggctacaaagccgcacacgtgaggccaccttgagaagctggcttggtaaggctgataggcgccctgtgaggggccgttttataaggtcaccctgaaacaccaatttacaaagcccgtaatctgcattgcagagaacaggtttatagcccatttgaaaccctctgggaggctgttttctaaggccatcaagagacaggtttacaaagctggtacatagagccccagtggaagccagttttatagtagggcaataaatggtctcctgggaggcctttccactggcctttatgagaagccaggatatgaggcccctgaggtcttttggatgctcaagatgagacttctccatgttgctctataagattcatgtaagccacacacgggatgagccaggaggccacccagggaggccagggatgggcccatgtggtgtcttgtgctggcctagtggataagtccatgctggaaattggactgtgaaacgctccaagaaggctgtgaatgaggccaacacaagccttctaggaggctagagatagaacccaccctggcaggctggggctctctgagccctaccataccctgagcttgctagaaagaaagttcattgtgaaccaagaatggaaatgaactcattataagctcagccctgtggatacaaagtccaaagagctcacccttgaaggcaatgagtgttctgggcagacactgccacttactgtgtagtttggcacaaattgcttaacctcgaaatctcagtttattcatctgtaaaactcccatcataggattgcaagggacgtgttaatctatgtcaagcatgcagcattgacatggcgcacaggagagggtgctgagatcagccagaatttaagccctgcttctgcacaaatgattgaccgtaggccttggggcaagtcacttcatttttgtttttttgttttaatttgagtcaggatcttgctctgtcacccaggctggtggcatgatctcggcttactgcaacctttgcccccaggcttaagtgatcccaccacctttaatctcctgagtagctgggaccacaggcatgtaccgccgtgcccaactaatttttgtattttttgtagagacggcgtcttgccatgttggccaggctggtcttgaattcctgagctcaagtgatccaattgcctcggcctcccaaagtgctgggattacaggcgtgagccaccatgccggccttctcgaatacttttcaaagcctggcactcctgagtgactgccatgaggcagactctgcttttaggctctgggaaacgtaggggaatgagctacgttcttgccctggtggagctggcagtgcagtgttggatagacacacgtgtaagcaggtgttttcatacatcctgacgagtactgtaagagaagctcaagggctgcaggaacacagaacactgttggagagtcttggcaggcctcacatagggatatttaagatgggctttaaaggttgggtaggagtttgccaggcagcggaggggtatgggaggcactgcagatgaggacaatacacgttcctttctgaacagacgtttatccagtgcttgctgagtaccaggtgttgcgccaggccctgaagatacagtggtgaccccagacagatgagggccctcccctccagagcttctgcccaacagagaagactgctgttgaaaaatcctcgcagatgagatgcaggaagctgcgggaatgcacaggggatcaggtctgtcctggtgtctaactcttgtttctctccacctccccaggcacgggactgaaccagctggtggtggcccgatggctggagacacccactgccccgcagagcccctggccagagaaggcactttatgggaggccctcagggcgctcctgccgcacagtaaagaagacctgaagttggacctcggggagaaagtggagaggagcgtggtgacattgttgcagcgagccactgagctcttctacgagggcaggagggacgagtgtctgcagagcagcgaggtgatcctggactactcctgggagaagctcaacacgggcacatggcaggacgtagacaaagactggcgccgggtctacgccatcggctgcctcctgaaagccctgtgtctgtgccaggcacctgaggatgccaacactgtggccgcagccctgcgggtctgtgacatgggcctgctgatgggggcagccatcctgggggacatccttcttaaagtcgctgccatcctccagacacacctccctggaaagaggcctgcccgtggctccctcccagagcaaccctgcacaaaggtatgtgggggagattctccccaagcacactagccatccagcaaccctgttgttctagaaattccgagtcatctctcccctggggtgaggcctcgtggcctgcaacccctctggtggaaaacagcattgccattgattttggatttctgtttgtttttggaagcagggtcccgttctgtcgcccaggctggagtgcagtagtgtgatctcggctccttgcagcctccacttcctggactcaagcaatccttctgcctcagcctccttagtagctggaactatgggtgcatggcaccacacccagctaatttttttagtttcttatttattttttattttttgtagagatagggtctcatgtttctcaggctaatctggaactcctggcctaaagcagtcctcctgtcgtggcctcccgaagcactgagattacaggtgtgagccaccgtgctcagcccccattgactttggaaatggaacagctccattcattttctctcttttttttttttttttttgcaaaggcagcgccctttcagcagagaggcagcagagaaacttcgtggttcctgagggaaacagcttaaagcgattgtgtgggtgagagctgcagccagcggcagcccgtttctttcagcttcttggtgggcttgctgaagtctcacccaggcgaggcgatacctccagctgctcctgtctctctgctcctgggtttggatgagatactacaactagctgatgtctgttttggggtcaatctctcccaccccttgggtctatgtgcctgttccaaagagcacccccaggaacagagcatggtttactctgaaggcttcaggtcctggtgccaacacacaggcctcacttgcaacacacccaagcaagtcacttaacctcctttgagcctcggtttccttgtctgtagagtggcagagtactgacccacagaaagaaatgactaagactgtactagacacttggtagtggaattatgggatgtttctgacatttttctaaatgctttgctatgttttccgaatttcctacaatgcatattattattattattatttttgagacggagtctcactctgtcaccccggctggagtgcagtggcgcaatctcagctccctgcaacctctgcctcccaggttcaaatgattctcctgcctcagtctcccaagtagctgggattataggcacccaccaccacgcccggcaatttttgtatttttaatagagacagggtttcaccatgttggccaggcttgtctggacctcaggtgatccacccacctcagcctcctaagtgctgggattacaggcgtgagccacaaattatttttatataagaaaaatgcaagtggttgacactaaacacacaggcatgtaaccaaaataaaagaaaatcaaataaagggagaagaaaatttttccacaaatatgtcagacaatgaatatctctattacgtaaggaatggtacaaatcaatagggaaaaaatcttgagccccaggaggtagaaatccaggaacctgaacagactgttcacaagaaggaaatagatctgttaaacaaatgtgcaggagaatgttcagcctcacctctggttaaaaaaataaaagagagagatgcaaatagcaaaacagcatttcatctttggctgttaagttagcaaacaaggcttcatatgatacccggtgttgccaagggcaccatgtggccaagggcatggggtgtgggttgctcttttgtttcattttttttacagacagggtcttgcccagtcacccacgctggagtgcagtggcacaatcatagctctctgcaggccgggcatggtggctcacgcctataatcccagcactttgggaggctgaggccggcagatcacctgaggtcaagagttcgagaccagcctggcccacatggtgaaacctcatatctactaaaaatacaaaaatttgctgggcgtcctggcacatgcctgtaatcccagctactctgcaggctgaggcaggagaattgtttgaacccgtgaggcagaggttgtagtgagccgagattgtgccaccgcactccagcctgggcaacagagcaagactcggtctcaataaataaataaataaataaaacatagctcactgcagcctcgacctcctaggcttaggtgatttctcctacctcagcttcccgagtggctgggactacaggcatgtaccaccacgccgagctttttaaattttttctagagccagaggtttctctatgttgcccaggctcgtttcaaactcctgggctcaagcagtccttccaccttggtctcccaaagtgctgggattacaggtatgagccagtgtggctggccatttcccagcaggttcacacctgtggacactgaggttctcaagcagcaagtaacttactcaggtcacccagctgggagatggttaaggaaatgatggtgcagccactcctaagaaactgtaaggaccgggtggccatgtggaaactgcttttgataaatgattggaggggagaggcagggctgctgcttcatcattgctgttactcccagtgggtcagagatattttgcgtgtgtgtgtgtgtgtgtgtgtgtgtgtgtgtgtgtgtgtgtgtaagatgggaaaagaataggaatgagaagaccttaagatggtgaagttggagatagtaagttttcctttattgcagaatgtctgtgaaagcagtttataatgaaacaaacatttttgatgaaatggttaagaaaaaaaccaccttgatctcatgaggagcaaatagtaatagtagcagtaataataacaaacgttgtctattgttgttactggtactcttgacagctaagctctcctacccctgacacaggttcctggtggaatacctcaaatgtcgacttcctgaggtggttgctattttgttctgttttgattttaaacagaaagcaagggcggaccatggtttgattccagatgtgaagttagaaaaaacagtcccccggctgcaccgtccgtccctccagcatttcagggagcagtttttggttccagggaggcccgtgatcctgaaaggcgtggctgaccactggccgtgcatgcagaagtggaggtgggtggtcgctgagggaggtgaggtcccttttcccattttagcgttccccagggctccctgaattcctcccgaccatccccagggaaatgcaaccttgtagatgcttcactagcagcccttgactgattgccaaggggttaaaaaagagtgaaaagtaaggtgctctgaatttatgccgcaggttatgggattcttaccttctaccttgctcgccttaagcggttttttaatgagtccctaagtggcagtcctagaatgtttctgttatgcaattttacaggatcctagcaatttcagaccatctcagggccctgaagctaagagcagaaataacccaagagacagcccctctctctctgagggattctgtggtctcttgtgtttgtttctagtcctttctcagaatcatgatggggagatcagatcaggcagctggagcgtggctgtcatgccgcggctctgcatgagtttggaaataaggaggcatctctccaggaaggtagatggagtccgcctgttttgtggtttcgcggagggaatggtacccgctgacacatgtggaggaattctcattgcaggagctctcctcacagcaaggcttcattaagcattttactacgtacctggcactaggacaggtgttgtcatcacccccattctgtaaatggggatcaaggactcgggttcagtaacctgcctcagatcccctggcctgtaactgatgaggcctggaatcagtcccaggctagagggcagagtccaggagactgccacctgccacgctgtccgctatttgttcaaaggtttctcagcttagtgacaaaatgagcaaagaaagaagtgaggaggctgttggcaagcagggaactagagcagcccagccaaccagacttaccggccctgtctgcaaagctgcacagcactgtgtatgagccacacagccttgagcagggagccccacctctccatgccggttcctcatcagtgaagctggggatgacagtccttgtctctgcacgtgaggttttccgaggatgaaaggggaccacatgcaaagcacacttagtactatgcccaacagatattagcagtgacgatgccaatgtgtgtctttctgctagtttggagtatatccaggagatcgctggctgccgaactgtcccagtggaagttggttcgaggtacacagatgaggaatggtcccagaccctcatgacggtcaacgagttcatcagcaaatacatcgtgaatgaggtacatcatggggactgctttcccctagtacttgcaaggcagagagcatagtacatttaggcaaataaccccccatgtgttgtaatgggaggttttggaggagccaggctgtaagtctgtggtcggagggacgaccgcagcgaggaaggcaggctgcttagccagcagacatgagggattcatgtcaggtcctttttaatgggcaggggagtataattcagtgggttttagcctgttccaaaagttggacagctaagtctagagtatgtgtatttaaatttttaatagcagccaggcatggtggctcacacctgtaatcccagcactttgggaggctgaggcaggcggatcacttgaaaccaggagttcaagaccagcctgggaaacatagtgaaaccctgtctctataaaaaatataaaaattagctgggtatagtggtacgtgcctgtaatcccagctactcaagaggctgaggtggggcaaattgcttgagcccaggaggcagaggttgcagtgagccaagatcaggccactgcattccagcttggacaatagaaccaggccctgtcaaaattacgacaggacaggataggacaatttatttttcccaaaagttagatcacttatactttcaccagcaattaacacaagtgtccattttcttacatctttgcctgcactgtttgttgccattttatgaaaatgtttgccaatcagatggatgagatcagtgctttacaaactgggtaccccggtgctggagaggttctttgaagctgccccagggcctctaagggttggagaggaccactcaggatggagtggaagggtgacgggtgctgcagctggggccagctggacagcagcagcaggagggcatctgtcatgactaactgggctttctgtgttgcctctggttttccccggtggattagccaagggacgtcgggtaccttgctcagcaccagctctttgaccaggtaagtctgaggccacgcacctctgcccctcaccgtctcaccttcccctctcctcccctcctgggctcagtgcggctggagcagtgagcgtgagtaggagggaggcagcaggtgaggctaggaaggtgacaggacgtgggtgatgaggagccattttcctaaagtgacaggaaacactggggggtcgccagtgccccgaggattgtaggggctgctattcagagatgaagggagcagctgtcggagcgggtggctggctgggctattgctgtggtgcaaggagaggtgatgctggcaggtggagcagttcaagaccggtgtgaaccaccgagccctggacgtgggtggatgtgtgggggagggagggaagatcggggaagatgcccagattcaggaccccaaaacactaaatagatggagctggggcgcccaggagggacctggctggtgtggtgtctgccaggagtgcccaggaaggcagcccttggcaggattcaaggatagggccaggtgcgtgtcccgaacgtggaagactcgagtcagtcagggtcagggctacagccaggggtgggctggggccgcacctctgtagcctttgcagtggggccctgggatgctgatcagctgctgtatctactgctgaagccaggactgcttctctgtctcgatgggggacccagggccagtaggggctgtgccaggagccttcatgccgacattaaaggacgctggcggtttctcttccccaggcctccctattaggacctgtgcatcctgcgtcctgtccatgtcacttgctaagtgaaggaaagggggattctaattgatcaggtccctactgtgtgatcccgagacccacctttctcctgaccctggtcatcctgggggcatggcctcagtgtgggctggggaccctggaagccatggttaaccttggctccctgtcctggagcagctgtttcatactttgtaggacaggaggagttatatttaggagtagaaggccaagttcacagtgactttcaagatgagccaggacttgaaagatgtttcgggtaatggagggccgcctgggtgtttaccttgggtcccagagctgagtgtctaccatgctgtggagaggaccctggagaagtcccagcagcccatgcccaggtgttatcatgccgtgtggcaaggacagtgttctagaaccttctctacctacaggacgctcagggactcctaccaaattcttgtcccagaacctcttattgacttttctcccagggaccccgtgttctagaagattttggccatcagtttaagcctgcctcagttattagtcacatctcgggagcactgattcccttcgggtctctgcatcctcggccagtgattctgatgacatgatctggtcagccaatcacctttcagaaatcctgatgatgtcatcagggaccaatcatagtttctgctcagattccacagggccagttctggtcaaaagcagcagcgtcgggttacctttgggaggaacccctcacagccctgggagggacctcagcttgcgaacttgtacttcagtcctaagcagcaggcgcggctgcgtttctgcacagctgatttgagacaggttcttaaaggtctgaatagcagtgtctgggaccaagctccctgcagggagaacattccagcttttcctggtacacactggtttctgagccagcagcctgaagttaccgtcactgctcccgaaggaatggtagtgtccacctgcaggtgccttcaggctgcggagcagtgactcttaaaaagccctgtgtccctctggcaaccctgttttcatgcctctcaagcttgaaaaatgccgccaggtccatccagggtcccgtgaagaaccctggggttctcggtggcctggggggtgtgggctggtggcctgctctggtgggttcaaccccggaggtaactgaggtgcctgctaagggtctggacaggaagtggacttagagtgagtgtgttttcactctgagaccctggctttgtgtaaaggaggccagggccatgtgcagtggctcatacctgtagtcccagcactttgggagaccaagcaggaccagcctggacaacatagcaagaccccatctctacaaaaataaaattagccaggcacggtggcatgctcctgtggtcccagcaatttgggaggctgaggcaggaggatcgcttaagctctgcaggttgaggctacagtgagccatgatggtaccactgcactccggactgggtgacagaacaagactgtctttgaaaaaaaaaattacaataaataaataaaggaggccaggccactgcggccctgccccaccgtgaacatccaagatcgcttgatgtgtggcatataactctgtcagaggccatggggagccgcgccacccttactgcatcatataaagctcagagcacagacccaggcccacacctgcctttctcgtcaggcagtttctcttctctgcccagcctgtttctgccaggtatggcaacaaatcctctgtgcctaccctggcttttaaaactaggacggcaagggccgggtgcggtggctcacgcctgtaatcccagtactttgggaggccgaggcgggtggatcaattaagtctaggattttgagagcagcctatgcaacatggcgaaaccctgtctctacaaaaacaaaaattaaaaaaaaattagccgggtgtggtgcatgcttgtagtcccagctagtaaggaggctgaggtggggggatcacttgagcccaggaggcagaggctgcagtgagctgagatcacgccactgcactccagcctgagaaacagagccagaccctgtctcaaacacacacacacataatggatataggtatgtgtttctgactcttcgttggcctccgggctgcggtgtccccagccggatccccacatctcatgtctgctctgccgcccacagatcccggagttgaagcaggacatcagcatccccgactactgcagcctgggcgatggggaggaggaggaaatcaccatcaatgcctggtttggtccccagggaaccatctccccactacatcaggatccccagcaaaacttcctagtgcaggttggagctgcagctggaatagtggccttctaactcctcctggcccagacacctggccggccacattctctgcctttaaacaccgggctcttaaaaagaaacaagaagcactgaaggggatgaggacaaaaatataaagcaaacccacaaacggccccaggcccaggaaggcctctgcagtcggtgcttccagaagcggctcctcctgcatgtgctcctcccaagatccctcacaggggagccctcgggagagggagcgagtgctggtgtgggtgcccggtgcctctgcccctccccgcctgctacccatgcgatccagaccagcttccaaataggaggtggcaggttgggggaggagttttctcagtcactgggaggtttttttcctgaggcccagtcagaggagcagatggatttgctgcaaggggaggcacctctgtctactgctgtaagaccaccctggttttcgcaggcaaagagaggtttagtaaaggagaacgttctcctaccccagcagaccagtccagagaggcagcccaggagtgggctaagagctgggcttcgggagccagcgtgcctggcgcagacagcagccctgccacacctcagctgtgtgagcttgggcagctcatttaatctctctgtgcttcagtttcctcacctgcaaaatgagagtgaagataaaccacctcagagaggattaaaccagttaacacacataaagcacttaagcagtgcctggcacagacaagcgcctaataattgtgggctccaaaaatgaagttatttttcaaaatgtatttggaagaaaaacataccttaggccaagtttggtagttcacacctataatcccagcactttgggagaccgagtcaggaggatcacttgaggccaggagttcaagaccagcctgggcaacatattaaaacctaatctctaccaaaaataaaaatacaaaaatcagctgggtgtggtggggcatacctgtagtcccaactactggggaggctggggcaggaggatctctggaggccaggaggtcgagactgcagtgagccatgatcgtaccactgcactccagcctggatgaccgagtgagaccctgtctctaaaaaataaaaaagaaagaaaaacatacacgtggaaccataagcatgtgtgtggtggggaagggcaggctgggcccagggagcagcatgtggaagggcacagaggccagagtgggcttggggcagcagtggagtgaggccaccagctgactgtcagggtctctctccccaggtgatggggaggaagtacatccggctgtattccccgcaggagtcaggggctctgtaccctcatgacacgcaccttctccataacacgagccaggtgggcactgggggtctggggtgacgttgcaggttctccccactgcccctggagatgatgacgtcctttgctttcttcaggttgacgtggagaatcccgacctggaaaagttccccaagtttgccaaggccccattcctgtcctgcatcctgtctcctggagagatcctgttcatcccggtgaaatactggcattacgtgcgggctctggatttgagcttctcggtcagcttctggtggtcgtagccaggataggagctgaaagggcctgacatgcagacagcattcatctgttcactaatttcctgggtcctggaatctatagagacaagcaggactgaacctgtgtcctgaagagccttcactgcccagtggcagccctggggggctgagctccagcactggacaggcacagagcaggggctgcccaggaaggagcacactccaggccaggggtgcatggcagaggaaggtggggagagcccagaaggacattgcagacagacagcctgcatggggactctggcatcagaaagccgaatgtttttgggaaacgggtgggtcacacaggcaggggtgaaacatgggctctgaggttggctacctgattcaaacccggccgcgctgtgcacctgctgggtgacttggccaggatcccccacttcgctgtgcccatatggaaaagagggcaaggccagtcctcactgccgagggccgagaaggcggtgccgagcccctgctgctgcatgaaccttagccgctgtcactgatcccaattactctgatccttttgcccttccttcccataacggcctgctggacgccacagcctgaatactggagagagctgggcattgcccaggtcacaggagagagtccgtagagacctgcgcaggagccgggacccctgctgagcagtgggagctttctgtcatccccatggctcaaggataacctacctgcctgcagagaagtgcgaaggtcttgctggatgacttttcacccgcactcacccaggagcaggctcccaagtgaagaaaccaccgaaccatcaccagctcctagaagcctccctcctaccaccttctagtcaccatcccccagaagtaatgactctcaaacctgggggatttgaggccagggggagagccaggctctatgctttctgtaattgtgtctcgtttgtgtgcacgcaggtttgttttatgttttggccattaagattttccccagccctctgttttttgttttttaaactaaatagagatgggatcttgctatgttgcccaggctggtcttgaacttctgggcttaagcaatcctcccaccttggcctcccaaagtgctggggttacaggtgtgagccacatgccagccttggcttctttcttccccgcttctaagataggcctggggaaaagagccctgagggttgagctgccatcctgccagcatcctgccactggctcagctgcttgtcttttagccaaaaatcaagcagccccaggaaagattctggttggccaggaggtagctaccctggggtaactagaagggggatgggaaagtggctgtgggcagctgaactccagctcctgatgccctctacccaggccaaggaatttgactttatcgtgtaggtcctggggttctcagcctttgagcagacacagcagaatctgcattctcgaaagctggctgttggcagggagaggccgtgatactcatcctgggagtgggctgccgaggggccatgggcgtgctggggagtgacaaacacaagagctatctggaagctgagtccacttggctccgtgggcagctgtttgcaaggacattgtttattccctgccatggttaatagtgaattacctaatctttcacaggaagaatttacaccagatgtcaacacccctgaaagtagcgaggcataaaacagggacgccctcatgactaggttcgccattagtgaggaggggtggcggcccggccacagtgggctgtgactcctggcccgcctgtgtaactcaaaccccttccccagctgaaggacaggtggactgtggccccagctcccagtgcctagccgctccagctggcaagccccacggcccatctgtagtgtagcgtgacagaaagctgggcacgggaggccacgttcattaacgtgtggtatcctggccaggtggcttcaagcagatgtcccttgtcagatgaggaatgggaaaaggggaaatgtcctgccctgtgggtgaggacacgcagcatctggaactcctcatgagggttttgagtgagtgctagtgtgcgttgtgggacgttcatgtcggtgttatcatgcaggggttggaggcaagagagacaagcagcaggagggctggtgtccccagtggccaagtgcccagaggcttcctgagtccccagccaggactgactcgagctcaaagaatgaacagccagaaccacaggacaactgggacagtccggagctgccccggcccctcctgcaggcattatttgctagttggctttttgccttctggcgtccatcttcccgtcttccagaacggcaagctgactgcattctggagaatgacctctgccccagggatgcggtcctggaaggtctgtacatcagctcctccctggaccggcatcttgagggcgtgtcgggaggagctcagacaggctggagccgaccccctgtggcagcagcgcccgcagtgacagaattgtcttgacatccatgacccttattccaaggtctcccattctagactggtcctgccttcctgtcatttctgcaagccacctcatacgtttccaaaaaacccctctttaggtgaggccggccggggctggcagtggctgaacgtactgggcttaccaatgggcgtgtctctgcccactgacgaagggctgggctgggtccccggctgcctcactatgggaaggtgggcttgagggctgaggagcccagacctggttctgggagggtgagcctcccaccagcaggggtcattggttcactgagccttggatgcctgctccaccctgggtttatggaggtgaacaaagtggggtggtcctgcctgcagcgggggaggccagccaccaattcagtgtccaagttcactccctgctgcccctgaggctactgaagatgtgatcgcaccttcgatatgcttagggaaaggcccctgctccctcagccacgtggcctgagagggacagtcccacccctctctccgaggtgggtctaattttccaatgccagctggataatcccatccccacctcacaggtgtccacgtgggagctgtgggccatgaggatgcttgcaaggatgtgggagccactaagtgagagccaccctcttcctcctgatcccaggcatgatgcgcgaggcccagaggcatggcagctattttgctaccatgaagaaggcagctggatttctaggaaaccacctcgtaggccccaagcatgcagccagcccagtgaaagcacagtagacacagaaatatggctgtgtggtgaccttgctggagcctctagaccaggcatctcctcaagacccctgtggccaagtccgtccttgtttcagccagtctgagttggcttttctgtcatgactgaagcatcctgactgatgctggggttcaagagagggatgaagatggggacttaacaagtgtgaggatggaggaagtgcagggagcgaggggctgaccagtgccaaagggcgagcgggtgctagccaggaaacaaagccagacaccagaggggagggcgcgcaggcccagggcgctctgtgtagaggctccggagctgacgaaggaagcgctgcaccctgagcagtgggtggggggaggcggtggcagatgagcaggagcctcaccaggggtcacagccctgctgcagcagtgggggcatccaggggtcttctgcagggagcacagaggcagagtgtgggccggggctggagctcagcctgaggcagcagtggcagggctagagggctattggcagctgggctggacaggatctggtgacaatgggatgcaggagggtcagggagaggaagcactgaggctgactcccagtcccggctgggacagctggatggcagggctgccgggcacccacagggagcagagcgtccagggagggagagcacgcatcccgcccaaacgcccagcctcagcccattcaggccagtggcaccttgggccaggggagagtccagactggggagctggggaggccaaggctcacacatccaggttcgggccagcccagtcctgctgggacagctggccaccgctgggactggaggcaaggctgccctgggcaaggacagtgagctgttctgagtcattgctgggggctcttgctggcttcacctgctggagcccaaacccagggggtctgagtgacgaccgaactccaggaaaggcaaggccccaacacggagcctcacacacgggctcgagaacacagacgggctgcagcaacttcccaggatggtttattccaaagctgtggacggtgaacattaagacgaaagaggtgactcgcgtggaacctgaaacacggacgcctttcttccaagaagggctgtggcgatcaggccactcaaggcagccagcccctcagcagggcacgatggctaatgctgcctggaccgcagggactttttgttcgatttcaagacaccagactccctctccttctcagggtcgaagacttctgtagacagaaaaggcaggaaagacacagtgaatggaggggctggcagcacaggggcaccagctggagccagcagctacgtctcctgtgccaaggactgtcctaggtctacaccatccttcactgctaaccctccccagcccgtgaggaaggcagagttagccccagttcagagaggaacaaactgagggagctgtggacatagctttcacgtccccctcctgagagggctgccagagagagagccttgtctagacaaaatgctcatacacgttggaatttcagctgggttctagaaagtcctctggagcggtgcacgtagctcagcctttacttcctgcagtggcttcttctaggattcaagctgctaacacggacccccacacaccctggagcccttcagggccctgtctccaagggcttccctggcaccaggccccacgtcctgctggcccagcccctcccatgagctcctcagggcccacgcacttgggatctcgtggggccagtagtcgttgcagtgggggcagcgcggttcagcattcgactggaagtacttggccacgcagggtaagtgcatcctgatcccacaggtttcgcagctttgaccctgaaacaggaaaggccaatgacggcggagctggtgcacacctccatgttctgcaaacctccggggaagccacaagggaaatgggcagcaggtggcatcgtgttatcttctgggccccagattaatattgaaaataatcccaaacgccttagtgcagtggagtcttttgtttgcttgctgcttgttgcggtgggttttactaaacaattctgaacacatgaacgcagtgacagaagccgagggctcccaaactcctgcactcagatcctgcaggtggcgtgtggacagccacagcttttcagaagcttatttgctaatgtgaatcaaaagctttcaaaaaaaaagtgcactttgtcccagaaactccgcccaaggaaataatcaccaggtgcccaaggatacaggtgtacgaggcccgtaagagcaattgcaattacaaacagctacagctgcaaaacgatagaaactgaaagacacatcaatgtccacgctggttcagcggttgcaaagccctgcaaaccagtgttaagaccactccagaaagcagcaatcgacaagagacactcactacaaaactaccaagatgatgcaggttgcacagaacactcagccttcctgagaaaaataaagtaagcgagggcccttggaccccaacagcagaaccagggaggagggcggcagtgcgtccctgcggggcacagcagggaggcgtcctgacacgtcctgggagatggcctccgccagctcttgtgggaggatgcgccagcagtgcaggagggctgggcccagagccaggattccgggaagtacctgtacagagccccgggagccgagggcccagtgatgagctcccgtgccctgccctgcgggtacctggatgaggaggctgtgacagatattgcagatcttcaccgcgtcggggtacgtctcccggatgtattgctccatctccaggatggcccggccgtgcagggtgaactccccttccttctgcagggacacacaggaggtggccaccctcagccaggccctctccccattcaccacctctcttccctctgtgatcccacagcccagtgctcaggaagacacaagggtctacgcagcttttcaccaaccccagccaacgggcatcagccacatccccctggcagagcctcggcaagggaaactgaggcaaagaccctaaagacatggaggcgtggctccctgacacccgccttttctcagcatctgctgtgccttcagacgtgacttctctgtctgcacggcagcctcgagggaggcagtcacagccctcctgcagatgaggacgctgaggcccacaagggggtcagtctccccagggtgcaaacccaaacacccactgctgccatccgccacccatcccactcccaaaaagcagcatccctggtgcctcccagcacttctgcctcccagcacttctgcctccaactgcagtagggaccctcagagatcacttccagccacatcactttacagatggagctggaaggagtctggagagggcagacaggccccatcacactgtgggcagtggagcctccagtggaagccaggcctcctggttcccatgccagggtgcggtccacccatcatgcatcctgaaatccctgggagagcccggaagcacaagaacaatgcagctccccaggccgaccctactgccaggtcacaggagaaaggcagcactgagggagacccaaggcaggcaaatgacacgggacccaggacatggacccatgcaggctgattccagtttctccacagtcagctcatgcatcggatatgaaccacaccaggagatgacgtcactgacgcctgcaagtcacccgagtgctcaactgccttttctgttattttctaatttttaatttttacaagcaagagctgtcactcccgtttcttttcttttctttttttttttttttttttgagatggagttttgctcttgttgcccagggtggaatgcaatggcacaatcttggctcaatgcaacttccgcatcccgggttcaagcaattctcctgcctcagcctcctgagtagctgggattacaggcatgcgccaccacgcctggctaattttgtatttttagtagagacagggtttcaccatgttagccaggctggtcttgaactcccgacctcaggtgatccgcccacctcggccttccaaagtgctgggattgcaggcgtgagtcaccgcacccagcccactcccgtttctgacaggtagagccccccaccccattcccaccttcatccccacagtgcaatgtggaggggtgtgcttgcgtaatctgggctcacagtgcgttcgctctggaacaccagtagaggagctgggtgagcacaggaaggaaggcagggcagaagcgtggggttggggcatggacagccgctgcgggaacagtggagggaggccggggcaccaggtgcttgtgccctgcaccgcagctgttgctggtgcacaggggctttgtgtcatccaagtgctgtgggcaatgggaggatgtgaccagcccccaggctgtcctcggtcctcagtcctatggctgttaccttcccccaaagctcccaaatccatcatggcaccccacctccctggccaccgccctcttccagcctcccctccagatccatcacggcaccccacctccttggcccccaccctcttccaccctcccctccagatccatcacagcaccccacatccccagccaccaccctcttccaccctcccctccagatccatcatggtaccccacctctccagcccccaccctcttccaccctcccctccagatccatcacagcaccccacatccccagccaccaccctcttccaccctcccctccagatccatcatggtactccacctctccagccctcaccctcttccaccctcccctccagatccatcatggcaccccacacccccaaccaccgccctcttccgccctcccctccagatgcatcatggtaccccacatccccggccaccgccctcttccaccctcccctacagatccatcatggcaacccacctccccggcctccaccctcttccaccctcccctgctcctgctgctctctgagcccactctcctccagcaacgcactcgctaccgaacaagcctggccctgtcactcccaactcacccccaccccagggcttcccaccacccttaggtccaagagccaagcccctaatacgcgtatctcccgggctgccctccgtctgctcgcctcgcaatctttgtgctcagatggccctggccttagcttcttgagtgcacctgctggccacagggccactgccgggctgatgatcctcccaccccaggctccaggcaactcccacacagccttcagctcaagtgtcacttcctcagcagctgagggccggttcctctgggacagctgtcataaagccatgtttcctttccatctgtaccaggactgcagtgagatgaccgtctcactgatctcgggctccccctccagaccatggccccatgggagcggccaccagctctggctgtgctcactcctgtgtccgcagcacctgctgtggggcccagcacttggcaggcctgtgataaacacccacgggaagatgaagtagaccttgcactgatcccaaaggaatgcctgacactaagcaagttcaagctcagactgaggcaggagctgcatttattttttatttatttatttgagacagagtttcgctcttgttgcccaggctagatcatgcaatggcacgatctcagctcactgcaacctctgcttccagggttcaagcgattcttctgcctcagcttcccgagtacctgggattacagatgcccgccaccacacccagctaacttttttatatttttagtagagacagggtttcaccatatcggccaggctggtctcaaactcctgacttcaagtgatctacccgccttggcctcccaaaatgctggaattacaggtttgagccactgcacccagccaagctgcatttactgaacacctgctatgtgcctgaaactgcacccaaggctcaccattcatgacccactcagtcctctgagggcccatcaggggaggggcaggagggatgccctagccctcaaagacgacgacagcccaggtgatctcccaggcgcctcgccacaacacttggaagtcaggacctcgtgtagggagcagtcctggggtgtatggaggtgcgccgatcagcagacgcccagctcccatgagccgcgcttgctctcagaggcctccccgctgaccccaaccacctaccacccctgggccttctcctggacggacagctgcctcagcacctccatgccgggccagtctcacacaggactggctgtccaggagtgacgtgtccttggggtgatatacccacctggaagggccttgtcagtgggcccctggctatttctgtgggaagccctgtgtctgagaggccaaggatcagacactgacatgtggtctctctgatcgaggtgctgccctaggaagacctgtcctgggtaagtgagcacccgccccggttctcagtgattcctccagagtgccgcagacctcaaggcaacccttaccaggccatgtaggtcagagagcactggaccctcacagaaaacacctggagctggcaatgtccccatcctgcagatgaggaaacagtctccgcaacgagaagctgctcaccacaggcagcggaggaacctggaggagtctcaccacacagcccctgccacattagcttcgttccttcgtcctcctgagggccccagcaggccaggcagtcaacaagaagcctctctagggctactgcccagcgccagtgctgagggccccctgctacttctgcagcgctcctgcaggtggcagctcccggatcctctgtccaccctccctcgagctcagaggcgccctgcagaaggtggtgccagcactgccaccgaactgagaaaggcacagagtacaagcgcctgcagccacagctcaccgccacagactccagggcggggcctctcctatccaccaccgccctctccagacaccaagggcagacaaagggcaagtcaaaccataaagctgggggcacgccctgcaagccatgcacaatggtggcagcatgtgctaggcatggtgctcttgggtgcaaagcagggtgcaaagtgttgtgtactgggatgttggggcactcggctctagggtctgggataacaggtgacttcagtgggtttctttatgcatctcaacatgttctaatcctcctgtaatgagcagatatttcctgtaacattttttgtaagttttaaatgctgttcctctgcaacctcatccacctgtccagtcatccattcagcaagcatttattgagcagttgaggtgccaggcactacattctgcaatggggaccagccatgaagaggtcataacccctacccttaaaaaacttggcctgtggccgggcacgctggctcacgcctgtcatcccagcactttgggaggctgaggcaggcggatcacctgaggtcaggagttcgagaccagcctggtcaacatggaggaaccccgtctctactaaaaatagaaaaattagccgggtgtgatggcgcatgcttgtgattccagctacttgggaggctgaggcaggagaatcgcttgaatccgggaggttgaggttgcggtgagccaagattgcaccattgcactccagcctgggcaacaagagcaaaactccatcttaaaaaaaaaaaaaaaattggcctgaagaggggctgcaccacaagcgagaatggtcagttataacctgagtagccctagaacattc

SEQ ID NO: 294 - DNA, 646452 bp, Homo sapiens
attaacagggcacttggaggtttcaaaattgtgaaaggcatgtttcttacatgggcacaattgctgagtctttgggataaggaactccattagacatgacagatggaatccaggctcagggcttacctcagaccagcagtgcaaccagatgttcagagtcttccatatgcagctgtttggagccacagctccacctgtgagggcccccttcccctccctcagacaccccacatcttcacagtcttctgatagacgtaccatgtaacgacacagtcacagtcagctttcaccttactttaccctgtgccacctcccaccaccttcagcttcccccacctgatgcataaaactcttaagtagagatggcaggttttaaagcttgaggtttggggagtcagagcccattgtacaagggcagggatggctgacttgaaagctagtgtatcacagttcttcctgccttgtccttggcagacatcactaattgatggcaccattctttccccatccatcctgtaagtagccgcataatcttcaacacaaagctctggacagtcactgccccttggttagagctggaacttgagatgaaacatagtttccattgctgaccaaagtcccataaggtgtctaagtggctgacaaatgaatgatctgagaggagttgaggttcttcctgaatgcttgttatggagaacccatcctgactcttgtggtaaataagggatgtggaacaaagtggggaatgaatagcattttctcatgatatagtgatagaactccatctgccagccacttgaacaggtggataagtcgggtgaattttttactgtgacctgtgggttctctgaagaccatttcacattctagaccttatgagtagggggtagagaaggaaattgctgccatggtcctgagggagcacctcctttttcagaaaagatttgagccactactttagtagcagcttcaatatttaaatgctttgaaaattaccagagtaacaagtgcttatagtaaaaaaattataacaacataaaattttacaaaacacaattctctacctttcttcattcttcagggataactactgttaatagtttggtatatgtatatcctactagaactcttctaggcatagtgaaatacatattgatagtgtgtatgtatatatttatatgtctattttcacaaaaagtgggataatacaaattgtttccaattatttcgcaaatcatatcctttcattcaataatagatcatggaaccctttcatgttactacatataaaactgcttgctcttgttaatggtttctaagtataatgtaggctgtgtcatagtttatcttattagttccttattgtgggacatttaggttttttctttcctttttttttctgttatagaatacactgcaatgtgtgtataagtacagatatttcagtaggtgagaatcttagaagaattgctaggttgaaggctacatgctttagaaatgttgattgtactgccaaattgacttataagaatattatatcaatttagtctcctactaggttggttgttttgttgtgtgtgtgtgtgtgtgtgtgtgtgtgtgtgtgtgtgtgtgtgtttttgctgggggaaatcttgtaggtaaaatgtggcatgctgttattgcttacttaacatttccctgatcattagtaatggtcagcatctttttactttttatcagtcatttatatttccttatctgtgggttgcctgttcataatctttacttatttttataccatgttgttaactttttcttaatggtttctaggaactttttgtaaattagagatattaaccctttgtataatttattgttgcaaacatggcaaatatttacttcctgcattatcttttaacattcatgtttttgcaactttatctactattttattctctgaggacttaaaatatatgaaaatataatgtactcacagtgttcaaaaattagtacaaaataaataggtctttatatgacccctatacctgtctaccaagccacttttcccataggtaaccatcagtattagtttctcgggaaccctcccagtatctctttttgtaaatataagcaaatcagaattcatacctaagttatccctttctgatcaacagcaggtgaatactaactatcctgctctatgccttgcgtttttaacccaacagtatgtcttgaagatcttttcatatcaattcacagaaagcctcatcattctttattcatagctgcatagtgtttctttgtgaaagtatactgtcattcagtgggcatcagattttttttgcttctgtatgctctaaaagaatattgaaacctttatgccccttcatgcattttagtggatacctaaacatttttttaccatgagtctaaatggttgcaaataataaattttctagcatgttgcatattataataggctttaaacgtattttcttcaaaatcttggagctacagatttatatgaattgggaaaggcaaatctgattgtcaaagcaagtagccaaattagacatacttacttcctgtcagagaaagtctaatttctttttataattcaagcaagcatgttaattaggcaccctctgtgacaaccccatcttcagaattctaagagtagagaggaagctattaataaatagatgtggttctgagactaaccatgctttttgtcttctagatgaaagaaggcacaatcattttcaacatctccttggcgatctcatcgaatcatggggctttaccttgctctgcatgcaccaatgactctgttttgttacctgttacactgtaacaaaccaccctaaatcttagtgacttagaacatcaatttatcattctcataattgtggggcttaccaggcagttcttctgctccatgtggtgtcttttggggtgctgggatagctggcagctccagggtaggcttcctctggtggctgggagggggctgggactagctgggggtctcaaccagcatctgtagttctcttccacatggcctttccatgtagcttagccttctcacaacaaagcagctagatgccaagaacagttgtatctattattgactccattattttgaaacgtcttttaaagagttaggtgatacagttcaagagtcaaaattcaaaatgtgtaagatgagttacagtaaaatgttgtccttctactactgttgctcagactcctgttctcctttggtgatttgtatatccttcaaaaaaattttaaaaatatgtatataagccaatatactgagttttgtgtcttgcttaggaaaaccatcccaccctaagactataaaaatttttcttcttgaagttttatagttttttttttccccatgggtatcatgatgtgaggccaggattggtggacttttcgggatgccaaataattgttgttcactatgcggatggtccatcaggaacttcgtagtttcttttttcctcagtgccgagggtcatccacatgtgtcacaaggtatagtcaaaacagttttcataattgaatctccagtggaactttccaacctgtgtcagaaagaggagatcagatgagttggggcagctggacattttcatttccctagtgagggaaggagagtgtcacaggaattagaggaatcataagctctaagaatctgccccctcctgaagggcaggtagagaagcctgggaaacttggagtagtgacttgactttaactctggtcccatgaattgagaatttcaatgtgacctgagcttgtttttgttgcaggagaatgcactaacctttatgaagtatccactatgtattaagtgtagtgctttggattttatatgctattttgttttttcctcatgaaaagttcaagttttatgggattagtcttatctccatccaaaagatgaagaaactgagatgtgggaagttattctaaagcctcagccctttcccagtacctcgaaggcttgcaaattaatggtacaaaaggtataaaaaggtttatagaatttatgagactcaattatttttaagaaccataagcagcattcatttgttgaaaagtaaagtgatcttcgcaactagttttttttttctttttgaaaataagagccaaggaagagaatattcaaattggctagtgtgcaagtaatttcattatccagcttgatgtgtatgtagggagccagggcattcaggtgagtcagatattctgatttaacagtgggtggccctgtggaacacacacagattgtatactttccataaaaagaaaaaaaaatacccgagggactaaagcaaaaaagggactaagtagaaaaaaaaatgttgagctctagatatgtgctaaccaaaatttagcatttatttgacaatacaggggtttccttttgatatggttgaacttcacattcattattatcaatcctagtcctatggtatggtgcctgattttactgggcagacctgctgaggggggctatctggaaaagttcctggaggggatggagaagggcatgggatggagagagcaggtagaggttcacaggagggctctgcctgggctgaggagtgaggcttcagctgtggtaactggcaacttagcttcctgattctctgatggtgacctcagggactgagagatgtgaggaacatttaagagaagccaaacctcctggggggtgaacggcctcctgttggccatgaagtaacaccatctcctttgataggcagagaaatggctcttggtggaaatgagatggaggaactgcatgactggctgcgagggaaacagaggaggtaacagtgaactctggattgcagaggcctcatggatcagttctgagagggtctctccaaatatttccagcttttttttttttcaggaagaattcctttgcaatgtaggtgccttggggaaggcagccaaccaggtgttcatgctgagtaggaaatgggaggtcagggcagtgagggaggatggaaggtgcaccagcttctgtgattgacttcatcaggatggcctcacagggacatgcctgtgaagacctagggaagggagtcatggactctgctccctgactgcagatatccacccccaccactgcttacctaaggcctgccctcctctatgccttcctttgacctaggctttatcttttgccaagataggaatatttcctgagggcctaaatattaagctctcatcataaataccttggatgggatgaggttgtcatggtacttttcacaggacctagtggagagggcatggggcccagggtagacgagctttataaggtcctgaaggaggagaggggactggctcttgtgtgggcagtggggggtactggggtgacatgctgtgttagagattcagtgcaacatgggggttctattgactgctgggggaactagaagcccccagagaaggggtagggagggatcaggttttcaccacttaacaaggtggtttagagcccagggcagtgaaaggttgtcttccatgagctgggcatgcctcagccaaggcagagttaaagatcctcagcagaggtcggaggtgagcaagatgaaagctacacaaaagctgaggcaaggaggaataattagcttctgcctttccctcctgctgcctggcctgatatttgaggtgacatttaaagccattgtacagatgtgcagtggaactgtggcagaacgaaggctttctggagcctgtggagagatgaggctgatttctcagcctcctgggtggcagcttctcacccctccatgtggggccctctactgggccttgagaggagagaggcccctctgccttccaggtgagcatactctaatgggggactcagaatctccctccctattggactctcagggtgttgggggaggtggggtacgcactagaattcaagatagtgacacgaagctggtgctgagggtaggagaggagagcacggactgaagcggatggatcaccattgcagaattctctggggagcttgttaaaaatgcaggcctctgggagtgaggccttgttatctgtatggataaccaaccgtctaaggtgattctgctgcccattaaactttgagaacctctgagatagagaatgtgtgaggttagctggaaagggcctcttgggagggtggacttgaatttcagtgtctagatgatacttacttgctgtagatactgtcctcaggtgtggacctaagaagcccgttcacctggggacactaagctgtcatgggagagactggcaggggtccaacccacccttgaaatggtatccctgggaatgtgttgccacgggttccactccaccacttgggcgctaatcgccaaggggacagaagtggtgtgggaggtgactgaggatgctgtctgctggagtgtttgattcatgttacaactgaagcacagcttgcaggtcaaaatggtagccgggtggagcccgcttgttggggcagggtgagggagatcagtatgtctgtggacggtcttcactttggtttgcagataccagcaactatgctacctcctgtattgccttcacttgccagataggtccatgtgtctgaggagttgggccagtgctgctgaggggacagtggccattgtcgtcccaggagatgagtgggaaagatttgggatatggttggatctctcctccctccgtgctgcttgccttctgctctatacacttgtgctggctttatctgattgggaacacagtgttttcaagttggggtgggtgaagagagggagaaagaacagtgccaaggaaagaagaaggaacatcgaagagaaaggaacacatccatgttgtgatatcaaataactgctgaacatccggatgggcatcagccctctggagtggatgggctgttgctggcctggtgtcactgcctgtccctggaaaacatgtctctgtagccagctgggtgggctggaggaaacacgtgaatgggaatagttgtgcttgctttgaccatgatgaaagaaggagccactgtggaagcattgtataagacaaaacaaaaacaacaacaaaaacctactaataaggctgtgtcctggccaatatcctttctaattgcactgcagttaaatggcaatgctgacagtctcttggaacattttattcaacttctggaggggctgcatttcaagtaagacttatgaggctctgtgggagatggagaaatgagcagtggtgggctggggagctccaaggagcccagcctgatgggttgaagccaatcttgagtaaaactccaggctgaatgggttcaccctggggctgacccaatgggcattgcttatgttcttaggtctgtttgcgggggaagtgcttgcacccatattattcttgacagtctttattcccattttctctgcaaatgagactgtgtggaatgttttgcccttgattactggagggaggggaacagagccagcttctttctccagccccaagaatgaggcttgtagcactagcaccattagagcactctctgggactttctgcctcacagtcagatgctcttcccctgcccctctctgtctaggtctcctgccatgatgcgagcctcccgtttcagatttctcccaagttgtgttagaaaaagcctttttggcattcttacttggagatgcactctctctgcagttataagtcaggggccaaagaaaaagatgaaaagcccttagttaataagtggccacatttggaccctccactcaacctgtgcccatggcatgtcagcactgccctggaggggcctccctcagggttcctgttaggaaacagcagtgtttccccaggtcctgccctactgtgagggctcccgtatctcagtgaaacgtgtcacaatttcccagagaatctcttagtgccccagaaactctcagggaggagacagatgggcacctacgagttatctgaccttaaacaagttatttaatcttttggaacatggattttctcttctgtatactggagaaagtgattcccatcctacagaccttgcagggcaaacaggagatgatagttatgaaagtactttgtgaacgaaaaagtactggccacatgtgagcgatggattcttgttactcgtgaagggagaaacaccgggttacttctctctggagggaggaggaggggtttgcattcttgtgttaactacacactggagtcttgtccatttaaggtaataagaaaataatgctaacagagcctgagaggtagcttcttgggtggtgatgtctctgccgagacccaatgctgccgtttaagaagaaaccacaaggcagttggggggcaggggcaggcggtggaggttgtgactctgcttgctttctccctctccctccttgctcctaccccctggacgtgcctcctccccagtctgagttcttcagaaatctgcaccctctctcatcttggaggtataagttccaaggaagagctggtgctgagggagacatgcctccagttgcctgatggagaccaggaggcctgggagaccaccattctgttaggacagtgagaaggcattgctggcatggcctaggctgcacagagctgtgatgaatgtgcagatggctgttgggtagtttttaggcttggagaacaaggtcatcctagacctggggactcctcaggtttcatttcagtgaatagcactcccagtcacctgggtcacaggctggcccactgtaagaggggctgtgattgggcaaggactgggcaccccgtcatgccccaaaggccttagacaatgcccaggggctgaggtctctgcagcttacttttctccttgccttgaaaataacattgtatcagggactcagatgcccttgcatgttcatttgtctagttagtaatcactcgagtaactgcgaagttcagggttctttgagggacacaaagatggagtttatgggcaagtaagggagaagagtcatatacaaaggagaaggtggaatgaaaaaaataaaatataaaggaaggaagatcagggaagtctgcctggattctgtggcatttgagttatttgttggaaaaattaggcggatttggccatgatgaggtggagagtggggagagcatcctattggcaggaagggcaggagcaaagtcctggggatagaaaaccgtgggatgtatgaatgtgtggggaactgagagtctggcaagagggagaggggttgagaggtaagggagaaccttctatctaccagtatctaccaggtgcaacaccagaaacattatattcttcttttgctttgaggctcacaaatactgttctctctggtttacagaggaggaagctgaggcacatggagctgaaaaacttgatccaggccaggcaagtattaagtggcaaccaggatttggacccatgactgtgtgacttcaaagcccatgctgtctctactataacaaaggttccatgaagggacgtagggaaaaaggatctgtggccttttaccagtcatgcaggtcctgcagtcttgggcaaggagagccagtggtccctacagtgaggcagtgaggcagtaacgctcccaggctcctggactggcctcaaagtccaaaatggccgagcttctggcttcccatcccatattctattggaggagccactggcctctggtgtgggaggtatggaggccaggatggcaggagatgctggaaaaaatttaagacatggacttgactgtggattttcattctcaagaccactgcaaacctcgcgtctttgcgaaaacccttcctgactccctcccacgcatctccgacctccccttgggtccaggcaggctcggtctgcacacggcgttgttctgcacttgttcctttgttgctgtgaaaccggctcccggcacagtcagcctctgtgtgggaggactggtggctgtctttgcaggcaggcatttgcttagagcaggctgtgtgcgagcccagcgtcaagtgattccggcctcctcgagtcagcggtggtgggatgaggctctgccgaggggactggctgtgaaggatgagttcagggtgggatgacggaccgcttctgggaccagtggtatctctggtatctccgcttgctccggctgctggatcgaggtatcctgagtgtgtgtatgcttgtatgagagactgagagagataaatacacatagagacataaagagacatgcagaaagacacagcagagaggggaggggggtcaagaagagagagaaggaatgaaacagaggcaagtagcaaacccatggaaagtaaagaaaggctgtttttctggggacatgtatgacccagctgggaatcgggagcacagggtcatttggggagcatctgtataacaggatctcatttcttgctgggtttttcatcaagctcagtactctagtcaaatacaagttaagccctgtcttgcagggctcttgatagaactctctgagaagcagtgcagaaggagaatgattcctgcagtaagaagctgggggcaaacagactcaggctcaagtctcagctctgccactgaccttagcctgatttatgtgacttttctgagcttgtttacccatctataaaatgggcacagtaagacctatgtgctgaggttgctctggagctattatttaattcatacatgtaaaatatataacatcatatatggtgcacacagtaggtgcttagtaaatactgagttcctccctatgcacctcttagcttcacagaactattactacctatcctgaggatagctcccttttttgattatctacagatacagccggtacagaatttgcagttagtggaaagaaaagagaaaatcagttttatttctcaggttaatctgaccttaatacattttatcaaatattaatgcaattaaagtcttctgataatgtgacacaaatccagatgttcttttgtaaggaaaagccactgtgaacttgtttggtaattgattttttaaaatgttgaatattatttttaaaagctttggcttctttaagaggttttggcaagaatgagatcaaactcctgatggaaaagatggccctggggaagccttgctatacagcccaaggtgtattcatctctgtgaggaatagtcttggtgtgccgggagatcaataccaggtggaagcagacagctgcacagagcaggtgaaacagggcccttatcaggggagaaatcaaagatggaggaaaccaaaccagcacacactaaaagcagtttctcactagcaccgagaaacaggccagtgggagcccagacttgagatgagggcgttaagaagggcatcagaacttcacactgatgaagattatagactgggagaagggagaagagaccactagatgtgaatcctccttatctttgtgacctcaggcaagttgcttaacctctctgtatcttctttccttcattcgtaaaaaggggtgatgatgataatggtagtaccaactcagagggttgccgtaggggctaagtgagaaactacaagtgaaatacttatcccagtgcatggcacaaacaaagtactctttaaatggtagttttcattaccaaggcagttaattctcactctccaacaaacatcctgggaaagacaggaacaggtggtatataataaccgggaactaagaaaagtccaattaagaatggttagaggcttagagacaatttatacttacatgaatttaaacaagattcacactaccatatgatgctaattataagaagaaactagatgttaatgtataagctataatactaccaatttatttttatcttttagaaatgcttgaatccatgagtcacaaacttaggctcaagttctggctccattgccttctaagtgcccttgaataaatggctaagggtaaggacttaaaacataaagggtcttgttttctagggctatacttaaccaaattctcagtttgttaatcttaaaaattggaatattaataataatgcctacatcatagaatttgggggaaatttattgtgttagtgcatatacagtgtcaggcgttttggaaatgtcaggttaatgaatttatgggttgatagattaacctgtcaccttggatagcaaaagctggttgcaagaattatgtggtcttccatgcacgtttgatcaccacatatggctgtaatttgaaagtttatgtgtatttctatctatagggttttccttaatgtgaagttttagaccagtagctcttgactgtgtagggtgtctgatttccaggtgtttggaggttgggtgttgattatgttgcccagttctggttaatcagtattaaagtattacacatgtgtgcatacccacatccatattcaaaaagaattttcagttatagcaactttcctcttgtaacgaatgttacctaacattgcatagaaaatggcatgctttaaagtggcatgttaggctgagctagctcattgaaagatgctcaataaatatttgttgaaggaatgaatgagtaaatgaatgaaagatgaacctgcctttctgggcagtgaacagaattcccttagatttgatctttcttaagtgtaacagaatttagctcctttgatctgtttgaagattttatatcattttgccctcatcattgtcgtgccttatgtcatcttgaaagtaacaggcctcaagaaagtaaggaggggataggaaatgagaagtgggaactgatgagtttatcccaggaaattgaaataatggatgagctgtatgctggcctgagtcactcacttggctgtgactggaggataagtgaatctgtgatttgacacacctaggaaaaggcaggaaacattagaacacatcatggagctgaaataaactttacaaagaaataacagcgtaggcttgatgattgcagactaatcttttgtctcccctatcactgttcagctaagggtaaggatttaaaaaataaagggtattgtttctagggctatacttaactatatgcaagaatttatttgacagtgtactaccagcttgttcagacattattttgatgatttattctccttaataatagatgctgtttttgtggtgtttgttactgggcgtttgccaattctgctgattgtattctgtgcttatagacgttgactaaggagatggttgctatggtggggactgtctatcaaaagaaaagagctcatagagataagaagcatgagttgtatataaaagaagtcacattgctttttgttgttgagttttggtgtattcatggggacctgacaagtaaggtaggggtttacgttcctttgtttacatgtaattttttttggtaatgggaagaatgaaagactgctgctctttattcacagagcatcaggcagtgtttcccagcatgtgggaatgtccaccactggtagtacatgagatgattttaggtgatttacagatgtttcttgagcttctcttgctggtcactgcttggcacagtccagaagacaatctgttttccccgatgcctgcttctgttgggctgtccactcctgccccacccattcactgtgggccctccttaatcccacccattcctcagctctctcttcgttcctacctctggtctccctcttctccttctggcatccctgcctgggcctcacactttgccctgccttagtttcttggccccagtatgtctccagcctccctggccctcatgcctattgtctgtcccttgtgttctttcaaggcacagctttatgctacctgctacaagtatccccattccctggcatttctctattatcctctaactaattgcccagcttccatcccttcttatgtctgtgctgggccaccttcgccccacagatcctgtgtctccaatcctggacttgcgcctacctgtcttccttgcctctaatcctgagtgcctttccctttcagccatgatcttcttttttctttttctcctacctttttatgtcaccttgcagtccactaatttcttttataaagaagcataagtaaaaaagagtcaacttaatatcaaggaaacaacagtgtaggaggtatgtggatatggttaaaatagtgacagaagtacaaaaattactgatgtttgtcattatgtcagcatctcacatgttgaacttaagtgatatgctgaattaggcttctaatttcttcttgatgcttttaaaaattgacacataataatcgtacatatttacgggtacacgtgatattttgttacatgcatacaatgtgtaatgatcaattcagggtactaaggctatccatcacctcgaacgtttcttatttatgttaggaacatttcaaatcttctcttctagctattatgaactatacaatatagtgttattaatgattgtcaccccactgtgctatcaaaccctagaacttactctttctgtctatatgtttgtacccattcaccaacctatcattgtactgtttacaccgtaagatgaacttttttagcttccacatatgagtgagaacatgtaatatttgtctttctgtacctggcttatttcacttaacataatgaccttcagttccatctatgttgctgcaaatgacaggatttcctttttataggtgagtagtattccattgtgtatatataacacattttctttatctattcacccattgatagacacttagattgattccatatcctggctattgtgaatagtgctgcagtaaacatgagggtacaggtatcccttgatatactgattgatctcttttcttttggataagtacccagtagtgggattgctggattgtatagtagttctatttttagtttttatgagaaacctccatactgttttccataacaactgtactaatttacattcccaccagcagtgtataagagttcccttttctccacatcctcaccagcatcttttattttttgtctttttgataataaccattgtaattgtggtaagatgatatctcattgtggttttgatagcatttccctggtgattaatgattttgagcattaaaaaaatatacctgttggccatttgtatgtattcttttgagaagagcctattcgggccaggtgcagtggctcatgcctgtaattccagcactttgggaggccaaggcaggtggatcacctgaggtcaggagttcgagaccagcctggccaacatggtgaaactccatctctactaaaaatacaaaaattagctgggcatggcagtgcgcacctgtaatcccagctactcaggaggctgaggcaggagaatcgcttgaactagggaggcagaggtttcagtgagccaagattgtgccactgcactccagcctgggcgatataacgagactcagtctcaaaaaaaaagaaaaagtctattcagatcatttgcccactttttagtgggattatttgggttgttttgttttgttttgtttgctgttacgtgaattccttgtatattctggatatcagtcccatgttggattaacaatttgcaaatattttcttccattctacaggttgtctcttcactctgttgattgtttcccttgctgtgcagaagctttttagtttcaacaagggtgccaagaacatatattgggaaaaggacatccttttcaataagtggtgctgggaaaatgggatatctatattcagaagaatgaaattagacccctatctctcaccctatacaaaaatcagctcaaaatggattaaagacttacgtgtaagaccagaaactatgaaattgctagaagaaaacatagggaaacccttcaggatattagtctaggcaaatattttatggctaagacctcaaaagcacaaacaacaaaaacaaaagtagacaaatgagattatcttcttgggactgtcaacattcctgtagctaccacaaagtgttttggattctggaccagaaaccagctgttctcacctctcaatgtatgctagaatcatctgggaactcttagaaagcgtaatgtccagttcctctgtttcaacacccccacttccacctccagccaattaaattggaatagctggaaagggggctaaacactggcattttaaagacctctgtaggtgattctaatggcagccagagttgagaactgcttgttgtcatcctttaacatggatgtcagagagtaagggcaaaaggaactctgttgcaaaataacaaaatgaacgaaaaacaagtcactacatgggaatagtaaacataggagaacacatagaacattgctaaggaacaaactgtgtaagaacgcaatcttttggatacacctcatgcaactgtctttacaaacttcaaccattttcaatgactttctagataaaccttgactttccttcatattcccagaaaagcaattgacctgtgtcccaggaggttgtttggcctcagcttgctttgggtttattgctctcagttcaggctgctgaggggtttggaggtagggatggtggtctgtcactgtagatgtcaaaaacctttccttccttggttagtataactcatactaggaaggcattaggtgggcattgtccatattctgccagaattagagaaagaaaaatcgttttctgccttcaggataaatgggaggtaaggagaataactgttttcaaggcttcatggtgttgggctctactttgaccaggaatctacttgggtttgtcactaaagttcacctctccctgtctggccattctttgttgtctcaactttcaaatctcccaaacattccaagtcaaggattgattctgctcaggtgcaagaagtcaagaggcagctggacctcatggtcttggttgtcagggtaccctgatctttgtgctttccttttcctcgctctcatcctcaccatgcctgcagcctttttctggctcctcatcttctatgtctgacagataccctgtctttgacttgctctgtcattggcttgcctgctgctcagctatctgcacagctctggcccctaaccaggtcagacttggtatctgtgcttaggccatctgcttgtaactggtccctagcctgccatggactctggatacccactgtggtctggcttaccctgttcttgttaactattgcatatgtgtgcccagcatgatgtgtgggttctttgtgccaacctttatgacttgttccttctttcttatattcagtgggaaaaagaagagaaaagcacgcagcatgtgtatgaaaagcacattgggtgattctgctgtgctagggtttttctaattagaggagtttgttttaatcaccttctcatttgagccaaatattcaggtaatacataaagaagttactttaaattggcttttatagtcatctatgtatatatacctattagagttatttaattggcttttggcacaagatcactttactaaagggaccaggcctcttgtctaataaagagtttgaacacacacccgtttgaaacaccatcacagaacaattccctgttgttctataccagagcctcaccagcaaccttcatattttcttgtgctttctcttgaaatgccccaaacctcctcttcttatagttaatccacattcttttccctcccaacctcttagccctgatgtcctccagaaaaatatcccctgactgtacctggttccgttcagagactcgtggtcactaggtgcatggctagtgttctgtaattcacaatgtgctcctgtgggtagtaataatacatacctcaggaggttgttgtgagccttgaaggagctaatatgtgtgacccgtgtttggtaccagtaagtactcagtaagtatgtgcttgttttctgaatttttgcagctttaggaatcttagtttcttgtcagggataatttccctccattaagagtggagtttccctgagggcaagcccttgtccccactatcctttgtattttcacctagatacctaattcaaagttatatcctaataggaaacctaataaataactttggctaacagagtatctgaactctccagggaaccattgattatcacagcattgttaaggaggaaaaagataaatgtaattatttgataattccaaatatcttacccctttgtttctcattatgcctttctgagatagatcatatcacttcccgtttcacagataggaaacaggctcgtagagattaagtgcttggttaaagtcagagagctgctaagggaaaagtcaagatccaggaccccggactcctgtctaggatgggttgccccctctacctgctgccatacagatgggaagagctccatctgtctgtctctccagcatgcatgttaaactgggagcccagccaccttccctgtcagcaggtagtagagcgtatcattgggatgtcttgtctgtggtgtgaactacccaggcaagatgtatctaggccaagtcctaggggaaggacactgatagctgctttgtgaggtcccggtgtggtgtttccatccagtggggtggagattactgtgatgtgagaacagtaaagcagcacttgcccagatatggcatgtcctcccagggcctgttctgtggtggcatactcagtggttgctgagaaccaaggggcagtgggacagctgtgtccctggatattcagaaggctagttggatccccagtataagtgatgggtttgctcttcaccttgtggacagaggtggcttgttatcaaagaaaacaccaaagcaattagtatcgttgttgttattagtagcagtagtaatagactctactaagggtccaggtagagcagggagtgattagggttaggtgtaagctcgctgcccttagggagcttacaattcaaactcctgaaagatcaagaatcaacagtaaggctgggcgcagtgactcatacctgtaatcctagcactttgggaggccgaggtggacagattgcctgagctcaggagttggagactagcttgggcaacatggtaaaaccccatctctactaaaatacaaaaaattagccgggtgtgacggcatacaactatagtcccagctactcaggaggctgaggcaggagaattgcttgaacctgagaggtggaggttgcagtgagctgagatcacgctactgcactctagcctgggtggcagagcgagactccatctccaagaaaagagagagagaaaaaaaaagaatcaacagtaacatctctgcatctctgttggccctctttcaagtgatacttataagggggagctcttctagctctaatgtttcatggttctgtgtggacaatacctacaaaatatttacctataatacctataatatatctttgtgatgccgcaggtactctttcatgttaagttgctagatgagtgctatgaatttacaagagagaaataattgggtctgaatgaaagaagaaatgttcatgtattcaacaaatgtcttctaaggtcctactatgtgctttgctctacccaaggctctggaaatacaatgctaaagaagacagtcttcttgtcttcgtgaagtgttatggttcaatgggggaagtagacaataacaaataacacaatagataatgcaatgacaggataaaaaggagagaacagggttaagctttagtagccctgaattacgaggatggaaatcagcaaatacagggtgtgcttggggaatgaagactaaatcagactgcctggagcatctgtgtgataagagttaaggttggagggacagattggggctaccttgtgaagattcttgcattggcatgttgggttaagggcaaatggttccagagttgtagcattcaattagaaaaggtattgagcagtaccaaggtaccagccagtagactaagtactactgggttcatatggtttaaggagagactcagatgtgtaaaaaggaccttacaacaaaactggtaagtgcaattacctaggcttgcataggatcacagaggacagaacagctaattgcctagaggggttggagaagtaagtcttctcggaatatctgatagttcagcttggggtgcaggattaataggagtttgtttggtggagaaggtggggccaaacattctagacagtaaagcatgggcagaagcacaaagtgggttgaaggggatggatagctaaagaaaagggggcaggtcagtgtatcaggaaggtaaggcacacaagagggagcaagggtcatggggaacttctgagcataagagcctggtgctggtcatgttctttaaagatgaatctgaatgcataaagacaactggagaaaaagaaaatggatgtgaaggaagcattggcctatggagaggaaggaagagaaggatgtaaaagataatgtcagagaaagcaacagggatttcttactcttcatattaaagggtcattgaagctttcatgcttaggtttgacttgaggagtggcaactgttacactaaaagtctgaaaagatgagtaggacttggggtgttggtaaagggatttagaaactttgagttttagatgattacaagatgcctgattcattcatgcattaaagtaggtttgtgtttctagggggaagtcagggcaggagatgaatattttgagtcatttgccaagaagtgatggtgaaactggtattagctcaaggaagacagcatagagaaaagtgagagtagtgtagactgtttttcgaaagtattgacaagggagacaggataagagagatacgaagagtattccttaagggtaggaggagagccaggacataataatttcgtgggaatagaggagaaggagagttagggagctccatgtgcgtggagaggaggcaatgttgagggctttggtgacagaaggcattggtgactacttacagcattgtttcagcacctcaatgagaagaaaccagattgcagtgggaggaggtggtgaagatgaggtagcagcaagcacatattgtttgtttgagaaatatgtcagaaaatgaaaggtaaaaatagaatggtggttggtgggacattagggtcaagtgatgattttgttcaaggaggaaggcctgaatgtgtttgaggctggggtaagggaccagtgatagaagtttaaagatgacaaacagaaatgaatttatttatccattcaataaatattcattgagcactgacagtattccagggacagtgctatttgctggaatataacatgaataaggcatgaaatcttcatggagtttacattctagtgactaaggcagacaatacacaagtcaaagtaacagttgaatttgcaataacagcttgtgataagtgctctaaagtgaagcagtgacctggaggaggtaggaatggattgaacaaagagtgcagatggaagtggtagactggaggagggggaacacttcctctgttgtaaggaaggaagaaagagtgcttagaaaatgatttttaagtagaaaaagtgaaaaatgaggaaatgcagttcagatggtcctgatattcttaaaaaagaacaggcagtgtcatgagctcagactggagaggtggaatagttcaagaccttggataggtgcttactgcttcattcaaacctccgatgaccctgtgatgttgtgggagggtgttattctcattgtatacatgagaaaactgaggggactgagagaggacccatgactgaaaagtatagcagcaagggagaggagcctcacctggatactcttatcatcaaactcacctccaagggccagctcagagggtactgtcagtgcaatcaagacatcagttcctcctcccttctatataaagccttgtgctgggccttggagaagactgtggagaggagatgacacctgtacctggaaaataagaaagatgaagttggaagagataagatgaggaaactgaggctcaaagaaatgattttactccccaaagtcatacaattatcggctgagcctggatgtgaagccagaataaaaaactccaaattgagacctctttccattatattccccgatatatacccctttactgtgctcagtagccttgatgtagtcattgtatgtggacagaatggagaattcatgtgtttgagggttatctggtttgggttcagcttttaaaggctccaggcaaaatttctaagaagctccaaaagcaggattgcatttctctatccttccttgttatcactatgaaaaataagctgagtggggttgcaagtggcacttcttggttctcctgggctgttgcagaattgtgctctaaagaacccagaggagtatcttccttataaacccaggataggaggaataattggcatggggcttttaatctactttcatgctaaatgaaatctgttagatgggataatgagctccatattttatagactattttaagcttgtctcaaaataaagtacagggctaggggtggaggaaggacgttaagtcttagagacaaaatgccatggcttactcatcagtgttttcattttaatgatcccaaccccagtacaagtccctcagtgatagtgtaatggaaaccacattttttttttcctgttggaagtttcaggatgaacacagccaaatgcttcaagacataattaagactacaatctcccatcctcggtaatatacagacctttcacccagggggctcagctagagacaatgtggttggaacgcagttgaaattatagagacttttccccaccaacctggccccctagagcttcttttctaggccttgtcctccctgtccttaactcccttctccttaactgctgcctcatgcctgggaaggaataaataagtaagaaccctggtgttgactctttccctgccacagggagagaatcccagacaaatgctgctgtgtctggaggaggctggactgcgctggcagaggcagcacatacatagcaggaagggcagccaagagagcttgccaacagatgtggggtgctgggagggaggaggtagacagtgtcatcattaggtatggaaggaggtagggaatgttctgtacattacaggctggaaaatccagctcataggaaggtcttgaggacttaagagagcaagacagctccttctgtgtttggacagaatgggtctcctttgctttggcaagctttctgaacctacacagatcagagttaacaagcttggcatgaccaatctgattatgtggcttctccgcccctcactctgttaatcacatcttgaacacctggaatatataagataatgggagcccacagtacatatatgtgtatactgtctgtttggccaattgcagtccagtcttatccttgcagggaaggctccacttagcacaaggaacaaaggaaggattaggatatttgccccttgctaccttggttccatactctgccctgggggtagtgattctgggatagccaaggataagacccaactgggtactctgcttggctccttagagatcatatcactggtacatttctcttctcactactccagccaccaaaaggcagatagtcatgttaatatctcctccaggaaaatgtattaattagtatattcttgactcatttaactagtgactaaatacttttctgagtctcagtttctttattcagagaattaggataatatctacctgtggtagtcattagtaccattcattaagtacttctagctgcctacatgtttgggcacacagttagattgtacttctctacatccttggtcatgtgacctgctttggccaatgaaacgtgagcagaagtcaggtatttcatttccaagtggaagctttaaaagccaatatactgtttacttccttccattgtttaattgattgtagctctgttgggataaatccttcatcagcctgggactgtgagtgactatgatgatcacagctctctactgaaccaagttgaacatgtagtatgagcaaatattaatcttattttctgtgaagttactaagatttggggggtggtttgtatctgtagcttacctagcctgccttggctgataatatactacctcataaggctttgcaggggattacacaaaatgcgtatgtacacatagtcagcactcaataattggtggctactttattctcaccatgaatataatttgggatgcttttggctgcaggtaattcaacccaaactcaaaatgcataagcaataaatgcatttctcctcttgccttcacttctcctcctgcttctccttctcctgcttctcttaacaagaagtttagaatttgggcaattgaattagaggctcaacatcatcactagcttctttcttatttagtctgcctaggttaattagatttcttaaatctataaaatgttgtagttcgtcatttttggaagattgtcagttattatctctgttctttttcttctttccatttgagatctcaactgattgtatgttgcaatttctcgttgtatagtctatatttcttattattctagatatttttatctccctttgatgcattctagataatttcctctgacatatcctccagtttattctctttttagctgtgtctaatctgcaattaaatgtgttcactaacttcttaatttcaattattgtattttttagtgctaaaatcccttccctatttaattatttcccaaatcacctttcttttggtttccaattttatgaaaaatactttcaagcttatcttttgtttctttgagcattgagcatagtaagcctatttgttttatagttttttgtttgataattccattatctgaagtctttatgggttgattttttttcctggctttattgagataaaatggacaaataaaaatggaatatatttaccatgtaccacatgatactttgatatacatatcatatatatatcatactttgatatatatatgacatatatatcatactttgatatatatatgacatatatatcatactttgatatatatatgacatatatatcatactttgatatatatatgacatatatatcatactttgatatatatatgacatatatatcatactttgatatatatatgacatatatatcatactttgatatatatatgacatatatatcatactttgatatatatatgacatatatgtcatactttgatatatatgacatatatgtcatactttgatatatatgacatatatgtcatactttgatatatatgacatatatgtcatactttgatatatatgacatatatgtcatactttgatatatatatgacatatatgtcatactttgatatatatatgacatatatgtcatactttgatatatatatgacatatatgtcatactttgatatatatatgacatatatgtcatactttgatatatatatgacatatatgtcatactttgatatatatatgacatatatgtcatactttgatatatatatgacatatatgtcatactttgatatatatatgacatatatgtcatactttgatatatatatgacatatatgtcatactttgatatatatatgacatatatatcatactttgatatatatatgacatatatatcatactttgatatatataccatgtggtacatggtaaatatattccatttttatgtatgtatatatgtatatatttcatatatacacacgcgcgcacacacacacacacacacacacacacattgtgaaatgattaccacaaatgtgggtctctttctgtattctgctattcctgatgatccttcttcatggtatactttttccttgtgttttttatctttgtatcttgatcactggccttgaagccaagaatgataacattcttctgcaatgatttttattttcttttgacagcccctgggataccaccagtccagttctaccttaacaaaatgcttaagattccttcgacctaggttgcagtcaactgggtttcaggtttgcattaacagctagtttattctaggctacctttatcttgagggtgaagcttcccctctgagaggaagcctagcttagagtgaatgttgtttatcaaagtcttctggggcagaggccctggatgttgctttctgctttcctactcctcctggttgccaaaagcacagcttagttttgctactaaactaaatactattgtttcttgcagattggcaaatgctctcaaggcaaaagctttttttgtgtgttttgggccttcctctttggattttaaacttctcctaggttttgacctagaaattctttatcttgttagctctttaatgcttttgagaaaataaaaacaaatataaatgattgtcctcagtgggaaggttggtcctaatcacccagcctgccactacaagaaaagaccatcttagaaccccaataccttacatctttccattctaccatcctgatagtcccaagatggctgccgtaactccatatgttacatgcagaaccgataacaactgaaagagcctgtttcttcatgcatatattttaaagcaagaaaacctttcccagatgtcctccaggagatgtttcctcatgtctcaaaggccattattttgccaccaattccaaaacaagtcactggaaggggatgcaatttccgtgattggtgtaatgtagtcagcatttaccctgtgggactgaagttgtctttgcgtcccctgaagcacatggatgcttgatttcttaacaaaatgtgggtctgtaagcaaggaagaagggggttaatggccactgggtaggcaaccaactgtgtctatcacagtctgtgctcaggattaaagattaagaagcatagtcatggttcttgttctactttgagacctacgtgctctgaatggtgcaagaaaatatagagccaaacgtaatacagaaaggattcataaatatagggggcatgttcattgaaaacacactttgtaacttaaaaactggaaaaatttgggatactctgtgttcaaaatataataaatttatttaatcaaaaatattaaaaagatatatagcaggaagaatggctttattggaaattcactccccaaacttaatcatattacaaattacttctataaatgcatattgtacaaaataggaatagatctgatgcagtcatgattccactgaatgagctgggtccttccaagtgctcctggtagaggtgggctgcagtttgcagaagaaagaaaatattaaggcttaagaatcctggccgggcacggtggcacatgcctgtaatctcagcatttgggaggctgaggcgggcagatcatttgaggtcaggatttcgagaccagactggccaacatggtgaaaccttgcctctaccaaaaacacaaaaattagtcaggtgcagtggtgcacacctgtagtcccagctacttgagaggctgaggtatgagaatcgcttgaacccgggaggcagagactgcagtgagcctagatcatgccactgcactctagcctgggctacagagtgagactccatctcacaaaaaaaaaaaaaaaaagaatcctccaaaaacttggaaacatgagcatcccttccctagcagggcagaaggtttttcttgatctaatatacctgcctttgttacctgggagcaggagaccacagaaggcgaggtatgaaggtacaaagatgatcttttccaagttctggcttgctcccagaagttcagaaaccagatcctcctgtttggacaagaggccccagagagagataggaatttatcctgcctgtccccaactgcaccactggagtatctaatgagcagaggtccaattcctgaacactagccttccacaggtttggggtccatctttccaccttctgttttccatatcctatatctatggcttgatctcatcttagaagtcccccttcctagtttgtcatttgccacaggttgctagctcttgaaagtccctcaaagaagatacccaaaggaagtgtgccaagcaggttgaaagtaggcatggggtgatatttttggtcacgagcagctgagtacagctgggttttgggggagggtggggacaagtagggtaaaagtgaattgaaagtgtatctacatgtacttgtagatatactttcatgtactacataactgcatgtctcctttgattacctccatgccgtttcattcttcaatcccaccagttaaagctgttgatttatgtaccagactcctttaaaaaaaccaaaggaaaaatagttaataaattcggatgtgtcaagcccagtgacgaggtttgtttagctgattggcttgcttttcaggcagtatgctgagtagttaagtgggaggaggctttgaaataaaaacagcctggtttagctcatagctctaccacttactattgtgtgacactgggcatgtcacagcctctctaggccttggtttcctcatctgtaagatgccaataatatcctatgtttaccttatagtgttattgtaaggattaggtgatgttacgcatgttaaaggctcaataagtgttagttattaattcttaacctgtattgcctaaaatctaacttttggatgagaaggggatggtggagtggttataaggtgctctggggactgaaggcttaggaaggcaggttttgaaagggtacggagatagaatatgcatgtgaggatctgggctttgaaagaggataatcaaaagttgaattggaagagagtcgatgactaacttccatttctcttgaagtgtggcccaaggccctgggggaaacttcagcttcaggctgtacctgtgtacctgcttgtgactgggatatgtttcctgcaggagtgaagccattggtagtttcttttaaggccccgcctcctcacctggagactactggccaggtggctgagctgggctgcctcagagggggcaggtgccctgctatctcctgctggctcagcctgcgaggctcaaggtacatcctgcctcactggagttccttctcctaagattaagagcttgagtggcccagcccagaataataaatacatgaactggcaggcattagaaggcgtcagcatcgataaatcatcatattctgggcagtatcttcagaaacccgttcttatcaaccacttaaggagagaaggatccaagggccatggtgaatatctgtctcaacccagaaaggaaggagctgaggcaacagggtctttggtagtgctggaagggtagagagtaggccctgggtggaaatatttttaaaaggagaaaggtaagagaaagggttaaaaggcagccttttgtcaccacctcaggcagctggatgagggaccaggcttgagggagcaggttggaagaacagttatgtagaggtagaagtgtaacttcagtcttcaaagtggccattatcggcatttggatatgttctggccatttcatcagagaggcaagcaccccttggtacctgtttgtatgatggatttggatgggaggaagagagaaatgggatttggggataccatgagctctttttcccaggggttcttctttagccaatgccgtgggctcacatctgagccctgaggagaggaaccctgtgcaaaagttgaaggagctgtctgctgttttcatgagggctctgtgtgacatatggggacagatgatgctgatcttgtgaacacagtggggaagatggacttagcttccatcaaggcttgatcctggcatagtgaagacttcgggaactcaggctacttggcacttggaatattggggatttgagaaccctggagcaagcactctggatccgacactggtgtcctcacagagggcaccccaggcatcctccagcaacagcgggcagccagagcagcagaggaaggacatggcaggtacggctgacaatgctttgtgagcaggaatgagcatggggagatatgagtggggctcctggacatagtgagatgaaacttttcaggggctgaggtgcaacatgaggaagaagatcaggccaaagccagtggaatttggattgcctctgttaatgggatgtcttgtctggtgaaggctaggaaactcaagtcacagaagaaacttcccgtcagtgaggtagtattccccaatttaacaaatatgtattgaatgcctaccctgtgcaggcactattatgagtgtgaacaagagaggcagaatctttgtcttcatgagaatgacagtgaagggaagacattacccagttagaaagtgccatgggagcagagaaaatgaggaggagaatttcagctgtggatttgatcttgaaagggccttaaaggatgggtaaaagttgggcttgtggagatagaggaggcctagagaagaagggagaatttgggaaatagtctttatgtggtggatgtgtgtttatacacattgtgaatgtgtatgaaggagattaggaatattgagagagaaagctggaaaggttggttgggtgggctttcggtcccatgctaggattttattcagtagtctatgggcagccattgggatattttgagcaagaaaagtaacttgatcaatcatttcctgcctttggctgaggtcacttagcagcactggtgttaggcagggctgcaggccatgattgtttcgatatgttctcttcctggccttctcacgggagcagtcgtaattttatttttacccacttctctgttttgggcgtccgtcagattagcagctagctctatgcctccagttggaagagagcttctgttcaaagtgctgtatgggtggagtctttctgccactgtccgagccctgctgcccttcctgggtgttgaccttggctgtagagggtgtgtcccttgatttaaagctatttgttcccccttctttttcagcttcaccctggtacttctgaatgaccagggttcctgcagggaggtcgagcaacggcagcttgtggtttgggtgttagctaggggcagcaactaataaatgaatggtcagttgtcttgggaatgtaggtctttgcttcaactagatttactttcattttatcataaataccagaagcttcatgaatttaaattggtttcctgaaacagaccctggttccaggaacatttctcactgtgggagacaggattgtcaacaaaaatggggatgcatttttaaagataagatctatttatcagtgtatggtccacaaagaatcaaatttggtgacttaaaacttctgtactcaaatgaagggtatggtgcatatttatcttacagtgacagtgatgttttagaatatccgtatggtactgctggcttagttggcctggatgttatattcatgaggccaaggctgcagcccagctctcttccctctggtggccagatatcttctctttggtcatggctagagactacatcttctgttccagctggtagtcttttagtagcattttattagtcatgcaagggccagcaaaaatagcatagacagatagtaaaaatctagtccttgtactggaaaaagaacttggagaatgtggcctgttgataatggttgtattatcactaagtaattttttttatattgattaagtacttcctatgtgccaggaactgtcctaagtgcttatctcaaccttcaaaatagtatagatcctatcttacagatcaggaaactgaggctgaaataagttaagtgacttgacaaagtcattcagcctggataatggtatgcataattaggttctaatctagcttttcttatcttaagtcttgtatcctttcctctcttctgtccagaaatgatgatgagaatatagtagttcccccttatctgagggggatacgttccaagatccccagtggatgcctgaaaccacagatagtactgaatcctaaatatactatgttttttccctgtatgttcatacctacaataaactgtaatttataaattaggaacagtaagagattaacagcaataactaataataaataggacaattataacaatataatggaagttatgtgactgtggtatcactctttctcaaaatatcttattatattgcatcacaggtaactgaaactgtggaaaataaaaccacgcataaggagagactactgtacctatactgtagattcctggaggcagagtcagatgttggactgttcagtaacatcttggaatctcctttgtccaccaaagtgtctttgactgtgaccttaggcctcttgctttgaagcagagttactctatcctatttggagtccaaattaacatctgctcaccaccaagtggatccctggagatctttcttgctgtatcctccagcccctagccccttttgaattggggaagtggcagatggaagatcaagtggcagatggaaggtcagatttcagaccttgcaggcttccttctgatctgcatcagctcagagggagagaaggggggactggctggtgtgtggtcaagtgtattttgttgacctgctgccctgagctaggggtctatactaggaatttcttttatggaaaagaaaaacagtgttttttttttttcccttgaacattctgggggtggggagaatcagcaaattattttatatttaaataactaaacatttattaagggtcatctctggagaagacagaattggtgtgatttgaaggatgctacaaaagtgcctcctgctcagaacctctctgacccttgtagtgctttgacaccttaaacagttcattcattccttttggctaatatcactcagctgatccttttataggtgctaaaataatgcactcttgtgttaatttaagattcttccggaagaagtagaggaacattaaggcagtgtgtgtgtcgggggagtggggtgggtggtgtttagagtgaatggatgactcagacttggtgagagatattctgggatggcttcctggaggagagaattacttaacatgatgtggtggccaagaaggctgttggcaccgttctttcagaagcttcagattgaggcattcaccaagttactgaacattagtttttagtttctaagataatggaattagctgtagtagtacaaggtacaaagccattattaacttataagcctttataattacttttcagaagccctttttgctttagcattgtaaatctttctcacagtgccagggatttaaaaattttagaaatgacatttaattaatgttgaacgtaaaatctctttgggttttaagctgtcttgggaatctactcattccctcctcccagatccatcttgcctcctcttagggatcatccaggaaacctccctgagggctggcatggaggtaggcagaggagagtgccttccctcagggtgactgtcagactttccagcccccagaaacattccgtggagatgaaggagacacttccatctgtgcctgggccatatttcagggagactacgtggtgggactcgcagctgggggacaggacagagggactacagatggcagatggctctggctgccacttggagggggctgttcttggggccgatgggggtgtgtggcttagactatactccctgtgaagtaaacagggaatgcttttcttaggatctagggaagttttagcaacttagttaggattatgccatctctgtgggagagagggtttctgcaggagactgcaaagatatacatgtgaacatttaaaaagtacaactttccagcccccagaagcattccgtggagttgcaggagacacttccatgcatccacagaagccctctgtccctcacgtgggctctggagattcctaagacttctgtgcatctctctatgtgagtcatgggacatgttcccttaggccacatgtaaatgccaggcagtgaggcctaaatagtcattgcactctaaaaaaagtaaacatatttaatttctcatatttttataacgatgtcttacttgaacatttattatataccagatttgttccaaacactggaaatccgtcttctcatttaattgtcacaactctggcaggtagttgtcattctttacagtttataaagcatgtccaccatctatctcacttgagtctttcagcagtatatgtatccccattttacaagtaggacgtggccagataagtgactgtcataagactgtatgtccatggagtagtgacattgaactcagagctctttgttccaattccggtctccttttcatcatactgtaatgagagcccagctttcttccttctctcaacccccaccttgttttacagagagtgtctctgggattctgtggctgggagaggtgggagaggtagctgagcaggtaagccttttacgaatgtgtgtagatttgagacctgcaaggcgagaggcaacagggagtggaagctgactgacagggccctgggggatgtgtcagagacagtgcaactgttgcacagatgtggtgcaggctcctcattaagagggagctggaaaggaaaaactcccacttcagagaagaattagactgttcccaatgtcttcacatctgtgaggggactgatggtacaaagactcactgataaatggacagaagttttcagacccaagaagatattaaaataaatatttaatttgcaacaaattatgctgtgaatcattaagacaaacataaatctcatgagtaagatttctgttatttctctgaatctcaatgaaatatttattgaggaaaatgaagtcagctcattgctttgcatgactaaatgccattgctggcttccaagagcagcttcctcaggatctgtctcagatcgcaaggatgggggaggaggcaggactacttccaggctgtcccaacatgagcagggatcagatcattcagatcgggtaggactgaagcatggtctagcattgtgtctggaatagaaaatgttgtctaattttttgttatttaaggttgattttgaaggtcctggggcactttctaatttgaggagtagggaggatggcttcagggtaagttctctgaattttcagatggcaaaccctgagacagctttcaagtgtgtctagaacttagaatgctctgattcaggttaatgcctttgggggtgatacacggatgtcctgatgccattcctgggctgctgcttgggtatgctttaccaatgctaatggtgtgctcacaccttggggattgggagaacaacatcaatccatctaatctcacctaaggtagtagaggatattgacccatctccccacagaggtcagccccagttcactgactttcttagttgtggcttatcagagcaaaactggctattctaggagatggatttcaagaggctgaaacaaaagacagcagtgtgggtacatggggtgatgaggatacccaggccttcctggactggtttgggctgtagccgttcccccgacagggcaggtggctctgactcctgagttcatggtcctttggcaggcagatccagtgtgggtcacatgatggatgtttctatgggtggtcttgctgtccaaagtcagccttgctgctctaattccattctggttttcttcttgcaatccacaggtggtttaggtaaatccccacagatgaaatatgactttattcctctctcaaaaacacagtgctttggtcagagagaaagcttagcgagcatgttgaggggactgtcacttagaactgaccatcttgttttcctttgccttagacttcccattttctaaatctagagtgcgattaatggtataaatgtagaataggaactcccatttctagcagaattactgaatttaactaagtatgtactgagaatgagccatgtgcctagaactgtgctgatggtctagaagatacagaaatgtgaacagaagaatccctacttttcaagaaacttacaatccagataggaatactaaaaatatatatatatatatatatatatatatatatattttcacataattagctaactattcattcaatgtgtatttatgcagcaccttctcttagcagaatataaaagaattcagaaatgctcctgtaatcccagcactttgggaggccaaggcaggtggatcacttgaggtcaggagtttgagaccagcctggccaacatggtgaaaccccatctgtactaaaaaaaatacaaaaattagctgggcgtggtggtgcaccctgtaatcccagctgcttgggaagctgaggcatgagaattgcttgaacccgagaggcagatgttgcagtgagccaagatcatgccactgcagtccagcctgggcaacagagtgagactccatctcaaaaaaaaaaaaaaaaaaaaagaaatcagaaatggctacttaaaaagacatgttaataattattttgtaaaatgaagagtaatgtgagttccaggagatgctatctgtgaaagatgcaggagtataaacagtacttctattagtagactagagaatgtagccaccagatagaggttttgattgtttatattttctatctccagaatctagcacaatgtctggtatacagtaggtgctcaataaagaaatattgaatgaataaatttttctaggctggagtaatcagagaaaagctacctcatggaagaagtcaagcttgagttagatatttaaaacatgacagaaattgggtggcagtggagagggcattttaagtttttcagaggatatcattgccatgtctacagtactgtgttatttatttctctctcatatttgtaaaatattgcacaagtcacccatgagcactcagctatttcttatctcctttatcagaccattagggaagggttgactctggggcccatggcacctggttgtatgataaaatgcaagaagtggtgatttatttctacttgaagaaacaattttacagtttggggatgcttttgcagccctgttcaaagaggctgtggattggaattctccataaggccattaattattgaatttgctttactgtaaaacaaaggagctgcttataggtgtcagctgttgaaggtgcagagtgacttagtagcagtataagtgctcctcctaatcacaggcagacctgttagcagacactcagaaaaaaggacaggatactgtcagcacattgcttcagggaagatgggcaattagtggcttcagatgtcacatagcattcttctccttttggtctcccaggtgctctctgttgggcaatcagagattttagttatgactctagaaacaagtcccagtgagagaattttgggctttgcacttgccaaatggtgagatgagtggtgccagagagtttggctgcggtggttgtgatggaaattctgcaggtggtggtgctaaagagaaagagaaaaaattcctggctgtcatggaagatagttgctttctgggcagtggagctggatataccagtgcagtctgcagtgctggtggaggctcaattccactctgctgctgtgattgtgtccttcagcacactctgaggtcctgatctgctctcctgtcttatatgtaggggtgcacaaagccagactgcaggagccttcttggtgggcatttttataatgatatgcatgaaagcttgacttctgagtgtataggcattcctcactttattgcactttactttattgcacttcacagatattgcatgttttgcaaattgaagttttgtagcaaccctgcattgagcaagtctatcaacactgtttatccaatagcatgtgctcacttcgtgtctctatgtcacattttggtaattttcacaatatttcaaactgtttcattattattatatctattatggttatctgtgatcagggatctttgatgttactattatgattgggggcaccacaaaccatgcccatataaaactgcaaacttaataattgtgtgtgttctaactgctccacctaccagctgttttctcatctctccctctcttctcaggcctctttattccctgagacgcaataatattgaaattaggccaattgataatcctacagtggcctctaagtgttcaagtgaaaggaagagtcatacatccctcatggtaaatcaaaagctagaaatgatgaagcttagtgaggaaggcatgttaaaggctaagatagcagccgggcacagtggctcatgcctgtaatcccagcactttgggaggccgaggtgagtggatcacaagatcaggagtttgagaccagcctgaccaacatgatgaaacccagtctctacaaaaagcacaaaaattagccaggcgtggtggcacgtgcctgtaatcccaggtactcaagggctgaggcaggagaatcgcttgaacatgggaggcggaggttgcagtgagccgagattgcgccactgcactccagcctggacaacaaagcaagactccatctcaaaaaaaaaaaggcaagataggcagaaagccttgtgttagactgttagccaagttgtgaatgcaaaggaaaaattcttgacggaaattaaaggtgctatttcagtgaacacacacatgataagaaggggaaacaactttattgctgatataaagttctagcgatctggatagaagatcaagtcagcaacaacattcctttaaaccaaagcctaatccacagcaaagcactaattctcttcaattctatgaaaggtgagagaggggaggaagctgcagaagaaaagtttgaagctagcagaggttggttcatgagactgagggaaagaagcagtctttacaacataaaaatgcaagatgaagcagcaagtgctgatgtaaaaactgaagcaagttatctagaggataattgatgtagaagtctacaccaaacaacagattttcaatgtagatgaaatagccttctattggaagaagctagagaagagaagtcactgtctggcttgaaaggacagcttgactcccttgttaggagctaatgtagctggtgactttaagttgaacccaatgctcatttaccattcccccaaatcccgaatccaagaaagcctggatgacagtacatctgtttacagcatggcttactgaatattttaagcccactgatgagacccactgctcagaaaaagagatccctttcaaaatattacttgctcattgacaatacacctggtcaccccagagctctgatggagatgtacaaggagataaatgttgctttcatgcctgctaacacaacatcctttctgtagtttatggatcaaggactgattttgactttcaagtcttattatttaagaagtacatttcataagactattgctgccatagatagtgattcctctgatacatctaggtaaagtaaattgaaaacctgagaaggattcatcattgtagatgccttaagaacatttgtggttcgtgggaggaggtcaaaatatcaacattaatgggagtttggaagaagttgattccagccctcatggatgactttaaagggttcaaggcttcagtggcagaagtaaccacagatgtggaagacatagcaagaaaactagaattagaagtagagcttgaagatgtgactgaattattgcaatctcatgatgaaaattgaatggatgaggagctgcttcctatgatgagcaaagaaagtggtttcttgagatagaattgacttctggtgaagatgctgtgaacattgttgaaatgacaaaagatttctgtaaacttagttgataaagcagcagctggttttgagaggattcactccagttttgaaagaatttctactgtgggaaaaatgctatcacactgcatcacatgctgtagagaaatctttaatgaaaggaagagtcaatcaatgtggcaaatatcattgttgtcttattttaataaattgccacaggcactcccaccttcagcaaccactatcctgatttctggcagccatccacattgaggcaagaccctccaccggtaaaaagataatgaattgctgaagattcagatgactgttagcattttttagcagtgaaatatttttaattaaaatatgtacattgttttttagacatgctattgcacacttaatagactacaacatagtgtgaacataactttatatgtactcggaaaacaaaaaattcatgtgactcactttattgtggtggtctggaaccaaaccctcaatacctctgaggtatacctgtatatggtaatgcgtgggagagggtttgcgtttaacgttgtagggacaaggcattcagtgcatttaaaccaaatcttgctgagcctacagagtggggtacaaccctagttcagaacctggagtataaggaagagacatggcctctgtaccagcaacagaaataggatgatttacaatttacaaaagggtttcacatgggttatctcatttggaatccacaatagccttctgaatcagtaaagcaaggattatcattgcccttttacagatgaggaaactgaatctcaaaaaggtgaagagatttgcccatggcttcctagcaacaagccttgaatctaggaccttggattacaagtttcctgctctgttctttcatgttagtttctaatcatgagaacagacaactacacatgaaatgactcaaagatactgattatcatgatgacaggagagtttgaagggaaggaggaagcccaaggtcagagatggtgtagtgaatgagcaagcctccatgagctggtgaccttgagctgtcacacagatgagaggaagctgtgatgtggtgggtggagggctctggtgccgtgcctggcagtgcaggcagtcactgtcttccaggcccactcttccttattcctggacatttgagggagtctaagggaggtccagaggaaacacaaacacctcattttaacttacagtataatcccccttcctagaaatgctttcaacacagtggcccacaaaaagtaaaatgacttggagtcaatttcttctactccttgcctttgattcccctgtgagtggcagggaaatacttaggaggagtaaagaggtgttgttaagagcctggatgattcagagttaggccatcagatgctctgcttaattaggagtgggctgtcctgattaggtgtttctgctttgagcaggagtggttccatgagttagaggctgcgtcttggtttgcgtcctgactctgaggcaggtttggaggaaaaggaggtgactctaccacctcatacccccaaatctcgacagcttacctactaacattctcttctgactctaggttgccttttaggaacatctgttttgccttcatcgtttgccttgaaatacaaaatgttgaataggagagaatcatggttttgtgaatgtctggccaagaattgggagagatttccttgcttttaccagtcctcaacttaatgattctgtttttttttctctattaaaaaaaaattaatcatgagtgaaattttccaaacttgaaaagatatatatcaatcagaaggatttttcagtaggattcctttatttttttcctcaatattatgttaagaaatacctgtaacccaatattacctcaactgttttctcagcgactgttggtcagatttctttctttcaatcattgaaatttttgcaaagtctgagcaaatatttgaggcttcttcctgctccccaccactcctgcatcttgagaggtggaaaacggaggtttgtgtgtggtctcaggacatcccctggccactcttctcctttggggtgatttgcctccatgttttaaatccaagatggtggacatagatgacatccaattataacttctttctgatttggggcacaaggccagattctcctaagagaatttacacagtcacaagtttggaagaatttctcatgatgtaatcaagatgtaaaagctatttccttgctataactcatgtacagtttcttgtgaaaatgaaatggtccaagctctgctgtaccatgctctccaagtgacagtttcatctactccatatgttcacagatgagggaatcattgtcacatggcaaatggccaagaaagcccctagcccacttctgtagcttgtccaagagtgcctggcacattccacccctcaattattcccatcaattgtgaacagatgggcacaatactctaagtcatagtaaagtgacttgtatctggccattatccaagtgaaatgaaagaaggtgctgttgtctatctggctcaactacaatatgggattcataaaataatgacccctggttcgataatgacaggagccccaagctgccaggatgggtacttttgtggcaaggcagctcagagatcacccttcataaatttcaaattggttgcagatttgtgggtgagacttgccttgttattgtcttcctttaatttgcgactctattgcttctccatattgcctcaacctgtcaaatatctgataagattttcccatttaaatttgattcaggttaggattacctaccagtttaggaaggctccaatttattctaaatagatgtttctgagaataatatctctggaccttaaagtgtccctgagaccaattatactgtcagagtgattattttctaatcctcctccccttactgaggtttctggaccctacactccaatatgtacctgtgtttctaaactagactaatttaccattctctgttacccccttctcaatctgaccccaaacttccctctttcaggaagtctgctttgcttgatattacccacttttgaccacagagttttagattagtagaaacttagttatgaatgagatcttagagtccatttagtctaactttccacttgaggcagaaattgcctctagatgatctctgagtgatggtgattcttatcttcagtgacaaagtgctcatgattccatgagacagctaattttattgttggtcagatctaattgttagtaaattattttatgtaattgaaatctgactttgtctaatttaggcttgttgaccttagttcaaccctctagagtaatgcaaagctatacaatttcatttctacttgaagtccttcagctaattgagacagcagttattactatcacacagtctttttgccagtgtgttatactttttggttgatccatgtctccttattttttttctttctcttatgcttcatttacttttttatgcttattccacagttttagaggtgaaatctcttcattattttgtgtcccttaagaatttatgtccttgacatgtagaatatgttttaagttactcagtttttgcctttcttcaatcatgtattccctcaatatttattaagtacttttatttgtggcaggtgtatggtaggtgctagcaatgactaaggccaactccccaccctcaagaagcacttactgatgtgtcacactaacttttctcaagttattaattattactatagtcacatttatcagtggaataagatcagtttatgaacaaagaaaaccagaagactgggatattgagacattgatgctttcaaccagtgttatgcttgtttgtctggtggccattcctcacccctctctccacttgctactttttgtatattaaaagatatttggacctgaaaaagatggattttccgtagagactattgagatagcaaacacagaagcctgaggtcaaataaacttttgggctgagaatggaagtcttagctcaatgccatttcacttgttggcaattcaaaggtgttagttatacttctgccccatccagagggcaaatgttccctctgagttgacaatacagggaagcaggaaaatggaatgaaaatttcaaccaagtaacaagaagtagagaagtagaaggtcttttctgatggaataagactacagagccatgaaaaaccttgatttaggccccaaaagctatttggagaagaagtgagccttctgtaggggagcattgtaatccaagaacttcatgcaggtgactgtggtatggtgccgaggtcttcctacttgcctccttctcagatgctcactgtgtccttttcaactggtcctgaagagttctgtggtccagagtcatctcattggtctaaacattgtgtgcttgttccctgtcccctcctctgtgttagctgccctgttggcttggttatatctctgcacagggatagaagcagctttccatcccagaaaatcatggagttgttctcagacatttgcatttgacatctagagagccaagcagaaactatgaattgtgaaattgagggcatagaggcttacgagtaaaactgcgtacagccgtattcagcatgctcatatttgggtgttcctaagaaaattcctaaaagtcacagtcattgtgctcaggcagcttttgtttgaggaaggtccgtcatactcaggagcattagcagaacggtgccccagcatcatggtggcatggaaagccacttagataggcttgtgctgtctattcacagatcccaagggtcccatgttcttcctactgttgtcttttgctctgctagagggcagagcactctctacgtctgcttcactgctctgccttaagtcctgtctgctttaaggatcagctcaatgcctgtccatagtgactcatactccagtttgcaccctgcatttagaacagagccccttctcactttacccacccaactagagacatactctttaagggtggtatgttttgtaaggtcagggaatatgtcttgtcttaggcactgcacttggtggttaggtgtgggatgtgatgctctacttcaatctcctggacaatggcaccaagaggcaagggagaaggaagttcatgatgggtggaggttggataaaggataagatagagcttggtcttctgttgtaaagaagaccagaggttgtaataatcacgtcgccttcaatcacccattcactctatcaccatggccctatgggcagggctgttctcccttcttctgttttcattccccaggaaacctcttttgggccttgctttcccctctaaagccaaggtcatcagtgaagtttgttttaacctcatttcatctgtgaaaggggttggatgggtaaagtgagaaaaagaaggcagatgacaacattccatgtgatgtgttctggagccctgccccttcaaggaacttccagaatgtctagctcggtaacagaatatgtgctttataaatgtgtattgtttgataactgattaacatttgccaagccacataaaagcaagtgaaatgaataacaactcacttacctattttggggacaacttttaccattcaggacatagaaatagcctttctagtggaaagcccatgtgaccagaacttattgacctatggtagtgtataaattaaagttcctgattgggccgtctttaatattttccaggacagagattagagggaggtgctctgggctgctgataccttagtgatatctacccatgaaggaggagagagtgaaatccttagatatttagtatatctctgaatatgttaaatgtatattcagagctctctgaacttctcagtgtagtctgcaatggttaggtagtttactattttcaagaagtaaaattattagattttttttaaaaactgcttaaagactaacatcagttatctggaaacatacatggggtaccgtcttttccagtgatactttaaaaatgactatttaccaataatatcaagttttgttgagactatggagttcctggaacttactttgctggtgggagtgtatatttatacagcactttaaagagaattttcatgatatctattatgcacaccccatgaacccataattctacacctggatatacccaatagatttgaactccatctaaaaacaaaaacaaaagcatgtacaagaatgttcatatcagctttattcataacagcctcaaactggaaacaaccaaaatgttgtttccaacaacagtagaatggataaatacattgtatatcaacgccacagaatgttatacagaaaagataaagagcgcactattggcactctaatagtatagaagcatcttagaagattgcgaaaggaagccagacataagagaatacatattgtattctcccacttatatgaccaaacaaacctaatgtgtgggacagaggtcagaataatagctattcttgactggaagggggcatgagggagccttctgggtagctgtaaatgttctaaatcttggtctggtgattatattagtgtataacatatgcagaaattcacccagctgtacccttatgatttgtatactttgtgcaagttatgctttaatgaaaaagcaaagaaaaggaagagagattgctgaagtgtgatgctgagtaatttgccacagaccccagtgtcttctatatgtctgaaggttaacagataatattcttaaggttcttgcccctgaaacttcttgtgaattttagcatatttttcctgcttccaacttgctctggaaagaactggagtctgtgactcaggagtcctctgctatagtctctcagccccagttaccaactgtgtttacttacaggtcagttcttcaaggagtatatgaaatagaccttccagtcactcctctacctttgacccatggggtctggtgaacataaagtgaggtataagctatcaaggagtttttgaaaaacattaaaagggccacccaaatactaagaagtaagattgtacttgaacttgatgaaattgatggcagctactgattagaatcacataaggtgctgttgacaaagacaatgctgtgactttaaagaattgggcagtgatttatgaatcatcatggtacttggctcagggctctcagtggcagctgtgacatcagggtgtaggaacacatgaggtgacttgtgtgttgggaaattgtggtgattacagaagcagccactgccgggaggtcagcatcacatgcttagaatgatggttcttttccaggtgaagcccttggactactgtggccaagtgaacagtgccctgtttagacaacccaggcccatttctggcttttccaccaaataattatgtgacacaaggcaatctgttcgcttccctggaccttagttcctcctctgtaaaatgggggaaatgatgtcataagtccctctgagctctaacttcctccatgtcttccccacatagccagttctcactttttttccgtatgtgtattatatggtcagttttaaatctggaacagtcttcttttcatgtggctgttttttacaagtagatctttaagaagacaactcagctgccaagaatcatgttgtctcctaacaaacaatatccattattctggaatattgattatccatcatttcaacaacccagtatctctttccatcattagtgctgatgactgggtgctgcctgaattacacaaccactttcctatccctccagcctcctctaccctgttggagccccaggtggacatgtcttgatgagcaaagctgtgcattagtaatgcttagtttggggccacattttcctaaggtttgtgagggaagctcaatcatcacttcaagtgcccagagcctagaacccgagccggtgagaacactgatgggaggagaagaaacttagtgagagggagcctccatcactgggaagtgagcactgcagcaccgcacaacacatactcctggacttctttcctggcctgagcttttcaaggctgaatgaatgtgcaaagccaggaagaaaataccttactctcctctggtcagcctgggcagagatcttcttttacacacggcaggacttggggaaggaagaggaggatgatgaggccaggagaaggtgactttgttgtgtctgggaaggaaccagggccttgtaactcagagaattggggaaaagctttgtggcaccttcatttttctggctccttcatggctgttttggcagggatttttgccccgtctcacattccaagttctttcatgagagctttgtgggtcagaggcagggaactagaccagaccttaacctctgaagacacaaattctcccctggcagcccctgtctctttgggagttgttctggttcctcctgctggggcatttacactgttttctctgaagtcaaatccatcttcctctctgtcctctggaatttggtttctgaggcacttagtaggtgatagcatgactgactgcctcactgaccacttccagatgagggttactctcctcacagcacggccttgaggcagctcatgccagggatgctgcctgtgttccaactgtggatctgcattctgggaacagccaattgatctgatggtgcggggttactttttattttttaaatttaaaaattaaaaaaaatatatccttagtggtgattaaaacttcagaactgtttttgaatactaatttggtttttggaaacagcccaactccattcgggaaaatctggggaagagggaatcaaatctgggcaagctgggtgacagtattttagtttaaaaaacaaaacaacaaccttcctctctcccccacctcaaaaaaacacaacacaaggtttgtctattaagtaatgaaacagtttgcttgtttttaaatttagaacgacagtcgaggctgttttcagaagttcaaaaatgtttagtgtctgctagaataagcacagagccccggaggtagctaacaaggacagccctcatttctgtcttcaattcaggaggccacaggtcaggatctgtggcattgtggagggcccacccagggcactgcctgtgattgcagacccactcctgtgccttatggggagggaggcgctagaggaatctggggctattgccaagtcccctatcgttcacatgttcctggagaaggagtttggatactgacaaatcctgcatcagggagggctacctgagtccagagatctcatcctgagcctgtctgcttgcctggaaccacaggcaaaaagagtttcagggcagccggaataggacaacatgttcctagtataactaaaatggcctttatcaagttgctttaaagaggtgttctttgactgctgaaagaaatcatagatgacacaaacaaatggaaacacatcccatgctcatggatgggtagaatcaatattgtgaaaatgaccatactgccaaaagcaagctacaaattcaatgcaatccccatcaaaataccaccatcgttcctcacacagttagaaaaatcaattctaaaattcatttggaaccaaaaagagagcccatggagccaaagcaagactaagcaaaaagattaaatctggaggtatcacactacctgatttcaaactatactataaggctatagtcaccaaaacagcgtgatactggcataaaaataggcacatagaccaatggaacagaatagagaacccagaaataaacccaaatacttacaaccaactgatctttgacaaagcaaacaaaaacataaagtagggaaaggacacccttttcaacaaatggtgctggtataattgactacccacatgtagaagaatgaaactggatcctcatctctcaccttatacaaaaatcaactcaaggtggattaaagacttaagacctgaaactataaaaattctagaagacagcatttgaaaaacccttctagacattggcttaggcaaggatttcatagccgaaaacccaaaagcaaatgcaataaaaacaaagataaatatctgggacctaattaaactaaagagcttttgcatggcaaaaggaacagtcagcagagtaaacagacaacccactgagtgggagaaaatcttcacaatttatacatttgacaaaggactaatatccagaatctacaacggactcagacaaatcagtaagaaaaaaacaaacaattacatcaaaaagtgggttaaggacatgaatagacgattctcaaaagaagatacacaaatggccgacaaacatatgaaaaaatgctcaacatcactaatgatcagggaaatgcaaatcaaaaccatagtgcaataccaccttactcctgcaagaatggccataataagaaaacaaaaaaacagtagacattggcgtggatgcggtgatcagggaacacttctacactgctggtgtgaatgtaaactagtacagccactgtggaaaatagtgtggagattccttaaggaactaaaagtggaaccaccatttgatccagcaatgccactactgggtatctacccagaggaaaagaagtcattacttgaaaaagatacttgcacacgcatggttatagcagcacagttcacaattgcaaaattgtggaaccaacccaaatgcccatcaatcaatgagtggataaagaaaatgtggtatatacatatgatggaatactactcagccctaaaaaggaatgaattaacagcatttgcaatgacctggatgagattggagactattattctaagtgaagtaactcaggagtggaaaaccaagcatcgtgtgttctcactgatatgtgggagctaagctatgaggacacaaaggcataagaatgatacagtggactttggaggcttgtggggaagagtgggaggggggcaagggataaaagattatagatatggtgcagggtgtactgcttgggtgatgggtgcaccaggatctcacaaatcaccactaaagaacttacacatgtaaccaaataccacctgtaccccgataacttatggaaaataaaatttaaaaaataggtgttctttgaaagggtgtgggggtgttagaggtctggggtctgcactgtgagctgtcttatagggaaagtctggttccaagggacccagcctgtttttaaggacagcgaatcaagatgctgggattatggagatggctgctgaagagaactcttgccccaaactatgaacagtcatgaagttttctttcttggtggggaagggtccttgatgagggaccagtgtaggggacattctaaacacagcagcccagctgctcaactcagagtcaaccaggggcccattctggagaaagaagggaagtgatgaacactgggcatctgctatatactgggcatttccttatatcattttatgtaattctcaatagtccttcaagggactgttacattccccattctacagatgagaaaatggaggcacagatggtgcagctgcttgtcctcatctccttactgcaggatcccttctcacttgcctgcataccctgttacagtctttgcactcagtatattgcattgtgatgacttccccacacctagaaattctaatgaaattggtctgggatggggcccagactggtattattttaaaagctccccagcttattttaattgcagccagggctaagaactgatagtttagattatgggtttttcatttttttttttatatccccagggcctaagtcagtggaactcaaacttgagcacacatcagaataatctggaggacttgttaaaacacaagttgtttgccctaccttcagcgtttctgattcagcaggtctacagtgggcccaagaatttatacttctcacaagttcccaggtgatgctgatgctgctggtctggggaccttgctatgagagcccctgatcctttagaacgagaggaggcacttgttcattacatgctgactgaattttaccaaattgccaaggtcccccccccattgattggaatcaggatttgaatactggcctaccaggtagcaaataggctggctctaggggagcctgggtggtagagtgaggtgggcctgcctgtctacttaacctctgggaggagagtagagtttgttggcctttagggtctcctcacagggagaaacaataaccagtttcttgccaggaaacctagtggctgttaaaggcccagaaattttgggtagaggtttgaggcagccagaagatcctagaatcctaatccaggacacagattcctagtgcagagtgtgacctgggaaaagatggtcatggatgtgcatgtaccagagtgtttgttacaaagctggtgacactgctctttaaagttacttcttgttttcgcactacaggaaattatggaggcactagtgatggaaacagggcggagtgatgccagaggtggggagcgaggccctgagcagacccggatgattagggaacagggttgatggggcagagcagctgtgagagtttgggcacctggaaagaatgtttgaggccacagcaggaatggtgtgtttgggagaggaggaagaggctatgctgatgaatatagcagaggacatggggagtctggattctcattctggagggacgtgcttgttacctggacactggagtcgccggttttgctgaacaatgcatttaaaaaatgaaacctcaaaacaaatatttacttacgtgtacaacactgttctagatgctgtagggctgccaaaaactggttaatgagaaaaagcagagtgaggtaagtgttaagtgattgttgcaggtggcaagtccataagagtggggagaagagtccagttggctgtgtggctgggaaggctgtgagcctgctggtcctggcaggatgagtgagtgtgagatgtgctgtgtcaatggggtgagcaaaggtgtagggtggggctctaatgagggacagctcattatgggagcaatggagcatttgtgcagaggatgtaaggatgtggttgaaaaggggaaatgaatgaatgccaccttgtccttgtttgctgttccctctctctctccaagtgtgagggctgggactaacttgaggatgcaagcctcctgactagcagggctgctggaactgactacttcttaaaagagtttctccaaggagtccttacacgcaaattttatgttatttttaccctttccagaaatactggaggctggaggaagaggaggaaagctctctctccttttagaaatgggactactgaggtctagagaagggaaaaggctaaaaatggtgctctgggtgtgggtcggatgcagggagatggctgaaatggccatctgaatgtaatagtgtcctctgagggcaggggtgaagggcacagttttctctgaacagcattgggatatggatgcttgaccctaagaatcttctgtaaagtatgtgtttttgtggatctgggaggaagtatagagaacaagggaggtcagaacagccctagtcggagcttaaggccctggacattcccagggatccccagtggcccccagcaggctggtatctcaaggttcacagagcctgtcctgggtgccacatcctagcactgtggtttcaggcatctcccacaatttgtgccacttccaccaccctcctgcagctttctctttgcccctcactgccacctctgggctcagtgggagttgagcagctaatcagaactgcaaaatcctctctccctgctggatcaccattagacatcaatttagcatgtctttggagagacctactcttttccactcccccaactttgaagtcagttagctctgactaaaagagggggaggggaggctctctgtgctctactccaccagtggtatcacccaccagtatttataccaaagaggttctgttgccttgacaactttcttgcatgggttctggtgctcagaatatctgacaaatagcaatgcttcacactcaatgggcagagacagacaagcagatcaaagagcaaatctcaatgatcaatgccagggtcaaagatgaaaagagtgactgaggcaggatacaagaaagccactgaggccagaggattcactgaagttcttcccttctcccatattctctccctccacctttccttatgtattctcctcctcctttctgtggaattcccgggccttttggtcttcatagatcagtcatcagcatgaactagggggcctgtatggcagagtattcccctggaccactgaagggacatggtgagtacagagggggtaactcctaactatggctttggtcctcagagagctcccagcttgttggaggagaccatggtattcatctccatgacacttctgctggggggaaaaggaaggctattagtgtgagggagcccaaaagttgagatggtgttctctgatattgtttacatatgtatgtatcatggcgcatataatacagatgtgaggccacagaaaaagctcactgcaaagataaatggtgcaagagtggggaccggggagcatatgggaggacttgcagcaggaggctggggaagctagcccagggataaaagtccttttgtggtagagaagagctctcctctcaggttccatctatagggcccagatcctttcttttttctcttggttacatggtcctttgtgagaaccatatctccttggatgcaaaagaccagagtaatgaggaggcaaagggattctgatgttgacaacactctctttaagttgttctccagagaaaacatgctgaatgggtgggtgctcatgtgtcaaagtttgggtgtatatgttaagtaagtgaagcttccacagaaacagaacaaaatactacatcttttgtggcttcctatggcatgatcctcttgagtcacacttggattagtgttttaatgcattcatttctttattcctcctgcagtttattgtgtactagctatgtactaggccctgcacagtatagactcttctaaaccactactttctgctttgctgagaactgctgggcagcagtccctctcttgttagggacaaggagggtttgtacagagaggagagaggcagagccttagggcacagtgagagggaatgcaagagtggtcagatacatggtagaaaaaccagagcacctgggggttcccttgtcaagggttgcaaggaaggagagggcactacactcaaggattggagagtgagatagaactgtgggggattggatgtgaggagatcatggtcatctttgaaataacagtttcaggactgggttggtgcagaatgaaagcttaggtgagcaacaaggggggattttgtatcatctgaaagggcttcctggtttcagacctcctttctcctggtacaccttgatctctctaactctgccttcacgggagatagaagtggcttttctgttgcgctttgccgtgctctctggagaggtcctgccccctatctttcatattgtaccctaaagggcccatattgtcatatggtagttccaccagcagagttatctctcttgtgacttcttttatctgatgattaggactgatccccagtgaagctgtgaaacttgctttctaggtccctttgccagtccggtcaatcgttgactaacttcagtagcctacccaaatatggccaatgattccacctccagaatgcccctctcctcctctccaaagcattaaaaccctggctcccccaggcatctgataaatgaatacatactcttgtacttacggctggtaacaactcactaagttatgcctcacaggagaatgtgtagtttaaaagaaacatattaagctagagaaataaatctctaatggtagaatttcaactgccactgacaagcgaatagaagtgatattttaggggccatgagctgcatttatagagctcttctctgtctctgtcagaccttatcttgaggatggaattcagttcaaggtgccccagatggaacaagtgagattcttacccaggtctctctgaatccaaaatcttatcccctgtctctatagcaagatgctgggtgaggtctcctgtgattccctgcccatggcaaaggctagatgacccctcactagagcacagaaggaattcttgcctggacagggaagtggcttcaccctgtttgaaagcttcacttgctctactgatgggaataattaagtgttggccctgagagtccattcccattctccctgtgacttctttcaccagagcatacagtttccaactcccaaagcagcagccttgccctcccggggggggcacagggagtaggggagggctggtctcaccctgggtcatgggtgacttcacctccccttccccagcctcaggtttccttttcttgagtttatgattcatgattatttcatttggatatcttagaagaatcttaaaaatgcatagaatggaaataatctacctcattaccaccttctccgcaaattttttgttgggcttctctagttctgaatgtgataccatcatgttcttgccttgaagcttgggttaactttgattccgccttcttcagccccccagtcaccaggacttgtctgtttgtccttgaaatacccagggaaccggtccttcctggccacctccaatgccatccctaattcagactctcttcatcccatgcctaatagctccttccctggctttctgaaccctgcaggtttcttttacttcaactcctcttttcaccatgtctttcctcactggaacagctgatggttttcatagccctggtcgaagattagaatcctcactctgtcagccacaactccctagcctcgcccaaccccacttttttatactgtttcccaccagctctgtcttctaagcaaagtgatcttccttggagcatattttctgctttttctcatgtgggtgagatttttccttttccaaatgcccttacctctctcatcctctcctcacctgtcctccccctgaatcctttaaggctcagatccaaactccttcttccacagaatccccatttaaactgtactatgatttatttttgtacatctcatttggcactttttgtaggttttcactaattgttaattttcacattttatctccttggttgcaaattgtcttttccatagcacttggcacaatgaagggtgttggttagtgactgcctggttctcattctttctgcgttctcaccttcctttcagtcacagcctgtctttgccccaggaatctgcccttgttaatcctggctatttttcagcctgtcagtatctctgcctgtgttgcctcaaccagtgttccttgcacccctttttcctattaaatctcagcatctcagagaagcagtgtgggccagtgggaagtgctcaggctttggggctgggaggatctgggtttgaatcccagctctgctgtgtggttttgagcaagtcactctctgaggctttggccttttcaactctgaaaatggggaaactattctttatcattaggtaaaaatacataataggccctcaggaaacatttatctccctctcccctccattctcaattcctccttctccatgcagcccttcccaagtaccccaggtgatactcacctctgctcttactgagatcctgtggcatgtacagtgtcagagacatagggctaagctttgtttatgtctctcaacttagagagcggatgcctgaggtccagagatgtggagcgacttgccacaggcttccccaagcaggtaagtggctgagccaggtccagcactcagtcctgcgtttcaggcaggtgtctgtctctgtacccagccaacacatgggctccttcagcttgagggctgtctctatccccacagcatcctgcacaatgttgaatgaacatggagaaggtgcttaataaatacttgttggtcaactatgtgtgtgagtcctacttccctggtgggagtaaagattgttatgttcagcttttgtccctttttggtattcattgcaggcctggttacagtacctgaaggttaatttcagacctaagaaccagggtttttcagtggttcctggggctgtccctacagtattctgcctagctctggagagaatgattctgtggagtgtccatttgtgagcggctccgtggggagaggcctgtgtgtgtagcctcgatgcttgcttataccacttttcctcccactctgtactcctccagcctcccctctttccatctccaccccccacccactccctgcaccatgccgctgctctccctgctctaagaataaatcatcactgttgcatagcaacgagtttggtttcctttactcctccttctcctcctcctcccacaaaagtgcctcagtgctaaatttaaggtagtgtgtcaggggatgctatcaccccacaaatgcctctgaaccccagcattgtttccctatagctactagctttataaggacagaaactgtgatggcttttttttttcacttttctaccctcagcacctaatacagtttctagtactaggcacatagtaggtgttcagtgaaaatctattggatgattaatgaatgaatcattttattggaattcttgcagttaagaggtgcttctgggaaggggaaatgttattgcagactctgggattatccataattcacctctcttggctgggtgcctcccctcctttctttccgcagccaccaaaaaagctgatctagcaagaaaaggcacatatttcttcatatctcactgtcatgtggatggtggatgtgtttccctctctattttctggaaactggtggttcaggcaatccacatggtttattgagcccaatgggaagtaccagtctaatggggctttagggttgggaacagattgctctttttgatgacaggagtatgaggcttgttttctggggaagatggacgtctgtgagctttgaagtcacaaagtcctggatttgaatcccagctctgcaacttgcgagctgtgtggccctgggtgggtcccttaacttagttcatgggttgtaagaattgcatgaagaaaactactaatagagcctcacagagtgctaggaaacaagggtgcccaaatagtgtgtgtttctttttcccctttaaatggagagagagaaacataccagaaaatacctattaatgctagtgatggaatgccatctatacatagacaggcaggacaaacaaaggtaaaccaagtgaaatttaacaattttggtgtcctaaaagcttccaataaagactaaaaaggctctaatgtatatttgttcaataaataagactggcgtcaaattctgtttgaaagtggggcatatatcctaaataaataaattttaaaaaagccagttttcattttagaacaggataatctgaacaattggaagctattagatgggcagtaagggggggatctaaggagtgtctcttttggggccagagggagtgttctccttggacctaacatatgtaccttttttctttttctggcctgaaaaataagtgttggatttcacaactgactccctagctaccctatgttcatctccttccaaacattcccaaatagcatcccaaattgactcagttgtagcttcatggagtaggaagtccaggatccagagggagaatgacaagtccagctgctcctctgagatcctggaactagaggttggagaggaggctgggaaggggccactgttcagctaaaaatagcagcatcagcaactaaagagcagccagagatcagaacctggggcagccccaggcacgcattcccagcagagaagtctgagcttagctaaatttttccctgctccttaggaaggggtagtgggtactgcctgatcttctgtgtcatctgtgcatctgtgcctgcccacagtgggcagctagcatctccccttccaggtatgcacaccacttccttgtcattgtcaccatcatcctcgtcctcctcctcttcctcattgtcctccttctcctcttcctcgtcctcctcctcttcctcatcatcctcctcctcctattcctcatcctcctcctcttcctcgtcttccttctcctcctcttcctcatcctcctcctcttcctcatcctcctcctcttcctcatcctcttcctcttcctcatcctcctcctcttcctccttctggttgccatttctcatcctccccttccctcttgtctctctgcagcattaccacagcagcatccatttactagactttcataaacgagtcactttttacagtgttcttgggcctctgtcgtctggaagtctgtagtttgagatggcaccctggactgaaggcttccaggaaaacaatccaagcagccattaaataaacatgaaatagatgagatagagtgttcttactctgtagaagttgaggccagtggtatttgtggagccttctgggtgtgtgttcaagaaagcccaggagtttcctgcttgaaaaaggtgagggtggactaagtcagtgctttcctagggaccagtgtttgaggggaggagcaagcccttctcttatgggcaagaggatgcttcctggctagagcttaaggctggaccttgggaaaagatgcccagcagctggaggtgagggatctgaggagacagggttaaggccatgttcgcatttgctccagacctatcctcctccctttatcgatctactgatccagtgactccctcattcatctactcaacaaacatttaaggaactctgctacgtacctgtgtggatgggagagtgttctaaatcagtgagttttcaccctagccacacgttggaattgcctatggaacctgaaaaacgctgatgcccaagcttcaccccagatcaatgacattaaaaagtctctgggtctgagatgtaggagtgagtattgtatcagagttccctgagtgatttcattgttctgtcagggtagacagccactggtctcagtgacatctgaggcttcttcctgtggcagtgccactcactgcccctcttcttctgagtgacatgaccaaaggtgtgacttgcagtcactgcagcagctgctactctgtgcccacttcacataaacgtctactgagcagctagtatgtgcccagcattagagagacacagagatgaggctaacagtatccccaggaagtaaattaatgtaaccactccatttccttaaatgtttatctggtgagccagaagccagcttttctgatgaatgggattttctgagatttgtcctgtcttctccctctgtggaagaaactgtgactatatctggtacgtttcagttaaatggagatgaagcaggtggtaaaaaagacacacacagaaatagatggaatgcaggcaaacagggagggatgttgaagggacaaagtgttctctttaggcaggttttcaagggtgcaccatcaaggtgaaatcatggaaaggtaaaagtaaataatatgcctgtttgagtgcttagattatcagcaggaattgggccctcatgaggcatctggttctgagcacagtgggcatgaccctggcactcagagagcatacaatcctccttggcaattaaaaccaatatccaaaacacagagatcttaagccctcagttgtgtttcactgaaagtaaggttcctacaggcttggagaagggaggtaatggagaagtgctccctaaagtgtggtccatggaactgctctgccaaccatttgttgtcagtcagtaatgaggagcacagaaatagaaaggaagcatttagaaactttatagcaatttgccagagtaattttatgtctgttgaatctaaaaattaaaaaattggaacttttgtttttaaaattgtactttgctggtaattcattttcattatagtttactaaagtactagtctataacagattagaataaaagcagaaaaaaaaatcaaactgagccttcactgcaaatggctcgaggagaagcactggactggaaatttgagacatcctggcaggctagagaggtactagaaggtggggaaagggcagatgttctatcggatgttaaaaagggagtaagggccaggctcagtgtctcacgcctgtaatcccagcactttgggaggccgaggcaggcagatcacttgaggccaggagtttgagaccagtctggtcaacatggtgaaaccccatctctactaaaaatacaaaaattagccagtatggtggtgcatgcctgtaatcctagctactcaggaggctgaggcaggagaatcgcttgcgcctgggaggcagaggttgcagtgagctgagattgcacctctgcactccagcctgggcaatagagcgactctgtctcaaaaaaaaaaaaaaaaaaaagaaaagaaaaaaaaagaggtgggggttagtaaatcctggaaacctagaacttatccatgagtgaggctctaaaacaacaaatatttattgagttatttgtggatgctggaactataccatgtgctttatataaattattttattgtctccttttacaaaactatgtgagataatagcgctcatcaccatctttgttttgcgaggcttgaaaagagcaagtaaggtccccaggttatcacagctagtgagtggtgggcctacattttaaagccaggtgtgttggactccaaagcctaatggtttataactccccaccccatgcagcccctccaggtgagagggagcacaggcaataggctctgcccatccagacattccagaatacgaatgaggagaaggccctgcagattcagatcatggagcatcttctataagcaagtgcttatggaagatactctgcctcctagggagagacagagtgtggacttttatctgacagttcttgctgtctgtttgcctccgtgttatttcaagaagtatttgagtaggtggacctatcctagtttgggccttttattaggttttgaattgtcctgtcagtagcttgtgttagtggcatctccatccattagaaaaaaattattttgaaataattataccttcataggaagttgcaaagaaacatacatggaagtcctgtgtgcccttcatccagcatcccccactgttaacatcttgcacaactgtagtacaatatcagactaggaaataatccacagactcatccatccagtttttctcccatattctgagaatcacattttaaaagaagcatcactaggccaaagtgtatctggaagagggagagggtggttggtctagaagccaggtcatatccagaaattctaagggactgttgtgagctttttgcatatagatgctgtatgttatttacatgtcctgtcttagcacctaaaacagtgtgaggcacacagttgatcctcagatgttttttggattgaatgtttgattcagagcgtaaaacctgtgtacacacataatgggtgccttccgtgttgtggggcctttagtgaggaagaagggtgagatttgtctgtcccctattgctctagaatgcagagctgggattaatgaaagtgggaaggatggaacaagaaacatcccacccagatgtatagaaggacttgaccaacaatgggaacaatgcagcagggatgtagtcggctcccctctactggttgtgtttagtcagtagcaggccatcaggggttcagtgggatgattaatgcattttttgtttttagtactagatcagatggctttaatggaaatctctttcagtttcttgtttctgagattctaagaacatgtgcttatggacagaaataggataactgggaaggggcaccagtttatgagaggaatcttcatggagtttgaggaaacagcaaaactttctcatggaagatcacctgtagattttgaaaacactgtatttgctttttaaaaggaagatcataggcagccaggtatgaaaccccttctcttagtgtttctgtgtaacctgtggaatttgcccaggggaacatctagagttaacctggaaatcagatgcttttctttcaggcagcatttggcaacatcaaaacatcagttctagagaatattgtgggtgctagagtctgactataggtgacatgtttttgtcatgttaatcaattattgaaattaaggagaagattattgcaatttctattccaggaaatgaagcatgcgctgagttaatcagattactttcaggtgaaaaaggaaaaaaaaaataggtaaaggttcttaaattaggccacctgagaaggttattatatattcatatatgattacctggaaggtatgaatttaaatgatttatgtttttatttcattctggctagcaaggaagatagaaactattcctttcatgtgttttaaaagctcacagaaaatccatcattttttagttggggagaagagaaaggaacaaaaatgtatttactgcctactatatgccaataactttatattattattatgttaattttcacaataattctgatgggtatattttatcattattattttatgactaaaaaaactgaaactcagagcagataagtgttctggggcacacattgagtgaaaaatagagctgggactgaaagccaggtctggcagactccaaagccagtgctctttatgctgtttactattggcggcatgcaaccctagcagaatccaaactgactatgttcatgaatggatttcagaacttgtatgtctcataaccacaggtgtcagttccctgtctgtagcaaagtctgcccagatgagtctaccattgctgatgaccttttgtagtagagtcagactcaggcattgaaaccattgctacaagtaggagtcttggcacctacctatctccctgtaccccccagtgcctccacaatgcatgatcttgaaggtgaatgctgtcctttcctttgactgtggcacagcttccagcttgcctgctgcccagtgtctaataatcctagcttaatttttttccaagttttggaagtgggatctcattctcttaagtggcttggagagaagccaagagaccccatggtacaaaggacagagcacatgacaaatatgttctatccatgctatggaacttgccagccatgtcgttttaaagagtctcttagttgtctgagtctcagttctttcaccaatgaaaaggggataatactaaccttctctattttcattgtaaggtgagtatgagattcagatgctattggtatctaggaaactctgaaaataataaggcattatacaaatgtaagagaaccatctgtcctctgcaaaagctttcctccagaagaggtgaaagccaatacacacggcagagtagggaaacatcagcttttactagccagccgggttccgttttgctagaagtagacttggtctctgtggcctcctcttttccctgaatagcatagctgtgtttcttggcttggcttattgaaataattgctcccaatcttccctttccaatgaatgccaagctgttagacctgaactacagccactggctgaagccttccaaagatcctgattgggtggactgtgtcttgctcagcttaatttgcttgctggttatgtaaatattagggttgttaatcttcattagagggtgttagccaagaaaaattgtatttttataaacctgtatattaacatggggaaaaaagtaaaagtaaaccaaacaaaattgaacaactttgatgccctaaaagcttccaatgaaaactaaaaagccccttatgtgtatttgttcaacaaataagaccatggcttcaaattatttttgaaagtgggacatagatactaaataaattaaaaagcaaattttctttttttttcttaaggaatgttcaagttttttaaattattattatactttaagttctagggtacatgtgcacaacgtgcaggtttgttacatatgtatacatgtgccatgctggtgtgctgcacccattaactcgtcatttacattaggtatatctcctaatgctatccctcctccccaccccacaacaaattctcattttgaagagaataatcgggataattagaagctatccattttgctgtcatttatagatttgagtttgcaaagcagttttcatggattttttattttcctacatggactttattccttaaatgtagtttgtgtttatattttcatgttataaacttttcactgaagtatagcaagtgtacagaagagtgcacaaattctaagtgtacagctccacggatttttacccagtgaacacacttgagtaatcagcacacagatcaataacattatgagcaccctagaacattagcccctgcagggtccctttctgttgactagctcctcctctcaagggtaatctctgtggcaactcccagcatcatagattagtttgcctgttttgaaacttggtatatgtagaatcctaaaatacacactgttttgtgtctgtcctcttttgttcaatgttatgtatgtgagattaatccatgttgtgtatagcaatttatttctatattgtataaatatgccacaatttatccatcttactgtacaaggtatttgggttgtttccagcttggtgctattatgaataaagccgctatggatactctcgtacatatctattgacgaatatatacacccagttttgtggagtatatacctaaggggaaataccaaggaatggggtatgagtatgtttagctttaataaacactgccaaaaagttttccaaagcagttataatgatttatatcttcaccagcagatagaacacttcccattgtttcatacctttgccaatatttggtattatttgtcttttccattttggcttttctgctaggtatgtggtagtgtcacattgtgggcgttatgtttttgttttttgcatttccttgatggctaatgaagtctagaacattttcatatgtttattcgccatttggatatcctcttttgtaaggtgaatcttcatgtcttttgcctcatctttgctattgaattatctgcctttttcttattgagttgtaagagttctttatgcattctgaatatgagtcctttgtggaatatatgtattatgaatattttcttccagtctgtgtcttgtctctttacactccttatgatgcattttcatgaaatgaacatatgttattaactttattgtggtccagtttattattttttcttttatatttagtactttttgtgtcctgtttaagaaatttttgtctactgtaaatatttcctactgaaagctttattgttttacttctcacatttggatcagtaattcatttggaaatgcttttagtgtacggtgagaaagagaggttattattactattttgtattcaatttgagagcaggtactgtttattaactgaccagcttagaaaaataatcatggtagacaccttagttcattctaataagcctgttgatctggtcctccctgttgccagcatctccaccttctacaaaatggatggtctttttcttcattctgtctcatggagaagataatttaaagggccacaggaagttatttgcttctttgaagcgttttccaacattatagatctcatgaatcagatccttcctgcagatgatgcaagagatcgaacaatcaaagtgttatctgtcaaagcaattcgcttcttattgattttgccataaccacgcttgtagattagttcatttactgacttcagatttgggtacccctatgcaatatatggttctacagtcctcagcatattaattgaagtcttgttaagcttcacaaaggttccattgaagatttgacgaaggcgaagaagctgcaacacctttcggacctttgggctcacactattgatacctctgatcctgatgacaaatgccaatttgggttctgcaggtacatagaagttgccagcttttcttgccatcctggccattcgaatttcagttctgtacatctgcctatattccttgttacagtgcttttctttttctttttctttttcttttcttttcttttcttttcttttctttctttctttctttcttttttttttttttttttgagacagagcctctctctgttgcccaggctggagtgcagtggtgcaatcgaggctcactgcaacctctgctgcccgggttcaagcgattctcctgcctcagcatcctgagtagctgggattacaggctcctgctactgtggctggctaatttttgtagtttttgtttgtttgtttgtttgtttttcattgagacggggtttcaccatcttggccaagcttgtcttgaactcctgacctcgtgatccacccgcctcggcctctcaaagtgctgggattacaagtgtgagccactgcacctggctgtgctttgctttttcatagataagcttcctccttgccttttgaagcacctttgtgcaaacttctttctcaggtgcttgatcttcagctctgtgaaattccttcactttttcttaaaggtttctggcacagcaggaaccttcttctttttttaattttttttaattcttttttaatttttaaattttttaattttaatttttatttttttattattattatactttaagttttagggtacatgtgcacaatgtgccggttagttacatatgtacacatgtgccatgctggtgtgctgcacccattaactcatcatttagcattaggtatatctcctaatgctatccctcccccctccccccaccccacaacagtccccagagtgtgatgttccccttcctgtgtccatgtgttctcattgttcaattcccatctatgagtgagaacatgcggtgtttcgttttttgtccttgcgatagtttactgagaatgatgatttccaatttcatccatgtccctacaaaggacatgaactcatcattttttatggctgcatagtattccatggtgtatatgtgccacattttcttaatccagtctgtcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttcaacaatggttgaactagtttacagtcccaccaacagtgtaaaagtgttcctatttctccacatcctctccagcacctgttgtttcctgactttttaatgattgccattctaactggtgtgagatgttatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaacttgtttgagttcattgtagattctggatatttgccctttgtcagatgagtaggttgcaaaaattttctcttcattttgtaggttgcctgttcactctgatggtagtttcttttgctgtgcagaagctctttagtttaattagatcccatttgtcaattttggcttttgttgccattgcttttggtgttttagacattccctttgaaaattggcacaagacagggatgccctctctcaccacttctattcaacatagtgttggaagttctggccagggcaattaggcaggagaaggaaataaagggtattcaattacaaaaacaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacacgaataacagacaaacagagagccaaatcatgagtgaactcccattcacaattgcttcaaagagaataaaatacttaggaatccaacttacaagggacttgaaggacctcttcaaggagaactacaaatcactgctcaatgaaataaaagaggatacaagcaaatggaagaacattccatgctcatgggtaggaagaatcaatatcgtgaaaatggccatactgcccaaggtaatttatagattcaatgccatcccatcaagctaccaatgactttcttcacagaattggaaaaaactactttaaagttcatatggaaccaaaaaagagcccgcatcgccaagtcaatcctaagccaaaagaacaaagctggaggcatcatgctacctgacttcaaactatactacaaggctacagtaaccaaaacagcatggtactggtaccaaaacagagatatagatcaatggaacagaacagacgtcagaaataacgccacatatatacaactatctgacctttgacaaacttgagaaaaacaagcaatggggaaaggattccctatttaataaatggtgctgggaaaactggctagccatatgtagaaagctgaaactggatcccttccttacaccttatacaaaaattaattcaagatggattaaagacttaaaccttggacctaaaaccataaaaaccctagaagaaaacctggccattaccattcaggacataggcatgggcaaggacttcatgtctaaaacaccaaaggaaccttcttcttcttctcttctgcaccctccatggttccagccagaaaaaagagattttttttctcctgttttgtcatcagtagacttgaagacatttattgaaaataccattctttcctcacagcatcacaatgtcacctttgtcttaaatcagaggtgccaccaagtagttgatactaccttgagtttgattgtactaagtaagtggcttatctcttggcacaggcaggggtgactaagaaaggccaggacaggatcagaggtctagaacatttccagatccactgccccacagactaggtttaaatatccttctccaagtaaaataactttaatagaatcatagtatgaacacacagacagttcacaaacaagacagttaagaaaccatcctctccattagaagatggatatggagtggaaccatatgaaatggaatttaaagaaatgcaatacctactttcaggttaaattcagtttttcacaagattcaactgaaaatgattattactttgtctaataccagttctcacaataagggaaaggcttttctggaaacaggcttggctcatgcccatttcttggggttcatccatcacatctccctcagctgagtgcagaattagacacacagagcctttaccttcttgcttattttaattactctgtgaagggccttttgtttgtgtccagccgcttctggcaacctgaaatctttcaggatttctaagattcatctgggtctgggatgctgataagacagggtctccttagatagatggacacccatccaagggccccatccagcttaaactatggagaacatcaactctctggccaagccctcattcatccagagaatacagcttccttccatcagccagattcagggtggtatatgaagtggaatccctcctcttaggggacttggacctggtctaggcacctttaagttcagggagtttccctccacctctgcttctctctcctggggctgacccgaaagtcttggctgccataaatgagaaacattgttcagcaaacaaacctcattggagcaacagcttcttttgtaagtttccatttggtgaacaagtgcagttgaataccttctgtatattagcactcaacatctattcccagtccttgggatacttagtttacctctaatagtctctacttaaacttggggcctgacaaactttattaatgcttgatcacctgacctcaagtcttgctcattcctgttccccgccatgttagctgagtattttgtaatgaatctcatctgtctgctgtgtattatgccccactttgaacctgtgttttgacttgagtgaatccatgtcctattaaccagcaagactccaacttagccgaagtcctaagttcttaagtatcttgagatgcttcgctgctgccccaggatctgccattgagctcaggacaaagcagtgcacttgtcaagagagaattaatctttttcgcataatgccatccatgtgttggggtcctgtgttttccctgtgcccaatgacaaaagataaaacaatgacatggagttaggactgtggcataatgtcccaattgtcatgccttattttcatcaggaaagagtcccagtcactacaagcctttgccaccctagacgttgcataattttgattttgttcacccatttgctctatatgtacacagaatggctattttaggctctttaatgtctgttcttttaaaatagctttttaaagagactcttctgttttgtgtttatgtttcttaatctctgcacatttaaaaaccattgtatataatagagtcacagactttcagaacccagagatattagatgccattagttcagtcttttcatgactacataatattgtgagatttatctctctagagatatttttaaacttctgttataatcacaggaagtcagagctggaagacaactaaggactgtgctaggccagcaatgtcattctacagacaaggaccctgaggaggcaagtgactggaccacacaggcagtggtggaatagggtcctgaatctccagaccctcagtctggggctctttgttcgtgtagacagggctgcttctcacttccaatttcacttcctaattgtaacccaaagacagctaggagtttgtcgtggaatctgtgaatgtgcttgttatgaaacaccaatcactgccaggatttaaggtaacatagaaatacccgaaatgtcttttgggcaagagccatgaatcccaatgggagtaggctgggataagtagttatgttaataaaacttttccacatcaaaagtgtgagtcagattcaatgtataaatacctttaagaagttacacgcagagggagtttagttttagtacaaatagatcatttgtttgcatccctttccgaaataaggggggtagaagttatgtctttcaagttacactgatcactaaaaaaaggaaaaccatctgcaggagggtccttttccttgtggactgctgtcctgtgtggtatttctgataaagcttgagtttccagtgcagcagaggagaagaggagagtgtgtcttttcttcccttttgtcttaactgcattcagaaaattccacctctgcccctttcccctgcgaatgcccctggtcccagctccttcctgagtcctgttgctccaggtgcagtggctgtgggtctgggacctgtgggaacctcctgtgatggagtacagagcactgttaaggagaaaggaaacatcagagtcagctcttcttctgctcctcagggctccccttttcctgcccatctttctcctaggatagactggtctacgcagagaggctcacaggtgtgccttgtaaacttcagaaattattctacccgtcacactcagggtttgtttctgcctgctttgtgtcacctccaccccaccctctgctcctgaagcagggatgtttgtggctgaatgaggagggtggagtagatgggagtgtgtttacagcctcctctgggcttctgcctggtgactagaaggacctagatgggaacattgtggaagagatagcccacttctcccaggaagctcccagtctactgaggagatgataattgcttatctgatggcctctggtataaagtgatgcctgagctgagcgtttcttcattacctctcagatgccagcaccagtcctaggctagtgcatcagtagaagccggatctgagctgagatggtgattctgtcctctctggagaggccattgtccccaagaggcattcatgtggtgatttgcaaaacactgttgagtttctctttgcctgtttggggatttttatgcaaagggatctccattcctagaattcactgaaagcaatccctgacatgccctctgcaactcatcatgttaatgggaaagaagggctggaggccagccagggtaccctcctccccccaccacccgccaagccatgtcaggatggctatattgattgcagagtctgacggaagattacggcaatggatggggattcacttggcttttgcaaggccactgacagtggagaaataaagctctggctctggagcctgtcttcttaactgggcttccatccaggtcttccttgccatccccctactccccctagtccatgatgcacacccaaccagatctggcttccctgaacacctcttagtcaaactccccagttgcttagaaccccttaacgggtcctgttggcctggactcagggccctataggatcaggtatacatctacaaacaattgcctttacaaccttatcactgataaagcctgccctctgcagtgaaacccaccatctagtcagatggggtcttctcatagtcccctaaaaattccaggcttatttgtacctctatgcctttccccagatttttccccatgtcttctgagctcacctccctccatctgctcaaattcagttcctccttgagtacttggcttatgccacacctccctaacccttggcccacatggctttttcttttctttctttcgtttttgtttgtttgtttttgagacagggtcttagtttgtcactcaagctggagtgcagtggtgcaatctcagatcaccacagctttgagcttctgggctcaagtgaccctcctacctcagccccccaagtagctgggactataagcatgtgccaccacgcctgacccattttttgtattttttgtagagatggggttttgccctgttgccaaggctggtcttgaactcatgagctccagtgatccactagccttggcctcccaaagtgctgggattacaggcatgagccactgcacctggctggctttttttttttttttttaaactttctatctcttttaaagttaactggttacattttgccttctctgctcctctagctgtgcagtagcccatttctctgatgcgtaatacctgagggtaggaactgttagaccctccagtccagggcaaaatgtgagatgaacacatgctatttcttgggtaaatggggagagatgaatgcttgaaataatgaactctctctggacaatttagcatcatttccttcttaatccggtgttcatatacccgttgtaaagtgaggactagaggtactgatgggtatggggggagatggaagcaggattctcagaagggtttccagcatagcagtgatgatgagcaggattgagatggagcaggtgctagatgaaaaaacgaaaacgaaacccaaagaaaataagaaattgaatttgacataccttggtgaaggaaggtgggtgtactgagttgaataaatgtcccttgaaagttcatatctatctgaaatcttagaatgtgaccttacttggaaatagggtctttgcagatataattagttaagatgaagtcatactagattagggtggaccctaaatccaatgacgggtgttcttgtaagaggaacagaggatacacagaaaagcagaccatgtcttccatgccggcctggatggaggggcccatcaagcactcagggcagcctcaggatgatgggaagccatgggccaagccatccctgcaatgtgcaggagggagaaatcacatcagatgggatctcttgaatgttcacgtttttatgaagaaggaatctggttagaatgatcaggaataaaagaggtctgtgcagagagaagggtgatggggagtgtactgtggtgcttttgtgaaaagtggatgggatgtgggtttgcttttatgtgagtgaaaagagaagagaaggaaaggaagtgtgaaatgacccaattggttttttgcaatgaatgatgtgtaagaaaatggtcttttttttttctgggccatcaggcagctctgactatctgtcagatggagtcacatcaggcagagggtggggtaagagacagcctggcctttggaggatttccttaggtaccactccaacaccttctttctcctccttggtgtcggaggtggtgagggataatgggatgcacactgggagccttctctggatccctgcatggtcagtgccctgtctgagcaagtctgtccccttcttggattcttggtcttctcccatgtacagaaggcttacaaagtttatgtgagcattgaggaaaaatattttgtaaaccttaaaatgctgtataatattgtatcctgtagttctccaaggactgagaaggaagatagggggagtcttaatcctttggggtttgagggaggctcacatactgtgtgaaaagtaatgaaggtttcagtttgagatgatgaagttctagagatggctggtggtgatggttgcacaacaatgtgaaaatgtgaatggactgaatgccactgaactgtacacttaaacatggattaaatggtcaataatatatgctatctattttaccatgatagaaaagtcatacctccatccctcccccaaaaaagtaatgtacatacaggacaaagctgatatgtgagtaaatttgccactccagatatttacagagcagttattaacattttgtggtgaatgcttgtatttgcaatcattgcgaggaattaggactggttaccaggactcaacacaatatattattgttaatgcttttggatggctctagaaattcttttgggagggagtaaattatgtcacaataatggaaacagaagtgaactataagctgaacttaataacatgatctgagatcgcttctccccctctacccctgccttcaaggttgttctcctgccttagcactactttttctttgtttctcaatttactccttatcccagtaggtcaaggtgaaaacagatttgcatctatagtacagaaacatgtgaatcttctgtggcctcctgtatgttactaaaaatgtctcgtgttattatggactctgtcctgtgggccagactttgctcccagaaagaagcaagaactatttgcatatctcccagatcattcattctccaggcctgtgggcatccacatcaaagccttataggatcacccccaattgtctccttcctctagctccaaggtgtttttgaagatcagagccataagtatgattactgcttgagggtctctgcatttctgaggagtctcccataggctgaaggcccagaaagtaactcagaaaggggttgaaagatagataccttttggattgagaaattgttttacttcatcacaaaataaagtacttacagtttggggtttaaatactgggacttgtattgtacctcctctaaatcatcccagaaaatgaagcagagaacaatgttcaatgtagaactgcccatggtgccagatgattttgagtcacatacagagccaggtacagctctcaaatgttatgtctacttgtgtgacaggcagccagtttcctaagagggggttgggggcaggaaaaattcagtgccttcattgtgggctgcttcttgttgaattttgctccacaggttagaagacaggtcccagtcttcctaatgaggcattgaaagtctaggtggaatagatgcttgctggagcctgtggatattataaaagaaagagctcactgccttaatgtggtcaggagaggcaggagtgagagccagtgtgaaggtgtgggagttggaaggaacttggaactcaacttcttttggcccctcaacttgagattcacaaagaaaaaaagcaatgtctcctcgctgaaaggtaagagtttaaaatttatctgaactcggaatattatagtttgttttggctccagtggcatgtttccataatgtatttaaatcacaaatccctgctctgaggcaaagtcaaaacacctggtcttagtcctgaggtgaggccctcagagctggaatagtgctttgccctgtacaggggccattatccgatttatatacaatgcagaagattgtctagaacctagagaagcactaactacagtcttatccttttcctccttagcaaaatggaagctcctccttgcacagtgcagccccttcctcactgtaggttattccaagtgagaagagtaaacatgacttctaaatgccatctaacgatatatgcatatctaaaggagacaaggatgactgaatgcatcttcatgtgtaggaagtgaagtgtctgttgacattaagtacttcttcatgagtgagaggaggcccatgatggagatgacaccagtacctccttctagcactctgaattcccaatgtttactactgctgtctctgaaactgcagcatcctcaccaggaccacacagggaacaaaggcaagacacctgaaatccctttagccatattcacaacacttacttcatagataagatgatgtttgaaatatgagaaggattttttttttaaaagagcactctattctcttggtatcctagtatgagtgcctgaaagtgcacattggctagaaggtttcatgtgagcatcagccccagggtccagaagacactcttggcaagcctggagagtgagtatgttgaacaggcaatggaagcatccatgaaaggcaggcaactgcgcacgactttccaacagatggctggtcagttgcacagagggaaggagccatggattccatgataatgacacttgtgccagcttttgtgtttccagaagttttgaagatataagggaaccaccacatgtagagtatgtgaagtcttacagagacgaggtcctaaggtatttattttgacaaatcacgttgcaagtaatgtgaaagcagtttgaagaaaaaatgtccccatctaatgctgcattatggcatgcatttctttagcctaaatctgtcagtgacatgaaaatacatgttttgctggacacataataggttgaacacataataggttctaacatggatctgcataaagaagaaagaagaaaggctataaaggtagaagaataaatgtataaatattacaacaggacactgagctgagtggctctttaccatagaccttgctcatagttctcactacaggcttgctctgagccaacttccaagttctctccttctccttccaaacttccctgtatgtcatcttgctcctgggccacctgactgatgtttaatgcctggatatttgctttcacctctgcatgaccaagccttggccaagtcactgttgactcagttgcaacatctgtcccctgctgagggctgttgtagctttcatagctcacagtccagcttgaatctaaccttttctgtggtcattcagagtagcaagaagcattgtgttttggatttactgcagaactcacacacttaactgtacacagtcagtttttatagctatcactgcatccagattggacagtgaccttggctgagacatcctttacctctgtttcagattaatttaggcggcatataaaatctctgtgcactgccaggggaaagtaaagacttcatgaagaaatggagaagagccgaatagttgaccattgttgctgtataaatcttggatccagggctaaaaggtggcagtataaatgcagatggtgctgctgccatattttcctggcacacctttaagcagcacatttcaagccttcagggttggaatggcatttccaaatatagactcaaaaaatcctcagatgtttgattctagaatagagctgggaattctgtcctgcaaatgccttctgcagcatgggagcaaacccactcttctgtgtctgttgcttcaaactctctattttctggaaactggagaaagatgtgggtctacattttgaaatatatgccttgaacaagaattatgcacctatagaaaacttgtcatacattgaataaactctcagtttacagaaatctatggaaatatcaaaataaaacatcagaaggagcagtaactatagaggttattaactaaggggataacctgaaaaataaagttatatttgctaaaaactgtatttgattagtttggacttcttttttcctatccctttcctgttttatatttatattttatttcttctaaaattaagtgatctttcactatctaattaatattgtagaaaatgtccaagtctagacattaggacggcttttgttatttaagtcacatgcaagaagcagcatggttttgtggagagagctctacctttggagtccagctctaccttcggtgctaaccccaggcatctttgtcccgatcatagtacccctctgggcctctccttatatttgtaaaatgaggggggctctctgcagtatccttctggctataaaatctatcagctctcattgctgaaggtttcttctgttcagagtttctaggtttctcgtaaactgaggagccagaggtcaggaggaatggaaacttgttattccttttgtaacattgttcagagttttaaatgaaaacacaagtaattaatttgtcatcactgcttgaacatattatactttactgaattataaaatataatctttagaaaaacaaatttgttatgagaaataaatgttgctgcttgtctaaaattttttagggcccttcaaattattgcctacagtaccacttattagccctggctgtgcattagcatctcttagaaagcttttcaatatgccagtgtctgccctcccaccctcagatgtttttatctaatttgtctgttgtggggcctgggtaccaatatttttaagagacaagattgagaacaaattacgttcaattaccaaggctgatgtatgcatggttcccatgcatggcttgtacctatccacctccatagcaaccacatgtggtcccctccaacatgtcgtcatgtttcacacatgtcatttcacactgctccttctttgcgtcttctgttgtagcctggaatgccatgccctaagaggcttagactttctcgagcccctccctacagtatagatttctttattagcatagctcctgtactttgtaatggcctgccttgcactcattcttcctgtattgtaaatattttatccaccattgtatatatttatattcatacattggatcatgtctcttgggcttaatgcccaccccttccaagtgctttcgcactgtacctacctcggcctgtaaggcctcacatgatctctttctcatgtgctctccctgaaccatggcctctttctcaaacctctcttcctaccacttcctgcttgttcacttcacttcagccttacaagcctcctgaccctcaaacataccatgcttgtcctcatctcagggcctttgcacaagtggctcctctgcctggggtgtcttcttcccccgctcatcctcccatctgcctgctccccagcattcaggccctccctcaaatgccatctcctcaaagtggcctttcttaaccaccctagctagagtagcctgtcccccactctaccatcccagcgtcacaccccatcccactacttctatgttctttgtgggacttgtattatctcaagtaatattgttgttttgtacacatgatttttgtaagcctcccattactggaatgtaagttttatgaagatagcgactttgtttagtgggggcttaacaaatattgaacagatgaaggttgtctcccctatgagatagtgcagtgcctagtgtagtgactggaaagatggtgttcattaagtgcttcatgagtgatgtttcatagatgtttctccttcagaagcaggaccaccagatagctcaaataatactcataaaaattatttttttcacattttcttaatttccagctttaaaaagcagagaaagtaaatatgttttttctttttataagaaaattatattatgtctctccctaacttaaaaatctttatttccaggacccacacctatggggactccctctctccaggagtccgttcagcatataacaaagggaaagggattcctctggaaatcagttttgcctagaagccccaaatttaaactgacaccgctgctctgagccaatgtgagaggaaacagatgtttttttgaacatctaaatttggagggcccggcgtggtggctcatacctgtaatcccagcactttgggaggctgaggcaggtgggtcactggaggccaggagtttgagaccagcctagccaacatggtaaaaccccgtctctacttaaaagaaaaaatacaaaattagccagtcctggtggtatgtgcctgtaatcccagctacttgtgagactgagacaggagaatcatttgaatctgggaggcagaggttgcagtgagccacgatcacaccactgcactccagcctgggcaacagagcaagactccatctcaaaataataataataatgatattataataataaatttggggactttccaaataggtgactggacaggtaaagatggagtgggggtggaccaagagtaaaccctgtgtccttgcagggctctgcctgagcgactgggcccagggctcccttagatccctgcactttactgctgacctgtggctcctatgaaattggctcctgttaagcaggagactctggttgctagtcatggtggtgacagttctaattccttctccctagcttcgctcttaccctgggatacctagaggtagagaataattcagaaagttgtcagaaacactgggagcaatgtttacttgtatggaagagcactggactccctagagaacacaggatctgtaaggtatgacccgaggagaaagatacagcaaacctgttttcccatctgtgaaataaaggggttgagctagatggtttttagtggcttctctgtttctaatctgctcagtctgtaagagtttgtaagcattttgttattgaagtgatcaacattcaaactgtaggcaaaaggtgtttttatcacgtaattctttcagcacagataacaggtattctctgtataaaattgcatgactctctttgtggacactatcaaattgaggtagtaaattaccattgcagcaaagtctggttgggatgccatagagtgtgttctcccatagagtagccaatagtcacatgtagctgttaacattaaaattagttaaaataaaattaaaaattcaatttctcagtcatattagctacatttcaagtgatcaaaatgcacacatcttctctttccagtacagttctcaattggacagagcagatatgtgcatttccatcatcacaggaagttctactgcacagcactggtttggagtgcacccctgccctcagatgagagttgtatagttagggagctgctaaggacccacccatctctaaggctgagtgattctgtgactttgtgttgggaagatcatattcctgctctttctttgctgaaaaggtttttggtttccaaaagtactgaggttggtggagaggtacaaaacaactgcagggagttcctgtctgcctgaggagatcatcattcacctcaagaattacagtgagaataagagaagatgaaatgatactgaaaagccgtttaaaaagttgaagagttatgcgtataaagcaagatgattgttaagtgaatgcattagatataaaggccacttgctcctggaccctccttgacttccatccctctaagccaatcaaaatgaagttggaagtgatggggtttggttgccattggcaactgattgtctactttgtccaagctctggcaacctgggttagataaactatgagaaagttctcatagagcaagcaatattggcttctgctggtttgagtcatgtttaccttggctttaagggagtccccagaatgctggtgagagtcattgggagggcctggatcagtggctcagccaagttaaactaggggaatctccctggggagaggctcagtgataccactttctttcccaaatgaagctcatagaagaggtgactctaccctctctgcttatctcttggtcaactttccgtctgcttcctctcatgtctttgcatcatagttttaactcctgttaaattatgttaaatattgtagaaaaggcaccaaatgtggtaactacagccacatgcctcaggtttggattagatctcaatcggcctctcaaggaagaggacactgggagtgatttggaaggcatctccatgtgtcttcattgtcaacactacctccaagcacatggcactattctgggagctataggaaccagtgacaaaggcacatgattagacaaacacccaaacacaggcaagtatatttagagtatatactaagagagcacaactctaagtgttgactcttgagtggaaagacatgggatttgagtcacaggaccttgatctaaatcctgtttattgactgtgttatctggggctctgtgagcctctgttcactcatgtaaactggaaataataatgccttaccttcagggatgttctaggaatgaatgatgaacacatagtggtggaaggctttgcacattgaggcacataaatgatttcctttccctttctgaggggtcagtgctgtgatttggaggggaatggtggagtgactatggagagtccatgcttaaagaatggaaaccactgcattttactaagcttgttggctctctgtggtttgataatagggtagggatggggtggatttggcttactgggtcagggaggatctccctacagggtaagggctcacaggaatggaactgcctatctctctttaatcctgagccagtggttgatgttttggtagctttggcttctcttcagctgtgggctctagctgcatagggcttgatacttgtgggtaatttgcaactactggtgcagtggaatcccggggattgacagaggggcagtgtgtgtagtttagggggagggaaggaggatcccctgtctccctggcgcctcatgtccagtgaaatgttgtgccaatcaatggcattgattggtctctgatggagatgtagttctattagttcaatttcctgtttcactatagaatgtgactgtatgtgtttgtgagagagacacagggaaggagttattatcaacagtgggcaataggggagtagtcaggggaagagagaggggacagttctctctgggactctcagttgtcctgaacgtgggagtagtgacttgctggagtagaactatggaaattagggtaacagggtatttttccacgaaggaaactagagaaggaagtaagatcagtccgagtgtaggatcagtgttctgaatacaagaggcagatgcccattgttggatatgagaatctaaggtggagaagagggctggcttggttgaaactcaaccaagagcatttcagagttctttcctcagaaaataccgtggtaaagctttagttagctatagatgtacttgggacgtgtggtaaaaaaagaaaaacaaataagacggggacccagtccatcactctgattccttacaaccacatcaaggcttcaagatgtggctttaccccaaggaacctttagcgccttcctggcatctcacaaacttttctctgaaggaatctctcttctctgagtgtgatgaagggtgttgaaccattgggaaggaactttacaacatccactgtgtgccaggtatagtactggtcactttatgtcatcttagttttcataacaactgcatgatctatgcatgcaaaatcccagttttacttattaagaaactgaggctcagagatgtgaagtgtcttatccagcgtcacatggctggtgaataagtggcagtattgggattagaaccccagacctgaatttagatcatttagagcccctaaatgtcaggttaaggagtttggaattcttttaaaaggcaacagagagttgttggctgtgaccaacaggttgatatatgagagaagacgttttcctcttgagtacacacagagaagttgtagatcaataaaagcaagctctaaacctctctcacatttatgggcccttgggcttgattcttctttatgcaatcaagacttcttagtgctgtctggctccagacttggggttttttgaagcctgcagagtctcagggcacaaacaacatgagctgcttgcctaagacatactttataaactccttccacttccacattctttttttttttttttttttttttttttttttttttttttgagacatggtctcgctttgtcacccaggctggagtgtcgttcaaaagattctcatgcctcagcctcccaagtagctgggattataagtgtgtgccaccatgcccagctaatttcttgtatttttttagtagagacagggtttcattatgttagccaggctggtcttgaactcctggcctcaagtgatctgcctgccttgacctcacaaagtgttgggattacaggcatgagcaacctcacctggcccatttctacattctttatgctacccctgttctcagaagtgatggagtaatgctatgtaaggatttgggaaattaggctccaaggtttagtggattgaaacaactatttgcttactggcttagctacttgggttggcatcagctgggcagtttttctgctggtcttacctggagtcactcatgtagctgcagtcatttggcagcttgactggggctggatggtctaagatggctttactgacaagtctggcaattggtgctggttgtcagctgaataactctctctgttcatctttttgtgatatcttatccactagaagaccagactgagtttctttacgtgatggcagaagtgttgaaagagaacgagagcggaagctgcaacacctcttgaagttgaggcctagaagtcacacagcatctcttctgctctactggattggtcaaagcaagtcatgggctagttcagactgagggggtagcaaaatagaccctacctcttggtgggaaaaaaggcagtcacattgtaaaggagtgggcacataaggatagaaggacttgatttggctatcttataaacaacctaccacagaaggacttctgtttttctgatcctcccttaagtttgaactacatgttccctgaggaattcctgcctgtggagatcaaattagaatttggattctcagcaggtggtttaataactgcaagcagttgccttcagagtccctgaataaaatcatcctcctggggtcctgggaaaggctttgatgggtatcttaagctctctctccgcagatcttgaactacttccataggttattggatatttggtgagaaaggcatcttggaggaatggaaatgcaggggtttgggaggtggacagacctggattcagccagttcagtcttagttctgactggctacatggctttgggtaggttacttgacttctttgaatcttattttccttatccataaaataagtgtattcattttgcatgattgagttgaggagtcattcattcaacaatgggtgataataactaaaatcaattccaagagtagcatgagctcaaggcctctcattcagactcctgaatcagcccatctcacccctaccccattccccttcgccttaccttggcttgctggccaaataggccgtgagttcctaaggtcttcctgtcttactctgtcatgattgttgtgagcagggcttatcccagtaggataaatgtacaaggaggaagagggagagagtttaagaaaaccagccagaaagtctgctccagataacaagaaattctgccaaagtactggatggaatagccagaaatgatgcacagagaatctagtcactgtttaggacatgggtgtaagatttggatacacaaggccaggccctgagccttctagctctgaagtcttgggcaaggctttgaacctactaagcctagcttttcttatctgtaccctagcaatcagaattttgtattgcaagttcgttgagaataggagaagaaaatttgccaggggcgcccctggaacatagagagttcctgggcctgtgtaggtgcacagtaaagggtggctttgtgattattctcaaccctctcaatgctgtgctccctgtgtgttgtggctctgctgtccacaggaagtaatggggtaagaccattccaggcttttaatgacccatctcctgggactcaatggctgtattttttaaaagttgtgctttatgtagatttttataaattgggtcctatttcctcattgaccaatctgactattaatctcagtgaaagagttcattggaaaacagatataataggaatgaacagagctgctgcaatcagcctgcatcatcattctagccaggaaattaggcttcaggagattaaataataactggcctaaggtcacacaactagttagtgaaagagccaaggaaccagaatgtctggttcagattggtgattggggggtggggatggtgggaagaaaaattcacagcaagtagactagaaggaagtaaattaaaaatatggttaatatatggagaatggggtggaattgagacattaggtcattttcttttctatgctgatttttcaaaatttgatgaacatgtattgcttttataatggttaaaataagtttgataaagaaaaaataaaaagagaaagcttgggagaacagagcctatgtagtggcctatggctagattatggacctgggtgttccagactggatgtagtgaacaaaggacagacagaattgggaataaacactaactctttcttaggccttgcagaagtgatgctgaggttaatctgaagttacttgggagatagaggagaggggaatgtagagagtcaacaaatcattgtattgaagtttcctctactttgtttgtcttttgccttggcctgctggcctagtgataattgggagaagggggagtgagaggaaagggaccaaggtttcctgtgctttttttaattattatttttgagacagagtctcgctctgtcaccaggctggggtgcaatggcgtgatcttggctcactgcaacctctgactccctggttcaagcgattcttctgcctcagcctcccgagtagctgggattacaggcatgtgccaccacgcctggttaatttttgtatttttagtagagatggggtttcaccatgttggccgggatggtctcgagctcctgacctcgtgatccgcccacctcggcctccctaactgctgggattacaggcatgagccaccgtccctgtgcttttgaatggccatgtgtcagggctacctagaaagatcagggcaaggcctcagaaatccccatcaggatagactgggatgagattcactccaggagctttggaagaaaatatataaaacttgttattgttaccatgacatacaaaatgccccactatttatcattatcaaaaaattcctggtacttccatgggctttctgcagcagagaggtgggtacttttaaaagtatagcatttgggccaggcatggtagctcatgcctgtaatcccagcactttgggaggctgaggtggatggatcacttgaggttgggagtttaagaccagcctggtcaacatggcaaaatcccatctctattaaaaatacaaaaaatgcctggccctggtggtgtgtgcctgtagtccaagctacttgggaggctgaggcaggagaatctcttgaacccgggaggcagaggttgcagtgagccaagatcatgtcactgcactccagcctgggcgacagagcaagactctgtcttaaaaaaaggaaaaaaagtatagcattttatacacaaggctcactagcttgtcagttgctgccaatctgccctcaggtttgggcctttctactagaaactcccaagccaagctcccttcttcgagcacctgggccactcctccatccccaggatgttaggccatttggcaaggtgcccagaagtccttaatcgcatctgtctcccaggaggagggcataagtgcaggattcccctcaggcccccatgcatgtggcctggagctgagcctctgccaactcctctccccctacagagcaggactgtccaggccccttgtcaatggagcatatccagagaaggagagctttcccagaggaaggaaagctgtgtctgtcagagctctttctctcttgatttcagctcttataatccttggcaggagaagatgtttgaggatagctcggtttccgtaagctagtcaccatcttcagaattgagaaaacagtagcagaatttaagtcctagtggggctttctttaatgcctggtcagtccatgtgaggactttgtgttgtccttccaaaggggcagctggcaggaccagtgtcccatatccctgggccagcttgacttctattgtcataaaaaattaatgtggaggatgaggtgatttgtagggccctgcagctggcaggcacagcccagcccacgtgtgcatccaggagaggctttggttctgtacttgccacgtgccctgtgttatgtatggtgaggcacatggaatatcaacagaccaagttctctgcactcaagatgcggaaggaatattaggaatgggagacgcatgcctggaggtaccaggcacctagcgctgtgtgcactgcctagggcccaggcctgctctccaggatgcggagatgcgcgctgccgagggtccaggcctgctctccaggatgcggagatgtgcgctgcgaagtgtccaggcctactctccaggatgcggagatgcgcgctgccgagggtccaggcctgctctccaggatgcggaggtgcgtgctgccgagtgtccaggcctgatctccaggatggggaaatgtgtacagccaagtgtccaggcctgttctccaggatgcggagatgtgcgctgccgagggtccaggcctgctctccaggatgtggaggtgcgcgctgccgagtgtccaggcctgatctccaggatggggaaatgtgtacagccaagtgtccaggtctgttctccaggatgtggagatgtgcgctgcccagggtccaggcctgctctccaggatgtggaagtgtgtacagccaagtgtccaggcctgttctccaggcccagcacagacgtggttgccttgctcaaatcttttagatttcagcctctattctctagctgtcctctcttttagatttcagcctctattctctagctgtcctctctgagactctatgtgaatatcttctttaacatgtctaaaattaaactcagcctctccttcaagatacattgcccctctttctcaagacctaaaattttgagttttttcatgattttctctcttctggggctctttcatcttaggttttagacccagtagcccccctttataacctcttgtctgcatctcttcctttccacccatccctgcctttttaccttttgtgtaggtgcctgcaaagccccctgaccagcctctctggtctggcattactcttttttagcttccccagatcaatcttcctaaaacagcaagtcttttcagttgttttttacctcctagaacagtgacttggcctggattatgttaggatcacctggagaagatggaacgggatgactggagttcccagggaacccaccctgaggaagccccgcagtagtagttgttgaagtgatcattttcaggctcagtaatatccacgcagattacccacatggtgatacgtttttggtgtcttgtaaaatcctggattggcttctctctgccacccaactgtggccatggtctcagtcctcaccgttgactggtgtgtactcagggattttgacactttgggatatcaattggaaccaaatactgtgaagaggataaagcagctgctcgtgccaaaagtcagggtatgcactgtcaagccgaagttggctgacccaaactgtggagggagacaagcaggagaagctaggagtcccggctccaactcaagcttaaccatcaactgtatcaccttgtgtttaagtcatttttccagtctgatctcagtttcttttgatgcaaagcaaggttcagttaggtgctctgcttgtctggtttgttcatagcactgctatctcctgttttcaaggaaatttgggagatgtattttctaactgtagattagttctctccttgcttcatgttaaataggcatccttaggtcttggctaaaaggaattacagactgttggtgttgggagggaacttggagattacctcttacctgatgggtatccacactattcgcaatgcaaaggagacagcagattgatttcctgtcagactcccagggcagagaggcccattgggtcccaagggctcaaagcacttagcaaggatcacctgacctttcctgagaagaggcacactaagaagactaagagagagagggcagtctatctcttcttagaggtggacaggatgcctggtgggcatcactgcctggggcaagtatggtaatggggtttctttattctctgtcccttccttttcacagggcctgggagtctgaggactcagctctgtgcaggatggagaactctgcgtgtgttgtctctaagaacaggcctgccatttctcaaacactccgggcaagactattgcttggcaagtgtggactcaggcaaagccctctgttgcattttaaacacaataaatatccagggtaacctggcattactcctttttagctccccaaatcaatcttcctaaaacagcaagtcttttcagttgttttttacctcctagaacagtgacttagcctggattatattaggatcacctggagaagatggaccaggatgactggagttcccagggaacccaccctgaggaagccctgcagtagtagttggtgaagtgatcatttttcaggctcagtaatatccatgcagattacccacatggtgatacatttttggtgtcttgtaaaatcctggactggctatagtctagtaaaagcatcaagaatggcagctaatttggaggaatattagggagttggggggtcccaaatgagtcagaagctttggtaggggtcataaggagtcattgacaagatgattgtgatgtgctggggagggatggttcctaccatgctaaagatcgctgtattttagtggccagtagcccagaagtttctttttatcctctgcagttttcccagtttcctaagccccatctcttggaaatcagccccaatctaatccatggatctctgggtaataggtggactttaccatagctacttggtccatgcaagtgttttagaaagtgtgatctggacaacttgcatcagtgccacctgggctgctctttcaaagggcagaaacccgggttctacctggatttataggtccaagcagtggcacccaaatgcctacctgagataaaagatgaacacatgtttcatagccctcttgttgtatctacaacatacctctttactaaaagggtcatgtttaaggaacactaagcaagtgctaaaaggaaaatatagtagttccccttttctgcgggtgatactttccaagaacttcagtggatgcctgaaaccgtggatagtaccaaaccctacatatactgttttatcctctatattcatacctataataaagtttaatttataaattagccaccataagagattaacaataactaatttaaaaatacaacaattataagaattatagtcatgtgccacttagtgaacagggttatgttctgagaaatgtgtcataaggcaatttcattgtacaaacctcgtagaatgtacttacacaaatctagatggtacagactactatacacctaggctgtatggtatagcctatcattccttggctacagacctgtgtagcatgttactgtaccagatactgtaggcaatcgtaacacaatgataaatattcatgtatctaaacctatctagacatagaaaagatacagtaaaaatatggtataagattaataatagtacacctgtatagtacacttaccataaatgcaacttgcaggactggaatttactttgggtgagtcagtggtgagtgaatgtgaaggcctaccacattactgtacactaccagactttatgaacactgtacacttaggctacattaaatttatttaaatatttttattagctagatgcagtggctcatgtctatagttctagagctttggaggtctagaggggaggatcgcttgaggccaggagtttcagaccagcctgggcaacataacgacccagtctctataaacatttttttaaaaaattagctgggtatgggggcacacacctgtagccccagctacttgagaggctgaagtgggaggattgcttgagcccaggagttcaaggctacagtgagctatgatcacactatggcattccagcctgctgggtgacagagcaaaaccctgtctctaaaaaaaaaaattaataaatgttttgtttaaccttaggttattgtaattctttttactttatagatacttttgtaataacacaacttaaaacacgaataggtgtatggctctgcaaaaatatttttatattcttattctgtaagcttttttctttaaaaaaatttttaaaacttttaaaactttttttttaacaaataaatacacaaacatattagcctaggcctacacagggtcagaatcatcaatatcactgtcttctacctccacatcttgtctcactggaaggtcttcaggggcaataacacacatggagctgttgtctcctatggtaacaatgcttccatctagaatacttcctgaaagacctgcttagactgttttacagttaactttttaaacaaatatatgaaccagtttttttagcaaatatataaacaagtaacattgttatttattattatcaaatatgcattgtacataattgtatgtgttatacttttagacaactgggagtgcaggtttctttacaccagcatcaccacatacgtgagtaatgtgtgtgttgtgctacaatgttatagcagctatgatgtcactaggtggtaggagtttttcagctccatcataatcttatgggaccaccatcatatatatggtctgtcatttaccaaaacgttgttatgcggtgcatggctattctgcaataaaagttatgcaaatatggtctctcttactctaatgtattttattgtactgtactcacctagtttcggaccgaggctggctgccagtaactgaaatcgcagaaagtgtaactgtggataaggggggactactataattcttcctgagcaaacattttaaaggaatgaatgcccgagatacatagttgtatagcttccttttcatcagttgtccactaaccataatcattgacacaaactttgatcagaacaatgctgagcttgagcctggggtaactgcttgtgtggtgggggtatgttcaacctttcttggtttcatcactgtggctcttctcagctgctgaccttgcctttgcccttccccactggggctattttgtttctcacctgccaaaggaggctgtagcaacttttggcacgagtgcctggtttttctctttctagtgctcctgagcagttctagacctgttgtctccatcctccagctcctaccttgaaggctatagagctttccattaggaaataaaaactttctggttccccagagttcctctgccatgtgctttagtgttgccttcccccagctttcatcaagaaaggtagaataagcgactcctctccctcttccctaacctagaaaaagaagggaaaagaaaagaaggtgcacagggaactggcaagaaggtccttgccagatcttcagagagacccaagttggaatcttggcccaccacttatcagctgtgtgaccttcagcaggtcgtatacactctctaagaagcagccatctcttaaatggcagaagaggacctccctcgttggactcatgaggattcactacagcaacatgagaaatctctagctcagtgaccctcacatattagctactcagtaaaggttgccctcccatgcccctgccctggctctcttttcccacacagcccacttctctctctgctctccttcctccgagttctccatggccccttgcccacgtttattcatctctgtctctcaccccacttcctgtaatgaacaacactgtcctcactctgtatgtatctgaccccaacttacaagtgtgttatatctaaaaatccattaataagtcaggtatcagaactactcttgtgcttttctaggggtggctcacacctgtactcctagcccttcgggaggctgaggtgagcagatcacttgagctcaggagcttgagaccagcctggccaacatggcaaaaccccatctctactaaaaatacaaaaaaaaaaaaaaaaaaaaaaaaattagccaggcgtgatggtgtgcacctgtaatcctagctactcgggaggctgttatatgagaatcacttgaacctgggcgacagagattgcagtaagccaagatctcaccactgcactccagcctgggcaatggagactgcacttgtgcttttctaaaaatccacatttatgcgtgatggttaacattcccaggctagacccaaaataactcatatcataagttacaatgaaaaaaacataaaggagagagcaacattattttaataatcatagcaaaaaccacaccaagcaagagtcctattacatttttttctggaaagctgctcatgatcagaagcaggttaaattaaattagaggatgaggaggtgaggttttggggtgcttttaaaggctttaaaagttgctggctttggttcattattagctctaatttactacgaaatgcatggctctccctttttcctgatgcaggtgtaaatccctggcaccaatcttgcacttatctgccatgattagcattatttttggctctaaaatagaacaaagcagggaggagaacgtggaggggagggagaggaatcttttgctgcagtcgtttggaaggaattgggaggaaagaaggaaggcagaaaggcctaggatagatatgaatgtgctgtgcaacactgtttgtagtggaaagtggttcctaggagggacaggagcacagcatctcttctctgatggggaaggaggaaacagaaaagagaagccaagtcaagtggtagagtgagtattcccatgtgttttaggtacagggtacagggatcttgtagcagatcagggataaacatcttgttaccaacctgagtttggatatttccatgttagtgtccctggcgtgcctttatagtgactctattcttttgcagtaggcaaaatcaagctgatgaaaattatatacaagataaaattatccgaagggaattaaatacaaacgtggatgctggaagacattagttggtcagaaattaaaacaatagggcagtaaatatttggaggttagagagaggactttttgggaagtgtattagttatttattgctgtgtaacaaattgctccaaaacttaacggcttgaaataacacacatttattgtctgacaatttctgtggttcaggaatttagacacagctttctgggtcccctgcttcatggtctcttaggaggctgcaatcaagatatcgtccagggttggagtcttatgtgaagacctacgtggaaaaagctgacttgacttacatggttgttggcagttcctcaagggttttggggctgagggtctcagtttcttgttgcagaggctgatctctggtctttgttatgtgggcctctccaacatggtagcttgtttcatcaaagccagcaagaaagagaatcctctggcaagatggaagccacagtcgcacatagcctagccacagaagtgatctcccatcacctttgccttattatactgattaagaagcaagctacaaagccagtatatactcaaggagagaggatcattgggggcctccccagagtctccttgccacaggcagggagtattaaccaagaaaaagactcaggagattgagagatctggtgccccagacccatctggcttcatctagtgcctctttaaccatctcactatcagcctccagacctgaaagatgtgctttatgcctgggttccaagtgctccttatctatgctgaccaaaaccgcatcttcacatctgttcttcctcattaaagattttcatactgaaaacacataaaaagaaaaataaagtgttggggaagaggagctggaaagttcaaaatattgagtatttgtatattatatatatagggtgttgtgaactgaattgtgcccttcccaaattcatatgttgcagtcctaaatcccagtccctcagaatgtgactgtagaaataaggctttcaagaggtgattaagttaaaatgatgccgttagagtgggccctaacccaatctgactgatggccttataagaagagaagattgattagggcacatggagagagactgtgttaagctgttcttgcattgctataatttaattaattactgggcaattttataattgctggttaatttataagaaaggaggtttaattggctcatggttctgcaggctgtataggaagcacagtgctagcatctgcttctggtgaggtctcaggaagcttccaatcatggtggaaggtgaagagggaacaggcatctctcatggtgagagtgggagcaagaggctggggaggtgctacactttacagtaaccagatctcatgagaactaactattgcaaggtcagcaccaagccatgaaggatcctcccccatggcccaaaaacttcccaccaggccctgtctccaatactggggattgcatttcaacataagatttgggtggggacaaacatccaaactatatcagacaccatgggacacagagggacaactgtgtgaggaggcaacaagaaggcagccatctgtatctgcaggccaaagggaggagcatcagaggaagccaaccctgctcgaccttgatcttggacttccagcctccagagcaaccaaataaattgctatggtttaagccacccagtctgtgatattttgttatggcagtcctagcaaactagtaccgagggcatttttgttttaaagtgttcattaatcttgtatagctttaaaaatgtctttgttccaggaaatgtgttggagaaggactgaggacttaaaagatggacctgctccttcagaatcctataggtcaagagagatacaaacaaatcagaatgtagtaatgaatgccataatcaccatacatatggtgctgtggggacagaagaaggggcaattatatgttgaagaaatattggaagtgacaggtgagctgctgcttaaaaatggggtggagttctcagaaaaggaagaaggttgttccaatctagacaaaccgaacacaggcatggaggctggaaagagcatagtgtgagcactttggctctagagtcacatggatctggattttaatctgcctccaccacttagtagctctgtgaccttgagcaagtcactctgtgcccttatgtcttcatctgtaaagtgagattaattgtaatactacctcataatgttgttgtaaggatgggatgaattaatatggttgaagagcttagaagaatgtaagtattacataagcattaggtattataattctaaaatgcaaatcttatgtcattcctttgggttaagcttctcagtgcttgtgtagtaagtctgtggaataaattcccaactcgttagcctagctctaccttgatccccagcctcttcccctgtgttctagccctgcaagacagcaatgcctacaacctctcctatcatattctctccctactgctgaaataaaactgcacattcctgaagacacaggtcaattttcaactcccctttgaagcctttcctgaccctcctgccctcacttctataattgtgtgatgtagatctaaattgtagcacttatgtttatattccggttcttttattcatttaccgcaatagaccagagatacccagaaggctggaactatgtatcttccagccaaattttgtattcttatcatctggcacatactgggcacccaataaatgattgttgaattaaaaaaatgaacaaatagtgatttgtatatagtaatagtatgtcttagacatgggcagataggtggggatgagcctggaagcagggattttgaagggtggatctgtatgaatgcatttaaatgatgaataggaggagccagttcagtatagctagcaaccatcttaatttccccatttatggaggtttgtttgtttgttttgttttgcttttgagataggatttcactcctgttgcccaagctggagtgcaatggcgtgatcttggctcactgcaacctccacttcctgggctcaagtgattctcctacctcagcctcccaagtagctgggactacatgttcatgccactgcacctggctaatttttgtatttttagtagagacagggtttcgccatgttggccaggctggtctcgaactcctgagcacaaaccatctgcccgtcttggcctcccaaattgctgggattacaggcgtgagccactgcacctaacctctaacaaatgcaacaagctaccaaaacttatgtcaagcttcgggccaaagcttgttcttgggccccatgtttattctaggcagcttgaatttctgtcccttcctagttagaaaagggaccaccttgggcttcctctcttccctgctacctttgtctttctctcggagctctaattaaagctgtgattgtggggcttctgtgctggattgtatccactgtgatcctccaaggttgaggactcgccttccttggcaggtctgtctggtgctgactctgtcgtgagcagtagttgctccagagtttgttccttcctgttcctctggtcagagtctcaccatgagatgccttcagctcaggcgaacctggtgcatagatggcaccagttgtcctctgccttgctctggggagctgcctcataaacctgcaaagtaggtggggagagggagaagaggatctgaggtagaccaaggccactcaagggtcatttgtcagcctagcactgagagggtggtagtgcccctcccctttcattgtcaaggccactggtatacttgtttttacctggattgtaagcaggttcagtgcaacaggcaggtgctgggtggtgccagttgctgggagatggaggaagacctgtggtatctgcccctgggtcaagggaattgccctctgaatcaggttaggagtggcagaggcattgttagagtcacactttcatggtgagctggaatcaggttacctggtttcagggcccagcttttttaccatggtttcttcatcagagaaaaaggatgttttcagtggagtatcttcataagaccttgagggaaagttggtagagagaggatacaggactcctctgaggaacagcaatgcccttagaataatgcagcctcagaaggggccgcccttgaggagcatagcactcctggatattgtgtgtcaggcgtctcttgaagacatttaccccagtggttaggtacatggattctcaagccaggcttcctgagttcagtcctggttctgttatttcccttctctgttcctcagcattcccaaatgtaaatagggtaatagcagcagcaaactccatggggttgtagtagggattaaatgagtgaataagttaaagatgattagaagcaatgcttagcaaatgtgtaacagatgctattttaaaaatcttaaagtgtgattgccttttatggtaagttccagaggtgagaccttgtcatatatactactgaatccatgcagtgcccaaccagaacctgtcctaagcaggtgtccagttatttactggatgaaatactgaaatctacaacttccctagtttatgtgttcatcagcagggagctaaggccaataaacatgttcctctttccctaggagtaaaaaccctctcacagttcccctagggaatcattcctttcagttcaacacagtccaaatttcaaccattaaagtaactcgttcctttgacttaagatgttttgctcctgaggcctcatcagtcctccaagcctgagtgtatccaattcctcctgagcagggtttttgacaggggtgatgggacacttgtttgccagttgggaggaggggtagaagatgggaatgatgctgaattatgcaggtgatttattttgaagggggatcttaatgacttggcagcattgctcagagctcaccttggtgcgggtgggatatcttgctgaaagacacagtaattaggacctggacatgtagattgaactatctttgttttttatcttttctttttttgagaaagagactcactctgtcgcccaggctggagtgcagtggcttgatctcagctcgctgcaaactcttcatcctggtttcaagtgattctcctgcttcagcctcttgagtagctgggattacaggtgcccaccaccacgcccagctaatttttgtgtttttagtagaggcgggggtttcgccattttagccaggctggtctggaactcctgacctcaggtgacccacctgccttggcctcccaaagtgctgggattacaggtgtgagccaccatatctggcctgggtatgtctttattggctgtgtgagaacagactaatacaccatccaaacacagggcatatgtcaggaaggtgaggcaaggatcttcagcagctgttcagtctctattggcagaagtccctaagcctctggtatgaaaggccatcttcacctaagtttctattcccctggagatttgggtgctgtggggaggggcagagaggagagaggccatgaatggcagagtaatcagccaggagaaacccagttgtttctgaaagtatctttagcaaggtgcacatggattgatggatagatgaactataaatggattaattagagtgccaaggtgaaataaaagaaagggaacaggccaattaagtctacaatgtgggggtagatttctgttgtaagtgattattagagagttaccaggtggggagagattttaagattcatatttgaaggaggaagactaaatggctttgttgaagggcaattaggatgtttgagcaaaggaatattagggaaaagtcctcaatatgtgcattttcacctggttactgtcccagtagggtagataaactggaagtcctcaaccctgactgcaaatggaatctcctagggaaacattttaaaaaaccccagaaatgaagcaaaccaacaacatacaagcaaacaaaaaacccacgtgtgggccctactctagaacaattattgagactcttcaggctgcagccaggcattatgtttttatgtgcagctagagttgagcccccagcatttagaacaaacttaaacgtacgcaagaatcacctggggcactttttaaaaaatgcagattgctaggcctcaccaccagagactctattcagtaggtctggggttgggggaggagtctgcatgttttaaaaggtcctcagataatttagattctgcagtagagatattggattagaggatgtgaacattccagacagcaagaaaatagtcatgaggggtgcgcaagggtggtggaggagagaagctctgtagggaaaaggacattcctgaaaagatttcccttcagagcaaaagctgctatcattaatatcattatcccctcagcatggctggttctgacagaaattggtgtctagcacccagattactcacttaattacatttatcttcagcgtctcttgtaatgtgccagcacaagcagtgggtcttgtaattaagagtatgatagaaggaagtactttggatagggagaatgagaggggctggagcaggtgtttcagaggggaggcatgtatactctattacctgatgtcaagaactgtaaagtgtcaaggtctgagatttaccctacctgctagctaacaagttagcctgccacagtttcatggatgctggcagaagttatgagactcctggatcagagacaaaggacttaatgactcacagcaaagcaggcagcatgaactttagcatatttgtattcgtacttcttacccccaagtcccacagtagcaatgcagaggggcccaggtagatgctgcgcgtgctgtgggtttgcattatagttgaggaactttgagcttaggaaattccagtttttacaagaggctacaaacaaatctgctttgtcctggggcggaggcattatctttcttatacttgtcagtaaacaaatctgccctttgcctcagagggaaacaatatctctgtcttccaagtctgttcactatatgaacatccttggaaagataatctggaacaaaagctatcagggtctcgcttataagatgtgcagaaatgtcagagaccgtggagaactgtctcccaacatttaacatctaaggtcttccagcagtggaagctatccacctcttctcactatgtaccacatgttccagggaagattgaacatgccagttagttttggtatggagtggagagtgttctgagacactaataaagtacttgtaaacatcgaagtctgcaagtgttgctgttgtgtgtgatgtcagctcatacctcagaacatgcaatggattccaggagttttgaaaaagggacatgaaggcagcaagtggaaatacccctctctctgaccatcaattcttgactctggaggtgtcatatatgcaagagtgtgtaaaaagcaacatagagggccaagcaaggtggctcatgcctgtaatcctagcactttgggaagccgaggcgggtggatcacctgaggtcaggcgttcaagaccagcctggccaacatggtgaaaccctgtctctactaataatacaaaatattaggccaggtgcggtggctcatgcctataatcctagcaccttgggaggccgaggcaggtggatcacaatgtcaggagattgagaccctcctggccaacagggtgaaaacccatctctactaaaaaatacaaaaattagctgggtgtggtggcatgcgcctgtaatcccagctgctcaagaggctgaggcaggagaatcacttgaacccaggaggcagaggttgcagtgagctaagattgcgccactgcactccagcctggcaacagagcaagactctgtcaaaaaaaaaaaaaaaaaagcaacatagaagcgagaatttatagaatgaacttttaaacagagcttcacagttcacaaagtactttaccaagcgacaattatttctccattttctgtatataggcactgaagaatgtaggaaatgagactaattagaagcaggtcagatcccacttactgcaggaagcaactcttgaacagggctgaaagacagcaaaggactaggatgaagaagagaagggaaggaaagaacagaggacattcggataggcaaagaatagtgtgaaagcccagaagctgaaacaagcagggagcttcgtatggctggccccccactgctcccctgaacccttctagggcctctgatgttctccccagtggagttatatgtctgagcaccatcatttatcctcaagaccctaccttcccccttcccaccatcactatttctgcattcatctgtgggcattggagcacaatcttaattgagcctggggtttgaccagattgccactgaagactgccagaacactagccaggcgtttcatttatctatttctgaccccaagacatggtggcataaacaaccaccattttattatgctcataattttgcaccgcaagaattcaggcagagcacagtgaagatgacttatctttgctccacaatgcttggtaccttagctgagatggctctaacagttggaatgggtgggaaaggtgtattagggccatatgtagggggctttagttctgtctgtagttacagtagagataggaaaatgaaaatgtttttcctagtctcaaacaaaccatgcaacacagaaaaaggtgtggggatttctccccaccagcagccaatcagttcttcagcagacaccaactgggtgccctataattaaattcaattctgacattatctacctggaggcagcattggattccacagattaagggcttagtccctaagtgtccccaacttcagataccaatcatcagccccaggttgtgacctgtgcttctggccaaccagctaaaaattggggttcgcatgatcccctcttcagattcagttaatttgctggagtgcctcaggtaactcagggagacatggtttaccagtttattataaaagatactaaaaggatacagagaaacagccagatggaagagatgcacagggcaaggcatgtgggaaatagtttctatgtcatttctgggtgtgccacccttaaggaacctccacatgttccactgtccagaagctccctgaggcagtccttttgggctttttatggagtcttcattgtataggcacgactgactaaatcactggttattgatgatcaacttaacctttattccctctccctgccccactcctgaagttgcaggatggggctgaaagtcccaaccttctaatcatgctttggtctttccagtggccagcccccatcctgaagctgcctaggggcccccagccaccagtcatcttgttagcacacaaaagacactatcacttgagagattccaaaggttttaggagctgtatgtcaggaggtaggacaaagaccacatatattaatatttccacaatatcacaagctgccttctttttctccccctacattgtgtctgctggggctggaatgtctaagatggtttttttaataccatatctgatgcctgggcaggaacagttgggctggctatttttctttctttgtttttctctctctgtatagtctccctacatggctagcttgggcttcctcacagcatggtagtctcagggtagccagacttcctatttggtggtaggcttttccaaatgtgaatgtttcaggggcactgggcagaggctgtaaggctttaggagtcccagaatgtctcttttactccattccattggtcaatgaagccaccacagccaatctagatccaagggaatgggaattagactctgtcttttaatgggaggactagggaacaatttgtggccatttttaatctacaacactaggtctgggcagatcaaaccatatctccaggtgaagggcctgggaacctgtgtgttcaacaagtgaccccctaggggactactgttatcaggaaagtttgggagacactggttggtataggctgaattttgtcccacctaaaattcatatgttgaagccctaacccccagtacctcaaaatgtaactatatttagagaagaggcctttaaacaggtgattagagtgagccctaatctgatatgattggtgtcctagtcatttgcaacaacatggatggaactggaggccattatgttaagtgaaataaaccaggcacagaaagacaaatatcccatgttctcacttatttatgggatctaaaaatcaaaacaattaaactcatgaacatagagagtacaaggatggttactagaggctgggaaaggtagtagggggttgaagggagcggggaggtgggaatggttaatggatacaaaaaattagaatgaataacaactgctatttgatagtacaatggggtgactatagtcaataataactcaattgtacattttaaaataaagaatataattgaattatttgtaactcgaaggataaatgcttgagaggatggataccccattctccgtgatgtgcttatttcacgttacatgcctgtatccaaacatctcacataccctgtaaataatatgcacctactatgtacccacaaaaataaaaataaaaaaggggatattgtacctacaaagagataccatggatgtgtgtgcacagaggagaggctgtagaaggacacagcaagaggccggccatctgcaaaccagaggcctcagaagaaaccaaacctgctgacaccttttaatcttggacttctagtttctaaaaccatgtaaaataaattgctgttgtttaagctacagtctgtggggtgttttgttatggaagccctagcaaagtaatacactgataccatgagttaactattaaactaggcattgtttgccttgagttaattacatatgcataaaacttacattccccaaaaattgtcagcatatgtacttctattctttattgacctgacctagaatctatctgatatttgatctaatgtttacttgcttcctgttggtcctgggcctgtttgccttcagatccatcccaacttctgtcctgccattttgcagggtgccaacccctgtagactgcatttcccaggctccatgaaagttggctgctggcagagtttagccagcggaaagccctgttgggagattgaagagtggaaagaaagcggggaactggagtatccttcctcagcctctctcactcccacatttttatgggtgaagaaatgaggctcagctgtcctggttccagcttccatggtatgaccctggttcctggtcatctctgggctttttctacattcttactctctttttagctctcctgtcatctggataagctatttcctgaattgaatctagtatgtttttaattcttagtatgatttttgtttttctgggtggaccctgaaagatgtactcttttaatattttctcctaatttaatgaaccacttaacacttccctatttccaagttcactcctactatactcctttctacatatacaatcaaatttaatgttcattctggaatttctttaaactacaacttatggcatttccaaaagaaagacacaaaactaaatgaaaaaatagccatctttcagagtccaacctgccagtgatgacccctctttaacctttggtatatgccctcgagtctttgtttcacttttttctttaatatattttccctaatattttttgcaattttacatagtttgagctcacaaagtatatctatttttgcatccagtctcttttagcttgacattttatcataagcatttccctatttttttaagaactctttataagtatcatttttaacttgtgaaaggaactaaaaaggtagaattagggaggattctgacttatgaaattctgtactccaaaaagagtgttccaactaggctttgcatctgtatctctcaaactagttgctcaacagatattcactgagtgcttacagtaaccctggtatggtgggagaactgagggaagaaaccatctggggacagagactggttaggaagccaagagaacacctatgaagcaattagagagcaagagaaggtttccaaaaaattagttgctaggtggagtgctccagacaatgagtataataaaagagcagaagagggagcgatcgatgtgggctggacttgtccccaaaagtctcttcctgtgacatgatctgaatagtgagtgaaccatgggcaggattctggtaggtctggaggagacggaaggaactccagggttaggaggctttggtgtcaagcatacctgggtcttagttctggctctgtcatctttactagttctgtgatgatagacaagttacgagcctcccgaggcttcagtttcttggtggtagtgatagaactacctactgcatggaatgaaattctgtagtcagaagagttcaatcttatttcttcctacaaggattaaacattcccccaggtgaggatggaaatgaataacttccatgtaaacacttgctatggattattaactatagctaaaactccattttcatgttactgaaagcataaatggcttgccctactaagacaggggaagttagtatctgagttagtatttgaaggtgtatctcctggtgcagctcaacccaagggcactgagccctctcccagtgctccttgtatgccaggtactgccagagcccttggatccgtgtggtttctcagatttcagcttggccctgttccctttctgggtgggcccttatctgctgttccatgagaaaagggttgcatgctgaggagaaatgaagtatgtttgctaaggacacctatttgaggactctgagctggtagacctgagttttaggaagagaaggcagtgatggtaggtataggggggatgggagaatgacaagtatgagaacatttatatgtaattgttgcaaatattataggcctggtacaagtgtctgtggccccaaatacctttggaatctgtttgcaaagttggcttattactactagcagagatttggggaaaagaagtaatgaagagggagaaaccacatacactctttcagagggtgcaaagacatttttactatagcccctcattaatgaacttctctcctggaggttagccaagctgatgggggcttgccagacctcacaaggcctcattcctccttccacagatgaacttacctttcttaagacctcctatgagacctacctcttgggatgctgcctttgctaaactgataggttgccagctcctgtgttggaaggatcaaaggatggagcatgtacaagtactttgttactggtggggaaagggtcctgaggagctgggtctgactttctaagagccataataaagcatgtccacatttgtggcacttcgtcctgaggctcccgtgtgctgtcagggtgagaggagggaagaaatctttttcccctcctcctcaagggccatgtagaatcacctgtcttatccaacctgccctaaaaggggaaggtcttgaaatagagaacctcactgaaccatgcccctggattctatgggcatagaattggctccacaagagcctatctttgcttccactctcatctacctcttgactccattgtttggataacaatgaggagctgagtttagcagctgaacatggggtgctttgtccatgtttctgcacaaaaggacagctgctgaagtctgcaaaggcctgcctacctgccagaaatctaatttcagacgcttgcatcaaactcacctgcactctagtgcacttctataattgttttggttcttgtcaaaagcgctcttttgctttgggagaaggaagaaattcacagagggaaagggggaacaccagggatctttcatcaccgactttgtcctcagggcttggaactctttccccaactgtccactctgaataatgggaataaatgggaaaggattagggtgttttccgtgaccccacttgtcttaattgagaacccctagaattgcccctcagtgatgtttgcacaatgtacatgatcccctctgattattgtggccaaagcaagcatccctgatttatcatttaattcctggcccttattaggttgtctatcttagtctcagacaagctgcaggtggggtctttttcaggttcactgctgaggttgttttaaaggccagttgggtatgtgagggctctgaaaaaaagtgaggtgctcttcccatgagaagtcttactgctgttattacagataatataataataatggggactgctgctgccatttcctagattggagaggctcagatcctggatcacagacagaagaagagagaagggcagggtggaggaggggcagcagtgacagccaggaattttttataagctcatatcaaagaaattcctcaggaacacatttcccttagagctttttttggctgcattgaagttggtctttcttttcttcatttctgagggcaaaagtagtttcctattcttcttggctacttatttctaaatcttcattttgttttcttgatcatctaaatacatacacacatatatatgacaaaaataaagcgtacacactttataacctttttaaaacctaaacacattgttcatgaacatctttcaatgttgttacatttctggaaattacttttaatgacacaatagtattctgtcttatggctgcatcttgataatggcagtactactaatagcgaatgtttattgagtgatttcttgttctacagttatctaggaatatatcaagccctgtactaagtaataatactaggaggcaggtgctatcattatgctcatttacagatgaggaaatggaggcttaaataatttaagtaattttctaaaagtcacacaattcttgagtggtagagttgggatttaacctaagcattctgatttcagaccctacacacccaacaattatgctatgctaccatcatttatttcactactctcttagtgttggacattttggatttttttttcatttaaaaagattgcaaaccctgtcgtttaccctttgcatacatccataatgattttcttgactagatttgccttatataattctgtctttgaataacatggtaactccagactcctagcatgttaaactttgtctctgtattctatattgtaagtttttatttggtttcctgaacatccatgatgctggggagaagatgcttactttctgcaggtgcattattcaagagcagccctcttgctaatcaagcccttgcttctggcctctggaagcaagccttgtgtgctacttataaacaaacacccagaacacagtcttctccttcttcttagtttatcctgttttcattttatcttgtctcgtagatcccagattctaccaaaccacatcttgccttcatcctcagccttgatccttctagctagaacacttttccggttgtgggcaagaactttcccacacgttctctgcctggttcaccctccagcccaacctcagtgtctcttgtggacatcttgtaaagatagaccattctaatgctgtttccaaggggctgccacttgctccagccctttagcagggacgtgacaggcagggcttgtcctctgccctgaccacagaccctatactgctgtgcatagggagggatttatcaggagccttcctatctgtttttcttgcaatgcagttcatctagaaatgttccttctatctgccaggtaattgtcctcgtcatatctccaaacatgccccctgcatgttcttttctgtccccaccttcagctgctctccgatggtttccaccagaatgctacccacagctctcttatggtgcacacttagtgattcaaatgacttccatggattcattctctggacccatatgcaattctccaggcactgtatgatttttaaaaaacaataccacatttatacagacccagagagacagacatataacaatgaggtattacttctctttttagctagatttctgatcgaggaattaaaagcttcgtgctaaatggggaaagaagggtagattttggatggcaagaggaactttcccttgcttactcctagaggtcatctaaccttgggaagtctctggagtgtggtgctgagaaaagcagacatggaccttggacaacactgggtttgattctgcactccataactcatgatttgtgcaacacagtcaagtttcttaacttctttaagcctgatttttctcatctgaaattgggataatagcaacttaagtttattgtattagatttccagaaaatgcgtgtcaagtcctttgcctttccacagcttgccgcacagtaagtgctcaatattgttttcattaaaggcttctgaggtgggagggctcaaagagacaatttgtgttctcactgttgcaaatgcttccctgaggggaggataagctgggagctgcctggctgagctaccaggggcttctcccagggagggcaacatccctcaaacaaaagttcatgacatcctcttgataaggagttcttattctgggttcatgagtgagcttttttggaggtccattcagctcctataattgcatggaaattttgtgcatgtatgtatacatgcaatttacgaagacaaaagtctgtggctttcatcagattctgaaaggggtcactgactctagagaggttaggaatcgctgctctagaagctcctttggctcctgcattgttttcttccatcaacagtggctgcggactatactgggcaggaatgagggatccagagcagaggctgggaatggatcatggggcctcagccagaatctggaagtaccaggaagccagaggcccagattgtgtgatcggtcagtgctaggagagagtcaggagcaaggatgggacaggtaccagggatcaaagtaaggcatgctgcagacctaaggaggctaaggaaaggcctgaaaggctagagatagggagactttgaagccgaggccaggctgcctgtttcactgctgaactgagttcctgagtgggagacacaggttggagcattgatactgcagtgcatgcctgacattcactcttgctgcttccagtctaggcttcttcccatttccctttcctctgctttatttgcaccaagaattctccctgccagggctccagagcccattctcctcaacttctcacacactccacaccaccccagaaatgcagaaagatctttcccaatgccttagacctctggctccttggactcttgcatcctaaagagtttctggatttgtgttgaacagcccacattttgtcctccctgggatctgtggagtcctaaattgggcacccacaggagagtgacaagctagtttccttttatactctggagagggaaaaaagaaatgtaacaagaaggattgatgttttgcattcatttattcaaataatttttattaagaagttacatatgccaatcaccatgctaaatgctgagaaaataatactgaattagatgcaatccttttttcttaaagagtaaaggatcttgtgcagaagtcagaacagtggccgggcaattaccatgcagcgatctaagtgctccattggaggggtatgtggctagcctgagcaatatgagcctgtacagcaacacacatcagatgggtaattgtagaagctttagagaatgtcaagatctgtttcagctgtttgaggtgggtggagtgaggcaagatagacaagatggccactggaaggcatcatctattattggatttggttttttagtacctcttgtgggtgagttttgatagagcatcctaccaagatgcatgttcttttggcaagagtaagaggttcctgaaaaggtttttcaaccttctctggtatttgccagattccccatgaccgatcctcttctgcatatgtctaaattttgaaatgggaaactagcatcataaacaggaaggtgggtggctgcagcagtggctgcaaaactcaggtatgcagtgtgagaagatggtcagtggtgtaatgaaaaaagtactgggttgacagtagaaaactgggttcctaacctggtgctaccactagtaagccgtggaatatttggtaagtaacttctttctgagcctctccctcaacttataaatgtggaataaatcgtctctgctgtcttagttcatttgggctgttataacaaaataccataaactgggtggcttacaaacaacaaacctttatttctcatagttctgaaggctgggaaatccaggatcaaggtgcctgcagattcagtgtctggcgagggcatgttcctcatgaataatgccttctgtgtgtcatggcagcaggggcaaatgggctctctggggtcttttttaaagaacactagtcccattcatgagggctttgcccttaggacctaattatctcccaaaggcctatctttaaataccatcacgtcgtacttagaatttcaacatataaatttggggcagggggacagaaactttcattctgtagttcatgccttagagaattgtggtgaacaatgcatgagagaatgcatgcaaaagtgactcagcatgttacatgggaggggttacatctgggagcctgagaggcttttctaagtctggggtatatttttttcacagcttttcacattgagagagcagaaattaagagccaccctacaccatccctcttgggagggtggtgtaagtgtccttttgatttgtgaatccgtatgtatggcatagataatgcaggttagtgtacttaatatctattccaaaaacctctttccttcctttattatcaaggatagagagtgaaatacttaacttcccagcttcccttggcactaaggaagatgtgacacaattttgactattgatatacaggcacaagccaatgggtgatcttctcttcctaaataaaggtaaagccatccaaagaaaaagctatttgcttttcaccctccttcctccctagaatggggatatgatgccaggagattctgcagccatcttgtgaccaagagacaaaggccacgtataagacaacagccaccattgaggcagctctggaatgccaggtccaacctcttacttaagacaaataagcaccttacttgtttaagccattatggtagagctttccgtgactctctgccaaatcctaatgtaggattctgaagtctgggaagtcccggctgaacttgggctcagaagctggtggagatgctgcatggtgcaggccatcccttccttgcaggaggaacaatggctgtccttgactccatctggcttagctcctggtcactccagtgtcttggcacttcccctggaggactggagctttgtgtgtgttttcttttttaggaaataagaaaacatcactagtattcagaaattttcccttcctgaaatagaatcctttggaaaaaaaaaggatttaaaatgctgttctcgtcaaaaaacatttataaagtcttggtgtatggtggctatgctgtggtctgtacaggttgatggatgtgatctccatcctcctagagctccttgtgggaaggcagatgtgtagacctccccctgggtgctcctaatctaatggaggacactgagcataaacaagtgatagacctgggagtgtttgctttttgagaatgtttaacttttgaggacttataaattaagtctataaatgcagctaagggagtggttcctgtcttgggggagaagtggcttttacttgggccacatctatgtctctagctaggtttggcccttggagccctgaccagcagctgctgaaaacgaggctcatgcactcagcagtctggggccagctggagccctgtgatggggccaggctgggccagatgctggggcggagtgggaagcacttcttgtcacatctaatcagtcccacttcttcctgtctcctacctcccttcacttgcaggggaaagcacagcagcttcagagctagctcaggttgcaagtatgaaattttatgtgcttggcatgtttcatctacatggaagtgatttggaaattttacattaggaaaaacatcagcatgaagatctggaaagttccctctttgtgtagagaagtggcagccacttcactttagtttttttgtttgttttgtttttttgagactgggtctcactgtgtcaccaaggctggattgcagtggtgcgatcacaggtcactgcagcctcaacctcccaggctcaagcgattttcccacctcaccctcccaagtagctgggactataggtgcgtgccaccatgcccagctaatttttgtattctttgtagaaatgggtgtttcaccacattgcccaggctggtctcaaactcatgggctcaagtgatctgcctggctaggcctcccaaagtgctgggattacaggtttgagccaccgtgcagcctaccctagttttttaatgagaagtcgggtaacctaattttctttgaaccctccctcctcctcctcctcctggtctcttttccttcaccttctgtggggctctctatccacccttccagcctgcctgctccatttgtggtatttgcttgtcccttctgtgattatttcttacaacagatacaatgggggcccttccaccatacttttgcttcatcaccttttcttcaagacacacctcttcccctctggagagtacaaaatgtgattcccttaattcctgagaatcttctagagtctctggagctctcaatgctgctgtggtcctctgaggctatcctgctgcccttctggctgtctgcatctcatttgcagtgtgtcgtgccagctggcaggctgggccgtcagcactctccactcgcagctttcttgtttcctttcctccctgacagttctggtggttgctcaagttccattaatgttttatgtgctgcccccaggaaccttggttgcagtactctggggaagttcccactcctccttcctcctcactgcagaactttgaggatagagagatcatttgtttcccagaaacctggtgtcatcggtcatcaagcttccaattagctgaaactcagtgcagcagtttggggtgccaacattctccctgaccagggagggaaagctcccagggacagtgatagtctggctcgttatccctgagctgagagtcagccttctcattaacccattctcctgggctcttcattagcacttctgaccaagacaggttctatttgattgtgcccatttggtggggatggaaattaagaccaagggaaccaggaggctgggtttcaggtcatgtagtgagttgagggcagagccaggctaaagctgatatcttgttttctgactactggtgctgtgattagcatcttctattgtcctcaggggactgctggagcctgccatgggctgctgctggaagagagaggttggagggacccaggcagcagcttccatggctttatacgtattgcttggaataatgttcccaaagccgagtgataaagaaaaataataataatagggcaataactaacactgacctcctctatgccaggaattgtgataggtgctttctgtcttccagtaacctaccaattcaggagtcttcccattttacagttgaggattctgagactcagagacattaagtaattgccctccaaaggtagctaacaaatggcaattagcctttctaccttacactcagagtcctgctagatctatgtgagcaacacgggtttgaattgcgtgggtccacttatacatggattttttcaaccaaatgcaaattgaaaatacaatatttgcaggatgtgaagctcttgtatatggagggctgtcttttcaaatatgtgagttccatagggtcctcaactgcaggacatgagtatgtattcttgggttttggtatacgcggaggtcctggaaccaaacttctgtgtatactgaagggccactgtaattgcaacctcttcaaaaatgggaatcccctgtagatctctgttctaagtatttttctgttctctggccagtcaaccttacataggtttcttcataggaccctttaattgccacaattattgttttgctcttatgcttttatgagtctgttcattatgcttttatgagtctgttcagctctggcaaacacaattctttagactcattgaatctaaatataaatgtagataccaaattttctacttttaaaaatcttctaaaccaaatgggatgatcagccaggtttaggaacaaactgctgtgggctacaaattaaaacactaatttctttatttttcacatggggattattctccacatgtggagtgtttactttaaaagaaaaagaaatgaatgcaggcttactgcctgtaaccactccataagcttctatgctcctttctccagatattggattggtgcatactcatctaattaagatgcactttgattcaagaagttaaatgttgtgtagatcaaagaaaaaaattccagtcatttatctttggctttggaattcatcatgtgattttatcttcagctttggattatctgtgctgctgcattaatgtgctaactgcacgtttttctttttttaaaataatccctgttttagaatttacctcaagggacctgtgatgcctcccccatctcttagtttaaaaactaaatctctaaggtctttctttccaaagctgtcctccgcactgctccagaatttaactgcctccccacctaaaactagtattttctttccaaattatttcttatcagcttattaggagaactcctcatggaactgtcagaaggttgagctgtgttaagggagacatacttcttcctcattcccttgtgtctttgtaacatttgcttttactgtttcaagtttttgtttgcaaagtctgcaatccaggaattatttccttattattggtcctgaaattccaacaaaacagcgtcaggacatagtgttgccttgccatactggtccaaataggaaggcatagtcagtgacgtgctggcaatgtttccagggaagaataaaagccctggttgtggtgtttgtaacatttgctgatttctattgtgtaaatactcctatcatagcagatttcaagctaccaacctgtttaacaacgagctggcaaaaattctgaaaattacaattagttctcagaaaccagaacaagcaggctctagcacaccaccaggtgtagataactgttttagggagcactccaatcaggtgtgatattttacacaaatgaaaatcgctctcgcagctcctacttgacagtcgtgtgaccttgggcaaatcatttgacttctatgagcctcagttttcacatctatgaaatgcagacaataatatctatctcatgaaataatatgagaggatttaatgaggcagttactataatgggcctggcatatggtatgaagcaaatgattcttcccctccctgaaatgctagagacacagagtagaagatagcgggagagttttgaactttgggtaccatttaatggaaacacctactggaggttggagatgcaactggttgaaaaacaaggtcaaatatttagatttgggaatcagaacaataacagtatagtaccttatgttcatatcgctctctaaaatttacctgatactttcacgtgtgtttgtaagaggtgtgagagtggaggaactcttagggagaagaatggaggacctgtcaaatccctggcagctggtatctaaattcttccaagttttcccctcccctgtgctcattattctgtttctctttgagttctcctgccgtttttgtacctagatcactgacatattcttgttgcttttaaagaaaccatgtgtattctttataaaatacattaacacctgacataagattttgaggtagagatagaaagcaatttcttcagtctccacagtttgccaccctgatattaataagagagtgttccctgcttattggtcagcataggttgatggctgtaataaccagtaagtatcagagatcacgtaatagaagattatttcttgctcttgtcatagtctcctacagatgttcctggttgatgacaacccaggacttaccctttctattcagtagctttgctcatagggcctcagagtcctccactgaacactttgcacccagccatccgaggatagatgagaagagagaatgtggaggacatacatgtgggatgattttatgagccagtcctggaagtggcatatgatacttctgctcaccttccattgaccagagctcagtcatacaactgttcctaactgcaagggcggttgggaaatgtaacagtcgtgtgcttcagaagagagaatgagcttggtaagcatctggccaatctctgtaccaaccttatatggattggtggaaatagtcaccactatggatataggtcagtccaggtcaccagagacgacttcttgtgcttattgcatagggttttctgggtagtgttgcatgttgagaaatacagcttcattcccacagttagactaagatttcatctaagttagacttatagcattacatgagtttccaggactttccaggactagagtgctttgctgagtgtaccagctggttttagtcaacacttgaaattggtaataatatttgctgttgtgtttataattaccacatcattaacagtcaatgggatggggaatttcatgggactcttcatttccatttagtcacttattattgtctaaaatgcctcagacagtcttctgtggattgtttttgtcacttgcctacatgaagaagactgatttcccacctcagaacattggcgttggcactttccaaggggttggtagaatgtctggctgagagtgaagggactattgggctagctggaagaggcaagcagcagcagtgaaatacatgggatccactggaacatcacaacaaacaagaagtttccctcaggtcagcatcatcatccaaggtgaggagtcctgcaagggagagtcaccagagtttgcaagttgggggagacattcgggatcaggctagtctgtggttccacattactgggccatcactccattcctggcaggcccccaggcagtgactagcggcacatagacatccttccctccttcccctgccaggaaaggggtatggcaagggatgggcaaggccctaaatagacaggtggggtttcagagcacagtgctagctgtaagttgctaattatagggctcagcaggaaactgaggtagaaacctctgtcctgtaactctctgtcttgtaactgtcccgaaactcgggggctggggattcatcccaggcacatcaaacagcgtgtttgaggctgcaccaaacatggctatgtcctaaccctaaagagattgaagttctggatatgtcctatccagggtgacttgggagctagatgagacagatctatatgtatgaggcttcatgcacaggctttggaataggatagacccatattcaaatcctgactttatcctttcctagctctatgaccttgggtgcattatttgctttctctgatcctcagtttttcatccataaaatgtgggaaacaatatgtaccccttagggtaattgagagaattaagcaatatagatatgcaaagcacttaggagcctgcacttaggaagtaacccttaataaatggtagcaagcatctaccacaaagtcccacgaaagcagcaagaacaaaacaacagtaagcaggccttgggaaggcaggagctgaaaagtgggctcatgtgatgcttgattgtgttctgtgaggtaagtgatcaccagtggggcaggggtaacttggtctgcctgctggctttaccagctgggctttccacagacattgttaacagtgagactgggtacacgctttcccccccagttcagtgtccttaaaatggaaagtagaactactaagtcagcccacatcctggccatgcagcttctttggtactttccacctcaccgcttgaggacctgcgctttctcctggcagcctgcagcgttattattacacattgtcttctaacacgcacatatgtaactagaagcacaaaggtccctaaaatggtaggaaggggcttttcctgtactggcactcagcctctaatggctggaaggttgaacataaattgctttgaccttgagcttcaaatgctgtaagtctggagggctgcccatgccttggaaagagattggccttccctttaagacaagcaggatgaattatgaaaggaaagggacttcttcaagaatcttgatttttaaagagcttgtatatacttttttgtatataacaaagttaaaggaagggcagatagctcaactaaacctagcaattaaagtgagcttgtgaacagttgtgatagagcagggttttagctctctgcttggggaagatggtctgttacagagggagatgaagaagccctgttctcctgcttccactgtctccagccaagaaaatgcacttcagattagaaaatgcaaaatagattaattcatatagaaccaagagccagccaggtacagtggctcatgcatgtaatctaagcactttgggaggctgtagcaggatgatcacttgaatgcaggaattcaaaaccaatctgggcaacatagggaggtcccatctctataaaaaatttaaaaaattagttgggtgtggtggtacatgcctgtagtaccagctactcgggaggttgatgtgggaggattgcttgagaccaggagatcaaggctgcagtgagccatgatcacatcagtgcactccagcctgggtgacagagtgagactctgtctcaataataataataataataatcatcatcatcatcatcataaccaatagttaagaaaaataaggggatagtaaaagccctaaactccttcaacagtcatggctataatagctgcaattgattatttatagggactttatgtacattgtctctctatgagtttggtgttattagccttattttacttatgagtccacaaggaactgagaaattaagcatgctgggttctcagaactagagagattagaactcatgtctgggccaggtgcagtggctcacacctgtaatcccagcactttgggaggccaaggtgggcagattgtctgagctcaggagttagagaccagcctgggcaacatggcaaaaccccatctctattaaaaatacaaaaaatcagctgggtggtggtggtgtgtgcctatgatcccagctagtgggactggggaggctgaggcatgagaattgcttgaagccgagatctcgccactgcactctagcctgggcaacagagcaagactcactctgtctcaaaaaaaaaaaaaaaaaaaaaaaaatccatgtctaactgttgtgtccacccaccctgacctctctgagagtagctctgcatctcaggcctgaaggaactgtatcctgaaatgctaaaggaatttgcctatgtggttttagagaaaccactaagaaattatagggtagagataggaaaatgcctagaacttgaaaagaaaggaatgaatagaatctgaaaattctagacttgcaaacttgatctcatgacctagcaaaattctagaatcttaacttttgcactaactggctatgccaccttgggcaaatcacatcatccctctgggcttcagtttccttgtctataaagtatatgcttgtattacatcatctccagggttccctttagttcaaagtatttcatcctaataagttcctttaatatgttctgacagttttaatgtttcagtcttaccaccatgaaataactcattttcatttggtatcagatgctccagtgtttcttcagagagtaaagggttaagaagatggagtttggagtgaaagagttgtaggttcaaatcttacctcttctctgtactagttaaatgaccttaagcagattatgtaaacgctctctgtatctcagtttttcctctataaaatgctagtctttcctatacttgcatttatttcacagggttgttttagagttaaatgaaataatatgtataaagcacttagctcagtgcctagaatataacaaatactcagtaaatactagttcccatatttattgattctaagatgctctttttccttctacattttgccatctctgaaatcaggatgcatcttatagcttatggtgtgtaatagtttaattggcagcagttttttcttttttaatggcacataaactaatgatacattttgcaattcactaaatatggtatttccccagcatggttcttatccctaaggttctcatttctcctctgggatgctcctttcttcaactttttgcaggccattatctcttctacagcaaagcagatttaggcaatggaacagctggggaagtgacaacctcagccgtcatcttatctggctcgtttattttactggttttgaaaatggaggccagaaaggggagaaagaagaaaaaaacacaaagggaactgaggtcttcggattcctagtccagtgttctttcccccatcagcaatgttattggcatggaacaatcccacaaccatgactcagttgctctgtagatgcctgggccccagttggatggtgaatgcttccaaatttacatatagattttgatggaaagattttaatcctacagccacaaagctggaaattaatagattttgactactgcttccatttgcacaaacgcagaattctaaaattttagagttgaagggaataattttttttcctgtgggaactataatgttctcacctttgctgtagtctgaatttgcaaagcatgctctctggaggcagcacatttcctctaagttattatgtctacaatttcaggagctgacagcatgtggataattgtgtcttgaattgtgaatggtttctgcagtttggctgttcccaggtttgtacagctgagcccagtggcaaatcaatcacacagttcagacacttcattgattcattcactccatcacctagcacttactggacatctaccagtcacaaggcacacacatagtctcagctaattctcataatagccttatgagatgttacttacattttgcagatggaaaaactaaggaatagtgatgctaagttacacttttttgaggtggacattgatgaaccttccagatgttgattagggcattttaaagcaagagataactttattgctataagaaaaatgactcaaaattgaaatagtaatatgaatcattttatagtacaatatgtgaacaaatacagaaatatgtccatagcctgtagaaaagaaacagaatgttcattggggatcttattagctctacacattaattgtatcagtgaattcagtggccctatggtgggctcacaggtaaaaggtacaggcccatgggcttaggagagggcagcagcagcctccctccaacagcacactggtgagaagtaatcccagttaccccagcctagtgtctcattgtgctttatattctagttggatgtttgttggagtcttcatcgctgcatgatgaggactcatacctcttggtgacatgtcctttcccagtgcttctcggggctctcttctgcctctcgattttagaggagtggtggcaacacaagtggagaggaggctacttgcttccccttctgtggtacctctattgactgaaaagcatagggccatctctggggatagaaactgcatgactcttgtgcctttttgggaaggcttcctggaggaagagggattgacagctgaggtcagagcctttctagagttctctttcttattctggggattaacctcaaacagcaaattcagaacatgcaaataaatagaataacagacaaaaatgaggcaaggcatgggcatttaagagaccaaagcggcagaggattataaaaatctagaaaagagaaaccagagaagtggattcatacagttttaagtttgggatatttttttcacatggtctttatatacttttacaacattgattttaatacatatttgttgtagaaagtttgaaaactatagaaaagtgtaaaaaaaaaatgaaatatccccataatctcacaccccagaaatacattatgtccatatttgggatcacatcaaatcactatttcagaaggttaaaaaaaaaaaagttgagtctcagcaatctgatatgatttagcctaacctatatagtgtgtgtatcattagtatcctaatttctactttacatgttgcgagcattcttccatgaaattaaaaattactcagaaatacaaattgtaatggctgatttgtatttaatttatacctatttcaagtttatcttaactatcccctttctgttggatacttaggatatttgcaatttggggccacattaaaaagtattgcatgaaaccccttgtttgcaaatatctgtcctcctttttccttagttccttcacatagacatgcagaagggatatcactagatcactgtattattattattattcgtattaccaaattgctttctgaaaaggttgaagcaattttacttgcactaatggggttataggcaggaagaggtaattaatgctgaaccttgctagcattgatgattattgccttctcaaaatctttgcaaatttaatggatttttaaaacatctcattgtttagtttgcattttctttattactaattaagtggactgctttttcttatgtttattatccattttccctcctttttgaaatgtatatttatattctttgcgcatttttcaaatagggagcagtaattttttctctatcgtatttgatacacgtttcctagcttgtcatttgccttttaaattttgtttataatctgacatatagtttaaattctacagaaacaaaaccatcaatatttttctgatttctttaaatgcttttgtgccttgagagctctttcttattcagggatcagttaaatgaccatgcatgttttctcttaaggtttttaaaaaaatgtcattttaaaggtttgggctctaatctctctaaaatttattttattttggtgtatggtatgaagttgtcaggattaactggatttttcttttccaaatattcagtttttccagtgccatttattgactactttatctttcctccattgttttagattatttccttatcatccattagattttaaaatatgccagatctgtattagggctatgtttcaggctccattgattgtatgttaattcttgtgtctgctccaccttttaataatttgagtttaaaaaatatactttcatatctggtagggcaagcccaacccattatttatcttttttaaaaaaagtttaattatttttatctatttgtttttataggtaaaaatctagttgaaaatccctttggcacatagggggtactaagagattcattcaacagatatccactataatgtttagctttttaatccaaaaacatgtgattttatttgaattttattttatttgaatcttcttttatatcttgcatttcaaagggataaaccctatttgcatacatggaaaattatccctaatgaaaaatggagttttcttttacagctcatttggacttcagttcttttagtcataagacaatttcatctgtgatgagtggtagccatttcttatttgccacaggatcacattgcagagtgaacagctgtgtaacacagttgtcctgaactttaaataaggttgctcttaaaatgctatttgacttgttatcataaccacaacctaattattaaactttttaagtgtatgaatattttacagatattctatatatgaaggatcaatatacaaaagagggaatttgctcttttccaattatttcaagaataaataagaaaaatctgacatagaaaaaaagttaaacattaacaaaatctgtaatccaacttttcagagataactgctgtgtacatatatatatgtatatatatatggtttttatacacacacaaacacagacactgtatgcacaattgagacatggttgtacataactattttataatctttttcacacttaacaatataccggaaaatttcccaaggcattatacttgtataatatttaatgcatatttaatgaatgcattgagtagatatggtttatttaaccacatccctgaggttgaacatttgaggttgtttctgattttttgaaatatataaagctatcataaatctctttactccctaacttaaaattattctaatcttagcatataggctatgttctgagttcacatgcacatttatccatggacaagacaatctcatggctccctagtcatggcaaggactcctcttttccagggagctgaaagagcaggggaccagatatcccagcctcctagaggtcttctgctaagattactgggagaggattatgagtgctggggagttggtgagaaaatcgtttcagagagcatggaactgagaatctaagcaacctggggacatttattctacatgtagcaagcagattttaggatccaactcacttggatttgtattcaccactttcctgtgccttcacacctagctctgtgtgttaagggtaacataacctctctagcttttgtttctctgtgaactccccctacttactacagcctgacaactcaaggccaactaagaaaaagactcacaggtcacttactctccccagacctctctccacagggctctgaaggctgcctactaggtagatgtggtggcttcttcatctcagatggtggcctcgctatcaggatgtgttttcagtaggcatgcttctcagaaatgccaccttgacctgtagatctttatgtagaacccagtctcataagggcagggggaagaggagttgggaaaagaaggaacaaggcctgccaactgctggcagctgctggcagctatggtcatggagatgcccctgaccatagccccctggccacaggaggagggacaaatgcacaatcagctgggcagctggtcttcctttgggaacaggaggctttcttttacatctggggcacctgggtaggggagcaggagtagttgtagtactcgccgaatagcccagattgggtagcagagggaaacaataaaaattcagaggacccacacagatgggtgtgagcagtgtagcttactggtatgcagtgggaagctggggaggcatttttttagctgccgttttctgagtttactccgttcacttactcattcacttgctcactcattcatatattcagtacttattattgaacatctaccaggtgtcaggccccatgaaagagatatcaagatgaacagagaagagtgagcattatgtttacttagtatcagctaggtgtctggtttttcaattttcctcccttaatcattacaacagcctatgaagtgtaggtattcttatctcatatgaaggaacagagacccagagagattaagctgtctaagggcacacagctaataaatactggagctgggagtcagacttctgtccaaagtctgtgcttgactcagggctgtgaccttcccctcaagacatgcttgtcctgggagagcttgctgtcttaagtagaagacagcatgatgagcaagtaatggccaggtgtgtcctatggtgccagcctcactaggaacactccagaaaccttatcctgccattatccaggctccagcagatcttgttaaacatgtttgcagaccctttctgctggctctaaccttgacacagtgtcatgaatcgaggaagggcctggggtcaagttgtcatccctccaatggcgggggtgtcataagtttggaaggcttactggaaatgtactgccttggtgtctacaaaactcattttgtgttcaactaacctcagttcttccagctcttagtagctccataatgagagagaaccacctctaataaagcttattcttacagcacaggatctttcagacagccttcaccttctaccatctgccacagtttccatttatctcagctaaggaatcaaatcatttcatttttttctctgccagcccaaccatggtattgggtttcagctaaaccgtgagtgtcataaagtgtgctgtgagggaggcagagcctagaaaataggatctagtggtttgaacccaagataacttgtagactctcactatgactgccctaggctattggttctcaacgatttagggtgtcatagatcccgttgaaaatctgttgacaactggacttaaagattgtctctcagaaaaatggacacatatggacagatatgcaatggtttgtgtacagtttcatgaggttcatggctttcccccatcacatacattttgaggcagggtttataggcctgcttcagtttgtcaggtgaaaagtataacttagtctgtcctctggtgagtagagttgaggattacccagtctaccctccagaattctggagaaggattttggcttcatgagatattcagatcaccccttctttcctatttagcacttaacattgttatgcttctttctaaagaaatagcagacattatgagtcaaatgttttcccaatcatggcaaattttctagcttatgctgggccctggttatgctaggtccacaggggaagctttgttgtttatctccagcaaacattaactcatctctttgttattatggatagggtctaggtcttgggaaaatcccattgtgtcttagttagtctcctctcttctcctagacccaccagagactcatcacctgtcttgtccaatctaggacctagataatgatcccataatccattacctcttctcttcttactgctttttcacattttagagacttccttagagctggagttttagtatctcttttggattatctgaatatttgtcccccatgtgtacctctatattatatttcttgcatgatattgaaattacatgttggttagtctgactctttccttaaattaaaagtcccttaaggtcaggacctctatattgtttacttttgtacccacagtaattgtaactttgcctgacacatataggtgctcaataaatatttactgaattgaattgtatatgtttggatatccaaggcaataacttaaatagggactcaaaaattgcttaaaactccaggaatctttccatggctaatccatcagatatggttagccaatttatctagatacctgaacattgtatcaggggacatatagggttcatgctatctcatttccatgggatctgtgtatgtgtgtgtgtgtgcgtgtatgggtacgtacacagacctttgcttcttggttaccacaataacttgaaaacaataccaaaaaaacctctcttctgtaatctctctgtatgtatatccctccaatgcttcttcacatttctttatctccatgatatatcttaacatctctttcatctctgcctctttctcttttggttggcatatcctaagacagcatggacagcagccactccaagtagcaacgtcacactagttcaggaccaaggacagcggcatacatgtcctggcagtggggagagggtgctttagtttgctagtttgttcagtaaaatgacctttggatgtgtcccttctcagctgtcagaccgtacctgcagttctgcaaacctggttgttactttggtcctggttgttccatgtatgtggtggaactgtgcccagtctgtgccagtgtattcctgtgacattgctcattgatggtcatggtgaggacactggagcaggagtggcatggttgtagaatcagaaagagagcaagtgggagtgggaagaaactctaggcttgggtgagagggtctgctccaggagctgcctgtgagggtcctctgccctaaactctgtggtcagccattgctactttactgccacccatatgggggttggagaggtggttgaggggagaagcatccaagaggtgctggacaatttcatatttagatacctgccagagtgccttccataatcacagagccccaaactgacttttcaagtcagcaatttcatgtttaactagtctttatgccctgattaaattaagtattaatattattgatatttgtgctggggaaaagggagggggactgagatgagggtcccaaggagcaaagcttttctgtgtctgaacttgcacagcacacaccttctgcccctcggcgcctttgtaactctctccaaatatattataatagcaaatacacagctaatgttcaacagttggatcataataatcactgacaagctaatgttctctgttactttgaggacccatccaacagcagtgcttaaagtaacaaaaaagacaataaatctaccactatcaccactacctgtgatgtatgagcactttaggtaacctggtgagttagaaaggaatcagtttcaaaacaaacacagtgggtggatagaatcacttctgaagtggccattttcttgtgtctgtgctatactcaagatgtcaacttttctggagagggagggcgggaggaagagtgagtaagcctgtgtgtattgcagctgaggtctcaactcaaactaatattaaatcttgtgaagaataaacagaaatggttgctcattagctgggcttagagaggcgttacccatatgtttaaagtgctaattattagtgatctttaatggagctaatttagcagtagaaagtgttacaaatttccattcctcaaaggtagcccattagccaggtctttatagctaatattgactttagaaagttcatattgaaattggcctcaattagagtttatgtgagagagggagaaagatgaacatgaaggtagaaataagcacaaagaagcatcatgggaggaagagacatggcagttactaaacactttttacgtagaaggtgtcatgacacttgggatgtgagaaactctgcctctgggtcacccattaagtgccagctgtgtaccaagcactaaagtcattgagagaagtactcagcccctgccatcaatgagcttagagtctagcgagggagccagatgcagtggtggacaatggcagaacagggaggtacatgccagtgatatactgaggcagagaagtgagtccagcccagatggtgattgagcagttagggcaggcaccctaaggaagctgtccagctcactatagtgcagggcagaggatggtcatttatggaaatatacttcaaatgcatatcagagttgagagaaggtagacattgcttttctccagtgtaaaggctgcccgacctagttatcagccaagtccctggttgttgtctcaggttacaggagacctggtcagtttgcttagaaaagctcagtatttagcaattgccaaaagaagaacatttttttcccctttttgtgttgaaatcaggttagcagaggctcctgggtgtcctttgcttagaaatcccatggtcaaggaggagaactctgctgcaccatccctcctgcacacctgccacctaaggagggggatgctccttggtccatttgatgtttgtgggtgacagcgatgaaggaagactgtggggggttggccccactgcgcacaggtagattttcaggttggggagaggcatgtgggtctccacactgtgctgtgtgtttggttgctgacataaagctgcccagcctctctctctctctctctgccaggtttattcctttctctaagcacacacttcctgtcttggtggtaggttttttttttgttttgttttgttttgagatggagtctccctctgtctcccaggccggagtgcagtggcgtgatctctgttcactgcaacctctgcctcccgggttcaagcacttctcctgcctcagcctcccgagtagtgaggtttacaggctcacaccaccacaactggctaatatttgtatttttagtagagacagggtttcattgtgttggccaggctggtctcgaacacctgacctcgtgatctgcccacttgggcctcccaaagtgctggtattacaggtgtgagctactgagaccggccggtggtagctgttttaaggagaactctaaggaacatatttatagtcactggcggcatttttcaacagtttccttaatagctccttagtgtctataaagaggagacaggaacattcacctctatttctttctctctctctttctgtgtgtgtgtgtgtgtatgtgtgtgtgtgtgtatctttctctctagctctttatctcttgctcttacccctttaccttatgttttctcccactcttgccacctctctctttttctcttgtgttaacataggaaaggaggggatgaaagaagggagaatgaagggaatgaagatcttgcttctaataggttctctactaactccagtttgactaacagtgtcttctcctaagggctccacccattttctacacagaagagaccaggactttaagtctctttcctttatgattcagtttcacattgcactttcatggggtcttacacaaactgtcagcctgctactgtcccagcagatcccaggaggttacccacaaacatgcttcctgcctctccttggacttagggagaagatcaaaagagacaaagttccagtgcccctaccccctattctaccactaacctcagcaggggccaagtcccaacctccccgtatcctcaaagataaagcagaatgtgacctggaggttgggatcagagcctgctgggccaagccctgttcaggagccacagccttcttctgggaccagccagattccacccagctctgccccttgctgtatgtagcacagacctggctctcggagtctccgaaggcacttgcagtggcatctttgccgatgcctccccaggtgtccaccctgttgggagtcagaccacagagcccaccctcctccatgcactccttttcatcaccccctaactctgcttttctgttcattgagtaaaaccccttcatccatgacgtacagtttgtttgcccctccctctctgccttggcatgtactgcttcccaccatcccttgcctcttctgttatttacaatctaatttgaagatcatcttctctgtggagactgacctgatggatcatctcaacttgccattctctgtcttctctgtgcctgtgcgtggtcagtttcagtatttcttgactcttttttgtgacaggccctgtgtgaggttctggagtagaacaaggaatactacatggtccctaccctcaaggcatcaggatcagttaatggggagtaaacgaaaacacataaatgccattcaggagtgatagattataaagtacaactggagacagctcagcttgatggggaggccagggaaacagcacagaggaaatgacacattagagagagatttaagaggtaggatcaacagaaccaagtagccaaatcaatatgtgtgatggaggagggggaggagtctagggtgcttcccaggtttctgtttggttagctccgtggatgatggcaccagtaattaagatatagtggatacaggatggtcagattgggggaagggtgggaaggtttttatcagaatctcagagtcttcactggttttttatccagtctggtagcttcctggtattgggggaaatggacactcggtattttattaggctggaaactcagcagaaattgggtttcccctccaagggagagaattgcctgagatgggcactgtgttctcagatgcagagctccccaggtgggcgcacccctcctttctgtttcctgaccagcatttccccagtgttcagggctttgtacctgtgagtgggggtgcaggtgggataaagaggcataagcagactggcttctctgtcctttagggctatcttagagatggcatcttggtgacagtatttatgctaccgaaagtagttagagaaggtagggctctgagggtaggaaggaagatttgtggtgaaattaaaacatctgatacatgaaggaatggtttaagctaccaaaattctgagcagtttggacaggtgttattcataaacactcctgccaccaaaaagtaagatgtgatccactcttaatgccctggagggggaatttatctacctcccagatagcttttttattccaaagctgaatttgaataatagatgattatagggtaatggctgaatctctggaatctctgggcagtggagaggggtcttcccatggtaggggccagaggggtgatgagtagtgttagatgagattttaggggtcctgtttaggccaggctacagcatgcttttctccatcttctgcctctgaggcaactctggaatggaaagacatactttagtacacaacttcccaaagtgtaatgtgcgtatggatcagctgggtttttttgtgtgtgtggtgggggctgttgagacagggtctttctcagtcacccgggctggagtgaagtggcatgatcacagctcactgcagcctcgacctccctggctcaatcaatcctcccacctcagcctcccgagtggctgggactacagatgcgtgccaccatgcctggctaatttttgttgtattttttgtatagatagggttttgtcatgttgcctatgctggtctcaaactcctgggctcaagttgtctgcctgccttagcctcccaaagtgctggtattatagatgtgacctaccatgcctggcctcacctggggttcttgttaaaatgtaggctctgactctgtaagtctagggtggaacttgagattttgcatttccagcaaggttctaggtgtatgtgatgcttattaccttgggtaccaaggctttaggactcatctttaagaagctcttttttttttttttagtctccttgcattttgtacaggtggtgtcctgtctctgataacagttaattgtcctatttggaaacccatctttctctgcttggaagcccccttggagagcaggatccatttcttatttgtcttactgtcactgaagcccgacatatggcctggcccatagtaagtggtcaatatagaattaatgaaataatgaccttaggaataggaaaatttcaaaattacaacctaactagggtccagccaaatgagctcctgcacctctcaattgtaagccagatctcttttatgcagcctctcagtgactcagtgccattttgagtaaggcttctatactggacaccacacgggtgaagtagaaagagaaggcagaaacctgagcacagggaaatgtgcagaaacagggctcaggcccacttgaagcaacattagaacacttacatagtaacttctaaataggtgcacattaaaggggtgtgactgagaaccaaaaggaaacaaagagcaatccatggatactctggcagcttgaacctccaatgctctataaacgcccactctgttgtttgtttcttcacttgttgaaatcaggaatgctttctgaaggaggttagtatggaacacaaggcacccaggtgccctggggaatatactgctactctagacccacaaaaccacagacagggctggggggctcaagggccagttttaccattgccgtgtaaggtcacacagaggctggaagccacagtgaggctgactggcattttccaacatgggaaatgatgactagaagcaatgtaagcataacacgtttggagcaaggagaagcaaaagtggggcttggagaagacccatgctggaggatcctggggagatggcaggggtaatttgtacttccttaatagatgtggagcatttcaactttgctaattaacggaacagcaggcttgtaattctgacagcagcaggacacaaatggggtgggattagcactgaatgccagtgaagcatgcctttgtccttaagaagaggcacaacacccaccacccacgttgggtcaggtccatgaaggtgccatccctgattttgttttttttttttcctgcagcaactccaagggcttaggggttttttttttaatgtcttctcaggccttccaggattttttttttttagatggaaacaggtctatgattggtctagagcaggagtgtctagtcttttggcttccctgggccacattgaaagaaaaagaattgtcttggaccacacagaaaatacactaatactaatgacagctgaagagctaaaaaaaaaaaaaattgcaaaaaaatctcataatgttttaagaaagtttacaagtttgtgttgggctgcattcaaagctgtcctgggctgcatgaggcctgtagaccacaggttgcacaagtgtgatctagagtttattttctaatagttctaccaaatataccagaaataacaatggcaatggaagcttgccttcttcaagagattaagcctcattgaagttcttccatcactattctcccattttggcattttgggctacctgcaaaatggggtgatctgcccctgagtatctgtaaactgattctgggggacaaatgggccaggaagccagtgaaatgttttatcttcccaaggtgcaatgaatcttgttagggaatttattcccagtacttccttttaaagcatattgatctgataacctgaggatcttaaaggccaacaaatatgaagagaaggtttagaaagtctcagagtattagagctgagtagtaccctggagggcatctactcagattgccagtgcttggtgtgacaaatgaagtcactgaccttgtataagtcattttaggaagggtcaacatttcattgattcatttattctttcatcaaatatttattgaacatttaccgtgagtctaccaagacacgtacccgatagtgaaaacatgttgctatttcattggtcctgtttgagttagcattcaatgaacttctcctttattatatattccaacagctggtttcacaagggccctgggggaattgatatgatacatagtatctttagtcagtgcaaataggttttatatgcaaggtcaccaatttctgagctgctgggctaattagctctacttggctttacataatacatatattgttcaaaagttatatgtaatttaatttttggcaagtgaaaaactgattcaaatcactaggggaactttatttgaagagactctggagcaaatccttttataatgtgaaaattttagttgtaattggaaatgattgtcccctagtttggattttgtaaatgtggacactttaggtttacttgtggacacacaaccaggcccagcagtggcctctacagggtcagggaggaccctggcctgggaagtagaagccctaggaatcctagaacagcccaacccaaggtattgacatttactggagcccatgactgcaagctgcatggacaagctgcacaccttctctcaggtcctgggccctggtggggagaaggaagaggtggggcacaatgagtgggtgtgatggatgagacttggagcttcctcttcctctccaaggatgggagtagagaggagataggatggggaaccctttgcttccattatagcaaatttgaaacccttccttaagatcttatggctatttagaactaggaccctcttgtgtactgcaacacagtagaggacaagagggacagcagtagaaaaaaataggaaaagagtttaggagaaaagagagttatgtggactctttttgtatagtaaatctcattagtttgggccttgctatttttgaacttgtaaataatctgaaagaagacaggactgaaatttaacttttatattacatttttttctatagaaattagtggagtgcatggtgatatagaggaaagcgttttaaaattaatgtatagaaagatatatttcacaaaggaaaatcatgtattttgatacagaagcatcattgttcacaaacaagtcatgtattagttaaagatccttgatccttgtctaacagataaagcctaatagattgccaaggaagctgaaatgtctcctcattgcatgaggatgaaaaaaaatactttatatatctatttgtaaattctgtaataatttatattgatcctaattagcctctattagtgaaatttaattgtttttctgtggaaaagataaaattagagcataaatatctgtagaaacaggatagaaagttcaaaatagtgcttataggctttgaaattcgagtattcttttttatggtgttactttgttttcctattgctcaaggtcttctcaaagtgagccttgtagctggttctctgtcagctagtaaagagaaacgactgatgaataaaaagacttgcagtcttcatttggtgaaaaatgaaagagaagaaataggcaaaatggtcagagacacttaggaaatttgttttaggtttagggtatgacctctgatcatagaaactggcattgtgagcacacatctctcttcctccttggttgagtgtgcagttggcccacttcacttccctaggccagtgatcttacgcctggcccagaattttattgccaaaattcccggatgggtttcttgaaacagtcaatgtttagagattgaaggattgagtgggattgtcctgcccagcatgttgttttcctctgtcaattgtcaaatttggaccctaagggtgtaagccaagtggagaaaggcaccagagggggtatccatggtatctggttctgctctctgagctgacatacaaccgctcgccttctgaggtctatttgtgtcatgtccctaatggcgacacataacagagaccccagttatagctcgaatcgctgtaagtgtgggtggctctccctgagagtccctgtggggttcttaggttaaatgatagggatgcaatggtctagcctggggtttgtgtatgtggaagctgggtcctgacttcccacaaatctcacactgggctggattgtcctttgcctcctgaggctactgttcctccaggcacatctttagtttccattctttgtgagccccaagattctgcctccagccccctaacaggaactcaactagaacatagaaaggactttctaaatgagaagcaagatttagaaagagaacaagttaaacaaggtagtgggtagtgcatttccttcccaggagatttgtatctccccatctcctgtctattgtggaccaatgatgatgacattgaggggaggaggaagaggtggggagaggagtattgtcatcaactttgcttccatctgtaggagttttgtggtttactttccttgtttgtaaaataaagactaatagttgttgtgccagaggaaaggcaagaaggattctttaggactttgtaatccatcttgatatcaattaactaattcaacagatatttcctgagtgctgagtatgttcaagacactgtgctaggcactagaggtacgaacatgattttttaaaagtcccccggcttcaagttgctcaatagcaacagggctgttttttttttttttttttttttttttttttttttttttttttgcccccactgcatggaggtttctccatgtggggagggtgacttggattgtcctctccttgagaaggactagggggttgcagccctgatcacccctatggctggcatgatgtggaagtatcccttctgttgcagaccctctcctggtccatcgggctgggctgtaggacctggacaaggcaggacttgccggctgatgatgggattgggagactgaggatgggaccttgcgattcagccagctggctcctctcaccctgattccttctggtttgttgtcccacagggtcttttcggaatgatggtttgaaagcttctgatgtccttcctatcctaaaggaaaaggtggccttcgtgtctggtgagtatttgtgggactttcttttgtaaaggacctagagaagttgtgtgtgtgcacatgtgttcagattcacttgtgtgttagtaggggagaagtaggggtggggaagttatgcttggggcagctgctttctttctcctgaggcagatggggagggagaaaggagggctctggccccagctgagtgttctaaaggacacccagaaccaaagggacattccctgagcttcccacccaacctcagccccctggcctggccctgtgagagttgctccaactggagaatctgtgcacttggcacattcctggaggttttatctgagttcatttctgcatggatcagggacgggagatttttaaaggagtttttgcttcctccttatctttctgtcctggcaaagggaactcaagtgagggttcatgtttagatgtttagtttttgtttttttctgaataatgacttccaaatatttatatctgacttctctctcccatacatcttgtgcacaaagacctcttaatgtctcactctggggtaagcaatctgtagctggtgggccatccaccagtttttataaataaagttttattggtacacagcaatgtgtatttgtttatggagtgtattagtttcccattgatggtgcaacaaatttccatgagcttagtggcttgcaacaacagaaagtcattattgcacagttctggaagccagaaatccgtttcatggggctgaaatctaggggtcagcagggctgtgcttccagagtttctaagagaaaattggttcctttcctctcccagcttccaatggctgctgacattccttggcttgtggctgcatcatttccatctctacctccagggtcaaattgccttctcctcttgcatctgtgtcaaatctttctctgcctctctcttttaaggatacctgtgactacatttagggcccacctagataatctagaataattgccctatctcaagatggttaacttaatcatatttgcaaagtctttgccatgatatgtttgtgggctattattcaacctactacagattgtgttgatggctgccttctcgctgtaacaacagagttgagtagctattgcagagaccatttggcccatgagcctgaaatatttactctctgaccctttaagaaaaagtccggtgacccctgatataattgaagccaaagactggccagagcccctaaggcagttgttctcaaacaataaggtatgccagaatcactctgggtgcctgttgcagggctccactctaggcctccgggatcagaatttctggtagggtctgaggcagaggctgggatagacagtgttagtagcgaaagattgtattttgagaaacatgccacgtgcttataccacatggaccaaacctttatttctgggtgattttggttatctacaaggagtagcagtggagtcacagagcaagagctagtccagtcctgtagagcagaggttcatgccacaggcactgttggtctggctgttgggcgacagccaaaatagagagaagaggaggcgggaagaggataaaggaaaggggaagttaagcagcagttgtctcccacctcatcggagaaaaggcgagagcctgatgattcagagtgtaggtgtgggaggtgagggcaggcatgcaatgggagtgtgcagaagactttgtaatgactaaatgcattctatattattgtaattattgttagcagtagtagcaatagtaatttattattgccattgctgttagatgagagtgacctggcagctgcctcttcccattaggggctagtatatcttataaggtaatgagccccctgccactgaagatgttgaacaggcagaacaactccttggcaggattacgcagcagtgatttgggtatggggagaggcataggtaacacaacctttaaaacctttagaaacttggattctgatttcttgctaagcatatgggaagaccttgtgcagaaatcctagaggccactgagcagtgccaggcctctgatttctgctgatccccgtagcctgggctcccaaggatgtggcccacagccctctgggagcccaatcttatcttttcttccttctttttatggtccttagttaacctgatgttcttcctgtcccctggatatcctgccaatactcccatttctcttgtgcctgacacttctttccctctgcagtgccttctccataacttctgccaagttgagcctttcctctccttccagagtcagtttctactttacctcctccaggagaccttcctggatctaatgtattcctctgagaatcatcctattccacatcagtttggggcatatgcatgcacaatacactctgacatggagacccttgcttgatgttcatggtttattttttcccatgtaaattcagtcagagccctgggcagagcctcagaaaaaaaccttctcaagtggtaggggcttgtcctaatggagctcatagaagcaacgtggccaggaaggcagtcaggaatgaggcaggtagaaaattccctgagtaggacgaagggggctgggagcatagctctcccccatttgccagcgtaagccgaacagcctggggtaagccttattcaactgcacctgcgcttgtggtgccagaaacttctgggcttagggaacattgcccttccgtgtctgggaaggacactgaataaactgggaagataatgactggctgcattaaaaaagcaaaaaacaaaaacaaaacaaaacaaaaaaacccccaaaaccaaaaaaaaaaaaaacaaaaaaaaaacaccaaaccaaccaactcttacatcctgagcttttaaaagataaaatgcaaaaataaaacaaaatgaagaaacctataattaaataatgcagtttaacagttggatttctttctgagaagaagaaagcgctgcaaggaaggtggtgagcagagaaacaggctgtttgttaattgagcctgccctcctctgctagcgcccagccttggccaggcaaaaggaaagccatgctgccatgggaacgtacattgggaataatccagggcagcccagaagcttctgcatgtgggcgtgtgcatgtctgtgagacaggatttggggctgtccctcagtgagcctccgttgttatccagcactgccccattctgctctgtcattcacagctcacgagctccccttggcctctctgatgtcctttgtactacttagaagtcacagcacccattgtcccttttatccagccttctcatgtggggtccatttcatcctattgtctttatgtgcatacacgccttccttttggccacctcctcatgattcctctctgcctccctatctcccaccaatgtggttttccttattggtttccaccgttcccagggaaccttatgttgctgtggcacaatctttcgtaccctggacctgcatctctcaaagtgttttccaagatcagttccacaggatgatcctctacaaagaaaacggggttctactctcaaagaagtttgggaaatgctggacattctagctctccttcttggagaattacaatatccattaaaatacattaacattttaaggctctgggaagtcctgcagtaaagaactttattttttttttttaatctggcattttccaaactaaagaataacctcattccctaaaaatttatgtgtctgtgatgcatatccattaacatcttgcagatctattgttacattgactttatcatggggtccttattattcatctctgcttattgtcctctgtaatttcagcatctatgtcaattattgatcaaatcctatagcttcattgctactcagcctccttggtacgaaagtcctccacctacctaccatgattatgcacgtccaagatcttgacccttgatgtgtctatctgtggttttagtcccttactttgacctttctgatatcctcttgtcatttgggagaggatggatatgagaggaataaaatcaacacctttccctcttttctgggatctcatcatccaatagaacatctcccaccctccctgggcataccccatttatatggtgcattagctccactctgccttcactcagcttggagcctggcacagatactgtggccaaagctttcaacagagctttcgctgtgccctagtatcctgtcagcaaccctgaagctcatgtcctacccagtcctactgtcattctcgagagaagttctccagtgatggtttcatttccctctcctcagtaccctaagcctaccctgaccctggactgcctcttgtctactgttccacccaaagaaccatgtccctcaggcaggctgaactcttccctctccaccacgtatctccatttcctcctctctcttggagttcaacagcctgcctcagagaggggggcagccccatctgctgtgggctgggcccccgccttatgccttccctgagaccttgctccgttgttgtccctacccttcccagcataaagattctcttcctctaggctcattcctctccttttttctataatcttcaaaggtctcttcctttctgaataccacatggcttgatcctgctgcctcctcttgactccttatctacacttctggatgtggggaattagaattctccaggctttctcttctaactcctccttcccttccatctgaaccttccaaacttcctattcactatttattatatgatttgaaagctcattcattaatggacactatgcttaggaagtggaaccaagtttctcaggagtgtcagacagggaaaaaaaaaagcagaaacttgattctgtttcctgagcatagtgtccattagtgaatgcactttaaaatcatataataaatggtgaataggaagtttggaaagtagaggaaagaaaaagtgactatcttccagccatctaaaaagctccccggccgtgatcctgaatctcatgtctccaaggccagccctggttctagcttgggaggggcagtgtcagccagccctccaagccaccctttgccagttggagctgtggttccttgtggttccaagactctacttgtataatgtccaaggaaggtcaggaaaaaaacaacagctatggtaaaacaagcaaacaaactgccagagtgacaatgcttggggtgaggtcaaggatagaggggaaggttgagagtgttggaggacctcccagcttttgggaaaccttccatttaattttctcgcttccttttcctcatgtggaaggcaatggagagatggggaccatttccaaggcagatgagacaagggtggttatcacgtcaaagaaccagggctagtggtatgaaaggtccaactctgagttaatctgtatgaatctgccctgagtgggggcgctgggcagtggtggtggtgctgaaacactttttcatcagggctgaatctcacagtggcctgatcttatgtaatccttttctctctgcagcctccttacttcctcctcaagggtattctggattgatttttttgtcaagcctcccctctatctgtgtggcttctggaccccttaaccagaaggaaaccttattcatgaactcacacttgggcgggatccctgggagactctgccctctgtgtaagagatccttgttttccagtattggtgaggttcgcacctctccactctctttcattagatccctttgtggtcctactctggggtatatccagtggccacctgagatgtggcgtgaagagtctgtgatcatgacatagtggttttctttgtgtaatggccagtgccctgtaaggtcatagttacccttaacttttttcctgtttaacgcccctgagaaacttggttccacttcctaagcatagtgtccattaatgaatacattttaaaatcatgtaataaatagtgaatagggtatttggaaagtagaggaaagaaaaagcaacgatccaaaatcctggccttctaatagcaacagaaattgtcattttggtatactccttccagttattttaaatgtgatgtttagaaaacacttgtaatctcagtatgtatgtatgcatttgcagtgattaagaccttgagcattctgatttctgataagattcatgtgctcctctagcaggagtgacaggtggcacctcaggcagacaggcaggggtggttttttggctgtgtaaaaaatacttaatgttttttctatgaatctgaaaacttcccagtaatgctatcctgggatggatgctttgaggtcttctcaccatagtagtcagctcatcacaagcactcccacctcacagaggtctataaagagaagtaaattagaggttaaatttccaaagaacatagcactttccaccagcttgttttctcaataagaacagttatcaccattttcattatcatctcacatttgtagagagctttacttttccaagtgcatccccatgtgccaactcatcagttcttgcaacagccctgtaatgtgcacagtactgttttcatctgccttctacagatgaggcaccagagaagccaaaagacttgcccacggtcatatgtgctacctgcatctagacccccccaccttgtcctaagcagtgaccagatttctctggataccctatttctgtctgatcacccagcactcagacagatttctttttcctctgtggctttcctttctgactggttttcttaaacactcttctcttcctccttcttgcagggggtcgtgataagcgaggcggacccatcctgaccttccctgctcgcagcaatcatgacagaataagacaggaagacctgcggaaactcgtgacgtatttggccagcgtgccaaggtaaggggaaggggaatggcctgcaggggagcgggaggggagctgggctgatgccagttttggaaggagcctccatccctgccagggaccctagtggtttctgctcttccagtggattctaaccattcctggaacaccattgtccattgtctgcctcattcccattgttactgctgagattcatgtgaatggggtgggagctggaagtggcaactccggacactcaactctgtatcactcagctacaggaaacactctatgacactgatttaggtcatgcattttcagtgggagtgatattgcccccaaagagagtgaaaattggttcttggggatagcaaaagatttttttttccatgtattaaacacaggtatacatactctaccaaggtacagtatatgtgtggtattaaattttcactgggtagggtgattagggaaaaaagatctaaaaaggctccttcggggcctaggatgataattttaaaaagtgtgagaaacactggtctaggtagcactggccacaaggtgggtgtgggagacacgccaaggacatagttgagacggaagagaagagagcttcacttgatcagagaaccacaagatgtgagagttgggagagccctgaggagcaatctaggcagatacatgtcatgtcctgcttagggaaaggggctgacaggggatgtgtgtggttcacaagggtcagtggcagagcttggtctagaactcaaccctcctgagtccagccccggtgctctctcaccatctttgttcttgagcagcgacggcactgctctctgtctcttagtggggccaaagcctgtgaaatgtttgttgtggcaaataagaaatggttctttgggctttcaaaaccttcgtcttgtctctgtgcattttatagaagaattagtgaattacagggaggagctatatatccagctttgcctttgctggaagacctgggataatttttgaatgtgctgattaagttcttgaagcaggtgttgagtgaggcaagtactgcatttcagagagctaaagaagagatgaatgtaaaggagtggttgggaggtgatgggcaggtagtaaaggggattttaagagcagtcatcacatgcttggaaggatgttgaatggaattgtgagccctgaagaacttcgggcagaagactgaacaagtagatgctgaatagtgtctgtttttttttttctttatgatatccactgggaacagaaaaaacataaaaggtcttaagcttcagtaaaagggatttgggttatatctgaagaagaacttataaactttgagtgcatgaaacaatgaatataaggatgaaagattttttttctgggggtcattataaagaagaaatactcttatctgtctcagaggcaaggaggtagactaaataactcgtgattgatataggtaatttagcaatttagccatctaggagctaagcagttttttaaagcacttttcctaagtaagtgactaacaggcataaaaccaggaattttctgaagcaatttacaatagaagttttcatagggagctgtgatgaactctcagttctcttaaagacagaagaaattgggatcccggaagacacaaagggtaaatttttctttcctgcgtgttcatcacatagctgcagctaattgatgctcatcttttctttagaataaagagggaaagagttggaagaatacttttcttcattctgacttgttaagcaaagagtgggacaaaacagacgggaagcaatttaaaaagaaaagatttccgctggggtgaaggggaacaaaacccaagaggggctgagaggaaggtcatgaaaaaggtggaataatacattatcactgaaggaacacacaagatgcaggctctctgcttctcagggggtggtcacatcagtgcaatctgcactcctgagaactggaaggctcttcacagggcaggcgagagccctattgccagtgggaagaactgttctgtgatgcctgctgccctgcctcctgagggacctgcattcatgaagagtgtaagtgcctggcaggccgcagagttcacctagtcatgcccaccagtcacttcctaattctcttggctacatgtcacacataatggctgttggatggaacaggattgttctaaagacagtgaagtttggggtaggaaaactgaataacttagcaggtcagattatatttgccactttcttctttgtagccatggctttggaagagaaagggaacaatgaaaattaactgttagactcagtagatgatactgatgagaagaaattgtttatctgggtcagatccaggatgctaaaaagacaggctctggttgttggaggtggattgttacaggctggtgtgatcaagcctgtaggtgacatttgatcatttgatgcttttttttttttttgagactgagtctcactctatcacccaggctggagtgcagtggcacaatctcggttcactgtaacctctgcttcccaggttcaagtgattcttgtgccttggcctgccaagtagccgggattacaggcacctgccaccacaactggctaatttttgtatttttattagagatggggtttcactgtgttggccaggctggtctcgaactcctgacctcaagtgatacacccacctcagcctcccaaagtgctgggattacaggcatgagccacctctcctgaccaacatttgctacctatttattcatgcatttattcattatgtagtcaacaagtatttagagcttctctatgccaggtagattgaggatttgtggtgaacaggaacacacattttgagaaatttaggggaaacctgggtattttcctacccagtgccaaaccagtaatagtaaaaggcagcccaagatgggagtgcattgtagcgtaggagatgaaccagccagcagaagacaaacaaataaggataagtgagtggtgaatgaggatcctagaatttaaggaaccagcaaacttaatggccatttgggggaccattttagaatagatgattaaacagatagtgttgataatttagaaatgaataggaagaaatagtcccactctcctctctgtaggccaggccatatctggaccactgcattcaactctgtaacattcatctggccagcttcattttaagaactacatagatcagttagagtgctgtcaaggaagcagcacattaaggcacccacaatccatgtctccacagttgaaggaatgagggatgtttgctggcaggcatgaagatgaagaaaaaaaaacaacaaaaaacgcaattcctgacttcaggagagctgccccagaaatgagggaacaggcatggcctctgttgcattaacgggtggacgttagaatcaggagaaagaacctgcccacatggaagctgtctagcaacactgctgctgcctctggagaaagtgaacttcctgtcactggagaccagatgaccctctgttagggatgctgtagaaaaagttcctctactgggttgaaggtgggcttagataacttctaagaatctttcctgccccgaattctaggtttctgtgatattggaaaaaacaatgcatcataaaatccagggcctcagaacagagtattaccacccccaccaatatgcatctaagtgctctcttctcagacttcctaagtaagttaaggtctgggatttcacttaagattttgtctataccttaaatcctaagagaacttctttttagtccccttcgactccaggtggaaattttggggcattacccaggaccaaggatcctgttggggtgtaacagcttggatcagtcctgacttattcgttcagcgtccatcttggcctgagatgagtcccgtcattttaacttctctgtcttgctcctgatgagtttgggcatctatctcctaggtcactcaggttttccatcatcttattctgaggagtcataggtaacagggtgggaagaaaccttaaacgtcttctaattcaacttttcaataactccatccactcagttcaacaaatatttactgagtgtctactatgagacaagttctggataggaatcttggtgaggcctcatgttatctttactgtcatccacctacacttatctaacatttttttgtcctggtctgctgtctgcttacagttacttgtacgtgaaaggagtggaaagaaaatactcagatgtgatcagctgatgaatgtccctagaaattgaaagacaggatagaaaatccagcctgagagtaaacaactgtccaggcctagcccacagtgtggataatctacccactgtgattattgggagttgacgaaatgcttgaaataggaatttctaagcactacatctagtaaggaaatcctgggttacttttattgcattgaattcctcttcatcatcactgttagcctgctttgtcacgaccttctttctgtgactcctaagggcaccagttgatgtatctgacacttaatctgctcttagcagttccactgagatactgagtgttctgccaaggaatgtggttatcatattggtgaggaaagataacaagaaattaggatgagttattctgtaatgtcaatcaaatcaaggtgcctttacttgtggcctattatttgataacatttgctcttgttctacggatttcagcaaaacataagttgggcttatggcctgcactgtctttgtgcagcattaccagaaaataggtgtaagcagagagaaccaggaagacagctgaaagaagaggggtaaaaactgcaagggtttcctgcctctattttctgcgtgagagagcctgagctatccaaactactgccatgaaacatgttctgttgtaagggcctgttgagatgtgttgttgataccttactctttgctctgggatcatcaataaaaggaggatgtggggaggaaggggagggatcaggtgatggaaaggccagataataggaccaatgagaacatttaggtcacattgtttacatttccctaaaacataccttttaaagatcattgttgatttctttatccattttgaatttaaaccctatgtataaatagcttataatttctatgtataaacaagatactttttacacacatttccagcaataccagttaggtgtccctattgttggctatatgtaaccccagccctgaagagcaaatagcattctaccatgctgctaggaaacataaagccacagtagtaactgcaatcgttagtaatcaccttccttagagtcatatcagcttttgcagcaaaggatgaagaggcatcttagtctagatggaagatgctgagcttcggatcccagctctacctttctgcagctgggaaacatatggcccctcaacctgggtaatttgggaagactttaaccaagacacagtttataaggctgtgggcagagaacagagaaaccagcaaggtttggatccctcaggcattgcaggcctggaaacagcacggaggggaaacattaccacttctaagagagaggagagctttgtgagaggctgcctgacaggaactgtggccttcagtggaagatgccaccaacacatggtgactccatgacagggagcaggggaattggtaccttgaccccactctcttcccattctctcatctcctgtcatcattgactgaatgtaccgagaagccagatgacaggggagcccattgatgtagtccatgtaggtcaactccccagggcactgggtagtggagagaagatacagaatggattcaaggtgcaaatggaagatatttggcacagagggagactttgggcatgctagtcaccatttctaagtttaatattctaatttttattttgggaaaataatgtctatctcataagggtattgtgaggaattatctagcaggctctctctagcacccaggtgctcgtaattgttagtctttcccctaaaggaggtcagtaatagtaataatgataataatagcaacaaaaaatatatatgaacatacatagatagcaatatttgctacatatgagggactagatgcagtgtatgtaaaggttatgaagcacaataataaagcgagcacttgagagcctaccctccaatttgacaagcagaacatcacctctatcctcaatgctacctagggctcctccccattctgactctcctacttcccccaaaaataacactgtcctgggttttatgtttatccttcttttgctttttgggaggtatagttcagcacatattttcataaacaatatatgatttacttttcttgtttttgagctttataagaatggtattgtacattgtgtagttttctgtgactagcatttctgaactattgtgatgtgcaacaacatggatgaatctttaaacataatttagagtgaaaaagaagctaaggttttgactctgagaactccaaaccaaattattaatagattaatgcagtgctaaagtgtctcttgagaagtttctcttagctaactgaaataaggaaaattaataatgattacttttctccatactttagaataaatatcataatttgtgtcaatatcaaacaaaaagtaaaattcttttcaatttattaattattggtattaagtaagataaagtatatcaagtccttacatagtgccaggtacacagtagattccataaacatttggttgcgtctccttctatggtctggggaagtctagcatgtgcataattgtggggtagcaccctgagttaagtgatgaaatagagggttgaacccagtgctctggccttccagcatgtggaacatacagcctcgctgttgactgggagtggggagacttcaaaagagacgtgagcagcatttagaagccccaagataattttgctaaaagcacgaaggggtaggaatgggccagtcagagggaagggctcaaaggaacactgggggtgggcaaaggagatgaaggggtgtcaggttaagttccagaaactcaagatgtagaaacacatagtcttttgggagaatggcagaggatagggcagagaggcatgtagaattctgtgggtctagttcaagaagttagttactaataggcaataaaaaagccattgaagagcttttcagcaggagaatgacaattaaaattgccttttagaagattcactctggcaactgagtggaagatgaaatggaagagaaggctaggcaatggggaaacagttccaataatgtggcttaaagacagtaaaagtaacaactagcatttattaatcaattctaggcactgttataagtattttacatgcattaacttaattctcaacaacactttgagaggggaattatcattatttcccttttacatatcaggaaactgagacgtagagagatgaagtacttgcctactggcacacagtcagtatgatctggagccagatggtctagcaccagagcctaagcttttatccagtgaagagatgaggaggccaaagtgaaggaagtggcagtggtggcagagtgagaggactgatttggggagagtaagaaggtgaactctgaaggatgggctaagactggatttggaacagagggacaatggaagagggcggtagggaagggcaccaacacagagatctaacaatggtgggcagggaccactacgcttcagacttcctttcctgaagcttctctttggaacctaagtgtgaaggttgctgcaggtgagaaatacaggtggtaattacctcagttttgggcttctgctggccaaggcaaccatggtggctgtggatatgcaggacaacaggggtggtgagggtggtggtggtgttggggtccttcacagttcctcccccaggtgtttgtgttcagttttagatgcattaactctcatttatgctcatctgtgggtgatagtcaaccatgatttagttaccaaattataccaagagatgtagggagaaaacaaaagcacttaagaccatagaaactatttaaagagattaatgaaagactatcagtagcagggaccccgagcttaatgcctacattggtggggtagtctctatcgtattctagcgatgatcatcttgttcattttccttgagtccgagatgtttccttcacccacctgcctgtctgtttctatattggcattgctgtagtgtcagaagtacaattctggaattagtgctcagttaatgcacattttgaggctccttcatttccatggccatgccaccattgtaggacttggcaggtctgtggggcctgcacagtccatgtggggctaagggactacaggggctcatggaaacgctgtgaacagggacaggttgtagggagtggggaagagctggctatcatgcttcaaatgcggagagacacatttgtgattccctggagaacaataactggagcaatcagaggcggaaaccacttggtcatgaagtaactatgagaagcagccctggttattccaggaaccagtaagtgcctgtagcgataaatcaaggacccacccagcactggacaaaagaattcctaataagtgagggtagtgagtctccttcacatgcatattccatgtatactctcagaaggggctttgggcatcagcattgacttggtgggagtggaacaatagcagagaaagaatgggctgcagggaaaaatgctgacacctggaaattatgtagggtattccagtccaggaagaatgaaccccagaatcctcccctctgggaggtgaaatgcgcatgcttgctaaaaattttcttacctataaaataggcataaagatattaccaaacacaatggtagtgaggattctgtgagataacacatgtaaaatgcctagcccattatttagctcacagaaggggctgacaacaactggcagtttctttcccttcccttgcttgaaagtagggaccttcttttgtcacttgtcctttattgtccctagcactgctttttcaaagttagggttagggttatgcttaagtttaggattagagctagtagtgatagcagttacagccataggtcagtaacacttcacttctaatacgtaatgaatgaatatatgtgcctaacagtgtgacaaagttttggcctatatttttaaattagaaagatatttcttttactggagaaagtaagtgcagaaaaaatattttaagagttttttaaagctcttgtaactgcaccacctagagataataacaatatattaacatatttccttcctatctttttttagaggtttgtttttttgagacggagtttcactcttgtcacccaggctggagtgcaatggcgtgatcttggctcactgcaacctccgcctccttggttcaagcgatcctcttgcctcagcctcacaagtagctgggatgacaagtgcccaccacacgtccagctaatttttgtatttttagtagagatggggtttcactatgttgggcaggctggtctggaactcctgacctcaagtgatccacacacctcagcctcccaaagtgctaggattacaggcgtgagcgaccgcgcctggcctagagctttttaaaaacagaaatggactgtattgtttcttcagttttgctgcttgctttattccagttagcattatactataggaatattttcataacattaaaaacttttcatgtgtaatagtgtgtcttgggatgcatcatatttaattaaccatatcactgggcatctaagtcgtttccagaagttcagtgttgtaagtaaccctcagtaaaaatctttttatgtaaacctttgtctgtatcttaagtggtttcttcgagataaatctgtagcaatcatgggctttttttagttgttacatatataatttttttttgctttttaaaaattgatacataatgtacatatttatagggtgcatatgatattttgatagatgtatacaatgtgcagtggtcaaatcagaggcattgagatttccatcatctcagaaatttatcattttttttgttggaaacattccaaatcttctcttatagctattttgaaatatattataaattattgttaactagagtcactctactgtgctatcaaacactagatcttattccttctatgtaactgtattttgtacctattaatcaccctctttgttccttctcccttctcttcccagcgtctggtaatcatcattgtatttactacctgtgtgagttgtttttttctagctcccacatatgagtgagaacacacaatatttgcctttctgtacctggcttatttcactgaacataatgtccttcagttccatccatgttgctgcaaatgataagatttcattctttttatggctgaagagtactccgttgtgtatttatatcacattttctttatccattcatctgttgatggacagtaaggttgattccatgtcttggctattgtgaatagtgctgcagtaaacatgggagtgcaggtatctttttgatacacagatttcctttcttttggctacatacccagcagtgggattgctggatcatacggtaattttatatttatttttttgagaaacctctgtactgttttctgtagttgctgtactaacttacattcccaccaacagtgtatgagtgtttccctttttctgcatccacctcagcatctgttattttctgtttttttttgtcattgttgttgttttttgtttttttttagtagccattctaaatgaggtgagatgatatcttatatggttttgagttgcatttcactgatgattagtgatgttgagtatgtttttcatgtacctgttggccattttgtatatcttcttttgagaaatgtctattcggatcttttgcccatgttttaatcagattacttattttatgaacctttttttaaagctggtgggacaactcaccaaatttatttccaaatttatcaatttatactcccagtatgacttgcaatgtttgtctttctgtgcctggcttatttcacttaacataatgtccttcagttccatccatggtcatgcaaatgacaagatctcattctttttattggctgactagtactccattatgatttcctttcttttggccatatacctagacatgggatcgctggatcatatggtagttttatttttactttttgagaaacctccgtactgttttccaatgagatttcctattctttgcatttccctaaatttatttgctcaccattgcccaggcaccattgtgcaaacattcttatcaccatcatcaatgaccctaacttagggccatatattgtgtacctaaaccttatcctgactttggaaagactaaagggattggtcacagggcctgctctgcagggcctcccaggcaaggattccttttactttcctaaactaatatggccccttaacagggagcgcacattaaagttaggatctgatatgaaatctaaaaagggcttgcttgtttttttttgcccttggtgattctttagttttgcctctggatgtgtttcagctccttggctggttgtgtagtcagttctggcatggcttaaagtggttaacctcttttgtgtttatcagaactggtgtccttatctgccttttatggagaaaggcctttctgggcagcaatgttgaatgagcctggaaagcctagatgtggtcatttaatttctcttttaggctactgttgtctatggctcaccaagagcaggctgattaggaagctgaagtgtctggtgtcaccttgattaggtcaacttcaatgtcaggtgaaataagatccaatgcattcaggtgtttctggagtttgtggtaggtaatcaggatgagttaaatttagctgggattcatttggctggaatattgaaaataagagagttccctgaatatagatgctggagagacagcctagcatctggggaaaaggatgtgtttttcagttatggggatccagatttggggctgtttctctttcccccattacatatcattttcactgtgttttctatttctctctttacttatcattggttaagtctgattatgtgcccttcactgatgtttggggttgagtatgttttcaggcatatatttgatacggacactctatgttacgacacttcagttttgtagagactgcctttattgtacactcttctggcagtttaggtgtgctgccaccaagtggtagagtacctgagctcagttgcccaagaagacatagatgggttttgtcagaggctccaatggttctattctggttctctcctcattaaatctgggattttccaagctttactgtttaaaattttattgaaacactgaaatttaagcaaccaataagcaaggattactcttcttcaactacaagtgagtttgatacaatctttctcaaagaactgtagtaaatgatagataaaataatgtttgtgaaaatgtttcacctgctatgttgaaactgggaattttataataatgctattttggggatataaatagtgtggtgtttctataataattctttttaaaataaaatcaaatttaaaaaaactaaaacactaacaaaaaacattcctgttggttttgccttcatctttggtagatctgaagttgcagtgccccaagcgaacttatctcttggagctcccactgtccccctgacctttttcatcagccacaaacattgaagataaaacattgaagataatttgtcttttcagaccttcctttccagacaatattttctttctctcaacatggaagatgagtacaagaaaaacaaaactatctagggtttctgttgcagagaatttagcttgggtgtaggcactcatcagttgcagaagatttctgtaccagtttgcctctgtcacttgtattgaaaaaaaaaagtctccccctcgccttctccaccccatctcatgttttcttagattgctttagaaaaaaagatttattcagaattttgttctcaaaagtccagcattacctaaacaaaacaagtgatttgaacagcatttaaagatttttgaatctggaaaactcatataatgggggtgagtcccatcccttctatgagatctgagtgtcctgagagaaaccacacaactttctctctgataggtggtgaacctcttgcaggttggaatggttggttttgtttcttgcccctgagggtgtggagcaccaccttgcaaactggctgaattcaattagactggaggctccccaaggaaaaaggagagggcttcaccccccccatactccttagggccaatgccgggatctctatttcagacatgaagtacctgaggccagactgaggtttccttcaggaggttctctttcctctgtccggggctgtgaccacagggggttacccaggccagaggtgggtggactggcactgtggcagagtggggcagagccttctgccaggggacggagcatggatgtacctgcgagggaactagcagtggactcagtctcaccaaggagctatattcttgtttctaaattaagcaagtatgacagccagccccatttctcctggaacttagatgggagcactttgtcagccatggtgactcagcaaggatgaatgtttttcggataatttactgacgtaattcaagcatgtgtcctgatggccctggcccctctttccttttctctcagagcctccttcctctctgcatttcccatttgttctaggtcaagtgaggaccagccttggttttgagagctactaaaaaactctaaaatcagtacatttttctcccttgcatctcccagactgttctgtccggagctggaattttatctgtttccatcgctagtaatgcatgtgccaggttttggcctggtgcctgagacaaggtctgaaccttgtcctgtgatgcactccaccctggttccctacacaggaagagaatgtcctggatctccagaccataagctgttttcctttgcaggaaattcaggcttcaccctcattggctgaagagaaactccctgttttgaacttggaggaaagcaagaccattcctcaccctcttgcagctctgactatgaaggagtgctgcattgggaagattgcacattggttcagatttaattctgtggatacacaggacacttgtttagttcttacatacacacaaactcagagggaatggtcaaatgatctcttggctgaatttgcagattaatggggtggggaatgggggagggacccagttcttgccttcaggaggtttgtggtctggttaaggtttcagaatccacaggagaagacaaaaactgaaagcttccaaggcagcagccacacaagcatgtcagttaaatggacgtaatcagacataatttactggtggtaaaaatctgacctggattgtaaaggaaatagatgaattggaattctggagcttaaaggcaggaagaagctgtagaggtctgccaggccaactctttcttttaaaaagagtagaatgctgtctaaaggggtccagtcatgggctcagggtcctccagctggctagggtaccagtcctgagcttgctgcaatcatacatacactgccccctaacatagaccctgcctgtgggacagcagggtgcctagagcagcatgcacaggataagggcctctatgaagtcatatgtggagggattcttccaccctatatgtgagcttcctgagcttctgagctagttatgcatgggggcagcctagtttattctgatttggagcaaagacctggagcccttggtcctccctgttccatttcaagatccaaacatgcaagccttcacctcccacagggctccccgactccagctctttgacctcccttgtaattcccaggttcccactagtgtctgagccatcacaaggtttttcctccatgtaaaccatggggatctcatcagtcccctctgccagggcaaccctggctgtgtgtcagagggaaggcaggctagctagagggtaacagccgcctgccctgcaggaaatagagctcctgcactggttggtaaaacccagtgggcatggcctggggggggtggctttgtgtggcgtgttgcattgtgtgttggtggggatggttgtgcatgtgtctgcgtgctgcaggcaaagagcactgggctttcaagaatgtgactgctacttaaggagaaagaggaggagggaaggagaggaggtgtgtgcaagccacagcaaggactgtttcctggaggaaacatgtggtttattaatgaggattccacctggcctgccaggaaaccagagcccagctggagagtgtgtgggggttcctgtgagagggcagggagaggtgggggtgtgacaagagaatgaggagtggtgatggcatggtagtaggccaagcctgggagagttgctgctctgtctcctggacaggtcgggtgcagcacctgagtgggaggcagcccatggctgcactgttgccatttctcttgagtcccctcagctctcttctcttactccacgttttagaaaggctccttgtgtcttacagtggggtggctgaggcactgtgcttagacaggtcacagtctttgtcacagatatatgtgctatgatcataatgatattttttaaagttaaaagatgaattgtttttcatatagcctgactaaggggagtggggagcgggaaagaaggagagggtagagaaggccagaagagagtaccttgggggttgtctgaggagggctgcggaaaatgggagggctatgtgggttttggtttccagttctttctttccctgtagtgctttggtttccatttcatttctgctgcatgttctgaatggcccagaaggaagggatgaacagctctgtgagggagggtgggaaatagggcaggaagctgctgtcctgaaatggatgtcagtttccatcccactcccatctgaacccacccctttgccaccttctctccctagccagctagaccagactctaggagcaatggttcttgtgctttcacagttttcatgtcttctcttggctaagagtagctccttccaaacaaatgctgtgctcccaagccactctgattcagaaagtgggtctcttcctttggtgaacaggagttgtgtttcagagcctgtaaggctgtaaaatgaccttactgattgacaaacccatcagggtttatgcagctgcctcatgctggtccctccaaggtgtacatcctttggaagactgcgtgcatttgcctgatcctgctgtcacccccgccattcccggagctctctttgggagctcccttcagctgtgggatgctcttttgactgtttgcggcgtggcatggcaagtctttgctttttttttttttttctttttttctttttttttgagacagggtctggctctgttgcccagactggagtgcagtagtgcaatttggcttactgccacctccaccttctgggctcaagctatcctcccacctcagcctccctagtagctgggactacaggcatgcgccaccttgcccagctacttttggtatttttttgtagagacgtggttccaacatcttgcccaggctggtctcgaacccctgagctcaagcaagtcgcctgttgcagccttccaaagtgctgggattacaggcgtgagccactgtctttgttctttttgagaggacttgatttgtagaatattttgtttaaaggcagcattgaagacaagttgggatttggatgcagagatcccgctgagtgattttaggcctctggacctgtcactttatggctatacctgggaatgttgggtgtgaccctgggacctgagtctgtgctattgaatactttaccacactctgcctggaagagaaaaagagaaaccaccacatccctgttccaggtgtttgcaatgagaggtctttttgtttttgttttgttttgttttttaatagtattatttgtgtagaattaggtagcagactttaaaaaggtggaaactatcaaccttcctcatttggtctgcagttagggtttccctgggactctgatgggcaagagttgggtttgcttctggcacacttgagggtgaggaactgacaaggagtagttcctagacctagaaataggcaaacaaatctctacaactttgccttcagtggtacttaaccatggctgcacattagaatcaccagggggaacttttaaaaatgatcgagtccaaccccagaccaattagtcagaatctcctcactttatagacctggaataaggcagttgacagttagatgcctggtccaaacggctaagatatccagccgactgtgtgacctaaagcaagtcacttcccgcctctgaaacttgctaccctcagttctaacaggaggagctagcaagaagaagcatgaatgtttcctcaagatcaagtgttctacgcatctatgaggcaagatagcatggcagttttatgcacagatactgagtcaaaccactttatagaggaggacttgaaacttagatttaggataagatactacctttgcaccaccccactgcccccactagccctggcatcacaaatcagatgtgcagaggcaaaagatgtgttgttaaatgggtagaaaagacactaactctttggaataataacctgggtaagaggccagagggtgacttccagtacaaacaacaacaaaaacctctggatgaattaacgtagattctgaggaggtcttttggcagctggattacagcttgacagaaagacagctggtggagaacagtcacccatgacccagcggagagagcgcatgagcagcacagggagccccaccacctctctcctgccttctggatacccagccatccaggaggcctccccattttaaaggaccagtttgagaactgtctgtgggagcaaacattcattcaaaacccattcctagagagcggctcattctctgtaagacactgtctcatccaatattctctttactacttctgattataccaattagagaacttaaagcaggtgataatgtgtctttaacacttttctttaacacctgctgatctctggtgtttcagaaagtgggtgtggcttggggcaatcagcagaagtacagaggcagttagaatagccctgaggagcagaaagcagcttaacatagatcaagtaatgggcaaaagtttgaacaaagtctagatcccacagccagagactctccacatgtctgaatggcttgagaattctggcacaaatgggtcaggagaattgttttctctacagaactccaggaacctttctttctcctcaaatttggaagaactcagtttatgtaatgatttagggtagacatgggtgcagcacagttctgggagaaagtgtgaagtggatacttacttggggctactttttcttcctcccttttctggtttctgtctgcctatggtgaacggtctgcaggtactaaaggctgcccaggcatcatggataagactcctcccgatcattcctccaagtcatcctgcactgtcagccctgtaggaccaaagctgtgctatggcagggccagtgccaccctcattaaatgaggaactcttagcttgccttgtccttcttctctgtcagccactcctcagtgaccaggctagctctctacccgtgttcagtttgtcaccttccctggacatcctagtgaataggtcttatttgaaggttaattgtgctccatcacagcccaagcactagggattcctggtcctcacactaggattctgacatcttcacactgctgataccctgaaacacacacccaggccaaaggaaccagcccccagcagcacacactaaggaggtaagcagaaatcttcatccccctgactggtctgctggagtggtgcttgttatgggtctctgcttccccacctgccatcagaatggatcaatgtgatctttattccagcagctgttttaagtgggaatctgccagacattcatagaaatggggtagatctcaggtggcatcacatgagtgggggcaaacagggtcaggccatttctctgctgccagagcacagtggaaaccatgaggaggatggtccttattcctgagttaggggttttagtactcacacaggataccctgggcctccaagccagattatttgatgtttgcttcttcaagggaggatttttcttcctgtcacttccagagttctcatggttttataaaagacctggagtaaggcagttgacaactagatgcctggcccaaatggctaagatatccagcagactgtgtgacctagagcaagtcacttcccacctctgaaactttctaccctcagttctaacaggaggagctagcaagaagaagcatgaatgtttcttcaagatcaagtgttctatgcatctatgaagcaaaaaaaaaaaaaaaaaaaaaaaaaaaattgtagttttatgcacaaatactggagtcaaacaaaacaagattcaaatcctgattttaccctttccttgtgactgtaagcaacttctctgagcctcagttttcttaacggtagggcaggataataaatagcagctacttatgagtttcatctgaggaattcataagataatgtatataaatgttaatacagagcctcatgtgttcggtaagttagcttttaccactaatatgtgaatatgtctcatttttaccaaaaaaagttgccccaaatttcagtagtttggctctcattgtatatgtctattcagctggaagatttgaggtcctcacgatttagagggctagccaagatgtagctgctggtctcctgcttccttaccaaagttcatgatttctgcttcctcccctggctgcagtggaggagcagccagcatccaggctgtttgactcctcagggcctttgcacaggctgttccctctgtctgaagtatatatatatattttttttttgagacagagttttgctcttgttacccaggctggagtgcaatggtgcgatctcagctcactgcaacctccgcctcccgggttcaagcaattctcctgcctcagcctcttgagtagctgggattacagtctcctgccaccacacccagctaattttgtatttttagtagagacaggtttcaccatgttggccaggctggtcttgaactcctgacctcaagtgatctgcccgcctcagcctcaccaagtgctgggattacaggcatgagccaccgtgcccggcctctagtatttttttagtgttcccctaacaaattatttcttatagtttcagtctttgctcctcatgtgggctgtcctaagaagttcttaagacttatcataacttgcatttattctctttatctagcattgtcttgtgtccacctctccttctagaatgaaactttcatgtttctgtcttgtccacatttatatatacctggtgcctggtactgggccagccacaaagtaaatgctcaataaatgtatgttgcatgaataaattaatgaactaatagataatatggtgcatttatgtgacactgtattatttgtgaagcaccttcataatgaggttctccttttgaagccgtatgaatctctgtaaggctctagaaattggtcaaccagagcctggctgtagataccccacaatagccatgacagttgccacgtgggaaagcacagggtcatggcaatgcataggaagagccccttatcccagtgcagatggagcagggtggggagggaatgtatctgtaagagaagacttcttggaagaagaggcttgtgaggcttgtgaatgtaaaaatgtgagtaaaaattacccaggcaaagatggggttggcgtgggcaagcacaaaggcatagaggcatgagagggcaaactgaatataaaattgaaactaataaatgcattaagagaggcatggataatgtgttgtctgttttagcgaggaggagattgctctgacagaggatgatcaggcaataatgtagaagaaagatcaggaaagaatagaaggtagcatttgaatttaaccctgtggtcagatgataatgggcggtatgcaaggtggttcactcatgtggccaggggagaatccagagagacactctgggatttgctcagacaggaacctggaaagaagttcaggaagaagagattggaagtcaagatgggagaaagtggcatttgtctccctaaggccaaactgtaatgtaggacaaagcttggcctggggttgtcattgacaggtgctcagccctgctgtctgggtccagagagacctgtggcttgaggcactggtaccctaattgccccctgcccctgaagtggaggtaattgagtctcctaaagtgtgaaacagagctgggataatagtagcaactaagacagagaaggcaaatccaaaggccaacaaactggttgtgtaagtttgtaaatgagcggggagtggcttgaagagtggtttttaagccttctccaaagacataaaaactttacagacaacaacaactgtgcctaataaaaccactttgggggattgtcttcaatagtgggctgctaaattgtgatctctgctaggctaccattagtgaaaacgatcagttgtgacacgcctattcattcattcctcacacacccacccacccacagaagccctctacacctggatctatcagacctggagccagcccagtgggtcaggagatgactctgtgggcatcaggtgtgggcaggacctaacatgcacctagagagacacccaggccttgcccagaagtttgagatgtggctgccaggtcaggtgtacgacaagaagcagaaacctcgcagtgatttcatggcaacttagagaggggagccagggaaagcaaatcttcagtaggtgtctgagcacatgcagcaatactggggagggaaactgccaagctctttagggaaatcctcattaggccaagaggaggagctcagtctttgcaaaaagaaccagacatttactccaatggcagaaatccttccaagcctattcttgcaataaatgactccactggagagaccctgaggccatggagagagaaactaacattttcaacaggcttctgtatggtgtagttgttgttcaccttgcagatgttgttctgacttatttcattgttactctatctatttgtgtgttacctactatttattaaatgcatattgtaatatctgatttagacaaagtgagtttttatcattaaactctcaaaaaccacacctaagagtgcttaactgttgtccttggatcactatggggagaatcctgagctttatcccagaccaacattcatcagaatatctggaaggcttcccccaaatcagcatttttaaacaagtgttctaggtgataaagaaagtcactaaagtttgagaagcattggcataaagtggtgaaagtgcttttctgagatagcacaggcttactaagtgaaaacggccccagtggcatttaatgaacaaaagaggaaatggtacaagaaacagctgatcaatcatccagtcatttggtatacatttatgacttctgggcccaagagccctggagagtctatgaaacagaacacagctcagtttgaagggattgtaatttatcacaaagggtgagaacctggccaagggggcctcaggggacccatggcccagatgggaaactatagggcagggtgagcacaggggagacagggcagtggctgccttctccctctcaagtagcaggtgtgggaacaggaagggggtcacccactgttctttcccctcctgaggggatttaaaagtctgctttgaaaaatatttttaaataaaaaataaggatataaaagtctgctgctccaaacttcaccctcctatgcccccgtcctcaccatacacaatgcaaacttctgcccttgaaagtttgatttgggctaataaatatcttttaaaaggtaaatcacctaaaggaaaaaaagcaggctacctgttagttatgttccactgtaaacgggtctgctcaaactgctgtcatttgagcacagtgaatgagagaacagccttggggaagagggcaggctggggagcagctgcgggagttggttggccagagagcaccatgcagactctggccactgctggggttggggagacagagccagggggtggaagtgcaccacaagcagcctctgatgtctgtggcacttcctgctaatcattacagagattaaccaggaagactgcttccttgctccagcatttattctggccccagcaccccactgaaatttccctgactcaagagaccgtggcctcttggttgctaagtacaatagttctgctcttagtgaatgaccagtctctctgcagcatttgacactgtggttcctccttgcaatcctctcctcccttatttctttgacgtcattcctctcctggttctctctaacctcttcattttttcctcagggtcatctacttccttctcccacctcttaaacactgatattcctgtcaattctattcttgactcagaagatggttcttttcctcttcctggattttgctgggggatctcacccacttgtgtgcacatcagctaccacccattcggggatctattcattcagcaaatgttcttgaacacctactatgtgccaggcactgtgtgactcctgaataaaaatttccacaccagatttctcttttaacttccagaccatatatcaaattgccttcagaatttcatatatgtatgaaatatacaattggccctctaaatctgctggtttcacattggcagattcaaccaaccaaagtttgagacctgctgattcagagaggtggctgtacgtattttccatcaaggatggttgagtacatggatgtggaacccacagatatggagggccaactgtatacaatttatatttacattattattcataacactgtaataaaaataactgtcttagactgtgtttaatatgacagggatttggatacaaatgatttattaagggtctgctattcaggaaaaacttgtaagagactgaaagaagcagagttaggaaaggggaaaaaccaactaaggataggtgaagacttcaggtgaagtctagctggagccttctggggagactggggaggcggtgaaaatgcatcacacttcagagttactctgcaatgaggtaaaggagctaggctctgacatacctgtaccagacaggcacttgctagccctggtgtgggagtataactgcccaggtttctcttggagaagcgtaggcatcagctaaagcaagtattcagagatggttacaggcatcagctgatagctccaaaactcttggaactggagaaaaggcatagtggttagtaaagggaccctgggtggacaccagtgacatctcctatggcagcttagacttacacagaacagtctgtgtatggcaccatcctaagtgatttatgtctattaggctttaagacaaccctgtaattattattcacattttacattgtgggaactgaggcacagaggggttccacagtaagtaaatgatggggccagtattcaggcctaggaagctggttctagttttcatacccttagctgctgcctccccttccttgtttgcaccaggcactgtagtaggcactgaacattcaacagtgaaatgaataaaaacttcctgcccttactgaggttactttccagtgagggaagatggacagtaaataagtaaaacatattatccagatggtaataagtgctaaggagaaaaataaagagaaggggtataaagagtgccgggtgacagttacaggtttaaatagggttgtccatggaagacttccttgaagagtcattttagcaaagacccttcttctactcttacacactcctttgggctgaccccagtttaccctccttctgcacagttggagggtaatctgtctgaatcacctgatcatgttccttctctgaatcttacccttcagtgcctttaggacaaatccactgctcctgccttgccatatgaggtgcattctgatttgaagcctgcatccactccagtctcgtctcttgcaaggcctgattctaacattgtggtgcctagggcaagagtacaaatggaagctcacataccctttgtctgaatatgtgaaattaatgtagcaagctaacaaactgttaaataaaacatgttctgtccttctaccttgacaaatatatcttcacagcaacctaggaggccaaatttaaatttagatttgttggactcctttgagctcccaggcccaaatgtggcagcacagtagaccagcctccactcatgctctgcctgccttctctctccactccctagctcagccctacatggcagggggacctcatgcattcaagtgaacaccccagctcacacatttatattctagccacatccttgcaaatagcagccctttgccacccctcaggcttaggggtacacataatggtggtgttacttgcccttgggaattggaccctggaaagagatacccatgggcccaggaagtaggctaagggtcctttgggcggagagtattagggtttcagatactaggagcttggcctagaaggggaagagggatgtgcagcacagactgtatgtgggtgagtcatcttggctcctggggtggagggggtggggtgtgcaaaaagagggacagagcccagaatgggactctccaaggcactcagagctgcactctcttgcattcaaaggcctgaaccagagttaatcacttgaactttctcaatatgccatgctcttttgcttctctgactttgtggtttttcacagactccagaagggagatcattcacttagactccttgccctaatttatcccgtctcctctgagtcccctaacttaatcccctcatctctgacccccaactcctgtccccaaacaaaaacacccacacatagtgtcagtgtggtgggttatagtatgatatagtaacctgagcttgggttttcttttttttttttttgtatttttgagtagagatggagtttcaccacgccggccaggctggtctcgaacttctgacctcaagtgatctgcccgcctcagcctcccaaagtgctgggattatatgcgtgagccagcctgagcttgggttttcaagtcaacagtcctggttttgaattttcgcttagccacttactagttatgtgatcttaggcaaattttatgcctccatttcatcttctgtcacatggagataaccatacctagtttatgaagttattgttaggatataatgaaatgatgtatggcaaatactgaactatagccccagcacagaatgagcacacaatgaaatagtcgtttcccctttcccagctatgccccttacttgaaaccaaacacacaaagcaccttggaagattagcctgttttcacagaaagatgccaattagattaggtcacagcactcagctcctgggcctctttctccatctcctgagttattgagaacctcctacggaatattaggacctaatttctactcttagttgtcagaaatgattagttaacagggcataacctgctactgaccaccagctttggatgctgggattgttgacctccagctcttggtagcaacacagaatatttgttgttagggacaaagaattctcaggtcagcataattacagcaacagagatggagtctgaggagcaggaaaataaggaagacaatcatctctaaggaaaggcaagacccacagttaacgttgccgaacctgacatagttgggcatgcaacaaatataagttaagctaaactaaatgatgctcagtgagaaaactcctaaatcccaatagaaagccactaatccctgatagaaagatggacaaaagagctgatcaggtaattcacagaagaaatatttacaggccaaaaagcaataactagtaatcaaagaaatgcaaatttaaatataatataatatattttttaataaaacgggcaaagattttaaaaattctatgaccagtgctggtgaggatacaggaagggggtggtactgtcatacactgctggtggacatgtaagttgacatacctttctgtaaaacaatcatgagaatgatcaaataagttatggtataggcataagatggactatcactaaatgcaacagattggaagaaattttagacatgagaaaaaactacgttacagtgaaaagtagaacagtatatgatatgaaaactctacgcacagaaaaggtggaaaggaaataggcctgggtgttataaagtcctaccattagcatctcttgcatggatctttgactacttcaacttttgtgtaattatcaggtgtttctcttataatgggaaagaaatcctgtaatttggagaaaaagtcacattgctttaagacaagaagatagacaaaattatttatggaaagcttcggccactcattgtttcaataagtgtcagggaagaagaggcaactcctttcctttgggatgcaggattggggagaatactcatcctttctctcatgctggagagagtcgcctctcctggggacttttctatgtaccagggaggcctaagtaagctgccttgtgcttgagacactcacatagtcaagagctgtggtctcttaatgaggctgtaacaatctcatcactggttgaaatttaagaataaagccccccaaaaaggtttttatttctttttgtgacctgaatccttctgtggccttactgccagcagctgtaagcaactgatatgtggtaggcacatatgtgggtcaggtaacatacatagtggtttaaacaagtgcagtctgggaaatgggaaattaagtgaaagaccctaaggaaatactatgctggtatttatattttaaaatgtgaagtaaccaatgtctattttgaattataaaataaacggattggctttaaaaacataagagaaggaaagacccctaactacccaaacatagactttcttccaaactgagatgttataactattctgaccttcgttttttttcttcctattctcaggagttatagtcaaagttcaaatgtttaaataaactttgctactaagttatatagcaacatcttgatttatttagcctgcttatgtcttggttttcaagatggtcactgtcacttcatcttgccttgatttcaagagtcactcctcccccatcgtccctcaacatcctgatacgtgcatttcacactgtgactcttacaatggaaatacatgaaacaactggtctgcatcttccattccagtcagttccactcttggctctctctgagtgatcagcatgactcagcgatctgattttttaagctgacttacattttaaaccacaaagctgggcatggtggcgcaagcctgtagtcacagctacctggaaggctgaggcagggggatcatttgaagccaggagttttgagactgtagtgcactgtgattgtgcctgagaatagccactgcactccagccagtgcacatagcgagaccctgactctttaaaaaaaaaaaaagtaaaaagaaataataataaactacaagtaatacatcttaaatacaatggtgataaatacatgttattcatactttgtgtaccatctctcatcaactggcagaatcaacatagagcctttttttgaaaaagtattctttggcccagtttgggcttagtggcaagatgtaccagtgcctgtcactgatgtgagcacagggcagaacaacacccctgtcaaggactttccatctcaggtttaagaggcaacagggtctctgtctttagagaactggaatttcaatggggaaaacatgattcattttaggaacaagaaagggagacaaacattaaaataaaaatcaaatacaattgtgaatatccaaattgtaaacatcccaacaagtacagttgactacaggttgggtagctcctatccaaaatgcttggaaccagaaatgttttggactttggattttttttttttttttgcggtggaggggaatgtttgcattctacttgccgggtgagtatctctaatccgaaaatccaaactccgaaatgctgcaacaatcatttcctttgagcatcatgttgaccctcttaaagtttcaagttttggagcacttcagattttggattttcagattagggatactcaacctgcgtaagaaaggccaagttatttgccaagtgctgggagaaggcagaatgccaggaccattggtcagatgtagaaagggttttctaaggcagtacagtttgagctgagtttgaaggtggccaagagacctggcatgaagttgaaagagtgattctggtcaaggggagtgcaggtttccgggtgctttttgactgtgtactccaaagtctcagctacccagagtgaccataccgacctctgacctccccacagtgaggacgtgtgcaaacgtggcttcactgtcatcatcgacatgcggggctccaagtgggacctcatcaagcccctcctcaaaacgctgcaggaagcctttccagctgagatccatgtggccctcatcattaaacccgacaacttctggcagaaacagaagaccaactttggcagctccaaattcatctttgaggtgagccagatttctctctcttagcatcttctttcccttccccttctgccatccacacatttctcacgtcctcttctctatctaccatacagtatgtgacacctcaagggctgagatttcaggattccttggccgccatggccttaccagttagagtatggggaggaacaagaggctcacgagattgtcccaaatgcacaccttcattagacagtcttatttactgttggtggttgtgttaactgggacaactgtttgtggaggcagctttgcaatttgtaacaaaaaccttaggaagagtttatatccattgatgtagcaattctttttttattgctgtatcatagttgtacatatttttgggtacatgtgacattttgatgcctgtatacagtatataacgatcaaatcagagtaaatgggatatccatcacctcaaacatttatcatttctttgtgctagaaacattacagttctcttctagcttttgaaatataccataaatgattgttaactataattcctctactgtgctattgaatactagaacttattccttctatttgactgtatttctgtatctagtaactaatttaagaaaatattcttttttttttttttgagatagagtctcactctgttacccaggctggagtgcagtgatgatctcggctcactgcaacctctgcctcctgggttcaagtgattctcctgcctcagcctcctgagcagctgggactacaggcacctgccaccatgcctagctaatttttgtgtttttagtagagatagggtttcatcatgttggcctggctggtctcaaactccttacctcaggtcatctgcccacctcagcctcccaaaatgctgggattacaggcatgagccactgtgcccagcctaatttaagaaaatattcttaatatgaaatctcaacaaacaagaaggtaaaaagccaggtaaaattgcaaacaagaaatgtctacaagaatgttcatcacagctcacatgttcctatacaatagtatatatacacatgtgcataaatatttatacatatatagtgcatatacatacacatatataggttgtatccttgctagccatgactgttggtgacattaatccacaaatactggctgggcgtggtgattcacgcctgtactgtaatcccaacactttgggaggctgaggagggtggatcacttgaggtcaggagttcaagaccagcctggccaacatggtgaaaccctgtctctactaaaaatacaaaattagccgggcgtggtggcgtgtgcctgtaatccaagctactcaagaggctgaggcaggagaatcacttgaacccgggaggcggaggttgcagtgagctgagatcgtactattgcattccagcctgggtgacagagcgaaactcctcaaaaaacaaaacaaaataaacaaacaaacaaaaaaacaaaacaagcaacccaaatacgatgaagccaggaaaagccatatttagaaaaaatagtattaaaatatttattgtttagtaaaatgcaggtgataaaacaatatggacactataatctgagatttgtttttaaagtgcatgtatggagaagaaaactgagattgaagatgttagtgatggtttattctacgtgactggatagtggatggtttttatttacttcatatgtttttatttttttcaaggatgatgtattactttcataatcaaggaaaacatgtttttaaactaaattttctggagggtatatgtttcccctgagaattttcaatgacaatacatcagattaaatcaatgatttaagcgtctgtattccagccaaatataaactgttcccttcctcagaattctagtcctcatctgcaaggggatgaacttttaaatgtgtgtgtgttgaaaacacagagctgcttttaatctttcagcagcttcccattccagacttttgtgccctgggggccaggagcgcctgtgtgtggtgtcaaataggctgtgatttgagcacaatgacctgacacttgatgcaggcgattctcactctgtgtaaacaatacaagaaatttggcttggtataaaaacagtgacctattatagtctcctggcacccctccagaacactagaagtcctgcagggaaatgctttctatattttggcttgtttatacagaggtggtgacaacaagcctatagatgtataagctgaagagactgaaaagcatcttttcagtaagtcttgatacttctgcttcagcattgctggcctgcatgtcccatctctctgtacctctttcactctaagttgaacaagcttgtctctgcctcctaaataagaggataggagagatagctgggggcctcccaatcaaaggaatatttataaggcagtatcttaaaaacagtgaatttaatacttagtgcagactggggtgacaagtgatacagagatgagagtataagcttgttcaacaacagatacttatacaacagatatataataattggtaagtataatgatggaggacttcccggaagtggtaaactttgagccaaatttgaaggagaaagtactttggaatagggtttctcaagtttaatgcacacaaatctcctggggattttgaaaatgcagattctgcctcaataggtctggggtaaggcctaagattctgcatttctaacaagctcccatgtgatgccaatactgctggtctgagagctatgctttgagtagcaaggatggagattagcaggagtttgcaactctacttgcacattagaatcatctgagggactcttaaacctactgatgtccaagctcccatttagccaattaaatcagaatttctagggatgaggtttgagcattggtatttttgcacactccccaaaggattctaatgagcagtcaagtttgacaaccattgttccagaccagtcctcctgcctatggcacctccttccttcctcttaggagaggggtggaaagagaaggaacaaagaggggatgctcagagagtggcaagacacagagagataaattgcttttcaggttttgagtaatgatgcagccttcagatcatcagagtgagcactaacagggattgagcatgtactccatgctatgcaccctatgtgctttacacacattgatacatttaatctctgcaagccccatgaggaaggaataattatctccattacacagaggaggagactgaggctctgagaccttaatagcttgccctgggtcacacagttaataagcatagggctgggacccaaacacagatattaatttgctagcctctcattcttcatgagaaagaagagaagcctaaagccctataggaaggaaaagatgtttactaataaactaaggtggttgcctgcatcatcatttgctggagacactttccttcctggagacaaacattctccagtccgctctccaggagcttgtaggggcctcacagagaaaaccaagggcgcagactcccctgttgcccatccctagttctgttcaccataccacagaagagctaaaagggagagccttggaaaagataagactgtgaaatctttgcagcccaagcactggcccatgttgcttaatccaactatgatgataccctgggtccacgggccttggttttaaagctgtggaaaactgtcccccagaaactaggtcagtttttcttccagcttctgcttctagcctctgaagcccttttgaagtgaactggggtcaggaggagggaaaatgaggagaggagggacacaaaagcagttcttctggggtggtaaatggctggcagttgtagaggcttgctaaagcagtcagcagtctgtagaaactgctgatcctgactgatctgtgactcctgaccagtgagtcccatggcctccactcaccatttccgaggcaggctgtggtcattattatgtggatttatcttgtcctttccctcatcctatttctgccctgttcttcccctgacatcactgagtatccttgtctgtgtctgccccttccagacgagcatggtatctgtggagggcctcacaaagctggtggacccctcccagctgacggaggagtttgatggctccctggactacaaccatgaggagtggatcgaactgcggctctccctggaggagttcttcaacagcgccgtgcacctgctctcgcgcctcgaggacctccaggagatgctagcccggaaggagtttcctgtggatgtggagggctctcggcggctcattgacgaacacacacagctcaagaaaaaggtgctgaaggcccctgtggaggagctggaccgggaggggcagcggctgctgcagtgcatccgctgcagcgacggcttctcaggacgcaactgcatcccgggcagtgctgacttccagagcctggtgcccaagatcaccagtctcctggacaagctgcactccacccggcagcacctgcaccagatgtggcatgtgcgcaagctcaagctggaccagtgctttcagctgcggctcttcgagcaggatgctgagaaggtaggaagggaacaggccaaacctgagccgggatgggggtgagggagcagaggttgctcatccaactttctgattaatgatagtactttcctggaaagctttaaaacagtgtgcctactagttttagctaatgtaatttttttaagctcacccttatatagtgtgtattatgtgcccagtattgttctaagcactgtgtgtaaatttactcattttaatcctttcaagagtcctgagaggtagatgtactattataatcacattttacagatgaagaaactgaaaggttaaagaattcaccaagctgggaagtgcagtctggctccagggtccctgcttttacctactgttagaagctgccccgagtgcctgcaatgagtggctcaagccagctaaggaacaaaaacagtactgttaacagccactataatattaattagtgattatggccctgcaatgtattttaccattgacaaaccactttcacacagtcttatttaatctgcataatcctttgatccttatgggttgagtggtggcatctctcttgacatgcagggaaacggatgttctttgatcttgggtctacagtgacagagctgacatctgaatccagcatttttctgtttctaagtccagggctcttcctgccatacccacttgtttccaaaggtttctcttcagctgctaagcactttcttgagtaagacaccattttttccagcagtgaattttcaaagctttccccttatcagggaaaagtaagataagagaatgtaaaaaaggaaaattgcatatagtgcctctttgctgaggatacaaaggtatctttcctagattctctttaagctaaagagaagaaagaagagtttactattatatgtgctttaagaagaataaaataggctctcttcctatgagttttctggatataacttatatttaaatggccaatactgttcttagggatgccatgacatctctcagtaacctgtgaattttacaatgtctgatatcatggttttctgtcttttaagagctcatattgaaaaatgtctctaggtatttttaaatgatgaaatcgagatcttcagctctctgtataagtgtgatcccaatttatgtattaaatataactgcaagaaaatttatcagaatattaatagttttgcttccttggggcaggcttatggttgattttaatttctctgtataattttataatgttttctaattttttataacatatagtaaaaaaattagtatatgcagtttttttaatgcatatcactttttatagcatatcactttttatataccttttgaatatgatttaagcaaggtttgggaacttctgacctttcttggggctctttgcccagtggcctggaagcctgggtctgaccctggcctgacctgccctgagaagggcagcttagacctcagaattcctgcattgctcaccgagtgattagatgccaaggcaggagccagctgttctgtgaagccagaatcaggtactttggctctgttgccagttttgttttctttgtttatttttttgttttgtttttttttttttttttttttttgagacggagtctcgctctgtcgcccatgctgaagtgcagtggcaccatctcagctcactgcaagctccacctcccgggttcacgccattctcctgcctcagcctcctgagtagctgggattacaggtgcctgccaccatgcctggctaattttttgtatttttttagtagagacggggtttcaccgtgttagccaggatggtctcgatctcctgacctcgtgatccactcaccttggcctcccaaagtgctgagattacaggcgtgagccaccgtgcccggccctgttgccagttttggaaagatctggaacatctcttttttcttgaggcctgttttgctctggggcagggaatctgctttgcagcctggcctgggtgcctgtttcagtgagcaagggacagaaagggaggtgggagacttaggtctgcctaggtatgttttagagtttggggcacttcatggtatccctcaggctcaaggacatgggaagcctgcatagggcacagatagtgcctgtctgaaaaaccaagtaaacggcataccatagctccagaagttcccaggtcaaggaggctgcctttctagggcctgccaagttccattcaacagggcagtaattgctgttacacctatatgctctcaatccatgttcataagaattgtatagtacattgataattactactttacagttgaagaaatggaaactcagagaggtgaagtggctggcccaaggtcatactgttggttagccagggccagtgttttaatctgtctccaaagcccatccaagctcttatccaataaccctgctgtccctctgctcccagagcttgccttctgctaccactgaacaccacctgttagcccctaggtctcctggcgcatgccttgatggccctagagaaaaatcccaaatcctacattttaatgctcattccacagcaggggctctttctgtgccatggactcttttggtctggtgaagcatatggaccccttctcagaataacatttgtaaatgtacaaaaaatatacataggcttggaaaacaattacttaaacacggttatttgcaggaacagaaaaccaaataccacaggttccgacttataagtgggaggtaatcattggatactcatggacttaaggatggcaacatagcaactggggactactggaggcagtaaagagagagggggctaagggttgaaaaactaactattgggtactatacccatacctgggtaataggattatacccaagtaataaacctgcatatgtatcccttgaatctaaattaaacgttaaaaataaaataaggaaatagttattacgttttaaaaatagcagcactatatgtatttttaattaacatactaataagatctacttgaagtctaataactaccataatcctgaagtagtgatgaatgtaaataaatgatgtttcaggacaacagccctgatgtgatatgaaaatgtgtgtgtttctattggagtcagagacacacactaatgcagtttgttgactgtgttcataatggaagagaatgctatatttcagttagaggttagtgaaaataaagacgtgatttttttccctatccaaatatatgatccctgaattctatccatgaacccaaggtttagaatgtctgttgtgtgatgtgctcataccttaaaaaggagtgtgggggagtgggcgaatgtgcacgtgtgtatgttcatgcatgtgcatgtgagtagaggggtggggagagagggagagaatattcaaaacaagggagcaaaaagaagggtgggacgagggcagcccaggaatattttgaggttgagtcagtggtgaaaatgccactcaagcttgacccagctgccactgaaaatgtgctgagtgctggacagggtagaaaaacagtccttttaagttgctttaagattaatttaaaatatctgcgcggagctaagtgcctcagcctttgacttatttggtggctttggaagggggtgaagagggtgatggtttggaataagggctgtgagtgtggatccacatctaaacaagggcttgaggaagtagttactgcctgagccaagtcttagtctcccttctggtgggaggctggttggcggaggcctctaattccagatctgggaagctcttggcaatcagaggagtctggtgatagttcagcctctatttttgtaaaagaggtgggcgcagtctcgcccctggccttgcagggtgacagcttgttcccaagggcttgaaaatgggttggtgttccccatttaccagctggccttggggagtgaagctgcctctcacttattcccctgacacctgtggtgagcccccacattccccatcttggaggtgctggggagtgggccgtgctctctcccaattaagtatctagggagtagggcctctgttccacagataattcataaagcaagtcactcattcatttaataatcaatgttgaacagctgtcgtgagccaccaaaagggtgggtaggccagaagttctgtctggagcagctcaccatctaattaagcaagtgagcacataagctcctgtgtattcacttttttttatttttaaaagcaggtttattgaggtataattgataaacaataagtggcacatatttaacatatatgatctgataagtttggacatacgtatacacctataaaaccatcaaggtaatagacatagccatacctccaaaagtttttttgtttccctttgcataaactcttacttattaaatgctttctgtgcatgctgtactgtcctaggcacagcctctgtgcttggagaatgttcagagaagagggaacactgctgctcaggaatgacaggaaagtcttaatgagcaatctgtggaaacacagagtaattcagagatgattcaaacaatgcatgatgttagatgaaccactgcagtctcagccgggcgccctctggtctataactaatgggcctgtcctccactgtattcgcagaacacaagccaggtcaccactcattggcctggtgcagattaaggctctctgtgcagccatgtttcacatctggccacccctccagttgtggtagaccctgtgtgatgaaggtgtctgccctgcaaacacaacctattactgaagagaagggatgggcctcttccccactgggggccatatgtggtcttaaaggtcattaagtagactcattgtagatgtgcctttggaaaatggaagggtgagtgctactcagtggaagatcctcccccgacacaccccttcctgggtgcctagggcacatcttctaatgctagaactagaagcagccgtgaagtccacacgtctacctcccacacaccgtagaaatcccagccttgccatctgatgacagtcattatgacctcgtgatgtcaatgtgctgatgccaatgataagtatcagaaaatatcgaaactcccatctgccttctgatgtggggaaggccctcagtcttccagtcttttcagggaaggagcagagcttcgaagagttccggtgcataactagacttaactgattgagaaatctttatctacttcatttctgaataaaggaagctctactgatgtctacccaggaggcccattttttagccttgcccaaagctattctggaaaggagaagatattcgcactttgggagaatccccaaaagagtgaacaaagctggctaatggggcttccagtattgaaatcatgcctattattggtttatgcagcacattgtatttgtttaatgtgtaaatgcatggttgggaaacacccaagacaatatccttatcaccctgcttgagaggatattttggtgcctacctcccccatgaccaagacatctagcccaaatgagaatctctcattttttttttaggtgttcagcagagactgtggcctccgtggctgcctagccctgcctttaccactacaggaaagctcaccttggaaaacctaatttttaaatgccttcctgcatattcatttttgcacggtgaaattctattcacatccatgggtgccatgctgaaatggagctgtggtgggtggggttaggatttgtcctggggtgacacgtatcaattgtgagacattaggcacatctttaacttatcacccccaattgtgttaccgacaaaacaaagataaagaatttatattacttctacttcagcatcttttgacttttcttctgcttccacactgcactgttctcatgcacaatactctctcttcatgaaaacatctttcaacaggagaagtggggtggccacggtcatggtggtggtagctttggaggtggtgatgacagagaataaacttctgaggagatgtaccagaatctgcagagtggtttaataaagccccaccccaaccccaatccatttctcttccttcctcttcctttgagacttgctccactaaataaatatctaagcccttttacaacttaacaattgtataatactttttgcttttgtgctttttcattctcccctacatatttatagtgggttcttctcttttcaggattgttgccttgggtaattatgaaaaataagaaacctctcagcaaataaaaccctactcccttgaggttttgtttgtttgtttgcttaaaaaaaagacaaacttcttcgcagggttgttatgagaattgagtggggttatgtatgtagcagtgcctggcatggtgcctggcccagcatagctattccaggaacattggcttcccttccttctccctgcactatttcagttatgatttactcttcagtcatgggtgcctgctgagaccatgaagagtgtcactgatgctctcttccaaatgaacctgctctaaatcattttcaattatccttaatggaacaaaattcagaattgatttttgagagaagttggaaattatggtgtagattcttgggggtcctgcaggtcaccaggctatgcagtgcccctgggcagggcacaaaagaggagcacataggtcacactggggtcacacctgaggagtcagggtggggacatcctccacagggaaagttctctggaaaaacaaggtctgtccttgaagcagccccagagaaaagtgattcttcctggtgtcccatgagaggtgagcacctgtccccatgcaccctctacatctgagacacttgtcaccttctgctttgcagtatagctaagagcatatttgtcttattcccttgcaaacttggggccagaaatacttcctatggcaatgtttatgcattttaatattcttggaagtctgtgcaaacaaaataatgctgcttttatgttaatcaccatgagaaaatctacactgggcaccactgggcatcgtggtaggcagcagaccactgtgctaagggtgatgtgcttattgcgttttgaggttggtatgtcctgttggccacattagcattgcaggacatccccaggatgccccgtcactgggcaaagtatccactgctatttcctgtcctctccctccaaggtataaacagttctggtcactccctagagcccaaaacaggacccaaagtcttatcctgcctggggtgaccagaaccagtggggctgttgtagagaaatcctgctgcttctacttccctggtggaccctggcccactgtctcttctcttccccacacctccaacacccccattccccatgaggcagcagtaacatgattccactgtcatttgtcaaagtgaagtgcctttgcagtaattacaatatgtaattcttttcggaatgttcaaagtattttcacacccatgaccttagagattttctggcccagcccttccttttacatagtaatctttgacccagagcagagacccacccaaaatcatccagtccatggttcatcatccaagtctcccatgtactgtgtgtggtaggccaggtgggcacgtataggggcatcatttcacagatgggaaagctgagacttggtgtgcttgagtggtttgcttgggatagagtcctctgctttgaagctggtgctcctccctcttctcccaacacacgcacgcacacatgtgcgcatgcacacacacatgtgtgcacacgtgcacacacacactctctacaccctctctttggaggctccttgccgtgcaggacagatggtggcatgtgccaggaacctaggcggtggctaaaggggctgggggctaggaggataagggtcacttgacatgtgtcctcaccagtgctgtggtgaagggacaagcactggacaggcctccagaggggcgtgtcatgtctctgtgtggttcaattgcctgagcccttcatgttgggagggaggcttcaaagagctgtgaccttcgggttggccagaagggcaaggcctttacggggtggttgtaatttcctgctttttttggagaaaggctccggtgccctcttgttcctgctctcccctctcctactgagaccttaaccaccaaacccctccacctcctgttgacggagctcagggcaaggaagtgtgtctgtatcccgccccctgacacagaacacagtgtcctgtattatttccagcctgctggtcctgggaatttcgacttactttttctcatttcctccccttgaacattagaaacattagattccaaaaataatctaagtcaccgtgttctacaggctgcatgtgtgtgttttctcccaaagctgtttttctccctcttaaatcctttctccctctcctttcttccctctcctgcattttcagccccatttgtatcctgagattagcacgcctgcaggaggagtgtgggtgtggagaacagaatggaggaaggatggggaagaatgctcaggcatgaggcttggctcccttccacggttctctcaagagagtggaaggtgccaagacctgaactgctgtgtgtaaaaagtctgcctatgcagcccctgcttatgaatggaccccatagaactgtggaccccttagtgactctttggaactgagaactaagacactgtgttaacagtactttccagaatctgggctgtcacactgactctgtctgcagcagttgaggtgagctgtgaaaagaaggtctgatcagagatgaactatgtgtgtgtgtgtgtgtgtgtgtgtgtgtgtggtgcagggcagtaactgagaaaagttcattgactcattcgtcaacagacattgagtgtctactgtgtgacaggccttctgttggggctatgtgtctctactcttaccctaggccttggatggaggatagtgtagggcagtgcagggaaaatcagagttagcactaatgtaattcttgatacatcgtaaggaaaagatggtttagagagtcaccactccagtggctagaacccaggtgagttaagatatcaaggtctctgttgctttctgggtggggtagggctggtggaggtggggtgagtgtcttagtatgtatgggagaaaaagcatggaggtggtccaagcaaaaaggagacatgtcagctctgccccagtaggggaaacaggggaaaggttttggtaccctgtttgaagaatgaaggacacttcaggtgtgtgtgtgtgtgtgtgtgtgtgtgtgtggtgcagggcagtaactgagaaaagttcattgactcattcatcaacagacattgagtgtctactgtgtgacaggccttctgctgggactatgtgtctctactcttaccctaggccttggatggaggagagtgtagggcagtgcagggaaaatcagagtttataaagtaaaaccaattttactttataatttgttttataaattataaagtaatttgggaatgccccatcactgggcaaagtatccacttctatttcctgtcctctccttccaaggtataaacagttctggtcactccctagagcccaaaacaggacccaaagtcttatcctgcctggggtgatgaatttgtcagactttataaaacaaagtctctgtttggggtaggaagctttcccaaggtttctttctaggcattttgctttgaggaacctgctttccttccttttttctaccttctaccattttccctgttcctcttctactccctttcccacttgtgaccttcttggtccctgtcctggcatctcctcaggcctgtccttaccttttgtgcacctgttctctctgaacttgttgaatggccttccttttccattcctgcttccttccttggtcagagttaaggaagagccccatgcacagttcaggcctcctgtgggggacagagagagcactggctttgaaactggagaaacctgggtttgaatccctgctgggccacttgtagctgagtgactgtgttcagttcaccccctctgaacactgatttctttatctgtaaaatatagattttaatacctgccttaggattattgtatgagttaaagaaaatgtacataaatctaccagtatggctggagccttgaagacattcagcacatggaacaaatggtagatttgtagagatagacttgtgctggcccatgtaaatgagtggaatcagcagtggatagatgcctggggaggctctcttgaggggcatgcatggggaatacagccccatccacaacaaagatgccagagtggaaagtaggcagcctgtggcagcagagcatggaggtgaggaacctggtggctggagaaaccaagaagggatcttgaggaggacctcatcagtgggtattagacacaaggtcagctgctagcagggagaaaaggaaatggaagctgtaaccagtctggcaggatcttagagaacacttgctgaagataagccaatcactgtgccgagtactgtgccagggatgggcaattggaagatgagctacattcaggcctggccatgttggagcagagggcaccagcaaacaaatagccattgcacaggtaagttcacaacggtgtctattagtgctatgggagcatagatggagaaatgtttagccagggtttgggatgcagggagatggaagagtgtgagcaaaggcacagcagcctcaaaatgcaggctggatcctgggaatgtctgcagttgggtgtggctggagcacaggctctacagagaggagtgcaggaggtctgtgttcatgccatgtgggttaccaggagtcagagcacaacagagagtcagaagtccatggaataaccagtggaccacgaggaaaactggattctggcaaatggttcaggtcttgccaggagcatctgagaatcctaaagtctttgattcaggtccaatcccttacccatggcagaactcccttccagatgtgcatttttccagattcttctgagcatttccagggctgaggaagccacagctttgtgaggcagcctgttccactgttctgtagccccagttgttagaaagtcctccttccagcaggccagaatctaccctcctgtagttacaccctgcagtcccatctctgtctcccagggtcattggggaactactctcttccttcccctgcagggcagctctcccataacttggggacagtgcttggggaccttcctcatgttttcttcaccagataaagttctgtgagttctttcagcctattttcgtttgacgtgggctctaaactctttaatgcagctttcctgggaccagtttttcaagtggatgaggggtaatgggaggagtctgcagcttttggtcccacttgcacaggtgagaatgagattttgtatgtgtaggtgcactagtttttgtagcccaagttagttgatctgaaaccccaagagtttgcccacccagagaatgatgttctctcacttgaatagagagagacaccatctcatatataaatacaggaggatgtcttctcacatgtgagcacagagagatttttccagtatgaaaatgttgagttaaagtgttctggtgccaaggtcagtagtagttactgtttctcagggaaaagcccaactcaagggtatctactgttcaaccccattcctgtatcccatggctcttcctgaggtcattcccaaggagagcaaaagcctcatactcttatcttgtaaagagtcggaaacctgtggtaaaacaacatggcacatgtatacctatgtatcaaacctgcacattgtgcacatgtaccctagaacttaaagtataataaaaaaaagaaaaaaaacacgcaaaggaatattaatctcttggaggaaatctgcctctagctggaatcccagaagggttcttcccccagtcccccatcccatggcccctttgaaatcccactcttggtttgttcacctctagtctctccttagtaagctttctctagcataagaatgtcctgctataggaacaactgctgatgtggtgagaagatatactctgtaacatatgcgttctggtggagagataaaagagggtttggtttcctccatcctctttagagattgggttgaccagcttgtcccagatttccctggggaggtgaccttgtcatgaggtggcaagagggggtacaaacatgagggccctagaatggagagtgagactggacttgggcattcagctcccatccctcagggcattctcttctgtgctttgcacattcccaccttttcatgcctttgttcatgccaacactcctcccatttggaatgcctgctccactatatgtgcctattaaaaccctcccccagctgaaggtccagctcagatgctactctctctgttctgccctgttggaggtgctctttctccctctgagcatttcctgcagcccttatccatccccctcaaattgtccctgttccatgccatctagcattatagctaggtgctcaaagatctcattcccccaattatattgaaaatttctggaggttaggaccagtgtcttcaattactctgtgttgaccagagatacttagtgccaaataaatagttgaccgtgacacagtctgtactcactgggctgcttgagaatagaacaaaacctgtgaacactgagctgacacaagagcaccacctactgctgaatggtttctaggaacgctaccttaatgcactcactgttgaaaactggggtgttagcaagtttcaccttgcaatggaaagagtgatttggaggcaagaaactggttctggtccttttatactaatccaagtgggaacagatgaggtggtagtgaaagtagaaagggaagggacaaaccctcgagacactcaagggaagaaaatgagaccagtgactggctggatgtcagggggcaaaggcagcaccaaggccttcgtgttaggaggattggcagtgggacacgagtgggaacaattcccgaagacattttggaagaaggatggataattaaatgaaattttaattttaatttgttttaaggcacagaaaagtgaaagaagtgattatgaaggttactaaaaacattatcatgtgttagctggttgttgcatttctgccctacatttttcttttttttttttttttgagatggagttttgctcttgttatccaggctgagtgcaatggcacaatcttggctcaccacaacctctgcctcctgggttcaagtgattctcctgcctcagcctcctgagtaactgggattacaggcatgtgccaccacacctggctaattttgtatttttagtagagatggggtttctccatgttggtcaggctggtcttgaactaccaacctcaggtgatccacccaccttggcctcccaaagtgctgggattacaggcatgagccaccacgcctggcctctaacctacttttagggacaatggatgctatctaaacacaggcatttaccttggtcctctggcagccttgaggagtgatggggctcttcattcagtaagttcttcctaagccctgcagagtatatcctgtagggtctggaagctggaaacactgccaagcttctccttgtggatgtgcccagcctggctccctgcatggccccttacctgtctgagccccattgcagaggctgctgctggaagaggggagaaggggcaaaatggggtgcctagtcctcctcctaagctcaaggtcaggcccacctagcacataccagcatagctaggtggtggtcttctccccaagagaagggctcccacagggaagcctgcctcctcccagagaggggctcccaaagaaagagctgcctcatccttagcctcatgtggagctttgttcccagatgtgcaagtgattggcacagccgattttaggatgtgtgggaggactagatgagaacatccaacagacactccatttttgcagtaacaataatagttaccatttattgagtgtatcccttatgccaggaacaaccattagctcatctaaattaacttgccaagggccagatctcagtttatgtctaaatttagctccgggataaagttgggcattattttctcagcctggattaaataggatttgacctcttcaagtctacattttgggaagtgagtgaagtacattccctcactgtgttcctgaaaatattttatcagcatttgtggttcaaatggaaggaatttggccactcagagtcaatatcccggggctgtctgggctgactcctggcttggttagttctgtttctcatctgcttgacttgctggctcctggatgaccattccttccccacaggagggtaatgagtgtgttgccagtgctgcagggaataaagtgcatccaggctcataggctggaaataaaatgcaaaaacaccttatttaaagtctgaaaatatttatattaatgacttggtgagattttttattacatcacttaacttgaggagggcaagtgcgaggagagtggccttttaaggcttagcattgagtgtgtgcttctccagacagctgctgaactgcagctcatctgtcaagaacagtgtgtgattttagcatgaagtttcgcagtcttagtttctctaatcagacagcaactacttgttgtgactgccagtttatcttgtctgaacccagaggaagtggaaagagactagcatacattctggatctgctatgtatcatatgctatactcagaacttttcatatattatcatattatgatctttatcttctttgacccagacatttgaatagtttgtgtgaaaaagatgggagagggaacaaaatggaggagaaagcggaggcagagaccatcagttggtgagaagtctgcaatgtgctagttggtttttgttctatgagatcaaggctggcttggtctcccctttgcaatgagataaatgcctgtatatctgggagggtctcagtctagacactcacttcgtagttaaaagcaaatctgagctatcactcccctccagtggttccccaatgcatcttttgccctttgtgatctggtatctccctatctcctactatggcttcttacaatccctcattttatgctgctgctttaaacctccaggcctttgcttaagctatttcctctgattaaaatgcccttgcaaactacaccttctttgcctgatgaaatcctgttgtctttcaagtgctgtccaggtgttgccacccagaagccatccatgcttttccctaaccctatctctgccaagttggaccaagtgctcctctactgtcagcccacagtatacgtctcttatagtatttttcacattttattaacattaacagaatatggaatgtgtttgtccccctcactagaccgtggccttgatcttttatcacccgtgtctaacccaatgtctggaatacgagtgctcaataagtgaatgaacaatcacactaaacatcatgagggtgtgactcttggtatcagaatgctttgggcttcaagaaacagaagacagtaaaatttgcttaaatatcaaggaaatgtattatttcacattttaagtagtcattcagagacaatgatgtgagcttcaagattgatgaatcagtgcgagcccatcttcaggcactcaggattctttctatctcactcctctgctgagatctcactgtttggccgagaacttccttgcaaggctgtttcccttcatggttctaagacagctgccagttgtaacagagcaacatgcttcactcttccccaagtgataggggtagcaggagaaggagggagaaacacagacattgacttctgtttcccagaagctctaagcaaatctctcctcaatttcgttggttcatactcattaagacttgcccaatcctgaacatgtaaataaaaaggggagtgaaattagtatgactggtttgaacaaatgatctggggtgaactggatgttagggaatcaatgttcaatatactactctagaaggagtagtatatccttcttatccttagagtctatcatgtcccattttctctctcctttcctctggaactctaagtatgcctgtgttaaaactacactacccaacaggacagtcagtagccacatctggctaattaaatttagtgggtatagtatacactattatggtgtgatagatacactgaaagctccaagacttcaccactatgcaatctatccgtgtaacaaaattgcatttgtatcctttaaatttatacaaataaaaaaattaattaaaaataaaatttttggtttgtttgtttttgagacagagtttcactcttgttgcccaggctggagtgcagtggcatgatcccagctcactgcaacctctgcctcccgggttcaagtgattctcctgcctcaacctcccaagtagctgggattacaggtgcacgccaccatgcctggctaatttttgtatttttagtagagatggggttttgccatgtcggccaggctggtcttgaactcctgacctcagatgatccacctgcctgggcctcccaaagtgctgggattacaggcgtgagccactgcaccctgcttaaaaataaaattttaaactcagtttctcagtttcacttgccacatttcaaatattcaaaaggcacctagtggcaaaccaactggacaggacagacatagaacatgtcagtcatcacagaaggttgtattggacggcactgtactagatcttttagttatgtcccacatctcttctgctgtgtcctgtgcttctatttgcttttctctctgtgcttcagtgtgctgttttctttctttctttccttcctttctttctttctttctttctttctttctttctttctttctttctttctttctttcctttctttctttcctttctttcgtctttctttctttctctttcttccttccttcctttctcttttctctttttctctttctttctttcttttcttctcttcctctctttctctcttgctctctctctctttctcccttcctcttccccttccccttcctcttcccctttccctttttgtgctgcaaactccgccttctggtttcaagcaattctcccacctcagcctcccgagtagctagtagctggaattacaggcgcctgccaccacgcctggctatatttttgtctttttagtagagacagggttttgctgtgttggccaggctggtctgaaactcctgaccttgtgatctgtctgccttggtctcccaaagtgctgggattacaggcatgaaccactgcaccctgcccagtgtgctgttttctattgatttgttttcaagttcattcatcctgcttgctgctgcatctattctgccattacactcatccagtgaattcttaagttcagtattatactctgcaattctagaatgttcatacaattctttttatagattatgattctccattggaacattccattttttaatccattttgtcccttccccccatttttttaagatgtcaatcatagttattttgaaagccttgtctgctaattcatatctggatcatcttctatagacaattttattgttttgattatcagtaatttttctctgtctctttatatatcttataatttacattgtatagtggatattgtagatgatacactgtagaggctcttgatagtttatctttccctaaatatcttaaagtcttattcaagaatacaattaaattacaaaagattatattgatctaattgagccttggtttagactttggtatggtaggtatatttttatctttttattaatcctagtgtatagcccttattctaaacatgtggctcttattcctatagcttggtgtttctggggtcacaaatgaatgcccagagagctcatgaaagcctctctactctgtttgaattagaactcccagcatttccccagcactgtgtgacctctaaaatttctttttagctcttaatatgccccacctctcatacctgttctctgctagactttctggagtcttgtcctgcatatgcaaagcttgggatttggctaaggacctgagggaaattttagtgaagactttaaggtagctcctctgcatctccctccactgtaatatcctgtcacccaaatctcagcctccttaccagtccctgaacgctgatacccattttttacatccatcaagactattcctgccctctgcttggcttctacttctccgctccacagttaggaaaatatcctcagggagaaagctgaggtgaatatggaacttacactgtatgctttctccctttcaaggatcattggtctatcttggttattgaccaatgcctttcaaatagctaatagacagtagggttaaatatgataccagctacttagtcagggacagaccataagtctccacgtgaacattttaaataaaaatgcaagtatattgaggttacctggagagcttctatggaatcagaaaatcaatggtagggcctaggaagatatatatatatatatatatatatatatatatatatatatatatatatatatatatgtatataatttttatatatttaatttttatgtatatttaatatatatatttaatttttgttttttgagacagagtttcattctgtcacccaggctagagtacagtggtgtgatctcggcacactgcaacctccacctcctgggttcaagtgattctcctgccttagcctccccagcaggtgggactacaggtgcctgccaccacgcctggctaattttttgtattcttattagagatggggtttcgccttgttggccaggctggtctcgagctcctgacctcaggtaatccacctgccttggcctcccaaagtgctgggattacaggtgtgagccatcatgcccagccaggaagttatattttttaagaaaacatttcagatagttctaaattaaggctatgtttgtgaactactatggtaaacactagagaaatgagtttccaagaaaaagaagtcagtatgggcttatttggtcaagaaaggcatcaggaggagatgagacttcaattttgaaggatgggaataatctggagatttgagtgtgggtatttcatggtggggggaaatgtggacaccaatatagggatggaatgagcataatatagtgtgtctgcatggcagtgaataaaacaatttggctgcaaaagatacttggaataggactgtgatgtgaaataataatgtagatttggaccagtctggggttgagagaggcctcaaatacctggttaggaagattggatttttcattgtaggtatcagcaatagtaggggttggtttttgttttctttttattattttgactgagataatgacacgggaaagcaatgtattagtgcagtgaacctgatggggtccgatggcttagtataagggacagaatggagtaagggggccaaataggcaagtatttgtaatttattatctaggcagggtgggctgagggatgagtagcagcaataatggaagtaaaaggcatattccagagttatttgagaaaatagagaaaaagttagctctgagggatgacgcgaagatgtgggaaggcaggaaaaattagtagttttgagatgcttgtggaacattaagaggatattaatattgagtccatagatactgtcttagtttgttttctgttgctataaaataatgcctgagactaggtaatttatagagaaagatttatttagctcatggttctggaggctgggaagtccaagagcttatagcatcctgtgaggatctacttgctgcatcataacatggcagaaggcaccacatgttgagacagggcaagtgtgctagctcaggttcctcttcctctccttctaaagtcactaattccatcatggggggggtcccactttgatgacctcatctaatcctaattacctcccaaaggcctcccctctaaatgccatcaacatatgaacttggggattaagttttcaacacatgaaatttgggggcacattcaaaccatagcaggcactgtgtgactatagatagtccaggatttaagtctgtattggggagaccatttaatggtttaaaagcatgacttttggagttatgtggacctagatttgagtctttaatatgccacccagaatgtgtgaccatgaccaagttacttaatctctctgaatctgtttctctacctaaaaaaaaaataaataaaaaggtggtgattatggcatctgttacttcataaggctgttatgaggattgagataatgtgtgtaaacctcattgtgtagagcctggcatgtatttattcttgtcaattatctgggaagttattgttagagagcattatgaaacaggaacttgcatgggatttaggttcagatggacactagagtccaatttatcttcatcacttacaagctgtgggatcttagccaatttatttggcttcttaatactgagttttcaccatgtttaaaatggaattaacaatatcttctttgtagcattattatgaggattatgtgacatacactatgaaggctcttggcacaggcacatgaaataagacatagtattattgttgttgaagttgtgggcccgggtggatattcacatggagagggtttgatggatgaagggtaaagggctgaggtccatgtttagattgtcacaataggctgtgaaggacacaaaaggaagccacaaattggcagccagggaagtgggaggtaagtttagataagtcattgtaggattggaggattggtaagctttcaaaattagagttttcctgtcatttttgtcatgctgagactagatatgatgtgtcaaggaagaaaattcaagtatgtgaaaacactgattctccagagaaaatgtttacaagtctagagacttgtgaaagcaggaagagacactcatcatgtctgaagccagatgggctgctgctgaaaattacctggtcttggggggcagacagggtggaatttcagaaaggactgcatctgattctgacacgaggtcaaagtgagtgagaactgacagaataaagaattcagaaactaggaagtgactgggtttcatcgtgggtgtcaactcaagaaagtagtaaaagcaaccatattttaagggctgaaggaggaattggatggaggaaaaacaaaggcagtaggggcagaacacacttctgaaagtctggtgatgaagagaaggagagacagaaggaagctccgggctcattggagggtttagcagcagagttaagagcatcaactctggaactagacctcctgggtttgaaaccttgactctgatgtttattagctgtgtggctttagacaagttaattaatttcttggtgccttagtttcctaattcataaaagggagatgatgatattgagggttaatattggggagataattatgaggttattaggaggattaagtgagttaatatatataaagtgcttagtacagtacctgtcacatagtgagcatttaacaaatcttagttgttggaatcgtcataactgtcatcatcattgatgttatggagataacattaacatatcatggagataaattgttatggagagaagggaagaggaagaaaaagaagacaagaggtttatactgttgtaggtatagtttggctctaaaatatgagcacaacacctaccagggagtcttcttaggtcccactaaacactcagatttatgagactaccatgggccatcttgggtactgatctactgagaatgatagaagatgggaaccacagcttgccagcagagcagtgcttgcagcagttcagctcagccatcggcttaggtgcaaggaggtaagatctgcattgggcagctgtaggagctgccatggcttataaactccatgccccatgggaaccagtatgtttggtaacaactccgttggcacagcttccagagtttctgcaatgaacattgcagttataaaaatcaccacctcagggatgtccaagctatggtgtacccatcaggtatttgcagttcacttacagttcctcccaatcaagatgaaatttgtgaagcaggggattttttttttaccataagaaacatgatttagcaacatgttggcacataccatcttttatctgttttcagggaagctgaacttggatgttaactgaaggtcaaattaccatgtaagaggggaaagggttttgttaaccctttgctcgtagtgggatatttggctgtttcacagagaaatccgacctgttctagattgtgaggaacatgtaagggtgttagacatgggatttgagatttaaggaatttgggtatggaaggtgtaagaaatgagttaggggatccgtagcatgtttacagatcagagacgtggcctggtcagtgagatgtttggcatcctggccagttactgaggatacagtgaaagtgtctcccaggtaaccaggctgtgctgtccttccttgagcagactggatttatgacaaaagacaaaaatggcttctcttttacacaatatataaaagtatgccaactgacatgccaaaaacacgaaggaaacaagcagagcttcaagagatatttattacacctacagcctctcaggcccatatcccagctgcctcccccgtctgtagatgtccgtgtaatgatctcttcagaacctaaatactctgtggtctgcagggtttgcaggatacgaaagaggtgagatgtcacattctttcagtaaggaattcttggaacctggagaaaactccacattttggggtcctttatgaggtctgtgtgttgccctatttgcacaagaaaatgtgtcctgggtcagtccaagttccatgaaagcaaaattgtaaagtggggagattttgcctttgattctcacgtctattttagggcttccctcctactctctaggacctctctgccactttgtaggatctcatccctgggccatgttcacaaaggaccttgccctcctactaaactgtttctatattcaggataagctaattccaggagggattgcatgaaaaattgcattttaataggcatctcacctgagtgaaaaactgttaagagccaaaggaactgagtctctaatagtgagagttgaggtgtagcagagagggtggggaagggagagtctggaagcaagccaagaggaagtaagattccctggtcaggccacccagggacagcaggaaggcaccagtgccctcaggcagagccctgagagggtgtctgggtctctgagtgcgtgaaggtggaggtggtgggaggatggacaggcacctttgggctgtgtctgtgcggtgccctgcggtcactctgggggtgcatgtctaggtgggtgggcggtggatgtgtttgcatatgagctgcaggtgtgattccccatttactgcaatcttaaattcatacctttcatctgttttttactataatgaaaacatttaggaaatatgtgcaatagaatatatgctcatatgcagatttcagaatctatcatatatgtagcacttaacaaagcattttcatagccatcattttatttgaatctccctgataccctaaggtttaagtagtttaaattattacccacattttatagataaggaactgaatttcagaccaatgataaaacttgtcaaagtttatacagcagagtctgtactgatttgaattctgttccttgcgctctaacactcatacaattttattttggaattgactgggcggctagtttcccagatataacaaggttcacccgcaaggaggttgttagttctctctagggcacaagcttttatggatgcaccactgtagtgtacacagggtatagtgaacatgattgatattgggatgcacatatttaggcaaagaaaagccattggttgtcttgtgtcctcttaatcagctcatcaaagctgaatatgaacatatttaataccaatgtaatctataattagagtataaaatactaacaatagataataaggtggtttgaaagttaaaactctaaatcagatgctattgctaaatttggcaaatgaaggaaaataaacataagattcttaatatacttgtcctatgaaataatttatgcttcttaaaaaaagaacaataataacattttagctattcctattattgaaaggagaaaaaggtttctgtttgttttcctaatttgcatttaagtagattcatttaacatttactgtattaagaactagatttgtatattttcactggattttagccagcagaaaaaaaaattacttagcttggttaaaaacaaaaccccaaaagaaaaggaaaaaaaaaccccaaatgacttacatgtaacatctatcttcttaatgagactaaactatgttaatttcaaagagatacaatttcattatttagacacgaactttcctctttgtagaattttttttgttatattacactttgctgaactcaccatttgtggcttctcaaaaaacaaagacaagtttgaaggcactttggagatatttttagtttaaaatgtcctagctggaagggagcttagaaagagtccacttatctggagactagcaaccgaataacctatgaccaactcatagtattcattcattcattcattcattcagtgagtattgagagaactagagctatttgaatcagccatccccagacacctggcactccatcttggtggggcaggcagtggaggaagaggagaagaaagaggaggtagagaaggaggagcaggctagatattgacagggaagtgttccaactgaggaatagcaccttaccccagatagagtaccatctggggtaagagatcattcaggttctgaagagattattacacggacatctacagctgccctttcagctaacttttagggataactgccctggggagctcaagcagagaaagtcttacagccatatgagtgggaggcagggcggtgtccccaaagcatggctcagtgggcactcagtgaatgtagccttgggtagaatgaattaaatctacaccctggactttacttccctgaacctgttttcctgcctgggaagtgggcctgatgatagcaccttgtgggattgttttatggatgcaatgtaatgatgaagggtgagtggacattttgaactctaaagcatcacacaattgtcagggctgagactaagaagattctcttcttttttttttttttttttttttgagatggagtctcgcactgttccctgggctagagtgcagtggcatgatctcagctcactgcaacctccgcctcccgggttcaagtgattctcctgcctcagcctcccaagtagctgggattacaggcacccaccaccaaatccagaagcttctctggctataaaacaatgccatttttctcactgacattattttattcaaaaagatagaaatgtaagttgtagcaatgaatatatcttctgatccaggagaatcaacaaaactattttttattttgggtggaaaaaatgcattctatacatttccaaattgtgcgtattataaaccaggatgcttgcctccattctgcaaaccactatctcttcaaatgaggagaagatcagaaatgaagtgacttttccacagtctcatgtggagttagtgacagagctgggcctggaaccagtgtagtcttcatctcacttgactgtatgtatacatgcacacgcatgcattcatgtatgcacacattctgcctctgcagccagttccactgaatgtaacagagatgactatgaaccttgcagacagccagccttgcaggggtgaggattatatgctagtaggcagcaagtttaggtctagagaagatttgtgattgtcccttaggaaaccttggttcctgacatcacatgagaccatctaatccccagagcaggtctttttctctctactgagatgtgtatcacctctttggagcgccacctccagtgaaagctaaacttttccagaatgtcccagaccccagtgacaagcttgtatgctccaaatgtaggaggcaaaatcagttgggatggcatgggcgcagacctcattttgtaagaagctgattcagcaaggtgcacagttccttcagcactctcaactctcacctgtctttaactcatttttatattgctttccaccctaattggcctgtgttcagctttccctactctgtggttgagggatctggtgctgagcaatctaatcattctggtgccagcacataactcatctgcttatttgcatatctaagtgaccatttaacataacatacagggaaggtcactaatcggccactgaaacatccaagaaagtgtatggagtgagcgcttttcatcacaagttctaaggacttcaggcatttcagactttcattaactttattgattcttttgtcaataaagaaaagaaatgagaaattattttaaaatagggctgggaggcagaattctaaagataaaaattatagaatcagagtcctctaaattcctgtcttcttttccttcttgtccttaataataattaaagaagaaaaaataaaagccctgaacaaatgcctgtgatgtgagggtagctgaggctggaggacccaggatagtgcacacagcacaaatatcgacccaacctctacaggagccccagcctgaaataaattctctgacactcagaagtaaagaatggtcctttcgtcctttctttactgttggtgtaagtagatggaagtgtaattcaaaagggagaataatctccaaatcatgcacgtttgcctttggaaggtgatgtttttatacttaagtgtgagttgttacagccctgatgtctctctcctgacctttagacacaaatctaactgcctactggatacctccccttgaaactctcacaggcctcccaaactcagcacatctaaaacggaacatacaatttcccacccaagcttcttaccttcttctttaggcagcatctgtggtggtactttttattaccaggactcaggtgccatgccagaagcctggctgttctctctagctcttccccaccttctcctctctaaacaactaagtccccaatcctgctcccagtagctctcaaatctgccaatttctcagactctactgccactcccgtaatccaggactccgggtcctcgccctcgtcaggatttcagtagcagccttctagccattttctcttcccttccagtccacatccctcactgtcatcaaagctcacttcacacttcactacccagcttaaaacctcccaccagcacctggcagccgacaatgtgtggtccaggttccctgaagcctgtgtgcaaggctctttgtggtcagtctgtcccacctgcctccccagccacacttcctccttgatgtcaggctccagaaacacagctgaggacccttcattgccctcgacacagtgggctatcccagttctgtcgctttgcctgagcatgcatcccactggccttcatctggctgattcctatctgaatcaaggtttgactcaggtgtcacctcctctgagaagccttctctgctcttccccatctcactcctcaaggataggtgaggtggcctcttctgtgctccctcaacagccaatattcacctctatcttatcagtagatgtttttttgagttgtaattttaatcacattgtgtgccagattataataaagttgtatctgagtccatgtcaactttccacattagcctttaagccactaatactcaagaaccatattttagtcatttttgcctcatgccacctccagcggtccctggcacatagcaggtatcccataaatactggttgaatgtaattgaagtagtaactcactcttctgttcaagggacataattggataaggctgcagttctggctccagagagctggtgcaatcatggccacttcttagcctgtttctgttctcagctgtttcctgcttcactctgcaactgggctgtggcctttagtccatcccaaatggattgtgaggcttaagtagtgcagttctcttctccaagtatactctttcacacctttcttggcttttgctgacttagccattgttttttggtccctagcatgtgtgagtcactgagctgagatgatgaggagcctcgagctgtggcacactggaaatggttgagtttccaggtcctcacccacatcaggatttctgtagcagcctcctaaccatttttctcttcccttccagtccgcatccccttggggaagagaaactgtaagggacatgtgatggctatcttcaaatatttaaagggctgccttaaggagaaaatagtagaatttcctgctctggacagaatattacagaaagtccaacttaaactggctttaataataaagaggatttcttggctcaggtccaaggaagtccagagacaaagtggaaaccagacaatgctcagccagggctctgcctgcttcctgcagttgtcttggctccaccctttctctacccattggcttcaccctcaggctgccagaagaatggctgcagcaatttgaggtcagagccacatacaacaatactggaagaagagaagccataactaaataactaggattctgttttcctagaagtttctagcaaacttccctcatgttttattgtactaaattggatcacattcttatatctgagacaatcccattggttgggaaatgtcatgcactgtttggcttaggtctggtgtcccaaaaagccaggggttctggtcagctcccattgaagtatgtgggctgcctggaagagggctggatacctaagtgaaaaccagggtatggagctaggaggaggaagatggcttaatgcccactgtgctagcaccaggtggtacttatactacgcttaaaaccctcatcttctgcttcccagtgggttatagcagaaacccaggaattgtgaggctgtagagttatgagaaaagctgattcacttcagaatcaattcaacattgtgtgtggctgggcagtgtataaggggggcagaggcgagtaaggatgtccctgttgcttccttcaaagatttctctcttctactagtgcggcaggagatgcattaagcctcccagcttgtctcctcagcacctgtccctaaagcaagcatgctggtaatggtaaacagcttcctctcccatctcccaattatctcactcattttctctttttcccttaggctctgtaatgcaacacagcggctgctggtggggtcttacgctaaaagtgagggctctcctgagaaatcaggctgtggcccaccccattaagaccccgagactcagaacaataactggttctcactgagcaccagcaggagagctttttccccttccactagctctgaaagttttgccctattcgacccatgaccattctgattatgctgtgccttcttgtcctctctagatgtttgactggataagccacaacaaggagttattcctccagagccacacggagatcggagtcagctaccagtacgcccttgacctccagacgcagcacaatcactttgccatgaactccatggtgagctgaggggctgttctcagcactgcctctgggagtgggagagtggggagaagtgggaggagggacagaaacagactttccacccgaggaagaactgtgaacatgctgaccctttggtgttccatttgttggaatggggatgagtgcagggcatgtggccagccagctgttcctgcagcagattatgcctccagatcctgctttacacagtgaaagaatgtgtcccgggttgcaggaggcattggctcagctcaagtctagaagggcgagttccaccagttccacttcactgacttagccaacgttttttggtccccagcatgtgtgagtcactgatcggggatggtgaggggcctcaagctgtggcacattggaaatggttgagtgacccggggctgtttagactggggaagagaaaccctaagggacatgtgatttctgccttcgaatatttaaagggctgccttaaagagaaaagggtagaattgctttatgtttgtttagaaggcagaaatgttcaggggatggcagtttgaaggggcggcaggatgtggcttggagcaggaggtggggtgggatgcagtgggagacagtgagctctccatgatgagcagtgttcaggcagatgctgaacactcagagagggatgtttgctaactgtttggccagatagaacttactttacctctctatgcttcagtttccttatgtataaaatggaaataataatagctaccatataaggttgttgtaaggatttaatgtgttaactgtaaaacaatgagaacggtgcctggcacatagtaagtcatcagtaaatgctggtgttatgataatgataaggatggaggagttcactccagatgaccactcttatccctcataaacctaacacttcgggatatatttttgttttcctgcgtggctaccccaagattttatttcaaaattgtgtctgctctttgaagccattgtatttcaaactcctgcagcctcagaatgcctatctcctccaccagctctttctacttgaattattggtccagaagaatagctccaccattcctcatatatctgaaaaacaaagacagcttatcattgtagctggtgatgttgggagtggggcaagtgttagaaaaacagaaacaaggtgaatcacagaggccaagaaggaagagaatttcattgtctaccaggctcttttaaatatgctatgcactagagttaacacactggagaagaaatattttaggttggtgcaaaagtaattgtgcttttgccattacttttaattaaataattctggcctcaagttgttcactgtctagctagagaaagaaaagtagataatcatggtgcagcttgatatgtgcagtgatagagatatgccgagttaaccaagaaccttaaaatgtcagtggttgaaaacaacagaggtttgtttattgttcctaccacacacccatccctagcttgtaggagctctgcttatcatagccacccagagagacctgggctgatggtatagtcaccagctcagatctgccagctcagatgctgccagtcttgccaggcaaagcatgtacccaaggacacatgctggacacatgctggctctgaaactttccaactagaagtgatacatttgctcacattccgttggccaacgccagtcacagaaccacgtccaatttgaagtggctggggacattgtgcagtcctatcacgtgctgggaaagagagagcaggatggttgtgaacagctctaatgactagcacactgaaagatgttaggtagaggtgaacatcatgagacttgcatagaaagatcactctggctgcagagatgaaggttatgagaccaggcagggaaatcatcaacactgattgtgttatcagtcttggccacaacacagtcttgtgtcttcatctcagtgtaaagactcattttcttcccactggtctcctgtagatatttctcatttctgtctccctttagtgtagagcagcaaagcaattggtaacaggtgattaagaacgtgaactcaaatctagtcaagtctgattatttgtgtgccttgtggattttccctggtgagttttacaaattctgtgccagaattttcacattacccaacagcctggccctaaggcagacaaactcattttaataagcaacaaagacaaccataattagggaggtaaatccaccaccaagcccctagaaacagtgaactgcaaagttaaatcaaaagagcctttggttttgaattatctgtaattatctttgaattaactgctcttctctgctagtgtggataactgagagttaacagcacatcaaaaacctttcttcagacagatttactgttgaagtctccattttttaggacaaaaataagggaggaaatttactgaagggaagtatcttctggaactggagagagaagagaagagatttagtatgcaacagccaattagtgtgtcccagccaatcttgtagcctccctcactgtgaatgcacacagcactcagaggcttccttggcctgattaggctggatctcctctctggcttcagggtaagggaagggaaatcccagggtttttggatcaaattgcttgcccgcctgtgcttgataaacatacctggtgcctttgttaaatgggaggtttaaggtttgttattaaaagaaacttcctgcaaagagggaggtcagcatcccaagcaggtgaaaagagggaattacagattccttttctctggcctgggtgatggatgttgctgccaagaaacacatgtatgcaagtggctactgctcgaactcagtgactacaggaatgatcagttactcaggggaagtgggaatgtggattgttgtgtagattcactgcagcgtttccgttcttggaaattatacacacacatatacatatacccacacatccattcatgtaaatgtacatatagcatactttgttttaggctgcaggtaagtcttttggtattgaatcttattttaccacacggaaataggccaatggttccttatgtttcaggtagttcacagatccctttgaaatcaaatgaaggttgtgaatcctctcttcagagaaatgtatgcataaacacatttttaaagacagtttccggagattcaggggaatcctaaaacctgtcaatcaacctccccaacttaaggttctaagaaccttatctcttctttattcactcatttaacatataattaaagatcagacattgtattggatactgagcatatagtggtgaacaagacagagatgattatgtctcatggagagtccagcggagagatagatgttaagtatataatctcacaaataaatatataattacaaaccaataagtcttatgttggaagagtaagggatgttaggacagagtttaagaaaaggacccaatttagatgagggggtggtcaggtcaggtacatttttcaatcaaccatctgcattgacttaatgttgattgttcattcattgatagaaattaatggcctgtgaattgaagtaactctataatgtaccaaagaacttataatttaaagaagtcctaggtgtatcattttgtcaatgaaaataatcaactaataacttacctgttctgttttattttcacatgtcaagtgtttatacattggttgaagacccaattccagcaaaggtgaccattactgagagtattaatttgctagggctgccataacaatgtcatggactgggtggcttgaacaacagaaatttgtttactcacagttctggaatctaaaagttcaagatcaaggtgatggcaggtttagtttctcttgaggcctctcttcttggctggcagatggctaccttctcactgtgctgccacgtggccttttctctgtgagcacacaccctggtatctctctgtatgtcttaacctcctctttttatgtaaagataccactcagactggattagatcccaccctaatggcctcattttaacttaattacctatttaaacaccctatcttcacatgcagtcagtttttaatggtacttgggggttagaacttcaacatataaattttggggctctgctattcagtctgtaataaaaagaaataattgcatatcattaaatcacagaagaaaaatcagaaattttctaaattttatctatgaattggtaccaggagaggccatcaattattaacataccaagagtgtgggagtgatatcctactaaatatggtacataaataaaatgaaaaaaagttaaaattggttgatctttagattttttatcataacatgtgtttttgaatttcccactgggaaacccagttcttttgatcttcaattaatagtaataataacaacaacccacctactaaacccagtaggaaaattttctgttgcttcttacagtgcctcagacaaccagctttcctgagctctctggggccttcctcttgtttaattctgccttctgttgtggaagccttttgcataaattttccttcccctgattgtggccttctactctgatgggagtatgggcagatggaagtgaagttgggtggtaatatgcacagaacagtcatctaaccatctatgttctggttcttcatgcgactcgcaggagtacatgcaaacgtaacacaatcttatttacaattttaattagctggttctttgggaaaaataaattgctaatggcttctgtctagagttttaaaatatgaaatgatattcattttctattatgactgtgaggattcacagtagtgataacaatgtgcagctgggcgggaggaatcctttctgctgcagcatgcttgatagctgttttaatcccactaatttgctcgccaaaggcacatattgccacttgatggtgtgcaaatcagaccagttgcagaaaaaaaactacagtgtgttctctctttgttttgagggaaggttacaaatgacagcaccaaggaaaaatcagatctggtatgagaaaaatcaagattctgaggcaggcaggtggtctcccaactctaatctcccaaccctaatctgagaaaccttgccccaagccctctgtcatctttgattcttggcagccctaaaccatgattctgtggcacttcccatctccaaacaggcagcattttttagaatgtcagaatttctagattttgttgtaaacacacacacacacacacacacacacacacacactattgtaatgtttaagtagccagtgtttgacactgccatagctgcaaagtcccttagtagacatagaacttgttttaaaaaaatgaagaagaagagttcaatcttatccagtaagcattagtctttttagtataattttttgtcaaagaatcacatagggagcttgctaaacatgcagatttctttttgattaccaccctagttctggaaaatcataatctctgggagtaggaccccaggattgtaaacaagttccccaagtgatctatatgcacgttaaatcagaaaactatttctctatgaagatctatatgtattaaattatcactttctaaaagaaaacattatacattctgaaggacagttcacttccagcatgacagtgtgaagaactctgcaaacctgttatccattgaaactagtgaaaaattttaaaacaagcatttaaagtatcggaaatggtccaaaatgcatacagcaaatgaaaaacatttattcaagaacatacactaaaattcaataagaacagtgagcctgtggtatttgaaccaagacccactctcttcttttcccctcccaactcagtaagtttgaaactccactccagaaagcttcaaccaagaacacagggttcctttaccctccaccctagttcccagttgaaggagtatcttcccaggtgggacatttcttatcctgccccaaactacgtgttgctgaagccaagttctgggtgaatgtcccccggagatggagactcccttctacccagccctcattcttagaacagtggctgtgcaatgtgtgccagggccccaatcacccttaggcagaatttccatgttgggagagataagccaagaagacctgaggctattcatctcactccactgagcattcagctcctaaagtgggggtgtcattcaggaaagcacaccattgtccccaaccccagctccagagctgcagctcagagattttgcttggggtagaaacaaactgtaaaaaaagaactctaaatctttccccaaaggaactgatttcatgtgcaacagaggatggaaaagtttaagccacttacaaaaatgctcttagggaggttctggtgaaagcaaattagaagattggtagatccattggcgacataggcagcatttcaggcaggttagtttgccagagacaatcagggaaagagatctcctggggccagaacaaatttcaagcattgacttcaggaactatctcttcaaagagacccaaatttaattgcatatgtctgtggaaccacttatgccccagtacattgttgaaaacaatagagcaatcagcttgcaattaatggaattaaattccattgacagcaccaaggaaaaatcaaacctggtacaagatctggtaccagctgggtgtggtcagggaaagaaaatcagagcactgccaaagccactgccattgcagggtgcctgtgagcctatccaatgctgtactccccctgggagcaacattggagtcttcttactgtggagctgtgggggagtgggaatatttcaataatccagtcactaaacaaataagcaaataacaacaacaagctctaaaagaagtgggagaccagtacccagagttgctgctatatgacctaaaatgtccaattttcaacaaaaaaattatgacacatgcaaagaaacaggaaagtatgaccaggaaaaaaaaggagtaaaaatatgtactagaaaaaaaataaaaaacagtcaatagaaatcacctgtgagagcaaccagatgtcagattttacaaagaccttaaaattgctattatagatatgttcaaaaaacaaaccatagttgaagaattaaatgaaagcataattacaatgtccccatcaaacacagaatatcagtaaagacattattattattattatttattttgaaatagggtcttgctctatcacccaggctgaagtgcagtgggacaatcatggctcactgcagccttaacctcctaggctcaagcggtcctcccacctcagccacctgagtagctggaactacaggtgcatgccaccatgcctagctaatttttcattttttgtaaatatgggattttgccatgttgctcaggctgagaggcttatttttttaaaggaaatatggagctgaaaaatacaataactgagacaaaaattttttagagaggctcaatgtagatttgaactgacaagaaaaaacagaattaacaatcttgaagataaactaatagaaattatgcaatatgaagaacagagagaaaaaagaatgaggacaaatgtacagagcttcaggaaaacatgagacaccattaagtgcaccaactgctatgcataatggcagtaccaaaaggagaggagagagaggaagaaacagaaaaaaattattaaattattagatgaaatagtggctgaaatctttcaaagtttattttaaaatatttatggccaggatgcttaagaaactccaagtaggataaattcaagaagatccataagcagacacattatggcaaaatactgaaagccaaagacaaggaaaaccttaaaaatagcaagaggaaaatgacttctctgttacaagggaacctcaataagattaaaagctgatttctcatcagaaacaatggaggtccaaaggaagtaggacaacatattaaaaagtgctcaaaggaaacaactgttaaccaagaatactatatccaacaaaactatcattcaaaaatcaaggtgaaataaaactattctgagataaacaaaaactgagaaaatttgtttctagcagatacaccttataagaaataataaaggaagtttttcaagctaaaagcaagtgacccttgatggtaatttgaatctacaccaaaagacaaagagcactgataaaggtaattatgtgactataaaagacagtataaacacacatttcttctccttttttctcttaattgatttcaaaagcaatcatataagataatatgtacataatgtattgttgggcctataacataaaaatgtaatatgttttccagtgatagcacaaaggaggttggtaggagcaaatttgtagtaggctaaggaaattagtccagatgataacttgaatccacagaaacaaatacagtgattcagaaatgataaataagactaatatgaaaaaagctataaatatatagtaatcctccttttttgtctcagcttctataaaagacataaaattacagaaagtgatacttataacaatctaatgtttggtttgtaacatttataaatgtaatatgtataaaatatgacaaaatgtgaggaaagggaataaagctctataggagtaatatttttatgtctcactggaattaagttaatgtacagtagaagctgattctgataaggtgtatatggtaagccctagagcaatagctaggaaaataactcccaaaatatagtgaaaaaaatcaatcagtaaagataccaagatgctacactacaaaatactcacttatgcaaaaaaagcagtacagggttatagaagtataaaaaagacatatagaaaaaagtcaaatggcagacataaactctattaataatgacattaaatgtgaaaggattcaataatccaatcaaaggtagaaattgtcagactggatttaaaaaccaagatccagttagtaacactgtcaaaaaacatttttaaaaaatataagacccaatctaattgctgtatacaggaggcacattttggattcaaagatataaatagatggaaagtaaaaggatagaaaaacatgtattatgcaaacagcaatcagaagaatagccaagtgactatattaataacagattcttaagtgcattttaaaagaacagcaaaaagttactaaagataaaaagcaactttttaaagaagaagaatgtcactctatcaggaagatgtaacaactataagcacatatacacctaacaaaaaagtaccaaaatacacaaagcaaaaactgacagaaatgaagcaagaaatatacaattcaagtgtattaattggagacttcaatacccccttttaataatggatggaacaaattagcagaaggaaatagaatacctaaacaaagaaatagaagactataagccaaattgaaccaacagacatctatagaacactccatccaacaatagcagactatataatcttctccaggacatgaaacattgtccataatagaccatatcctaggtcaaaaaacaaacctcatgaaataaaaaaggatagaaataatgccagatatttaccccatcacaatggaatgaaattagaaatcggtaacagaaagaatttcagaaattcacgaataggtggaaattaaataacatcttcctgaatatccaatagctaagagacaaaataaaaaggagaattggaaactaattttagatgaatgaaatttttgacacatcataccacaacttacgtgatacagctaaaattgtgcttagagagaacatatagttgtaatgcctatcttaaaaaagctaaaaaaaagttctcaataacctaaacttccactttaaaacactggaaaaagaagagcaaacgaaacctaaagcaagcagaagaaaggaaataataaagattagagtagaaattaactagagaataggaaaacaatagagaaatttaatgaaaccaaaagctggtttattgaaaaggtcaaccaaacttacaaacctttacctagaacaaccaatgaaaaaaattactagactcagaagtgaaagaggggatattattacttaccttacgagaaaatagtattataaagagatgctataaataattgcaagccaataaattagataataaatgaaatggacaaattcatagaaaggtagtaacaactgatactgattcaagaagaaatagataatctgaatagaccaatagcaagtgaagagattgaattagtaatcaaagaaatattctcaaagaaaagcccaggcccagatggcttcatcactgaattctaccaaacatttaaagaattaatactcattttttgtaagcttatattaaaaaaaaaaagatgagggaacatgtcccagcttacaaggccagtattaccctgataccaaatccagataaatctgtcacacaagaaaactacagaccaatatctcttataaatatggatgcaaagatttccaacaaaatactatcaaaccaaatccaattagccagacatggtggtgctcacgaatagtcccagctacttgtgaggctgaggcaggagagttatttgactccaggagttttatggctttaatgagttataatcgtgtcattgcactccagcctggggacagagcaagaccccatctttaaaacaaacaaaaagaaacaaaatccagcaacatatagaaagaattacacaccacgaccaagtgggagtcatcccagaattgtgagcttggtttaacttcagtaggaaaaaaaaaacaaaaatcatgtgatcatctcaatagacccagaaaaagcatttgacaaaatccaacacctattcataataaaaatactcaacaaactaggaatagaagataacttcctcaaccagaaaaagggcatctacaaaaattcacagctattgttatacttaatagtatactggatacttccccgcttaagatcaagaacaagacaacgacactcttgccccttccattcaatattggagggtctattcagggcaattattcgggaaaaagaaataagagtcatccaaattggaaagaagtaaaactatattttcagatgacacaagcatgtatatgaaaaatcccaaaatattcagtaaaaaactattagagctagtaaataagttcaacaaggttgcaggatacaaaatgaataaacaaaaattaattgtctttccatgcacttaaaataaataatttgaaaatggaaataggaaaaaaattccatttataatagcataaaaaagaataagatgcttgggaataaatttaatgaaaaaagtgtaaaacttatactctgaaaactataaagcattgttgaaagaaattaaagatacaaataaatgaaaaaaaatctcatgttcattgattagaagacttaatattgttaggatggcaatactcctcaaatccttgatctataaatccagtatatctctatcaggatcccaactggattctttgtagaaattgacaaactgattctaaaattcatgtggaattttaggagatgcagaatagccaaaataatgttgaaagagaacaaagttggaagactcatactatccaatttcaaaacttaatacaaagcaaaagtaattaagacaatgtgatactggcataaggacagacatatagatcaatggaatagaattatgagttcataaataaacccatgtgtctgtggtcaacatattttagacaagagtgccaatatcattttatggggaaagaactgtcttttcaacaaatggtgctgggacaactggatagtcataagcaaaagaatgatgttggacccttaccttacactaaattaaaaatggataagttggacatcatcaaaacaaaaaattttgtgcatcaaaaatgacagtcaagagatgaaaagaaaaaccacaaaatgggagaaaatatttgcaaatatttatctgataagggagttatgtctgcaatctataaagaactcttacaactcaataataaaaagacaacccaattaaaatgtgcaaaggatttaaatagacatttcttcaataatatatacagatggtcataagcacatgaaaagatgcttgacataattagtcatcagggaaacgtaaatcaaaaccacaatgagatactacttcttttttttttttttttttttttttttttgagatggagtcttgctctgtcacccaggctggatactacttcttccccactagaatgcactagattggctataatcaaaaactctggacaggcgcagtggctcacgcctataatcgcagcactttgggaggccgaggcaggtggatcactggaggtcaggagttcgagaccagcctggccaacacggcaaaacctggtctctactaaaaataggtaaaaaactaactgggcatggtggggcacgcctatagtcccagctactggggagggcgaagcaggagaatcgcttgaactcaggaggcagaggttgcagtgagcagagattgcaccactctgcactccagcctgggcaacagagcaagactccaaaaaaaaaaagaaaagtaaaactctgataataacaaatgttagcaaggatatggagaagtcagaatgctcacacatggctgcaggcgtgtaaaatggtataactactttggaatacagtctgacagttcctcaaatagttagagttgccatatgacctagtaattcaattcttaggtatatactcaagagaaatgtaaacatatgtctacataaaatgtccatacattgtacacaaatgtttgcagcaacattatgtataataatcaaaaggtggaaactacccaagtttccataaactgatgaatggatagacaaaatgtagtatcttcatataatggacttatatttatttggccataaaaaggaatgacatgctgacatgtgttacaacatggatggaccttgaaaacattttgctaagtgaaagaagctagtaaccaaataccacttattatttggtttcatttatttgaaaagtccagaataggcaaacctttaaagaagaaagtagattagttgttgcttagagttagaatggaaggggtataagagagttatatctaataggtacagagtttctttttgagacaatgaaaatgttctaaaattgattgtgatgttggttgtacatatctatatactaaatactaatatactaaaaaccattgaattatgcactttttattttatttcattccatttcatttcatttcatttagacagaatttcactcttgttgcccaggccagaatgcagtggggcgatctcggctcactgcaacctctgcctcccgggttcaagtgattcttatgcctcagcctcctgagtagttgggattacaggcacccgccaccatgcccggctaatttttgtatttttagtagagatggggtttcgccatgttggccaggctggtcttgaactcctgacctcagatgatccacctgccttggcctcccaaaatgctgggatcacaggtgtgagccactgcgcccagtctgaattatacactttaaatggacaaattgtatggtatgttgaaaaaaaagaaaagaagacaactgaagagtgagtattttgcaagtgggtctttacttgcttgaaaatataaccttcctaaacattaaagggaatggccatgacagagtgtggacaccaacactggtggtgttagggaagctgaagtaagaggatctgtgtgtaccacacagtattcactcatttgtgcattcaacaaacttttgctgtctgtgtcttttactaaacactgagaacagcaaggttcatgagacacaaagctatcttcaaggagcttgaaatttagtcattcccaaattcatgtacctaacgcaaagagaattttgcccactagagtataaactcctaaaggcagagctttgtctgttttattcacagctgtatctgcagaaattataacaatgcctggcagttagtaggtgcctaaataaacgcttgttgaatgaactatgatgttaagcatttcacagtgtctgtcaccaaccctgaacactatttgagcatcaaggatgcagagctaggaaggtagggcctttatttttgagggagcccaataaggcatggctccagcagaagctgaacaaccaccaattagaaggtgaatgagagcactgattttcttcagggatggacatgcttacagtgtccccaggcgatacacactaacatccaggaactaccagactgcatgatctttcaagttccactgatcccaaacatctttgtttctgggattctcatcctaaagacagaagcaaagccactaaaaagcaaacccccaccccctgacaaaaataaatatgatccagtggtcgctgttaacactgcagttcctaaggcaggcctttagggaacctgtgattgcaaagtactgcatgtatacccagccagacctgttcttatcaatcaagttgaacaggatacagtgtttgtatctccacagacagcctggtggatggaacttcccttttcttctgactcagtaggagcattagattttattttctgatctgctcaggattaatttatgacccttgctcttggcaccattgtcagcattaaactagacccaaaggagagaagggtgtgctttgaattcaactctggtgaagctagtgcttgtctctaaggcagcagtcctgcactctgactgcccgctggagtcacctgggaagctttttaaaaatgcccaaaataccacatatgggttccactctagattctgatttaaccgtactgtggtgactcaggaaatctgtaccaggctgagaaccaagttgaaaatcactactggttcagggtgaaggaaataagccaattgacattagccctgaggtcaaactctaaagttatcaaataattagcctgtggacttggagggtgtcagttcatttgtgttgctataagagaatacctgagtcataggatggctgggtcaaatggtatttctagttctagatccttgaggaatcgccaccctgtcttccacaatggttgaactagaatacccaaaggattataaatcatgctgctataaagacacatgcacacgtatgtttattgcggcactattcaccatagcaaagacttggaactaacccaaatgtccatcaatgatagactggattaagaaaatgtggcacatatacaccatggaatactaggcggccataaaaaaggatgagttcatgtcctttatagggacatggttgaagctggaaaccatcattctgagcaaactatcgcaaggacagaaaaccaaacaccgcatgttcttattcataggtgggaattgaacaatgagaacacttggacataggttggggaacatcacataccggggcctgttgtggggtggggggaggggggagggatagcattaggagatatacctaatgtaaaggacgagttaatgggtacagcacaccaacatggaacatgtatacatatgtaacaaacccacacgttgtgcacatataccctggaacttaaagtatatttaaaaaaaaagaatacctgaatctgggtaatttataaagaggtttgtctggctcacagttctacaggtcatacaaggagcatggtgccagcatctgcttctggtgagggccttagatttcttccactcatacaggaagatgaaagacactggcatgtagaggtcacatggcacgagagaaaggatctggttctgtctcctaggctggcatgcagtggcaggattgtggctcactgcagcctcaacctccagggctcaagcagtcctcctgcctcagcctctcaagtagctggactacaggtgtatgccaccatgctggctaattttttaattttttgtagatacagggtctcactatgttgcccaggttggtctcaaactcctggcctcaagtgatccaccttggcctcccaaagtgttggaattacagatgtgagccaccatgcccagcccaggttcttttaacaaccagcttttgtgggaactaacagagtgagaacacactcattaccttgaggaggagctattcataagggatctgtccccctgacccaaacaagtcccactaggccctacctccaacattggagatcacatttcaacatgaggtttggagagtcaagtatctaaactacaggagaagatgaggacatttctccgacctcaagagtcttcagggagaaagagtgcctgtgttttaatccctactccttgctccccatcccaacctttccagatgtcccatttgcttttacgccctaactctaatcagccatgtttggggattggttcctattcaaacaggaagcacagggaagctccttggtttaggcagccttctcagttttgctctagtgcacacatggcctgggtcccttctgcaaggctcctctgagctgaccagcaggacttggctgatgactcaggtttctgactcatggttggcactgcctggctcaaccatctctctttattgcttatccccttcagaccccagatctccctccttttctccctcactgctggttctctacccacgatcctgggaccttcttttctggcttccgtccactgctctctcaggtcctttgtcagcatgttccataacccaggctatttgctgtatcctctcggtgtttgcccccgagacctgtagctcagttgacccacccacttacacatactcatctatggccactacttgttctccgtcaggtctgcatttgctaagcagttaatttgtccgaaattcagccaaagctgacttatgcctttctttgtggtctcctggagttgaatgaaaggcatgaaatggtcagtgaaacctagtatgtcagatgagatatgcacatgagaagtcttgaactgtaaagcagaacacaaatatgaagtgtcgataataatcagtgacagtgccatttggggacagcatggtagccagctaggagtaccagatgaaggacagagactgattacagacattacaggtgagacgtttgcaagtcaggaaactgaagaggtgtgagaggtcaggacgagacgggcggatgagaagggagcagcacaaaaagcagaagtcacagttccttacacaaccagaggcccggaaatgaggaaaagctaaaggactgtcttctgcaagtcctttcagctctaatctcaaaatatatccagaatctggcctcttattgccgcctccatggttacccccttgatccaagctgacatcagctcctgcctggactgctgtagtagctcctacctggtctctctgcctccacctttgctccccagcagtccattctcgacccacagcctgagtgatcctgcctaaaggtgaggtccgttacatcttgccactctgcttaaaataccttcatgtcttcctttcctcataatgaaagccgaagtcccttaccatggcttactgggatccaatagactgaactccacttacttttcacatctcagcctctacaacttgtcatttgtcccggtcatcctgggattcttgctgtttcttgacccaccaaagacattcctgcctcacggcctttgcccctgctgctcctctttctgcagatagccacatggctcaccttcttacttcattcagggtcaagctcaggggtcaccctgccccggcttctctattttatgtagcactctccagccccatcacgtgctatccttttcccaggcatattttatgtaacactgaaataaagatatagtaaatatttattaatttattgtctgactcttctactaaaaggtaaactctgagaacataggaattttgtctgtcttgtaccttgcttgtacaatgtcttgtattgttgaattaatcaatggatgaataaacatataggatgacatatttaagactccagctataaggcaagatattgatgaaagcaaagagttgccttaatcttgaactttcttgcggttctatggagaaaatgacctgttcctcagggcagctggcttcagatttacaggtagagattattgctccaaggcaggagggggcaagagaattccacctaccaggctcctgcccattccggagctaggctattctggaaaatccaagagcacgtcaagggcccaatgggaaagcttcagagatgaaaacacgcttactgagttctctctccagaggctctttttctctcggctgtgatttttagatcttcagtagaaatttctcatcgtcttccctcaagggagagggaagtgccccagctattgcatttatggcaaagtaaaacagctggggcagtaggtgctaactgtagctctgtacttccttcttagtactgtgatcctaggcaggttatttaaatttttcagaaccttaccacctcatctgtaaataggggataatgacagtgactttgtcagggatggcctaagggtgaaatgtgtttgtacattttaagcacatttggcatgatgttatgtttgcaaatgttcagctattgttaagatcaggcgtgctagaagaaatagttcttgttcggggaagctcctcagctcctaactgcagagattctcaaacattaatgtgcatacctataacctgggacaatcttgttaaaatgcagattctgattcagaaagttggggaagggcctgaaatactgtatttctaacaagctgctaggtgaagccagtgtcacagatcaagctctaagtagccaggccttattaaaaaaaaaaaaaaaaaaaaaaggcgggggctgggggggcagttggggataaaatgctgataaatatatttcccggaagtcttagaggctctaatttcaaccttaaaggtagcctaaagttactacatcctaacccagaaaagctgcaatttttcctaatcacttgcctcactaggtgcccctgaatctgattccagctgtacccatcattccctaccatttcaattttgcaatgatgcctcatacaaaaacatttaccctgcccaaggaggtttactcagagctgagagagagagaggagcttctcttttttcttaaaccagatcctgggtttcctgtggcctttggacatatggccaggcgcttgttttcatggctgcttaatggtttgtaaagcaattgctggaggaaacattgctatgggcaagccaggccagagggacaggactcgtgagccaatgttatctttgctgggcactggggctattcctgttccttttctgtctccatccggcagtgacagatggcctccacatggtttggcctactgtttggccagacctgatcagatagtcatcaatcagctgccccatttggccccccagagggcaccctgtggttcatgggaggcagaagttggaggtttcctttagagctcatcacatctcatagctattgtagtatagtttcaagcatggacagttcttattccagatgttactatcccagtgtccatatgtttcgaggtgggatcagcaggtttacatggtaatgttaaactaattaatcataaactaatgatttaacagctttaggacccaaagtgagttttgtactggcaaatatataagtaatacatatggtgttattaagctggagaaaggagatgaggctgagctttttccattgctttgacacaatctattttcttactgatactgaatgttactcacaaggtctctgaaaactgttttggaatatctccaaatactattcctcatggctttgagattgaggaaataaaaacttaagttaatataagctgcagggcacaagaaaaagggagcaataagcagaggggccgtgtagagaggaaatcaagatgctggggctctagtctcattcttcctctttctttgaacgtgtcgcttgactgatatcacacacattaggtagatataagcaatggctgggttcctttttttatttcctaactgtaaaatgagattgttgcatgaacttggcttctaaaaactttaaataaagtggttttgtattcttgtctttagaaaagcagttttggtcattaaaacctgcttattctactatatgtaaattgtactttactaaaaatatatatattttttgctgaagtcaaaagagatggggacatttgagtaatttcaactttgatggagtgcaacccagctaaatgtattaaagatatattaaaataatttttaaaattaaaattaaaaataccaaatgcctataatcccagtagtttgggaggctgagaagacaggatcgcttgagcccaggagttggagttcagcctcagcaacatagctagactccatctataagaaaaaggaaatttaaaaaaccaaatctattaaagttaaaaataccaataaacccctagcattatttatagtggggaagaaagaaactagaaaccaacaacctttgcacctcaataaaaagagtgaattgataaaagtaggaggttgaacataagttccctagctccatcaggtgttttgacatctgatattttgattattaacttcagtggggagggagagtctcctctgtatagttttaataacccttttctccctgattatttatattatatataaattatatatataaaatatatataccaaaaatttttttaacttttctatacataagagaatagagatgagaaaaagaccctaaagaaaagttcccaccatcatgtatacctggtacaaaataagtattcaggccaggcgcagtggctcacacctgtaatcccagcactttgggaagccaaggcaggcggatcacttgaggtcaggagttcgagaccagcctggccaacatggcaaaaccccgtctctactaaaaatacaaaaaattagccaggcatggtgacatgcgcctgtaatcgcagctactcaggaggctgaggcaggagaattgcttgaacccaggaggtggaggttgcaatgagccaagattgtgctactacactccagcctgggcaacagagtgagactccatctcaataataataataataataataagcactcaataactggtagtatttgggtgtgcttccctcgtatgtataacgttttctcagtcgaggcaatactgtttatattttgtattagctttttcattgagcatttgattttcatttgacctgagtgattttgctgagtaccgtggctctcagctggttgtttgcatggcctccctcccttgactttttgatttggaaagtcaaggtctcaagagcttgtcgagaggacagggcccctttagggaaagtgtccccgaagtggtggttataccttgcctcctgtgatgatctgacaggtgatcacacctttcatgttcatagtaatgattaaaaagctgtagccccattaactggaaaggaattgagatccctgtgctcaggacttgttctttgcagagatgaaacagctctttgatgggcttcctctgcctctctcgagctgaagacaagtcacgttgcccatagaccacaaagtgaagagccccaacacccagcatggggaggaggcttctctcaccttttgtaatacagtttgtgataaggagaaggatctgtttccttgtatgaggacaagatggccccacttctgagcgctctggatgtggctatcacatgccaaggtggttgaggcaccccaagaagactatctcaagagataaagaccctatttctccaacttaaggtatggaaggacattgtattgaaagagcatggctcagaaagcaccttattggctgattctgaatcctctgatctctctgggtcaaggaaaaacttatagacaattctgggctccagacctttaactcctagggaaatagtgtctgcagcagagggtttgtggcatgtggggcatagcctggtaagtggctagggcagcattaacagctatagtagggaatagtaggaagcttgtgttgtgctctctgtgaaagacaatgagacttcgctttttttgcctcttgttggaatcattgatagatttttctttttgttgtactttttactaatactttgatttggtatacacctaacttttagagttaatgtcaatctcctggaactgaatgagggaaaagatatgacattctttgcactattggttttgtgccaggcatctggctggatgctttatgttatctcatgtaatccacagagaatgtgtctcattcagagtgggggcctatgaccacaaaagtgtaaagttcacctcagcttttaggagtgaaatgaatgggattcaaataataccttctcttggcaatgatcttctcttataatcagcccctgacacataacttaaggttaccaaaatgataacttgcataaatgattatttctagaataagcagtatttctttcagtataccacataagaaatcacaaagagaaaatttagctaaggtttttaatggaaagctatcattatcttgtttttgtagccggtaggcgtaagccaggaatcaggttggaagtgggagcccttttggcagggctgaaaactttgatcaagattctgccaagcagttctttcaggacaatgactctgctccatcgatttcagttaatcacagcatgggacaaggcctcagaagaaggggctctccatcctgtgatctccagttaaggactgcaggatgaaaaaaagaattttgtgggtaacaaaagtgagggcagggtgtcaatatacacggtttttgagttatcgagattttgttggaatttagttatttttcctgtttatgaccaaaatgatgggaggaaaggctttgggcgtaggtaagatggggcagataatgcaacggaccatgctgcaggtgcattgccttctgcagggtagattgtgtctataccttgggctgtgccatactttggataatgataataatttaataacaacagactgcatatataggggggtttaaatttaataaatcagttttgaggaaaggatttaagaagatacatatcaagctagaattattagtcaagttattaccttctggccagggaaactggttagtctgagcatctcagatgaggggaaggggctaaagaggagagggagagaagggcctctggcccttggtcacctagaagctgaaggactcaggggtccatctccagtcttggtcctcacactactgggcagtgagcagagccagcatgaggtgctgagacatggacagcaggcctgggctacatatacctctggagtaggcagcactatgctcctggtctcctggaactgacattacttactcagaaatggaatgtctgcgatcattaggtcgactccctcacagatgaggaaactgaggcacagagaagtcaagtcatatcttaagtgaatgccagagctgggaccaaaactcatgactcttgattcctggcccagtgattttaatgcccttgactaatgggcagctctgcagatggaaaggcattgaaggctggcagggaagaatgggagagccaggcagatggaagagagtggagggggcagctggtaggaaatgggaaagctgtaaagagccaaaatatccattcctcttggccatgtcccaaggacaaacataactcccaaatgttcctaataggggcataaacagtcacccagaagaaccacacaaatggattgaccaaaggccatgaaaagtcgtttatgcttaatgagtaagcactcctatttattcagactcctaatccagctctttaacctcattctttccttttaagtcattggagaccttccttgccattactcccttctcatttgttgtgtggctgtcgttgtacctagggacaactgcagtttagaatctatctgcccatttctctcaggttctggggcaaaggaaaatgaaggagaagatgatgaacttgagcgatgtgacttgcctgaagtgtttcatattctgaaaaggggctatagagaagaacaatgagcaaattcataagtcaacattgtatttatccctctattatgagggatactgcctctacttcttttgtgaggcataattatttgttagttttagcaagacatttctccgcctgctgataaggaaacaaaaaaagcatttactgtgctagtctagaatgtgaactgtaagctgtggtctttttttgtttatttgcttttagttttaatctatgatcacaggcttagaggttgaaggggactgtggaggactgccagcctccccatcctttttcatgcggggagcctcttcccaacagccctgccagtggttcagatcccttccctctgaatccccacagggagtcgcttctacctctgtggaagcacttgcttcattttgccttaaattaccgttatttgaggacttgtcttaagtctcagctgtgagcccctgtgggcagggggtggatgggcaggaatcctatcttattcctctttgatctcctacagcccccaacacagagcctggcccactctccgtaaatatttgaatgagtgacaaggtgttaagagtctacagaggcagccacagttggacacctctaatagctagaaagttcttcctaaaagtaagcagaaatatgcctccctgtgtgccatgggagggaggaggatgtaataggcagtgatgacaaagggctgggtgtctatagggtatatctggggacagggtagtgccttgctcttactgcttttcttgcattctatctggccagagtatacaaggcctttctccaggacaggaaaacccaaaaacctagatagatctgggtaaggtggcaggggcatggattccaggatttgaatccagtttgggaggacagctctatcagacactgtcaatgtcccacctatatggcctcagcctgccctgggggtcatctgcaggtgattctcatgcagactgacagctgcctgcatttatcggcggtgatcactctctgacctcagaagtgtgcttggtctgtttgtgggttcggctggaaatgccaggaacttaccccaggaaggaccttcaaccaaagatcaatgggacttagtgcatcagtaacccagattcctcacccctcagtgggacagctcagaggtgtgttttatactttctcaaaaggtctcaatagggattgaaccccagttgctcatagaacttaacacatcctttattcatttccctccctttcactatgcttcctgggaccatgcccaagtaaactgtctctcccaaataattgtctcaaggtctgctttggggagaacccaaagtaagacaatgacatgagcaggagatttgagggacttcccatgctattcttcccatagaagataaaactgtcgaaatcagtgtgtgctttccccctccccattcttcctctctatttctaagtgcagagtggtttttctgtcagttccataaatagagtttaattttcagtagaatttgtgtcctaactcagaaaacaaggctgagaatgattcttacatctttgagggatagttatttcccataacaagaatcagtaatgtcctagttctcttagggaaatgcactatgtcagaaagctctcaggccagactaaaaagagagatgacacataggggtcattagacatcaggatggatttgtgtggaagttcttcacttaactttttaaacttccacagagacattttaaattaagagagaccctaccaacctggcccaggtttgggatggtgtgcttagaggtcagggacagctaagacgaatgcggaccatgagggaagtgagaaaggaaaataaagaaccttcattaaacctactcagtattaatgaactacatctgagctaacagaacctagagaaaatgctgttactgcagaacatgtataatcatttgagaagatttgtaacaaataacgaaggtgtgtgaataacttgcctccctggtcctccttcatgcagacattgtgtgattcggaaaagctccctgtggatgccacaaccttacctgattgttttgacacctcagacaactaataggagatagcggttaaaaatagccataatcactactgtcttatgtttgtggagtttttcttttgtctcgttccttcctggagcatttttcagtgacctaataggaaacagcatacatgttcatgaatttttaattagcaagtaaagatgggaatgaatgtaaacaaaacaagtaaacaaaacacaagatgacaggagacaatggatcaagagagcccctccttgatgccttttggggtacccacagatgccttttggggtcaggtggggaaatcttcctaaatcaagcagagataagaaagggcttcacagaccttattattagcatggaaaagtgtgtgggttcaaatgctgtctttatttaaaccctgtttgatgaccagtgcctcagctcttttggcagggctgaaggaggtaggaggaaggtggggacatctttgctaggtgataggaagatgtggaattactgtgtctcctttgccctctttgatgagtacttctgccctgtttgttgtatgtagatggcaatagtgtcctgggtacagctctcccctgagcaagagagatgtctctgcctcctttagcttgtgccctcgtctgagccatcacttccaaagaacgctcttgagagttatgtgccatccctgggaatgacttcataagatggttgtgaagattacataaagtagtccatgtaaagtgactgcattaaagtgcattaatagttggcacaaaatctatgctggttccccacaatgaaagttccctgctatctactgaaattgaattgtagaaaaagatttcccttgggccaaaaacaaatacactagtatggactgtaccagcgtctctcagacttttgttttgggcagctcccttccccaaatatgtaccccacgaaagtgctcagtggatgtcttttgagcctgccccactgagcactctccttttctttccagaatgcctatgtcaacatcaaccgcatcatgtccgtggcttcccgcctctctgaggccggtcattatgcctcacaacaaatcaagcagatctccacccagctggaccaggagtggaagagcttcgctgctgccctggatgaacgcagcaccatcctcgccatgtctgctgtgttccaccagaaggctgagcaggtaaggtgcagaaacctgcagcagctgctgttggtaggaagggttgggcatgggcaggggagggctggatgggagcacacacactctctatagggagctccacctgtctttttgaaacactgaagaccctgccgagtcattgcaacaataacctatgttctaccactttgatggcccctgtgtgcacaaagaaacattggtaactcttggtgactttgcttgtcatacaaacaagaggggacccagagcctttttacattttgcttggtagtggttgcatgtgcgtgtgtgcatgtgtggactgtctgcttagtgtgcattctttgaacacagatcaaaggggtgaatgtaaagtgatcattgaggtgctgagagcaggggaaactaattttacatgaagtatttgctatggataatgggaatataacaataatataatgggtcaagataataattactcgtacttactaagtggccaggcattggccagtgacattgctaacccattttacaaagaggaacactgaagctcagagagattaagtgattggcctgcctaagatcccatgatgtgttggagcctgtcttgaaccagctcatggagagacagttgttaaatttttaggaattttgagaactggttgtcacattctagctattgcttaattatgtaggtttataattaaatgtgttatgttaaaagcaaagttaataaatactcaaaattcatcacttcctgattattttacaacatattgttattacctatgttcttgaaatcatttttatgtatttattttttctgtggtggaaataccgtacaattgtgtgctatgtatggatcacctcttcccaactccatgttggtgatgtcacattggtagcttaaaatacaccatggtaggagtttcatattatagaaattatcagatgctacaaaccagggattgatttattgctttattgttgcctagagtcttaagaaaatgagggagaaagtgtttgaaaatgcagactaaacttaaaaatgtgtcctgtgtatagctgttacgttgtaaataacacacaaaaatcaaggaaatattcttccaatattcaaaaactgttatttggttcagcaaagaagttgctgacatccttgatgaacaagtgatgttctggcgtagtattcaggtgcttttcacctttgtctcactccttaacatagtgaaaatatcaaccagcatgtgtgtcagaactatacatgtttgtcagttgcaaccataggtcaaaagcatcctgtgagaatcaactggctacattaaatatacaatacagagtattgtatatgctgttgttctctgtaaattgtgttttatacattctttatatcagtaggatttgtaaatgaacttacctgtgtatatgtaatatatagtcatatacacacacacatatatatgctggttgttaaacattttctaacacaccactgctaaaatcacacaatctatgagtagataggctatcacctcaggtgtgttttacactaggcctgtggtcttaacttctacaattctttctttgcatcacatttgggtaatataggccaaggagagtcagacacctggtcacaccttaaatttctccctctgttaccctctctagtgtggaaagcaacatggcataattaagagtctagactttgaggcaagacacatggattctgatcccagctccaccattcattcacccttaggcaagtcacatcaccattctgagcttgtttcctcttccgtaatgtggagctaatcataaatggcacagggctgtgctaaagatacaacacgagagatggaatatgtaaggtgcctcgtgtgcttactaaacagtggacattactactatgggtatttgcaccacatactatcctggtatctttttatttcctccatttgtgtctatttccacctaagaacttcctaaagactgaaataatacttgtgtcaagcacaaccctatactttgagagggatttggccatatctttttgtcgccgttgttaaggttgttggtggtagtgactgatagtgactggttcattcttagggccatgagaatattgctgtccaatctcctgttctgtcttcaaccttatcacttacatactttattcaaggtttgcccagattggtaaggaagacccaactgcttctctctttgtctctctggcattatctccttgaggtgatcgttttgtgggatatgctacaggccacctgttagaatattgcagagaaatcccatgagccttgaaggagtgttccccccatgattgacacaagaatgtcaagttgctcccagggtcatttgtaaagtagttattggtggagcaaagaagcttctgagatcttagcatgtacatattatatgatctgatactcgatggcacctggcactcttccagaattgcttagaaatggtctagtgtgttacaaaatgtacagaatgaagtcaaccacaacaatcaacaggccagggactgaaagctgacagtgacaacaaaactagaacgcaaacggttgctgtaccagaactgagaaaactggagaagtgcacgtttatttcatgtttcctgactggactggtttggatcagaagcgattttatttgtatctattttttaatgcaatttctgcaggtattactagtccttcagggacattcataaaccatgcttctttttaactggggaaaaacatgactcaaagttattttttccatgtatttatttaggcagctctttattgtcctcatatgggctgttcttggcaatgggataaagaggtctttaggcaattaatttaaatggagctgtgcatccagacgagaggaatcacagacagaacgattccagactgttgggtgaattatttgcattttaaaggtgcatttttccacccaataaatctgagtgatttcagttagcttaccctttgtgcgtgaagacccatagtcttccacagttgttaattttaatttttaaataatttgatgtctgtcaagatctatgtctatatatcacaacctgggatgcagtaggtgtagcacagcctgtccccctagactgcctctctcgtttccacccttcaggggactgacccaacagtgggagacctgttgagggcagtttccgtcccatatgggatggtctctgcaagtttcctggggttcctggtggtctgtgtgaggtgttttttgcttgtcttcacaactggatgtacatactgtaaagcacagatgtggaacatctccttacattacacacagcccctcacgtgtgcctgtgagtgtgcgtggggcaagaagctctaatgtatccgtggaatgtggtgagctgtttccatacctggacattacagttagtgtgtatctataacctattgaacatctgatgattcacctgccacctacagtttcataatagtcaattttgtggagactatacttcctaaatgggtgcctgggtctgatttcttactaggagttagtgttcatagaattaaaaaaactctaccctctacagtggtctctgaaggctttcagaagtcctgatgtttcttcccaaggtatctgaccctctctccataatccacccaactcctcacccccagtgctcccccactgatccaccctgcatctccttccagttcctgtcgggagtggatgcctggtgcaagatgtgcagtgaaggtggtctgccatccgagatgcaagacctagagctggcaatccaccaccaccagaccttgtatgagcaggtgacccaagcctacacagaggtgagaatggagcagggcaaccatggttcttgggcatgtctgcatgtgggtgggtgatgagggcactggcctgtgccctgtgaaatagcctgggtgggactaagaagaagaggctgtttttctttttttttggtgacatctttaggaaccttgatctatgaactatggtgtctccagccaggaagcagaaaaaattggggccattattaggcaccactttggtgcactcgcattcattctctctctctctctctcacacacacacacacacacacacacacacacacacacacaccccatacacctgcctcatcctgtgtgtgaagattggactttctcctcttgggggaggaatataagaaaatgaagctgtgcttctctggaggttgctttctggttggtgagtggagatgtacacactagccctgccaccttttttatgaagcagctcattaaaaaaagattaattttctcactagacgatccagaggaaaacacacagggtggagataagtgtttgcaggagtaagaagcttccatgaatgtgaaggacaaagactcttccattgaaaaatcaaaggcagggggttactgtaaagttaagaaagggaaaaaacctcttgacagtcctctcaaagtaaaaggaaacagctacataggtatatctgtgtagatacacataagttagtatgtttgctaactggcatgaattctgaggaaggggactgagggatggagagagatgggctgattaaggaagctggatgaggagaagaagtgaattcacatccaacccatgtgtttcctctgggcaggattagttagaggagtattaaaatgggttcctggaccacctgcatcggactcacctgatacagattcctgggtcccaccccagactgaatcagaatatcaagaagtgagacctggaacctacattttaataactattaccctaggtgagtttgatgcacattgaagtctaagaaccaatggctcctaggtaagagtaagggtttttgccacagtcaaactgagtttgaatcctggctctcctatttactagctgtgtgacctcaggcaagttacttaaccactttgagcctggtttcatctgtgaaatcaaagtagtaacacctgtctcataggatagtgttgaggttataaaggtaatgcatgacaattcacaattgcaaaaatatggaaccagcctaaatgtctatcaaccaatgaatggataaagaaaatgtggtataaatacaccatggaatactactcagccataaaaaggaacaaaataatggcattcacagcaatctggatggagttggagaccattattctaagtgaagtaactcaggaatggaaaaccaagtatggcatattctcacttttaagtgggagctaaccaaacaccacctgttccccaaaactatttaaataaataaatcaatcattgtacccaacaaaaatttaaaaaaataaaatgaaggtaatgtatgtaatgcacttggcccagtgtctgacagtaatgaatactaaaaaatggtaatgtattctgtcattgtagaaggtacaacgaaggacttacaagccaaatctgatctcatcagctctgatccatatggctcaaagctttctgtcttagaactgtgcctctgcccatgggtcaagaatctttaaatttactccttgcaaaatacaaatatagagagtacaaatgagattaatattatacttccacatatgtgaggtgtgggtgtaattatacatatagacacaatatttctctcaattaattatcaggccctagcgttgtgaggcttaaaccttccctccaagcccacttcagaggccagtgagctgtccatgcttcctacagatgtagagactgaggcagaggattagagctcatgtggggtggatttctaggacttgggactccatctctaactgccctaccctggacatagcatggtgccaaaagacagcatttgctcagaattccagaaagagagctctcctgggtttcactataggatatttgtcttatttatgtctctggtgggcatcacctctgcattatgtataagctacttcccccaccccactcccctggcagtcaattatgggagatggggatggcaggattgggtgggtggtggtgatttcctctcctggcctctgctgcactctaccgcagcacccctcctaaccaccctgccctgaaagcatttctgtggccccatgggcaggagtaacatctgcttctgtattcctggacccccatccaagctattatcagggaccaaaggaggggtgaggggaggatgcaaacccggcaaacagcttcatcatcagaggtgtggagatggaagcacacacacctcattccctaccttgctggtgagataaaagaccattttcatctccaaaagccttcttttggggaaggctccaagccagctttgatttagttggtaaccaaatttggggactcaacatttctatcaattcccagtcatccctgttttaaattggaaagatgcatgttctgttgggtactttgtcaagcacaggagggccataggtgttgattgtatgtgtcattttccagaattattgatgcccgtgattgtgccagaactccaatgagaagaatggcagagagtgtcatcccacttttctcagactgtgggcgagtgttggggaaccgaggaaagtggatggtgtgtccactgtctaagtgtcccagcctttctctgcatgttctagaaaaatgaggattgtactgcttttcaggagaaagaaagggctcgtatagagcgagagcaaagtattttaaaaggataaagacgaaagaaaatgacaaggaaataaagaggatgggagagagatgatgatgatgatggttgtattagtctgttctcatgccgctaataaagacatacctgagactgggtaatttataaaaaaagaaaaaaaagaggtttgatgcactcacagtttcacatggccatggaggcctcacaatcatggcagaaagaggaggaggagcaaagtcatgtcttacatggtggcagtcaagagagtgagtgcaggggaactgcccttttataaaactatcagatctcatgagatttattcactaacatgagaacagcactggaaaaacccacccgcatgattcagttacctcccaccaggtccctcccacaacacgtggtgattatgggaactacaattcaagatgagatttaaatggggacacagacaaaccatatcaatggtgatgatgatgaagataaaattggtagccagtatcacttgtcaggctctattctaaatacggtatgtgtgttaactcatttaatcctcaccatgactttatgaaatatgtacataaatatccctcctttacagacaaggaaactgaggacccaggaggttaaataacttgcctcttgtcacacatctagaattttagagccaaatagaggaatttgggaaagaaagaggaggagaggattatggtgggaacttacattgacttcatttctgaaatgaagttatgctgtctgacctggtgtgagtcagttaaaatgtttaccaagcctgggcactgtggctcacacctgtaatccaagcactttgggaggctgaggtgggcggatcacctgaggttaggagttcaagaccagcctggccaacatggtgaaaccccgtctctactaaaaatacagaaattagccaggtgtggtggcaggcacctgtaatcccagctactcaggaggctgaggcaggagaatcgcttgaacccgggaggcagaggttgcagtgagccgagatcgcaccattgattgcactccagcctggggacaagagtaagactttgtctcaaaaacaaacaaacaaacaaaaatttaccaaatgcctactgtgtgccaggcactgttttgggcattggggcgagagcagcaagtaggcagtatctctgccctcacagtgctgaaattcaggaggggagagagtctcacagacaactggccagcactccagcaactcccacatcaggggattccagctgctctgccctccaccaggccggaggatgggccccatggcagctctggctggctaggtgtctgggtatggaatgcctgagattctcagaaggcctagtcagggaccctcaggcagacacttcctgcttctctctgtgccctgcctatcacccttttcccttaacttaaacttctctctttcctgcaggtcagccaggatggcaaagcactacttgatgtgctgcagcggcccctgagccctgggaactccgaatccctcacggccacagccaactactccaaggcagtgcaccaggtgctggacgtggtgcatgaggtgttacatcaccagcgacggctggagagcatctggcagcaccgcaaggtgcggctccaccagcggctgcagctctgcgtcttccagcaggatgtacagcaggtaacaggctctgagccccggtgtccattatccattctaggaggcagaccgagctcaagtccctgacctaggtgatcaggcttaggagagcccagatttatagaaggacataatgaaattcagctctcaactgctccacagaaccctaccaaaacacagaacaaaaactggacctgtgaattgcatatttcttgcctaagtgactgtatagactggccttctcaccacgtggtattgtaaagggagactcagtctcaggaactgcaattcctcgtagtcatgtggcacatttttcttttgttttgttttgttttttggaaacagagtctcgctctgccgcctgggctggagtatagtggtgtgatcttggctcactgcaacctccgctttctgggttcaagcgattcttgttcctcagcctcccaagtagctgggattaaccgcatgtgccatcacacccagctaatttttgtatttttggtggagacggggtttcaccatgttgaccaggctggtcttgaactcctgacttcaggtgacccgcccgcctcggcctcccaaagtgtcaatatgggttaggattagggccaatatggcacatttttcttttggtgagcttgacccacactcaggcaatgattgctagacagcttgggggtggggggttatccaagcactgtcaggcttggactccacatacggtccatctgggatgcacgtggcctgccagagtgaaggtgaagtggagtacaggaaacttcagaggattccttgacaaggttggaccaggaaaatcagatttaaaacctgggctgttgttcagtgtatgtttcatgattacaggttattcctgactttatgtagtttctttttttttgtattatgacatcagttgttgctttttcctttaccactaataataaagaaatggttatgtttctgaccacaaaaggacaatcttgctacaaatgccctttcagatgaaataacccattcttttctccttgtactttctctgtttctgtcttccagaggaccctgggatctttgctggaggactaatatactagtgtggggggagctggctgggagatggggactgagatccaggctcactgtcatctgcctcttagttcaccataggaaaactaaggatgggcttagttgtcctaggatgggctctgcagagctgcagagaagctgctcgggtggacgcactcgtgttcaaacacctgtttgacttttctgtggctaccgtgtaactccaggattatacatataaaataacaattcactctcctttcattcttttgtggtatcaaccaggtataatccaagtataatctaatttatctactgtattatataatacaatgtaatccattgtatatttccagtgtagtgaaatacacatggaaaattgagagccaactgtacatgtctttgggatatctgttcccttcacaggtgtcattagaggggcctctgatgctgggtgcctgaagtggtcaggcagagtggagggagagttgagcattcttatcactgactgtgacactctctgaatagggggatagtcactgtgcaatcagtcccaggaacagatgggccttcgagcatgcccccacttcttgggctgtcataactccccttgaagagtcctcttctgactggagcatcagttgagttatcagaggcaacacctcagtcccaggagaaatgggcactactgatgtgctggctgcagttctgaagcccttgtggggcctgccgggagtggagaagcaagtgaatcagttgcctactcctgccatctggagctatcctgataaatatatcactcctgagcacaggagagcacaggaggcagtctatgattgagacagagtgaggtaccagcctctgaaggcacaaaggagaggcgttgctatttcagtgaactctccattactctcagagatgatctgggccgtgaattgtgcaatatccatggtgtcctctttaccctcatgctgattttatagctgttgtcctggagagctgcagaggggctgcaaggagggtgtgtgaaaggcctccccaaggggagggtggcattccagactccaactatcagggaactgctgtaatctgacttttctgtggctactctaaactaaagctaagaaaaagtataaaaccacacctgtggttgttctgcatcatgctttcaaaaatgagagcctttctgaaattaagaccctgtcagttcatcactttcttgtttgtaaatccatgagcatgaaatctttttccatttatttgtgtccttttatttccttctgcagtggtttgtagttctccttgaagaggtccttcacatcccttgtagttgtatacgtaggtattttattctctttgtagcaattgtgagtgggagttcactcatgatttggctctctattattggtttacaggaatgcttgtgatttttgcacattccagaattgtgcaaaaaatcaattgcattgattttgtatcttgagactttgctggagttgcttatcagcttaagattttgggccgagacgatggggttttctaaatgtataatcatgtcatctgcaaacaaagacaatttgacttcctctgttcctatttgaataccctttatttctttctcttgcctgattgccctggccagaacttccaatactatgttgaataggagtggtgagagagggcatctttgtcttgtgccgattttcaacggaaatgcttctagcttttgcccagtcagtatgatattggctgtgggtttgtcataaatagcttttattattttgagatacctagtttattgagagttttagcatgaaggggtgttgaattttatcaaaggccttttctgcctctattgagatatcatgtggtttttgtcattgattctgtttatgtgatggattatgtttattgatttgcgtatgttgaaccagccttgcatcccagggatggagctgacttgatcatggtggataagcttttggatgtgctgctggattcatttggccagtattttattgaggatttttgcgtcaatgttcatcagggatattggcctgagattttctttttttgttgtgtctccgacagggtttggtatcaggatgatgctggccttataaaatgagttagggaggagtccctcttcttctattgtttggaatagtttcagaaggaatgataccagctcctctttgtatctctgttagaattcggctgtgaatccatctggtcctggacgtttttttgttggtagactattaattactgcctcaatttcagaacttgttattggtctattcagggattcaacttctttagtcttgggaggatgtatgtgcccaggaatttatccatttcttctagattttctagtttatttgcgtagaggtatttatagtattctctgataatagtttatatttctgtgggatcagtggtggtatcccctttatcattttttattgtgtctatttgattcttctctctttttttctttattagtctggctagtgatctatctattttgttaatcttttcgaaaatcagctcctggattcactgattttttgaagggtttttcatgtctcaatccccttcagttcttctctgatcttagttatttcttgtcttctgctagcttttgaatttgtttgctcttgcttctctagttcttttaattgtgatgttacagtgtcaattttagatctttcccgctttctcctgtgggcatttagtgctataaatttccatctgaacactgctttagctgtgtcccagagattctggtacgttgtgtctttgttctcattggtgtcaaagaacttctttatttctgccttaatttcattatttacccagtagtcattcaggagcaggttgctcagttcccatgtagttgtgtggttttgagtgagcttcttaatcctgagttctaatttgattggactgttgtctgagagactgcttgttattatttccgttcttttgcatttgctgaggagtgttttacttccaattatgtggtcaattttagaataagtgcgatgtggtcctgagaagaatgtatattctgttgatttggggtggagagatctgtagatgtctattaggtccgcttggtccagagctgagttcaagtcatggatatccttgttaattttctgtcttgttgatctgtctaatatttatagtggggtgttaaagtctcccactattattgtgtgggagtctctctttgtaggtccctgcgaacttgctttatgaatctgggtgctcctgtattggatgcaaggaaacccaaaatggaaaaaaaatcactaaaaattattttccatttgttacagaaaatgagggaggcatcacatgtgaatatgtaactatatttttcaaagtgtgatacttggacccctgcattaaaatcatctgggcagagtggagggctttttaaaaacagattatcaggccgtgttctacatttcttgattcagaatttgggaatgaggtggagcctataatttaaaaagaaccccaggtgattcttaagcattctgaagttcaaaactgttggcaagagtttgaagccttagtgttaaaaagtatagtgcctccagaaacagacagcaaggtaccaggcagaggaggttctctcagagaggtgggaggacccagcctccgctctgctgggaggggacgggtgcaggtgggctggggctggagaggcccagggttaggggcagctgagactttgggtctctggaccctcagctggcttccacccaactttgggtctgccaggtgacaggattgcagctctcagtggaagcacagtccgtacacctgctaatgagtttctgctgagccctctcagaagaatgatggcttctcctgccatagcaagacatttattttgatcatatttgttccaaagaggggacgcaaaatgagttgctggtaattgggcatttcaagtggtgcctgcatgctctccagttgcagccgatggggagctgggtggtacaggcagcctaggagctgctccccttcagaactagtgctcagtgtgctgtgtgaggagacagaaataatgatgtggcagactctcctgagtgctcttcacactgtgtgtacttgaacctttaacagaacaaaatgtcttgtagatgcctgatggcatatagatgatccttaatttacatcagaataatggctttctaaatgtagggggctgagggctgagaggtaggaattaagagaggataattctttagtttacctaaaacatcaagcatcttcttgttttaccccgtggatcaaattatgacacaagctgaataacctatttcaaataagatgacttatcagagagaaccaggtgaggaatcagagaggtgagattctgattccacatatggttgcaaaacgtctccatttcttttcatgggttttgttcttcccactcaggaagttttcaaattatatgtgttattcacttacccatttattcagcaaatactctgagaagaacacagcagcaaatcaaatgaaccccctgtttacatagagcttacagtcagggggtggaaataaaacaacacccaaaccaagcaaatatgccgtgtgtcatatggcgatagctggtgatgagtgagtggagagctgaatgaatgagcaataaggatgtgtttaagaagaggttctgggactgggcactgtggttcatgcctgtaatactagcactttgggaggctgaggtgagcggattgcctgatctcaggaattcaagaccagcctgggcaacatggtaaaaccctgtctctactaaaacacaataaaactagctgggtattgtggtgtgtgcctgtggtcctagctattcaggaggctaaggcatgagaatcacttgaacccagtaggtggaggttgcagtgagccaagactgtgccattacactccagcctgggtgacagagtgagactctgtctccaaaaaaagaagaagaagaagaggttctgacacatggaatggtacttacaaagtccttaagaccagagtggtttcccatgagctcagatgcgttcatggccactatacagagattgtttgttaataattctcttcaaaagaacattttccagctgggcgtggtggctcacacctgtaatcccagcactttgggaggcaaaggcaggtagattagctgaggtcaggagttcaagaccagcctggccaacatggcaaaaccccgtctctactaaaaatacaaaacattacccaggcatggtgatgcgtacctataatcccagctactcaggaggctgaggcaggagaatcgcttgaacctgggaggcagaggctgcagtgagccaagatcacgctactgcactccagcttgggcaacagagagagacttcatttcaaaaaaaagaaaaagaaaaaagaaaagaacattttcccttctccttggcagttagaaaagactgtctcctgtgctgaaaggcattgcatcttgattgtatgctggttggaataaacacaattagatgaggaagaaagggggtgattagggaattatgcataatggctgttaagttaactttcaaatctagtcaaggatgtgagcatctcttttggaaaagactgttcttggaaaagactactttctggttgaaaagtcaagacgagaaaccaagaagatctttacaagttgttacaagactgcctgcctgctgtagtggcaaggagcctgggctcacctgcgttgttatccctagtgatgacattcctgaatggggtggcaaaattcctctcaagacgagcagggcagggaccttggccacatatgcacgtggcaattcatggctataaacagtcattgtgtatcttccaagtgcaagatgcaggcaaggatgctgtgtgatagaggagagggaagggtagcatacaaatggtgaaaaacccatactctttacatccctctaagaactaactacctgccaagtggggcagtggggaaggtggagatgcacaaagagagaactttgagtgtagactgagatagagttacagtgggagtgtagagcaggagatgttcactccaaagttctgcattagaggggtcagtttgagctcagttcaattaaacatgtattaagcaactactctgtgctgagtaccacactctgtcctgggagtacaaagaggttggagtctagtgtgagagacaggcctgtgggcaataattgtagtttcaacagaataagagaaacacccactccagcctgaatgggttattaacgagttaaggctttccatagccaatgattttgaggcagagcttaaaggataagtaggaggtagcctggaaagtgggtacacgagaggaaaggatatggaaagtgaagggaaaaacagagcaaaatttaggagatgagaggcagcttttagggtgttggggggtgaggcaggaactcactaggggtggggttaagagggggtagggccaggtataggggacttagtgtcaaggtaaggggctgctcaaaaattataccctggtgaaaagcccttttgagaattcgtgggttaatttcatttaagtctgagggtatgcctttatttatttatttatttatttatttttgtataaatatacggagtccaagtataattttgttatatacgtagattgcgtagtggtaaagtcagagcttttaggatatccatcacccaaataacatatattgtactcattaagtaatttctcatcacccagccccttctccctttccggtgtccattgtctagcactccacactctgcatccatgtgtatgcattatttatcttccacatataagtgagaacatgtgatatttgtctttctgtacttgacttgttttactcaagatcatggcctccagttccatccatgttgctgcagaagacatgatttcattcttttttatggctgaatagtattccattgttgatatataccacattttctttatccagtcatccattgatgggcacttaggttgaagttatatttttaaaatggatttggtattccgttttattattgggattcagctagattaacaatttataatttatttttaagccttagtgtataaattacttctttgaaactaaaggcacatctttcccagaatctgactgacaaccattattgagtactatttcccattccagttcaggggcacaaatcactgtcacttatgcccctgagtatacctttccatagtcattctcagaacaagagtatgagcatggaaagggaaaaaaatcttaaggaaaaaaaatatgttatgtctgtgctaccccttataactcattcactcctgtaccagtgactagttctaccttccactcagttattcaagacatgcccctgggggccaggcttaccacctgcctctccatctcccccatagccaattaccaagtcctggcaattctttcccccagcctgtctatctatagacactgccattggcctcgcctgggtcaccatcacctcttgtcagaatttctgcctcctgttttcccttctctactcttgccttctccagtttatcctccacaaagcagtcagagcaatatatatacacatatatttgagacaagatctcactctattgtccaggctggaatggtgatatcacagatcacttcagcctggaactcctaggctcaggggatcctccctcctcagcctcttgggtagctgggactacaggtgtgcaccaccacgcctggcaattttttttgtattttttgtagagacagagttttgccatgttacagaggcttgtctcaaattcctaggttcaagcaatccacctgcctctgcctcccaaagggacaggattacaggcatgagccactgcacctagtcagtcagagcaataatttataactgaaaatgaaaagtgtctttatcctccttgcagcccttcagtggctcttaggatgaacaatggattctcccgttcagcacaccagggctcaccacaatcttgttcctgccttttcagggtccatttcctacttatcccctatgcaagccatgctggtcttttcaattcctaatttggttaaatcctactctctctcagatctcagctaaacctcacttctcctgagaaaccttccgtgactccccagagaagatgcgtttggctgttgacacttttcacctttgcaatgaatgatgaattgtgtgatttagtgtctagtgcttgttacccctatagactgagttctcagcatcaggccatgcctgccttgtttactgctacacccccacctccagagctgctctagtgcctgacactgtggcacaataagactattaaataaatgtccgaatatgtgaatacttatatacccacacatgcttctctgctgcctgacaaaaacaaaaagataaaacctccaaaactggaaatgctcaaataccaattcagagccatcgataggtatgaatgactatcatgctgtatatcctgactatgattggtaattgagtattttaaatatgccttgtagatgaagagaaattattcaggaataagattataaggagtaccttgatgggtgcttgtacttaggtagggtccaggatttgactagaaagtcaatttattctttaaccattgatgttcagattctgggaccttgttcatcttaatggaatgcactagaaactgacaaatatccagaatctcaagccacacataaatttatagcgtgtaatgtaattgtcaggcactgctgatgtctgctcaggaacatgtttctctgctgcgcaggatctgcatggaaagtcagattgtactcccgaggttggacgacatggaatcagggtccagacagtatgtggtctaaacacgtgtatcatgcaatgatggctctaaatgaactgtctgaaacaaaatagtcagaaattagaatctttaacaatacttcatatattaactatgtttatctagcctcaaatactttttcagtctggattactaaagtaattttgttaactccctaaattatttgctttttgatttgttaaattgatttctgcatagctcctgaactttcgtcgaaattgcacatattttccctacagcttcaattttaatggtagaaattggactaaatgatggcaccagagcatcacagagcaatcaaagttatgttaaagtgaagtaaaagcttctcaaatatgaaagaaataggtttttaagtgatgaaggcatagccaattaagtaaaactaagtgtcactaaaaataaattgacattttaaagaaagcaaagtaacttaaaaaggaaacaaattgcgtttaaaaaatatttagaagttgtgaaatcgtttctggggagtgcaaacactgtatgtgggtgaactagtagatgaaaaatattcctcttcaaccaatttgcttcagaataaccaattttcttaaagctagagataaaaaatgagataaaacaaaactcatgaaaacattgccagacaagcaggccatacttaagtgctcaaaactaaatttaaaaaattgtagtctgaaaaatctgttataaattccaacacattcataaacgaccactggtagttcttttatatgcaaaaaattatcatcaaacctcaatttgttttcaaaagggattgatgaaagtttatgcattaaaatcctaaaactttactatacttcgcacctaatatatgggaaactttgtgactacaagtatttacctttgaccttgcatgctgaagctcataactcctttacagtacagaattgtgagatctaattgtggcaagccaagtaaaaatatactctcctgattttttttggttgaagtttcaccgtaagtaattctagagaaacgcaggctcttctaagagatgaacatgtaaagttcctttcagtgctgcctttcagtgtttgcaaaaggtaaaaatccagcactaccacaatttctttttagggttgtgcctccagaatacttaaaatatgtatattgccagaatatattataaagtgtttaaaatctccataatgtttagatgaattcattttttatttataaaaaactttttttcttcatgatgatggacaattactccgcctgtcttcattaagtggatatttgttaagcctcatttttatattcatatatacctttctctgaactagcacaatcacgatgtgggctttgtgatcctgtcaccaaagactttgaaaatgttcataccttgcacactgcagatattaaatatcccaaatgtcagagaactcccatacctgtagtcaatggaatgatttggttttacctctgtttgctgcagggcaatccgtttgagacacaggaatgagttaaaccatccttttaaatagacctagttcatctaaaccattttccagtaagtgcttccaaaatctggaaaggctagtacatcattaattaaatgtttagttaatggttaatattgcaggcagtgagtgggctcacttgagttttagcaggatctataacaggtgtgtctatactgtaattctgatttaattgtggtcacctgatttactgagcgccaactcttcagagatcaaaagatgatctctgggatacacacatttttgttaggccatctgcaagaatgcaaaatgggtattaaaggctttcatcctccctgcacgtcaaggcttttactaagggatttccatcctgcctctcaagtgcccctcaggaaaacttattttccacccttcttagcatcccctctctctcacccctctattgcccaggggtctctgttccagtgtctctaaatatcaaggaaactgtcttgaagccaaatcactagatctttagcctggaagaacctgaagtctccactgcttcccaagagactcagatattaaaggacttaggatgcaaacactttaatttatttgtttgtttggttggttggttggtatcgattggaggagggagatggaaagaagccagagggggctcttgtcctagtggtcagatatcatgagcatccaactggagactgactaccctggactttgctttcaagattaggaaggggagtccccggagcacaatgaggcaggatccccatgactggtcaccattgctgtttgtgttcttatggcagcgtgacggatgagtaatgagggccaagatactgcccaaactgctactacctaatttcctgccaatatctttatgtgattgggtagaagtggtgagggggttaaactgtgcctgatggtctgtgtaacttgtttaaaataatgaactaagaaaatggaaaaagtaatggaaggataatatggagatcaaaaaggataagttgaatttaggtaaaggtgggactatgatattgccaatgacagtaatgaaatcccatggactcacagcagattgaccatttccacctgaactgctgctttacaactgggatgggatataggggtggttaggactctagcagttgcacatgttgtcacatgtctttccttctgctagaaagtcattgttgctgttatccttctttgaccaggtgttggactggattgaaaaccatggtgaggcctttctcagcaaacacactggagttgggaagtccctacatcgagcccgggccctgcagaagaggcatgatgactttgaagaggtggctcaggtgagaagctgtgtgtgtgtgtgtgtgtgtgtgtgtgtgtgtgtgtgtgtgtgtgtctagatgagggaggcatgatgactttgaagaggtggctcaggtgagaagctgtgtgtgtgtgtgtgtgtgtgtgtgtgtgtgtctagatgagggagaccagggctgtggctttggtgtttggtgaggcatgctgggttgataacctgtggctgctgggctgccttcctgcctgatgcaaggagtcctttgtcttcttttggattctaggtgagtggtaaaatagatgcccacatttatggtctttgaaaaagatcttcctgctggtgtgatctaaaaatgccttgtccacgaggtggtgctggcaggagggaatgacattattagattcctcatcaccccagggctactgcttatgattgtcactgccagtgagtgagagctaaaaatcagtcccagctctatttacaaagccacataccttccaggacctggagaaataggtggcacctgctcaccagccatgcgctcacagggttgaatgtgcccagagaacctgccttcgtgtgatttgtacaatatttaaactgccatttatataatgttcagtcttttagctgagctgcacacctgatccaaaaagggcactgtttttgaatttatacaaagatgttgtatgacaggccctgaccatttgtctaatagtataattgttttaaagtgtttttgttcagagcctccacctcaaaaatgttatcctaactctgttatatttctgcattggggagttttccaaacgggtcctgaaaattttcattttcgagatgaaatactgctctccagttattttatcaggcgtgattagctgccatgtaaaacaaaataatgaggagtaaggcagggagggtgcccatatgggacagagaggtgggtgctgctgaaggagtgagaatgacagagctaggttttgccatatcactgctttagccagagctgacttcgatcccaccaggcagacagccctcaatgtgggccctactttgggcattgtacagagccctgggcctcacccagggaggctcccagccccagacagactatgtgctatggatgcaaaaagagatggcatgtcaacaaccaagcaagaacaggaaagtcatggagcattactgcatctctaggggagctgcaagcatatgctgaaaaatgagaggcctcataggaggcagaaagaccatgtcagtggcgacctgagcccagggaatatgggtggattggacccaacctgtgggataaagaaagcctcatatagaacccttgtgcactgttgatgagaatgtaaaatggtgcagccactgtggaaaacaatgtggagggtcctcaaaaattaaaaatagaagtaccatagatccagcaattccacttcaggctgtctccctaacataattgaaagcagggactcaaacagatttttttttgagacagtctcgctctgttgcccaggctggagtgcagtgatgtgatcgtgactcactgcaacctctgcctcctgggttcaggtgattctcctgccttagcctactgagtagctgggattacaggcacctgccaccacacccggctaattttttgtatttttagtagagatggggtttcaccacgttggccaggctggtctcgaactcctgacctcaagtgatccacccacctcagcctcccaaagtgcagggattacaggtgtgagccaccgtgcccagctgtcaaacagatatttatacacccattttcacaatattcaaaaggtggaagcaactccaatgtccattgacggatgcatggataaacaaaatgtgttctattcagataatggaatattatttagccttaaaaagggagggaattctaacatacgctacaacatggaggaaccttgaagacattatactaagtgaaataagccagtcacaaaaaggacaaatattttatgattctacttatacctagagtagtgaaattcatggagatggaaagtagaatggtggttgtcagaggctgggggaagggaggaatggggagctattgtttaatgcaagcttatccagcccattgcccacgggctgtatgtggcccatgatggctttgaatacggcccaacacaaattggtaaactttcttaaaacattatgattttttttgcaatttttttttagctcatcagctatcattagtatattttatgtgtggcccaagacttcttccaatgtggcccagggaagccaaaagattggacacccctggtttaattgataacagagtttcagttttgcaagatgaagagttctagagatggatgatggtgatgcttgcaccacaacactgtgaatgtacttaataccactaaattatacactttaaaatggttataattgtaagtgttatattgtgtatattttaccacaataaaaaaaaaagaaagcctcatagccaatgaggaccttctgcagaatgaggtggactttgccaatgtaatagacacaggtcccaatgcaccttatgatggacaagatgcagcacagatccacaatatctggtcctgggtcattcctttctaggctgttagggggcaaaggatgggagagggccacaggtatcccctgactgctgagagtggaggttgtagtacgtggggtggtctgttggaatagggccatcccatagctttggggcttctgcctgtgggctgtcctatgcctcagcattcctcacttagaaaggacgtccccaaagccacccatagccctgacccagctcaatcttccttgccctctgcctgatatagcctcagaggcaatgccaaccttggttataggcccatgttttggttataggccgcagtttttgcattttgttacaaccattcaagacccatggccatcccagtcccatttttcccaactgttcctccaccttctcactgatgcctgatattcctttcacatgggacaatgcctttccatcagcggcaaagacacatgaatttaaattcacgctaaagaaagaatggacacatttttgagagcttatgtttccattatatatcttgtcttataccaatcctgaatgataggtagtatttgccttgttttatagaagacaacactgaggcttagaaagttcttccatgtgcccaagtcatccagcttgtcaggggctctgctgagattcaaacccaggtctgttggattccacagtcatgttcttatcctaattccatgctgtccctccttattgaggtataggaagtgggcataaaattcatttctaggtgcccatttgcttatgggaagtgtgggacaaagagaaagggagtgagggtgggggatgttgccacccttattgacatccattacaactttcctctggcccttccaatgagtaatccactggcataatccacatctccctgactctgctttctgataagactgtattttttttgaaagagaagacagagttctaacttccaaaaggctcatgcttttaggaggaatgtttgctctgaaaaggagaaaagcagatgtgagctacaaagggagcactttacctggggtttgtgagccatcccattaccctgaaattagcctccagagctggatcttgtagttggggaattaatcctgccttattccttcatcaccactctgggagattgagtggcccagcatcctgggattgttagtccacataggaaaaccaatgctgaccacagtgaaggcaggttgactgtcagtagcagcctgtctgagacctgctttgttctgtacaacgtgattgccatgtttaggtggtgaaaaaggggtaaactaggaaggaaagggttcttctttctctcttgtttctgctctcaattagatgatggccactgggagaagaggagtggatttaatcaggaactgaaaagttctcgagtaagaagatcaatgacagaaagccaaagcatggacactcttgttctttgtttgggttgctgtttatgagatgtgttcaggaaggctatatatgctgtggggtaggagcctggggtaacttataagcaatactctaaaggatcatgattctgtgaagggacctcttttagccttatcatttaggattcctttacctgaggctgataatgagaaaggaattctgagcacccattctctgtatttaggttcaaaaaattgtcttgaatcaaagcagaaagacagctattacatctgtcacagctcctggaaatttgtccttctgcaaggaaaagcaagccctcaacagagggaatggctacccacggggaggggttaggcagtgtaaagcccctgaacaaatacatttccaccctagggatagtggaggcatctgtgattcttaccagtggtcagtctttgtagtaaagacatttagggcagctattaaaatagatgtaaatgatatctttgaagaatttatgtggcaatccattatccttcattaaactttaacttttgtgtttaatagctcttgaacaaattttaaacaaattcttcaaatgccatttgaagatgaattaaatatttgagtcctcagttcatcctgcagatggcactctttgaatggctgacatagaagctgagctgactggggaaaggctttgcagtcatgacagcctccctagagaggaatccaacattcagagtgaaggcccaggaagggatacaccagggaatctgtgtctacagttttctagtctaagctgctgaggttgtgcgtgctcaaatagaagtcccgggcactggcgggaacctctcctggtccttagtcaactaatggactcagtttgcctataatctccccaaatggctaaggccaccgagtagtttttaagagacacatattttaagagacattaggtgtcatcaagaatataaacaagtgtaagatggagttcctgcccataataggatggctgtcaggggatagatgtttccatgtctgcccaggtggtggaatagaatgtagtactgttatattgtcctgagatatttgctattatgaggtaggcgagtattcaagtgcctgtggtttacataacagctgtgcctactctgttagtgttctgctttatggcctcattatctgaaatgccagattttctgtacgctaatttagtcaaaaattagcaagcgtttatgttcaaatatatattatctaaagcctcagagcaccaaatcacatttaagcagctagacatattaagtagcattaatgtaacatttttgaaagagcagacaatttaaagaaagacttaaagaaatagaaaaacatgggcacaattaagtactttattcagtaatctctggttacttgtttctctatccaacccttgtggtttttttgttttgtttttttttttatcaaacttgaacacactttaaaaaaatcattctgaaactggaaaccatcattctcagcaaagtaacacaagaagagaaaaccaaacaccgcatgttctcactcataagtgggaattgaacaatgagaacacatggacacagggaggggaacatcacacactggggcctgttgtggggtagggggctgagggagggatagcattaggagaaatacctaatataaatgacgggttggtgggtgcagcaaaccaacatggcacatgtatacctatgtaacaaacctgcacgttgtgcacacgtaccccagaactgaaagtataacaataaaaaataagagctattatgaaagaagaattaacagaatgaatggataatccaaacaagtggtaagagaaagaatcaatgatgacaaatgttctgaactctgtaggcaactgcattgtgctatcttgatactttgttgacttagtaaaactggaactataaaaaaaaatcattcaaaataggtaagaatagaaggaaggcattttagtggatttatcagtgaccttgcccaccgaagatactctgagtacaatcagcaaacctaccatagtaataagggcaaaataaaataggataatccacagagatggaaagtctgtgccctcagagttggacaatagccctcatcaattttcatttcccatcaagtttctgtgttgggcactgtgaaaagttagagttccacagtttctgtcttgaggaactcaaaatctaattttaaaaaatgcatcaaacatgttctaaccctctaagaaattctgtgacaagaaaagaggcataatgtttgctcctttaggattttcaaggggcatttctagtgaaagctacatcatctggcaattcagttaatatgcagtgatgcagtgaccttcacagtaagttccttctttctcttcttgccagagatgatgaccaattatagcagctgcaaatgcaagcagaaggaaaaggtgggagagcttaaatagatgctttttcacactctagcttcttaacaaggatgaaagattcttaggcaaatgaaaaaaaaaatagtgaggaagaaagccaggaaaatgcagaaaaattaatgtcatgaagtgggcaagtggaggaatgtgaagcagcagagaaataaaggatagtcttgccctttggatcttgcatgacacgtttcccgttggggtggattcagaactttccctccctggagcactagggagaagttactggtatgagctgatgggagaccatctggtgatcacactgaggatgaaaaaagatgttatatcttgtggataacttccagtcaggggttttgaaggtcactttatgtggatatgatgtagaaaattgggagagggcaggagccaatatccaagatattatagagagcctaccatgaaccttttattaaccccatgaactgtcacccacatttgctgcttcctttggggaacaaatggcacattcagaagaaattggggttttattcctaatgacataagttctgagtaacaaactgaaagatttgaaagcacaggtggtgtttttatctctcgttccatgtgatggcagtaactacagcaaagaagggaagctttgagaaacatgcatgcctatgtagatggtatttaaaaagttttctggactgtgttctacagagccaggatgacgggcttctggcaagggatggagtgcatcttgtaaggactgggaaggatatacattggcagaaaccttgatgatctatatagaaagatttaaatgaattttaaagttgagggagaaaattaacccagtgaagccaaaatcagatatatcaggctttacataggtgacatagaaaaagagtgttataaataaaatgtgcttagataaccttaggtttcaaaaaataccaagaatacaggttgcaaacaatatttttaggcttctttataaataaaccaacaaaaggcatgtgtaacaagtagtgcacttaaacttttaacacaagaagataaatataataggtagtcctgagacctcaggatattgagctcataactagaaaatggcaatagaagaggattctttgttgaaaggacttgttctaatgggaagagtgacagtgtatcaggatgcttcacatctatatgaaatctacaaacctgagggtagaaccttatgcagaaacaaaatgaagataagaggaacacagaaatgagccatcatgttagtggagaggaccatagtctgctccatcaaatggaagatatggaaaatgctgttctgagattatttcaattctggtcaaggaaaactatggtcatagtgggagtcctcaagctccctggaatctcctggaaaaatctgtgatactgtaaatgaaatcagttaagtaggttagagcaaagggttctatgtggtagaatgtgaatcattgtagaaaagttcaaaaagtgtagtttgtgtataaactcccaagaactttgacctgtagatgcaaggatatagactttattcttagagcagagaggaatgttaaaggcttttgagtgataatataaattaaaatataatatctaaaccagagaaataataattatactgtcactgtttagatcacatgtggaaaattgcgcctaattctggaaaatatatttttaaaaagatattgacaaaatacaccacaattgttggaaggctaccatgattgtgaagttgaagtaactggatatgttttgttttaagtaaagaatgttttatggaaggcaggggtgatgagtttgatagttgaaggcttcccatagatgaaataagaataaaaggtatagtgaagccaattttagcttaattcaggtgtaacttctaaccatgggttgcatttttatgagctgtccaaaacagagtgaagtgccttgtgatgtagtgtgcttcgtcccactggaggttttccgatacaggcaaccttttttccttaggattaaacaccctcaactctctcccatcttttttttttttttttttttttttgagacagagtctcgctctgtcacccaggctggagtgtggtggtacaaccttggctcactgcaatctctgccccccagattcaagcgattctcctgcctcagccctccaagtagctgggatcaaaagcatgagccactacaccctgctaattttatattttcagtagagatggggtttcaccatgttggccaggctggtctcgaactcctgacctcaaatgatccacctgccttggcctcccaaagtgctgggattacaggcgtgagccaccgcgcccagcctctcccatcttaaaaacaaattaatacaaatacaagccaccaagaacagcttctctgaactctactttcccctctgtttctccttccctttgtagtccaagttcttgatagaggagtttatatttgctgcctctacttccttacctcctccattcccctcgacccctgccattggcttttgttctctctggcccactgaggttaatcttaccagggactccaacaggagtctctggtttttatttgctaactgtattatttattgctaaatccaaaagacactgaacagattgttctcttttttttttctttttctttttctttttttttttttttgagacagagtttctctcttgtcacccaggctggagtgcaatggcgcgatttcggctcactgcaacctctgcctcccgggttcaagtgattctcctgcctcaacctcctgagtagctgggattacaggtgcccgccaccacactcagctaatttttgtatttttagtagaggcagagttttgccatgttagccaggctggtcttgaactcctgacctcaggtgattgcccaccttggcctcccaaaatgctaggatttacaggtgtgcgccaccgcacctggccacttaacaggtcttaattgactgttctgaagcatttaatcctgtcacccacttctgccttttaaagccctctttttccaagccttccttgacatcgtgctctgttggtttccttatgactttctggctggtcctgattaaactcttttcccttttccccaggatttgttcctcagatcttctcttctcactttacacaaactccctgaacaatttagactctctctcagtctcaacagccacgcctactctcatggcttccaaatccatgtctcatctctggtttcacccctgggttcgatatttataaacccattggctctgtggacacctctattgcaattttcagagggttcctaaactccgtgtgtccaaagtttattatatcacctcccaccccttccggtgtgctcttattcctgcattcgttataccagtgaaggccaccaaccacccacttgcttgagccagaaacttgggagtcattcttgattcttctcttgctcttcctcatcattgagtctattgcaatattgcaaagtcttattgattctgcctctttcgtgtgtttctttccttccatccccattgccactgccttagatcagagcctcattatctcttgcttggaatactgcaatatccttctgttttccctgactccagtcattgtcttaaatctatcctcacgctgccacaacagtggcttccctcaaatgcaatctcatcatcatgatctccaatggttatggaacctatagatggctccccatcaggataaagttcaaactcttgataatataaaccctttatgacctgcccattactttgtttggctttaccttttacccctcctgtgttccctctatcccatcttgtattcctgttgtcctggagttttcctgagcatgccatgctctcaagtctcaatgctgtctccttaatccttctcactcctttaactgaccagctcctatcaccttcaaacacttgtctcaagtatacctcctctaggaagccctcagtagcctccttggtttggattggatgccccttttctagtcacctagttactctggtcatatctctattatggtagttagcacagtgccataatcagttttttgctatcctcactatctggctggactgtgaccttcctcagggcagtaattttgtctcagtctttttaaaccaatgcctagcacagtggtgaccctgacatgcaatggatacttgaaagataaacgaatgagtgctatggaacgaatgcctttgttgggcggatatcaggccagatgatctctgaggtccctctcaactctaagaatgataagagaggtagatcagatgaatatttataagaacacaggctccagaaccacataacctggaacataactgagtactctcctgatagaattagcaagactgccctgtgctgggggtcaccctgattagccccagcccagggtctggcactttagaggaagcatcttttgagtcaaattttgagtgagttctttggactcttttgtattttctttaattaaagaaagctaaaaaaaaattcagatgaagctataggaaaccactcttgacaagaagaaatggcagtcctttctgtgtccattttcccagccccactaattttccatgatttatccagctgggatcattatcatcacactgagcctgactatcagaggaggctttaaccttctcactccgttagctgaaatggaaggaagtctttttttttctttttaaaaactcgctgttattacagataagattggccttttccaaagagatccgaaaggcaacaacaaaacaaaaattagacagaagtggtatactgtatgttgactttgtattcagcatactgattttgagtccaagacaactcttctagtcacagactgcttttgattcaatatagtatgttcactggttgccatttttttccttcccctttttgagaaggaaatggccttaataacaacaacaataataacacctactgagtactttctgtgtgctggacactgtttgaattatttttcttatgttaacttatttatttctcacaacatcccatgagttattaatatatatttctaattctcatttatagatagggaatttgaggcacagagactaaatgagtagctcaagttgatagacctagtgaatggtggagctcatattcaagccctagtagtctagctccagagtccaggctgtcaaccaccctgctgtggagtctcttgattcaaaagaacctcggatgtctctgggatcaggcctggtggggatcaggcctcatttccatcccagagccagttcctagccctctttccatgtgtggatctgggtcatccctcagacagctagctgcacattagcactgtggctgtaggacccctaagtgatactttttccctccttgcctctaagattttcatcagactatcatgaagggtcaccttcatggtcctccttgacatctttttaacccaaaaggtgtctatgcagcctcaggctgcatatgactgacttttgcccttctctgcctgtcctctggtgtatctgaagcacatgtaagaatgattggtgacagctggctctgctctttgctgaagcttggcctatttaacaattgatttggccggtatctggcctgagtcttcatttctatgttctagcacaaaatggtggactatacttggcccagaccagatagttatttcatccctttccttttaccttttgctgaaattaagctatcactaatgaaatgtcctagctttcaaaaatctacccccctagtagtcccctatctccatatgagatgtcccctttagttctgatttcccctctgctgggacatatgatatagtgaagaaaagcatagcatttggggtcaatctgttttttccacttttggccctggaccttgtgaaaatcacttaagttctctgagccccagagttcttctctctaaaatgagagtgacacctaccctgaagagtgatgtggagattagaaataatatatggaaagtacctaatcaagaatttgattctcaggagatgctccataaatggcggtctctgtggcagcaaatggtgatcatgttggtgctggtggctggtaatagaatatatttaagcttcactcccttccaggcaacgctgttaagtcccatgctgtcatctctcaagattcagcatggtgtggtctacttagctatgtgggaaagagtaggcctgtgctttgagatggccaggtgccaagaggacagatcagctgcaggtactgacaaacatcatcaagcgttaagtgttatggaagagatgggtgccttatttgaccagtcaaacaaggaaagccaatagagtaatggtatatcctgcctaggggcagggaacacccagcagctgggcatccaggagccagtggtgttcagcgacccaaggtggaggctggacagtttgcacctgggaggctcttaacaggtttccgggctgtagctgctgggctgcaattcagaggcaggattcttggggtacctggtaaggtaatggctggctcttaggaacaggacaaaattgtggttatggaaactgagtaccaggggaaggctgggttggctgccggtggaatctgatatggaggacaagtctgtcagggagatgtgcgattccatttggtgtatgtcactgggctggagctgagcctgccatggggccccagaaaagggagaaagaagtagagagacactatgagacaagtgagaacagactctcccttctaaagaattctctgcctagtggccctcctcagaaagagtggaatcactcaagtttcacaaatgtgacaacatattttaccttgcacagtgagagtaacacaccaataggaagaataaagttaatgtctctcagagagcattggcatggtttagaaaggaagcaaggaaagctattccagaggaaagctttcttgtctgcccagtattgattctgaaagcaaaccatttattaccatgtcttccaataattaatctcaacacaagtcaacttgcccagattaagagaagcagaatcaacttcctttctcttctccctttcttttgtttctgtgacaccgtgagcagggtgggcctcaggaatgtgcttgctgctggggaagccagcatttgtctacgctgaaagaagagggagcatgtgatgaatttgcatataggaggaatgtatgcaaatttcacaagactattttgccttcacgaaaagatttgaaaaagtatttgtaaggttttaaacctatgctataaagacaaacatacaagaataactgataataactatcatttattgaaggcacgcttttacaaggaatacctcacttaatctttgaaacagctctatagatttactgttaatattttccagatgaggaatcaggcttagagaggatcattcaagtggaggtggcaagatgtgaacccaggtaggctgacctcagagcctgcacttctagcacacacacaagaggaattaaaaaaactggggttagtcaaccttccttctgatttttttctaaaggaagtttctactttatttatctttttatgtttaattacaaagttacatatttttcaatgtaaaacatacagacaagcaaaaagaaacagaaataatccacccacttggttgtctaactaacagttgctaatactttctgtttattctcccagttattcctctgtttatgtgtatataggtacatttagtaaccagtttttctcatttaatgatatagccatggtaatagatgcatatctacaatgttatttttctttgctagtggcatttttaatattaaaactttatattcttttccagattctagtaacttacaggctattaaaaccaggtacagttataagtgtgtaaagagaagcaacattagcattgaagacagagggctgggtctaagccaagcattcggaatttcttcccaagagaaagcttcagagaatggcaatttacaagaaccctcccaagcctttccagttcctcattgtaggtgtgcatatattacagggctatgaggaccttctgagtccataaaaccggctggggtggggagtagtgatggtggcagcagtgggggtggggagtagtgatggtggcagcagtgggggtggggagtagtgatggtggcagcagcggtggtggggagagcttcagaacagtaacatttgtagcctctttcttcctccttctcctcttcctcttcctccttcatcccttcctgctggtccaggtgtgatttgaggtgggcaatgctttccagcccccctgagacctccatgaggcaagtacttcctggccgtggcattcagggtaatgggggcaaatcaggttgtgggggctgatgggtaagagatttgagaacatgtgggtagctgaggcagctggtgcaggcaatgaggaaaggaaccagcatcaaagagccctgaggaaaagggcttcaggcagtatattaagcaaaccaaaaaataaacacacatcaccaacaagagcaacccaccaggcagatctgtcttttttctctgccaatgagcaactggaggcattttcataaaccaattttgttcagaataaatttttaacaggagaaaagcccactctcaagttgtgacaggaacagatcattacatctgagttattccacctggaaatgtagccaggtttgagacagagggagctgagatcttatggcctcctgcagataccaggggacatccaagcctcatcaggattggtgcctttatttgtcttgggatgcacaaggcatatgcccagctagcccaaggtactgccctttggatttaaatagagattggtgcagctgtcctgctgcaatctaggagccaacaaaacaaatactggcaacttcagctataattacatatctccatggtgtttcacaccatgggctattttgcacaatatatctgagcctcggcaatgccaaatatggattgaaatagctccggtggactttggctcatcacctgcctagaattttaaaatatcaccaagggaaggaagccatggaagaggctaaaatgggaactccaaatccatatgatggacatgtttcatttttctttttctttaggaggctttgacctatggactctttagtgtcttgggaattcccaaggtcagtttcatttgcttaaaaaaatacagctaagagaataggattatttggatgtagatcttgagtctgattcatccgctgtagctgtcactctgatgaaactttgcaagtttataaagttagaaaggttcaaggtttggatatcccagttactctgatttgatcattgtatattacatacaggtatcaaaatatcacattactctaaaaatatgtacaactattatataaaataaattttaaaaaaattatagtataaagtttgggatttactccaagaaactacattttatcatgacttcagggtgccagatgacctggactaaggataatttcctagattttccctttcttcactctatgcctcacacaaagatcacttgaaaaattagtgccacaatctccccatcaacaaaatgggagttgcagattcttcctgcatttcttccttgtgggaagcaacaagatccagtgagaagtatacagggattataatatttggatgggaggccagagctaccccacctatatgtacagctcccctaaccttgccaagcctcagtttctatgtctacaaaatgggaatgatatctattccatttcagttgaagtaggcatgcagtaagataatgtacttaaaagtactttaagtctagagcacagagcaaatgtaaattgccatcattatttttcaggggatatggtgacagtggatgagatcatgtctggaacacacccagaaaagaagaaagatatagaagagattgatgatattgccccatcccaggagtttcccaagagagggaatgtgctgaccagtctctgagtttaactgaactcttgatgccctgggcttctttcactgtttgagggccagattcccatgtgtagcaggattagccaggaaactttccacattctaaagctaaagctaatgatttaatgagcaaaatctctccctgttctgatgtttatttatataagtttaggtcagtaggactttggggcaaaagcagttgtaagtggaaacagcatgatgctttgcatttagagttctccatcagtttcttttccctgcccttctaatcagagaaaaatgggcagccctgcccagtgacctctcaacagcaagcagtgttgccccacttcaagacagcaagggagtgctacagtgcttcttatatctacgttttgggggttctgtgaacttatttatgcctaggtagatcctgcctccaagccagcttgttcttgtttcattatgtcaccatccacattaacaccactgcttaattttctttttctcatatggagggtggattcatatggaattacttatggttcttgcctaggcttttgtgactgtgaggattatggtatagtctgtggtcatggaagatagctcttggcctgtgaatgtcaggaacagtcaagagtttcagaaaattagctgaatgatgggatgggagcctgaacctcatgacccttccctgtctcatggtccaatcttcagctatttggattctgccctttccctgaagagctttatgtggggagactttgatctcctgcagcttctctgctctgaggaaatgttgcaatggctatgtcttttcagttaatctcctaaggaaaggaagtgggaagaacatgttcctgctttgaaagtggggagccagaggtcccagatggccctgggttttggccgacagtgcatggtgaacagtccttagtggctatgtggtgtctcttttgtcctaaagcaaatctcccaatccagccctgtttgagaagtgtgtgcagatggccttgtcattagcataggtctccttcctcttgtctttctctcctctgactccctcccaccagctttccacaccagacagccactcattagggcttatcccacagtgaggactgcagctggggtctctgactctcaaaccgtgcttctctgaggacagctgttctgcctggagagctgttagacacttctgctgtgctcccacagtgagctttccaaatctgtactattgcccctgccattccctttcctagtagactactctttggcttcacattctaggcttttaagttggctcaaaaagtcacttcctgaaaatttctccagccttatccctcctgccctggtcactcctttaccaagtatgacctcagcattatattgctaatttgtgctactgtcacccttcatttctttcatgtccttggggtctatataacttaattgtgtagagaaccaagacttaaccctaggcacctcaaggagaaacttgtcaatttttgtttttattgatgatgaactctgaaatacagtttatgtttttccatgccttatatactgagcattctgaacataattcacccctttaaaaatgaaggggggtacctatggcaatgtccacaaatcccagtcatgagcagagacaccctgagagccactgcagaagctaagtttgtctatttctactcactgttgtgtctctcccaacactacagtatggttctagggctagtctgcattccacggggcctaatcagctactatacagtctctagagcagccgtgtgcctgacacctacatttctgctggatgatgatgatgattttaacagtgtacctgaggaaggtgagataaaagtggacttggctttctaaagccatgctgatagcccaatcctagagtgaaccaatgagactagacaagagaggatgattcttctagatctgagtgttacctgttatccctttcactttgcattactccatgtttgtgttgctaattctcatttaaaaggcctaagcatttaaatctatattagcttgtcagtttcacacatggaggaacccaaggtccagactccctgcctgtcattctgtgctgctgttagttctatgccatgacactaaggcttttgacatttatatgatggtgatagggaaggctttcaaccaaaacttacagtgccacttcagacataggctctaggggtgtgatcagagcacctgcttcacttttaagtactttcaaatttgacatgtttcttacttctgatggctgaggaaaacaattcagggttatgaataactaatgctggcattgtgcctagggagaataatttctaggacttcataggtgatcatttttagtgagttttttttgcatatgtgtgtcataccaacatcatgtttcttctaagctatgataagcaatgtcataaagtccaaactgtgaaaggtgtaatgtctgatggggctacagagacattttatatgttttgtgattgtatattttattgtatttctttttttttttaatttatttttttattgataattcttgggtgtttctcacagagggggatttgccagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgctttcaagcatctgtttaacaaagcacatcttgcaccacccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctacttctttctacacagacacggcaaccatccgatttctcaatcttttccccacctttcccccctttctattccacaaaaccgccattgtcatcctggcccgttctcaatgagctgttgggcacacctcccagacggggtggtggccgggcagaggggctcttcacttcccagtaagggccgccgggcagaggcgcccctcacctcccggacggggtggctggctgggcgggggtctgacccccccacctccctcccggacggggcggctggccgggcggggggctgacccccccacctccctcccggatggggtggctggccgggcagaggggctcctcacttcccagtaggggtggccaggcagaggcgcccctcacctcccggacggggcggctggccgggttggggggctgaccgcccccacctccctcccggacggggcggctggccgggcggggggctgacccccccacctccctcccggatggggtggctggccgggctgaggggctcctcacttcccagtaggggcggccgggcagaggcgcccctcacctcccggacggggcggctggccgggtgggggtctgacccccccacctccctcccggacggggcggctggccgggcggggggctgacccccccacttccctcccggacggggtggctggccgggcggggggctgacccccccacctccctcccggacggggcggctggccgggcagaggggctcctcacttcccagtaggggcggccgggcagaggcgcccctcacctcccggacggggcggctggccgggcggagggctgacccccccacctccctcccggacggggcggctggccaggcggggggctgacccccccacctccctcccggacggggcagctggccgggcgggggggctgacccccccacctccctcccggacggggcggctggccgggcagaggggctcctcacttcccagtaggggtggccaggcagaggcgcccctcacctcccggacggggcggctggccgggttggggggctgaccgcccccacctccctcccggacggggtggctggccgggcggggggctgacccccccacctccctcccggatggggtggctggccgggctgaggggctcctcacttcccagtaggggcggccgggcagaggcgcccctcacctcccggacggggcggctggccgggtgggggtctgacccccccacctccctcccggacggggcggctggccgggcggggggctgacccccccacttccctcccggacggggtggctggccgggcggggggctgacccccccacctccctcccggacggggcggctggccgggcagaggggctcctcacttcccagtaggggcggccgggcagaggcgcccctcacctcccggacggggcggctggccgggcggagggctgacccccccacctccctcccggacggggcggctggccaggcggggggctgacccccccacctccctcccggacggggcagctggccaggcggggggctgaccccccccacctccctcccggacagcacggctggccgggcggggggctgaccccccacacctccctcccggacagcacggctggccaggcggggggctgacccccccacctccctcccggacggggcggctgccgggcggagacgctcctcacttcccagatggggtggctgccgggcggaggggctcctcatttctcagacggggcggccgggcagagacgctcctcacctcccagacggggtcgcggccgggcagaggcgctcctcacatcccagatggggcggcggggcagaggcgctccgcacatctcagacgatgggcggccgggcagagacgctcctcacttcctagatgtgatggtggctgggaagaggcactcctcacttcctagatgggatggcggccgggcggagacgctcctcactttccagactgggcagccaggcagaggggctcctcacatcccagacgatgggcggccaggcagagacactcctcacttcccagacggggtggcggccgggcagaggctgcaatctcggcactttgggaagccaaggcaggcggctgggaggtgtaggttgtagtgagccgagatcacgccactgcactccagcctgggcaccattgagcactgagtgaacgagactccgtctgcaatcccggcacctcgggaggccgaggctggcggatcactcgcggttaggggctggagaccggccggccaacacagcgaaaccccatctccaccaaaaccagtcaggcgtggtggcgcgtgcctgcaatcgcaggcactcggcaggctgaggcaggagaatcaggcagggaggttgcagtgagccgagatggcagcagtacagtccagcttcggctccgcatgagagggagaccgtggaaagagagggagaccgtggggagagggagagggagagggagaggacactcttttgtcctttgccttacaccaatctattttattgtatttctccaagcattcgtgtcttcaggctctacataactagaaaatgcattcatctttaagataaatatatttgtaatgaaatttatttgtatttctaaatgcactcacatttttacctgtcaattgacaaaactatattgaatccttatctttcccttttaaaatttctttggtgtttttcaaattttggagaaagtcttgtttattgtaataacaagtggaacattgcaaagatgtgtaaagagctaattattcctccactcccactttccaatttcagactcccaaggtaatcagttatcttgcacatctttctctttttcttttaaatttcttattttttaatcaacagaaacatgtatgtatgtatttactatgtacaacatgttgttttgaaatatatatacattgaagaataatgtatagctaattaagagatgcatcacctcacatagttatcatttttgtggtgagggaactttatatttactcccttaggattttttaagaatacatatattgttaactatagatgctatgttgtacaatagatctcttgaacatgttcttctatctaattgaaattttgtatcttttggccaacatctccccaactcccccgcctcaagaccccccacctcaccacccccaattatcccagcccctggtaaccaccttactctctgcttctgtgagatcaacttttttagattccacatataagtgagatcatgcagtatttatcttgctgtgcctggcatatcccgcttagcataacatattctaggtccattcatgttgtcaaaaatgacaggatctccttttttattgctgaatagtactccattttattgtattttattgctgaatagtattccattgtctatatatgacagcactttgaaaagtttatggaaaatggaattaaaaataaaaaaatatataaacgttatttgtcaacataagttccatcaagttcaagacacctttgtaagtgatgctaccagccatttagtccatccctaaagaaccaaaggtcctgggaatttaaccaggtcaatgtatgttcttaactcaagaaaaatggatgccctttaagattttttttatgatcaggatacaaaaaagataccagaaggacccaaatcaggactgtaacgtggatatctaatgatttcccatcaaaattctcaaaaaaaaaataaccgtatttagctgagagaaatgagcaggagcatagttttaggggagaaggactgtctggtgaagcttcttgggcattttcatgctaaagctttgggtaattttttcaaaacactctcatagtaaacaaatattatcattctttggccatccggaaagccaacaagtgaaatgccttgagcatcccaagaaaccgttgctatggtctttgctcttgaccagtctgcttttgctttgacaggctcccacttccacctcttggtagccattgctttgattgtgtttgtcttcaggatcatactggtaaagctatgtttcatttcttttacaattcttcaaagaaatacttcaggatcttgatcacacttgtttaaaatctccattaaaaactctactcttgtctgcacctgatctgggtgcaatcattttggcacccattgagtggaaaatttgctctactttaatttttcagtcagaattgtgtaagctgatcaaactgagatgtctatggtgttggctattatttctgctgttaatcataggcatgaacgagattaatttttttcacacattgatgtggatggtctgctgctgcgggcttcatcttcaaaattatttcactccttcttaaaatgagttagctatttataaactgccaattcctttagggcattgtccccataaactttttataaagcataaataatttcaccattcttccacccaagcttcaccataaatttgatgtttgtccttgcttcaattttagcagaattcatgttgctctgattggggctgtttgaaactgatgtcttatccttcttagtacctcaaactacttcctgttcaggtatgttatgacaagttagtatgagtttattttggtgtaaaaaagttgaaatccatgcatagtttccttttaagtactacacatttcctatgaactttttgaagaccctttgtcctcttcatccatttattcactgatgggcacgaaggttgagttcatatcttgaaggttgagttcatatctcgactactgtgaatagtgctgcagtaaacatgagagtgaagacatatcttcaacatagtgatttcatttcctttggatatatatccagtaacagaattgctgggttgtatggtaattgtatttttatttttttcaggaaactccatactgttttccatgatggctatactaatttaccttcctaccaatagtcttacacacctttcttcttacaaaaataaggaaacatttgcaaaacaaatgtttctgcttactttttggaataatttctttaaaaaattttttactatgtttaaattttttgtgggtacatattggtgtatatatttatgatgtacatgagatgttttgatacaggcatgcaatgtgaaataaacacaacatggagaatggggtgtccatcccctcaagcatttagcctctaagttacaatctaattaaattctttaagttgttttaagatatacaataaagttattactgactatagtcatcctattgtgctatcaaatagtaggtctttttcattctttctattttttgtagctcttaaccattcctaccttacccccaactccctactacccttcccagcttctaaaaaccttccatctactctctatgtccctgagttctattgatttgatttttagatcccacaaataagtgagaacatgagatgtttgtctttctgtgcctggcttatttcacttaacataatgacctccagttccatccacgtttttgcaaatgactggatctcattcttttttatggctgaatactactctattgtacatatgtaccacattttcttcattggagtaatttctaaacaatgccctgcatataatttttatatttaagtgattttttccattttttctaattatgaaactaatacatattcaccatggaataattaggaagcaaggaaatagtggaaaagaaaatttatctctatcactgagacataatcattattaatatttattgataaatttccatttagcacagcagaatactaagattgttttgcccaggatcaaacaaatgtgaattccagatcaacatcaactatttatgtgagcttcttttacatttttaatcctcagttttcttatctataatataatagcataatcattatcattatcagtagtaagtttttttggtaataaaattagaaccatactttggtttattctgacttcttcatttaacattacattaagaacttttttattatttatttttttatttattatttatttttcattaaatattcttcaaaaacataattgtagtgagtgggtaatactctatcacgtgttatcacagtgtagtgaactattctgtattgttgagcattttggtcatttctggttttcatttctataacccacagttactatttttaaactgccaaacaaagtgttaaatagatcactgtcctaagttctgagcaatttcaaggcaaaagactagatttctctcatgttggaatttcagcccaggctttgagcccttcccttggatgagcggtttcaatggtagatgagtggctacaattagagtcacctgggagcttttaaaacatgtggctgccagacattcccgcaactccctcccccagcccatcctaatttacataacctggagcagagcctgggccctgcattgtccctccaagctcctttctttatccctcataccccttggccctcaaccccctaacctcctccccctgtcctgtgagaaccacggattagaggattccttaaggtttctgccatctgaaggattatcagaaaaatactgtaaactgggaaggttgtatgatctttctcaatacagcttcctctatggtcttatggtctaaaatggtggttctcaactggaaggcaatttttgtctccccccgacttctaccccacctggacatctgacagtagctggggacatttttgattattacatctggggaagaggttgctattggcatcctgtgggtagattccagggatgctgctaagcattctacagtgcacaggacagcccgtgtttgtttcccgtggctactgtaacaaagtaccacaatccgcacagattaaaacagcagaaatttatcgtctcacagttctggaggctagaagtctgagattgcagtgttagcagggttgttccttctgagggctgtgagggagaatctgttccaggcctctctcttagcttccagtgacttgctagtggctttgctgtttcctggcatgtggctgcaccactccaacctcagctttcatgttgctctccctgtatgtctgtatcttcatttggacatctttctatatgaatgaacaccagtcataccacactatgggcctaccttatttcggtatgatctcatcttaactaattatatctgcaacaacgttatttccaaataaggtcacattctaaggtactggggttagagctacagcatatctttttgcagggacagaattcaacccacaagagccccacaagcaaagaattatccagtgcaaaatgtgaatggtgttactgttgagaaactctgttccacataatctgtggaccaagcccagggaggttaactaaggtaaaacccagggcaagtagcagtatggtctgaatgtctgtgtttcctccaaatgtatatattgaaacctaattcccaatgtggttgtattatgaggcaggaactttgggaggtgatcagtgcccttttaaagaggttctagaaagctagctagttccttctaccatataaagacacagtgagaagatcatctgtgaaccaggaattgaagccctcaccagatactgaatctgtgggtaccttgatcttggacttctcagcctctagaactgtaagaaataaacttctgttatgtataagccacccattgtaaagcatttgttatagcagcatgaatggtctaaggtaaaaagagtccagagtctgggaaggtggaaagggagcaggagcatcgtctttaagagggtcaggtacctttgctcttatatcagaggctgtgggcttcctacagatgtatataggcataacctcaggcaacagagatatatgtgaccaaaacagggtgaaaggacttgaaagagcactatgctaacagggatagaagcagaagtgtggccaaaccctctgatttggtcacctcaccatctgacccacctttccacgtcaggaacagccttttcctcttttcctccgttaggaatggaacaggagagaaaaataaatccacaagccccacagttttcagcagtattttcaagccaactgtcttgtctctccaaagcccagtcttctctctctgacacccactccctcccactgccagccaaacatagaatacagaaaacaggaaaaacagcaacactgcaaagttacatcttttgagagagaacattgctgtgggtacatttccccccatacctcttgaattgccaaaccttgcagcaggcagccttattctgttccatggggatgctgtctcaccaactgcttgtttctttggcttcaggaattccatgcaagaatgaatttctgccgagatggggtcactgggcagtctatgtatccacatctgtatatttaagtctatcttcttcacttttaaaatatttttgtccacatttttatgttgtggctacatgttccccttcattgttttgccatttccaatagagagagggaaatgagggaagggagagggtgaccagaggagtggagattatgttatcaaattccaggagagatgggttgcttccgagcagcaatatgaatacccgctggctatatccggggcctgctcagtgggaaaaggaggaagccttcctccagtcttcagagctccgtgtctgcatagcgcacgcctcattttggtctcctaattgctcagctatctttgctgtctattgttccctctggtttgtctcaggaagcagctctgggccaacctctggcctctagtccccttgctctctgcaccatcttctttgtgtcccattctaagtgctagtcctggctcccctaggcccagcttacagccctgactctgccttccacagctccccattccttggtgggctaggtggggagaggtcagggacagaatctttccctgctatatgtctcaggccccagagggtggccatgttttctggaatctggactgtatttttcttacagtctggacctggtgttatctgtcaaattataccttgtaactagtattggcaacctctaggattgactttgccttttaatccacaaacaaggtattttattgttgttgttattgcatggataaaatgttaacagttaattatttcttttgctttcctgcctcagagtgaccagatatttagcttctagtttatagtcaggagggaatattttgaaggtcctttaaagcaataatatgtaaatgaagagagttattgagaaagaaagaaaagggatcagtgaaagagagcaccccagcaaagaacaactactataattttctcagaatttctaggcccatgtaccttcctaaacacacacggttggactgtaggaaaataaaactttactttaaaaaaaatgtggagttctaaaaatatgccttttataggaaaaggtgctaaagcattttagatataaagaaaaatagtctccagcaagtagagatgtgtgagaatggacagggtgattattacgtatgtaaatgtgataaagttggtgtttaagtcctcagagatagtctcagtaccgaaactacttgtgttgggaggtattggcacctgcaatagttatttttagtatcagtcccaattagtaactgaagatttatatacatagtcttcaactttaaggtgcatctctttagggtactccttagacacttcttatttggacataaagttgttctaatggagggaacttacttgttcccttattcagggcacctaagaagatattgttctttcagcagttgtaatgtggtgggtcaaaccatcactggtacccagaagtaatttcctctgtttcttcttacttctttccaccaaagaccactttgccattcccagaattcatccccttccccactacaagagccaacagatggaggagaaatatattcctggagttctaggatgaaaactgaaaagcatttttctatatcaccctccttaatcatagacaatgtgctatgtcagtactatattttaaacctattatgtgctcaactgaattgctttattttatcctgggatcctaaccttcatttacatggcaaacacattctgagtgctaaatggaactgggaaatgtgacaccttactgctgacaagctgctgaactgcagagtttttgggttgagtgactattgaaaggagagcactatgcccactaggtacatcgaggaatagttgagatagaaaagatgagtaagatggactctttcctttaaagtgaatacaattctccttagaagacaacatgcacacaaaaggagtgtattgcaaaagaaaaaaaaaggctgttgcacgtgcacaattacaatgtcataatttaaaaaccaaaggcccaagaatgaatgtaattcaaagtaataaagaagcagaagagctggagattttatagtgagttttggagaagtacatgtttcagtgaaaagtactggaagttatagttagagagactcggcttgccattttctagttataaaacattgtttaaacaagttattttacgtctctgagcctcagttttctcatttgtaaaatgaaattaataatacctatcttatgattgatcccaatgcttacagataatgtcgataaagaacctaacacaatgcatagcatactatggacacctggttaactgatgccaccttctttgacctatgggttatttagatatgtgttatttagtttccaataatttgtgagtattctggtaatatttctgttactgatttctaatttaattacattatagtcagagaaaatatgttgtatgacttgcatctctttaactttgttgagactcattctatggctgagaatatggtttatcttggtaaatattctgtgagcacttgaaaagaatatgcgttcagctgttggggtgggggtggagtgtcctacaaatgtcagaccacgttggttgagagtgttcaaatctatatccttacaaatttcctgtctacttgttctattaattactgagagggggcatagaatctctgactataattatggatttctctatttctccttgtgggtttaatcagtctttacatagtttgaacttttgttgatagaagcataactgtttagggttattacatcctcttgatgaattgaccccttgatcattatcaaatgataatattattcattttttcctggtaatgttattcactctgcaatctactacgtctgatattaatatagccacccagctttttttctggctagtgttatcatgctgtatctttttctgtccttttactcttaccctacttgtgtctttgtacttatagtgcattccctgtagacagcatataattgggacttgcttttttatctaatctgacaatctctgccttttgattgtgttatttagacaatttatatttaatgtgattgctgatatgtttagatttaaatctatcaccttgtttttttcttttctatttgtttcatctgttgcttttcctccctttttttgcttttttggattaatttaatatttttatgatcccatttgacttcctttgttggctgatcaactataactctttattattttaatggttgccttagggtttatagtattttaacttatcacagtttaccttcaagtggtattataccactttacataaagtataggaaccttacaatagtatacttccatccctcccttcctggtctttgtgctgttgtcatataccttacttatatatgtaccataaatcccacactacattgttatcattagtttttaaacaatcaattatttttaaatagattcaaataataagaggaaaaaaaccttatttacccttgtagtatttccagtgctcttgattcctgtgtatggatctgtatttccatctgataccattttctttcttcctgaaggacttcttttaacatttcttgtcttgcaaatctgctagtgaagaattctttcatctttgtatatctgaaaaagtctttatttcacttttgtttttgaaaatacttgtgctgggcacagaattcccaggttttgtttttttttttatttgttttgttttgtttcttttagtactttaaagatgttgctccactgtctgcttgcactgtttccaataacaagtctgctatcatccttatctttgttcctctgtatatagcttgtctttttttcctctgtctactttaaagattttcttttctttcccttttttgccactttattttatttttatgttccttggtgtagttttctttgtgtttcttgtgttgagggtttgttgggtttcttggatttatagtttttgttatatttgaaaacttcttggtcattatatctttaggtatcttttccaataccctcctcttctcctagggaatctcaattacatggatattggcctgtctgaagttatcccatagctcacagatgctttatttttaaaattaattttttctctcagtattttagtttaaatacttactattgcagttttcaagttcagtcattttatcttctgcaaagcctaacctactgttaatacagtctaatgtttttcatctttaaaagtacaagggattttttaaaaatttttttatttcttaactatctgaacatatggaatacaattataataaccattttaaaatacttgtctgctaatcttaacatctatttcagctctgggtcagttttcattgattgatttttctccttctcataggtgagattttcctgattatgtgcacgcctggtaattttttactagataccagacatcgtgagttttaccttgtcagttgtggatatttctatattcctataaatattcttaagctttattctgagacacaataaagttacatggaaaaaaattgatctgttcaggtcgttctcttaaaatgtactaggcaggaccagagcagttctcattctaagtctacttatttacccttctgacccttctgggtactccatccaacatcccatgaaccatgaggttttccaggctgactggtgggagcaggtgctatttctaactgtatgagtgctaggcactgttatctctaattctttcagatggttctttctctagcctcaggtagtttcctcacacatggattctttgcaggtctgccccagagagggtaaagaaggaaggtgaaagagatttgtcagctgtaaagtactattcaaatgtaaggttttgggtgttatcttgattgctgccctccccaatgcctatgcttttgtgtctcctttgtctttaatgcttacatattttttttcctttcatctcattacgtattggtttcagccatgctggcctgaaaaaaataaccactgtgaggggcattttctcctactcctctggtagtctcattcttcaatctacattgcctcttttgaatagtaagggtgactttcaggcctcatcctcctcattcccaggtataaagccaagattctcacttcatattaccaaggaagtagcctcttgattctagagtgtttttattcactgtctctcccaccccttgcctttaaaaagcctgcttcctgcttctccgcctcagcccagggaatctgaaaacatacctgtattgctggaattcagagacaaattatcctagaatgttctgtttcttccctggggagaaaatttaaaagtaatgggccaaggcttcagcagagtgtttgaagttagacttaagggctgaattatttagggcatcatacctggttgacacagtcatggggtgttggagagggaagaacaggaactgtagccatcagtgtggcccatatctctgaatgaggggctctgtctaccacaggtcctacctgaaagctccaacagctgagggatctatacaccagcactcataacccatttttggcatatctgttgggaaatgtcaataaggggtcaagtccaaggcagagactaggagactgggaaaccaaagaatgcctaggaaatatgttcagagcaaggtcagactctggctttgagtcaaaagctgttgttgatttggtcagaaagtgagcagaaacctgttgtgatccttgccccaatttgggggtattgacaagagtcaaagtattgctttggtaatactttagttgatattttctgtacacatttctatttcaaggctgtgccaggaggtaggatataccaaataaaattgaacattgaacatgaattctagcatgtaaggtcttgtaccaggtagttgatgaggagtgagggttgaatattaacattggtggaggttgatatcgtctttaaatcattcattcatttactaaatatctatggagacttactaggtgccagacactaagggaaagagatgaaagacattatctgcccctaagcagatgagaaagacaaaaatttgcactagaaagtagcaggtaccatggagagggttggtatagatcaatctaggagtccagaggagggcacataagctagccttgggagagaagaggatatgagggtggacttcctagaagaagcaatgcccttgctgggtcttaaagaatgaataagagttggtcaaatagaagagtgaagggaagggcatctcaggctgaagaagaatatgtgcaaaggcacagaggcaagattcagtgcagtgagttttgggggatgcaagtaatttacttcataggctgtttgtagggaagtgatgtgggttgaagctgaagggaaaaagtgtcaggtgaagaagggcattgcacaccgtgtcaagacattttaccccaaaggcagtgggaagccactgaacagttttaagtagaagacagttgtgattgggtctgaattttagaaactcttttctactagtaatggggaagagagctgggcagagacaaagctgagggcccagctttaacactgaccccattgccttcccacctgtctttattgttccattctctctataaaatgtatcttatagctcttcactgacttatccaacctgattttttgccactctccaattttagtcaggttgactcaacttattcaaacaggcctactcatttgtgtcttgtttgttcaacaaacatttagtaaatgcctattgcataccagccacagcacttggcatgggggaaccaaggatgagtaagacatggaaactgcctttaaggagctcacagaccagtagggagataccatggagatacattgttactataaagtgtgatgatggctgtggggtgggctaaatatagagtaccctgggtgcagaaagaagacaggcttggctatgagaagcccttctccctctctactaaatcctacccatcctcagactcctgcctatattcttatagaggcagggtaatttaatgggttgttgcttgggctctgaagcctgccaacagggttttaatcctggttctgccacttactggccatgtgactttggcccgaaattctttgtacctcagtttcttcatctgtaaaatgggtatgatggctgcatcaacttcatagggttattgcgaggattaaaggagatagcatgcataaaatcctttagaacaatccttgtcatgtgcgaaatatttaataataattagctactattattctgtttttactccttttcttcagcatctatatcgtatcaagaaattttaacccctaattatctattagtttgctgcctgccccatcttatgtattgtcatgttatttctctcaagaatgattttaattcttctttgagacaaaatacattatatatttatctgtacttttggggtgcttacaatattgggtatgtattatagcaatcagccatcccaattttcccaggaccgaggggatttctgggacacaggaatttctatgctaaaaccaggaaaatcctgggacaaattgatcaccttacgtgtggtagacagttcagtttggctttttatttatctcttattggtcccaaacctaatttgcaagcaagctcactttgactttgccacaaatttttatttattgtctacagaatataaagctacaatctctagggttcttgcggggggaatcctgagactctttaggattaaaggtggacaatttgagggattcctaaaatacctctctcccatcagctgtgggcatatagactagaaattgtgggcaatcccataagagctttctttaacctgacctacagccgtagaggtctacccttgcctgtcattccccttgtctccctgcatgtctctcatgagtggatgacttccttcatctgctttccagaattgacataccctgctttaacccagtggcaaaactactttcctcatatgaagctgctgtttttccatgaatttcccagttggggccaagtgatttttcctctttttcaaccctgtgttgggagcattgggacaatgtaaatgactttttctctttttcaacccggtctcaccagcattggaacgatgtttaccttgggaagttgcttttcaagcaggattccttatggatcccctgaggcctctctccaaattcctagaagccaagacaagtgtttgcctgcccatcttccccaggtcctatgccagtacaatcaagaggctggctccacagcctctgaaagtttcaaccctagcgtctcagtttcctggggctgttgtaacaaagcaccacgagactgtgacttagataacaacaatttgttttctcacagttctggaagctagacatttgagatcaaagtgtcagcagagctagttctttctgaggaatatgagggagaaatctaccctgtgcctttttctcaacttttagtagttttctggcagtctttagcattcttagccttgtagatacatctcccagtttcttcgttcatcttcacatagcattgtccctgtgtgcatgtctgtctcttcacatggcatttttttttaaataaggacaccagtcatattggattagggatctatcctactatagtatgatttaaacttaatgtaactaattacgtctacaattatcctgtttccaaggaaggtcacattctgagatactggggattaggagttcaacatgtgaatttgagtggggggcacagttcagtccatagcacccaggtcttcaagtgagcccaaaacactccttacagacacggagaccctgtctccataagcaaaacaaagcaccagagagtcattgctcatgaatccatttcaattctccactcactttgtgtttgatactgactgctctgcttgttcgccactctagagttttgtgccaactctagggatacttagaaatatatgtacacctgagtcaccagctctaagtcaggacatatcaggagactttcaaaatgagaagcctgctgaggaaaagctgtatctgcggcaaataatgtagtaactattctaaaggcagtggctcccatcctgatgaataataattacaagtcggttgccttttaaaatgctctggagaataccatggtgtgtacagatagggagttggacgactgtgtgtgcatgtgtgtgcatgcagtagcttatgataaacaaaatcaccagactcttccccaaccttcctgcaaacattccctgggcccgcagggagtagcctgcatctcctccctctggctgtggccgctgccttctgtcagctccctagagttgctgatcccttcccctccaaagaaatagctctgttccaaaaagataaacaccagtggttacagggaacttgaggagaaaagcaaagtgagtctcccacttagtgtttttctggtgttctcacatggaaatacagaccgtctttgtgggtgtgctatttctgatcctggcagttacagcctgagatgtgagggcagtgatgggttttcttgaaggtaggggatagggagcagctggggtatggaggttctctacgctctccccacttctttccagggacactgcacctctgagaaatcccaggggtggatgaggcacctagctggtgcccgcctgcaggctgctcgcttgctgagaggcggcgtgccagctccgcgcaccgcgcctcagtgccagatcagggagctgtcagctcagcgcccacgcccctccgcttcagctccggggagccccagggtgggctgctggaaggcgcgactgcaacttgactttgcctcactgttgttgctggcagaatacgtacaccaatgcggacaagctcctagaagcagcagagcagttggctcagacgggggaatgtgaccccgaggagatctacaaggcagctcgacacctggaggtgcgcatccaagacttcgtgcgcagggtggagcagcggaagcttctcctggacatgtctgtttccttccacacacacaccaaagaggtaaggggagctagtggagagagggcattctgtcctgccagggtcaggtcggcttcctagtaaaatggccctgaaggtctgaccagggtcctgggtagtctgggggttactaacttcctaactttggtaatattaacaattcattcctgatagcctgcatttaggtctctccgaatggggcaaaatttcctcctataatatctagtgaggaaaaggggtcatggagacaggtggttttcggggcatctgctagagcatgcaatctgcagctggagaaatgtgggaatccctgatatagcaatagtcactgcaagaagaaatgtaagaggatcacagactctcttcccactacacacccaatttctcttggttgctgtttcctgtcagaaatgagagtcccacagaacttgtaggactaccagcaaggaacatgtagagtttacagatgtgttttttctgtgtttttattttattttttaacaggggatttaatcttcttaatgaggtctgtggcagggtgatattaaagttggtcctcactttgcctgactgtggagtgacaggcattgaaagaagggggactgagatgccctccaccaaggaagctggctgggcttgaagcccagcctgaataattcaccaagtggagaaaggagaaggaaggatagattatgttaagctgcggcaagagcagaggggccccatagagaggaggatggttgcaaacctatgattgcttttcatttctgattaacatgggacatgctgaaattgaataagtggccagtaaggaggcacatttagcatcatctctaataacagccttggcagatgaactcattaggtgtatgcatgcttgtgtccccccccaggaattccctttaatagagtattaattaaagtttgattgctgctcaggaaaaaaaaaatagccctacttaattaagttgaattttaatattgggaatgcattaagaatcttggttgttactgcttcacagccttttctgacactgagggaatgaatgcaaaccattgcagcgcctgtcagagaaaaacatgaaaagatagtgttctctaaactgagattccccaggcagatgaagggctggcaagctccctgaagctggatttgcttcctctctgcgggacctgcagccactctctgatgagtgtctataaaacaaggggattagcattaatccagggtttcctgcctggttctctgcttgatagtggctcacccaattcttaatgaaagtctcagaaaccaaagccatgtgtattcccttttaattatgagcctgtaggtgatggaatggagtatgaatgaacaggagtcatgttcctcatgagggctgcggtggtgctggctgcatggagaagtggtggaccggggtcagtttccatggaactaccactcccaaaagagtgaccatggcttccaggaattcctctagctacatctcccacctgctatacacagagctagtaggctgggattctagaccagattctgctgctaaagaaccatatgagcttgtgcaagtcactatgtccctggccttgggtttccttatctataaaattatgcagttggacttggccctaaggccccttatggttctaatgtgaatccaagatttcattcttcttctcttcttctttatttgctattggtagtgataataaataataataataattaagctgaagtagtataggtgatttaccaagcctaagatttggtttattgtaagcactcaaaatatattacatgagttttttaaatggacacctattacttgccagacacatataccatctcatgtaaccttcatgataatcttatgatatagattttattaaacacatttttaaatgaggagactaagcctcagaaaataacttttctaaggttacagactttctcagtagtacagcagatattttacctgtcttcctattacctacactcttgtttttttccttttctatctcctctcctctgttcttccttctccttacttttatttttcttttttgcatttctaaaccccaaatcaggggcttaatgggtaggacagatcttggctgagaaatacacagtgttgccaggattgggtgtgtgggagacaggaatagtcaggaagttattgactattgttttcccggatatctctcaaatcttgctaagcttggtcgtgtttgaacctgagacttgtttcctcactggaactcagctataaagtcacattcatgtgaaatactactagaaggagtggtgtgatacagggggcaggtgaagaaagagaaagaactgaaatttatttagcacaaaccatgtgctaggctatctggctatctagttcatagccatgataattctcgttttttaaaattccagttttacaaatgggaaaaccaaagttcagaaaaattaataatttgcccatggttttatagctaggttgtagtaagtacggaaattgaccccaggtctttctgactctaaaggccatgcttttttctcctttgccacaaagacttttatataaaggctagtaaacagagacttgaatgaattttttttttccatcagagaattcattcaaacaggaggctatcaggaaattgcatagtctctttctcctcagtcccaaaatacgagagaaatttagagcagccctgcctgtatacaaaggggtttatggttatgaggctcattctattcaagacatctacaactctctgatcatacagattttattttttttttcaggatggacagaaaagcaacattttgagtggctgtcacagaggagctgttccaggggacatgcagtgggactttgtatctgcatgttccctcttggtcaccttcccatccaaaccagtctgtatgaggtcccctttaagtgatttgctaggcagggtagaaaataaggtgtgtgtgtatgtatacatgcacatatatgtatatgtacatgtatatgtgtacacatgcacatatatgtgtacacacacatgcaaatgttcccacacactaagtacagcaagatcttggatgccaggtaggtctgatttccagatctattttcttatgctttgtgcctttgggagaattactcttaatctctgttgctttgtaataattatgaggatgactattacaacactcattttttttcctagtaggaaacttcctcccaaatttttcttagtgtttctttaaagtaggaagtttctttaaagtttctttaataaattaggaacttaaagactcaacttagacatcattttttttttcttgaacttcttcatgggtgcttccaactttcacccagacaagagcagagcactgtatatacctcacactgagctgtgattctctccttcactaaattgggagtgctaatatgtgtagtacacacgtggcattagatgtgtagctagagatactactgtgtctgatacacagaggtgctcaataagtattgaataaatgggtttacttgacaatgggaagctagtctctcctaagaaaagtaaaagaaaaagaagaagaaaaatgagggaagagtcccttcaatcacattttaatctactgcagttctttgacttgagctctccagatattgtaaataagagaggctgggtggggaatctaacttgctgaggggagctttcctttaggacctatatatagcaggcaaaaatggattattagaagacagaaatgagcatccttgaatggtctcatggaagaactcctgtggtttggtttttccatactctgtttaatacctctcaagactcatcacctcttaaacatcactaagtatgggtcctatttgatcctgagttcattaactcttgactccttcctcttgactctataggcaaagttctggctttttattcaagacaggattagtagtctgttagggaattttgagttgctgtggttgcttttccttcttaccgtgaatagagtgaatagaaggaaaatctgctcaacttttgctaaagtggccttcggtactgctgataaatactgttataaatcatttctgcctcattatggctatcttcctccttctttctttccttcctccatttcttccttcctataataatttgcagagtttttgccttggtgccaatttgtaaaagaatgtcctcatagtctataattttcagggaatgaaagccccttttgtaggagatttctaagtgggaagtgaatatccacctttataaatgatttaacctagacttcctaggactccccaggctaaagttcataattttacttttgccaactttccacatcaaaagatttactctaatgagtatcagagaggaaacaggaggaagatataaaaagataacctccaggctcatttcttctacaaattcaagtctgcttaatcctattggcctcttgaattctttatttattgtaggagccgagagggttaaaaatgtctaactgtttcatcacagtgttagtcataatcttgaataattagagaccatctaaatgtttcacattgggtgatttcgttaaacaaatcataatgcatttatatagtaaaatattacacagtcattctaaatcacattgccgaagattattaatgacatgaggaagagcttgtggtataatatataaaaactgtatatccagtacaacacaatttcaataacacatatagaataaggaccagaagtaatatttaccagaagtaaatatgccaagaatttaagattgatatgggagatttaattttttggcttttttttgttttgcaagatttcttcaatgatattttaaattcataatcaggaacaatccaataaatgttatttttcaaaagcaaaactattcatccctacttatagagaaaagctacttaaaaaagaaaggcaacaaacatgtacttgggactttcttatacatccagagcctccactactagtacaaatcatgctgaacttaaatacattctttttgcctggggccaagagggcagccagctttgttttctggtctggagagctagagcaagtttgggagaagcattgacccgagtcctcattctttttgtccaggaacatggcatttgtagcacctgccctgcagaaattgtcatcacagaattctctttccttgctgtgtttccatggaaatgctgtagtcactgggctttcaaaatacccgtttttagatatttttgtagtataaatataagtcaagttaaataaggaacatggccaaagtaaccagcctctgctctttattagacagcttaattaaatacccacttatatttgtttcaccttgtggaatcattctgccacaccatttcctactcaaataggtacaaacataccacagacactcccatatacacatgctcctctatccgccaactctggaaccaaaactaaattggtcttcaagagagatgatggctttaagaacaaaaatagccttatcctctattttacttgctgtactgttgtactgtttatttaagaaacaagctggtggttgatgtccaggaaaaattatcttttcaaaatgagggaagaggaggttcaccaggtggatatggtgtgcctttcaacatccttaaggattgttgatatcattattgttaatcaattgttgtcagcacagtggctgcccaagctgtgcaaatgaaacagccaatcagcaggagaaagtgatgaaattaaatgacctctttccttaaccactcatccgtaagccttgttatttttcttacaaacctcctaggctcttcctctcttgtctccttccttcctgtctttttcagttgccgctttctcaggctgccccattatgcaagcaggagagggtctgtgggctggccctagctgaactcactggttcactattagagctaatcttatgtagggcatggaaaggctcctttaactgttcccctatcaaggttctagaaattctcaaattggacccattcttttggatgtagatatttttggccacaactacatgtgtttctgtaagaaagaatgcacaaaaccatctacatgtatatatcagcatggagcaagcaaccattgccaagaagtgagcgggactctaaaagaagggtcatagtatacatatattttgatcaagaagagagggtctggaaatggctgaaacatgggatttttcttttctggggagggggtgggttggtgaagaaggtacagtgctataatgttaaaccttagataagcagaaagtaaagaagatcacccaagggagagaaaccaacgtggaagacagtgggggaaaaaacacgcgtggttgctgctgccaagctacctcactcactccatgattttacctaattagttccagcagacattggcttgtagtagcttgacagaaaagatcgttctggctggatgtcactgactgcttaataatcagtgaagtagtagcagaagtgtctctctaatttggactcttttcaaagcatgttcttcagcgctaaatcggagggacatacatagaggaaacctttgggacattgagagagatagaaaaattacagcctaataaatgggatattgactctactcatggtttagtagcaccaacttttatttctatctaccttatggtgctaaatctcagaggtgcttattcaaaattatgagcttgcaatttaagtttgctgccaccaggcagtgactgtgtgcaccatgtccacaatttcacctctctctctttacatctatttttcttttagaactatcaagactttttagtttctaggctttcctcggttatcctgagacaaagtggcaaaaacggaatagagaggcccagcccagtctagtatcttgaaggaccaaattcaatgttgatcttatacaaactccaaaatgaaggactacttcaaactttccctttgccctctagtgggaactggagatggcttgcaacaaaaatatcttttttttcctttttcttttttttttgagacagagtcttgctctgtcacccaggtggagtgcagtggcacaatcacagctcactgcagtcttgacctgctgggaacaagcaatcctcccgcctcagcctcctaagtagctggggctacaggcatgtgccaacatgcccagctaatttttgtgttttttaaaaaaatttttttatagatgctgggtcttaccatgttgtctaagctaaaactatattttaaatgtaataatatgtagcactgataagtattgactatatgtcagacactgttgataagtaagatagataatatatttgtgtatacacacatatatcaacttatttgtaatctttatcacaactctctgtgaggaaagcactgttattatccccattttactgataaagaaagccaaggtgcagagagaataagtaacttacccaagattatatagctaatatgtggtagaactaggatttgaaactttttttttttggagacagagttttttttgtttttttttttaacaatttattgtatattttcttttctttctttctttttttttttttgagacagtctccctctatcacccaggctggagtgcagcggtgcaatctcggctcactgcaacctccgcctcctgggttcaagtgattctcctgcctcagcctcccaagtagctggaattacaggtgtacggcatcatgcccagctaatttttgtatttttttttattttttttttattatactttaagttttagggtacatgtgcacattgtgcaggttagttacatatgtatacatgtgccatgctggtgcgctgcacccactaactcgttatctagcattaggtatatctcccaatgctatccctcccccctccccccaccccaccacagtccccagagtgtgatattccccttccggagacagagtcttgctctgttccccaggctggagtgcagtggcacaatctcggctcactgcaacctctgcctcctgggttcaagcaattccactgcctcagcttcctgaatagctggggttacaggcacctgccaccatgcctggctaatttttgtatttttagtagagatggggtttcgccatgttggccagactggtctcgaattcctgacctcaggtgatctgcccaccttggcctcccaaagtgttgggattgcaggtgtgaaccactgtgcctggcccctgaaactctgcctctctgtacaatattttttcagagaatccatcatctcttccctaaagacttaaatacacttagaaaatgtgttttctctctagaaaaaacgacagccagaaaatatgaagtgacattaagctatcattatcaatatcctgtacgtcctggttttatgctgatttgaaattagcatattcacacagcaacatgtatcccagcttatatggtctggaaaacttgtttggtgttttatttgaaaaggaaataaactgaactaattacaaccagacttgcaagctgataaatgtgagggatgctgaataataatttgcattccctatagcaatcagcataatgctgtaggcttattaatactgccataaatttatctaaagcattaataataagaaaatagttcagtcctcacagtctttgaagtgagcagggcaaatcttattattcctattttgtagataaggaaactaaggctcaggaggttactcacctgtacaaaaaggacattctttacactttcttattcatggcctccaaagcttattaatcttcctgttaatctcttctgccgcatctagggcttctctatctaaggaacaaagaataacttgtccaaaatcttgaagactatttttgtctctctatatttttttaatcttcccttattgaaaaggccatattgtaatttaccatactgagaaccaactcgatgaaataatattcttgaggtagacatttacctatgtttttaacagggaagacttcaagatgttagaatcagatggaaactaaccaatttattttgtgctttccccaacctactttacacatgatgtcatggagatggaagggtatagtgatttgtgcaaaggcaccatgagtaacgggaggaacagaagccaaaatctgcatcttctgactccatctatcaattttctctctctactggcttttttcctggtagagccctgagcttatctttcctgctagtcaggtgaacactcctggtttcaaagcaaacaccagactcatcttcccctctctcatttatgaaaattctcaaagtagtcaaaagtgagctctctggcaggccactggagacctgtattcagtatgatgaggaaaagctatcaataaatgatttttcagtaattcagttttaactcctcatcatttccagtgcttattttgttcaaaacactatactttgctcttttaaagttgtctggccagtaatacctagttgcattttatcatcttgaatattatgggaaaatgtctcatatatttattgaaattaagataagccacatctttagcattcagctttctaaccaatttagcaattttaaaaagaacaaaatagtatggaatatgtacaggttatgctcagttaatgtgcatttagttcttattgaccaccacattctttgtgtatttgcaatattatgatacatttctaggaatcaatgtgcacagagtacattactccctttcctcctttctgaaagatgaaataatattcgttcattctagtctcctgttcttcctagtggtgtctcaaagatgactgatctccttgctctaagatcatacctgtaggtttccctgaccacagggaagttaagccaggggtgattcctgtctttagggactgtcaacaccaatggagtaaacttagcaaagactggtgatgaatataaatgtaaaaacacaaactgacccatagttgtgctgatgagaatggcactgactggttgagagtaagttgggtgattccagtctagcttccttgccctcaccccagccctggcctctcccatcttccctgagtggaatctctgctctctctctacagttgtggacatggatggaagaccttcagaaggagatgttggaggatgtctgtgcagattctgtggatgcagtccaggaactgatcaagcagttccagcagcagcagaccgccactctagatgccacactcaatgtcatcaaggaaggcgaagaccttatccagcagctcaggtcagcgcctccctccctcggggagcccagcgaggccaggtcagcatgggcagagctttccagtgggaaatgcctcgggctagacgtgagataagtcctgtcccagtcttgactcagcaaaatcttgctttgtggtcttgtgtgagcttcggtttctttatctgtaagatgtaaaaatgcctgcaccatactcaacttgaatctagaataaaatagtaaatggaaaagctttaatgtttcaaagaattatttatcattcaggatgttattcagccatcagtaagtaacataaatacaacaaaaattaacaaaagacaaaaaaaacaaaagtaaaaaataattaagaattagggcatatttgctcatgcagagaaatagacattatggaacatagtgttatttaacatctggtcttaggctgaactctgacctccagtgccccagtcagcaaaatcagatcattttgctgatgtttgactttggacccatgaagacataaaaaaagtgtggtggtgtcctaccagttccctgttacccaattatgaccttttaccattccttgctgcccagaaaataaaactccttctgcatcaacctaaacaaacataactaaggagacaaatcctgtctaaaatttttcatttgtttagaattacccaggccattgcctcctttctattggcatcaatatctagttctctgcccctgtcaaggacactggctccttagataaagtgtcatgaggccttaagcaagccctcagcaaccaaccccatgcctaggtgctgtataaataggatttgattgtgctaatgatgcttgcccacagggactttttcctatcccaaaatcactgagtgctgggacctctgccagctctggacagaaataatctcatcagcaagtcccaggctatccctagggcctgagggaattacgtcaattggagagggtttttttcacccataccagttgtccaattaaataaacaatgagaaattacctttagaaggccctggcatgtttttctgttggaaattaataatttctattccaaatatgcacatgagatgctccaaatcctcctattgcatgctaacaagacagcctcttttccttcttcccctaattatcttcatgaatatataatacatgacagctttgtgtgcctccctaggaaactccactgtcatttgcttccgaagagaattcctaatagtggacagtcatttaacctctctgggcctcagctgcttcgtctgtgtaattaaggggttcactctaggagctctggcagctctagaattttgtgatggctttgtgttatctattcaaaaacttttcacaggcttggctggcttcactttctgtggggctaggcctacggagatgccacttgttcttaacaactgtaaacctgcacaatgcctaagggcataaggctacttgatgatggcaaaggcaacaatgtgggtgatgcctgctctgcaagattaaattccatgggtttcagagagtaccgtaggcatatgaccaagagccactggcgaccattcattatgccagtaacctgactctagcctaggctcccctccctgacatcaaggcatgtcaaagagaaaaagaagtaaatggtgcttagtggacattgacaggatgcctcacacacaccagaaacatcttccctatgtcttcctgatctttctgacacttgttactagagcacctaagggagcttttgcatcatctctgtgattcctagtgagtgtgacactgacatagtgctgcataaaatggtccaaaatctttcctttccttctggaaaatttgtgatggagaaagactgagaggagaagtccaagagaataatcacatcctcccagcagcaaagccctcaacaaatacataacagatagcactgagtacatctcatgttattttcatgcctggggatgtccgtgcagttgtgggagtagaaattgtgcctgtatcacaacaaacaggccagggtgaggaggcaggaatagggagccctgtgaccggtagacggaagggtgcttgacaaattagccttacgccatcctcagaaacagaatgaactcaaataccattgcttctgagacaaacacaggctaaaagaacatggctttcagaaagcctgctgatgagatgattggaagtaaatgattttccccttgtcctttgactccttaaattgtatgagaagctaagatgtcacaagataatgaatgtgccagtttatttcaagttttagggctctagcttactcaaggccctatggaatctaaacttcttagccaccatcattttcccattatagttatcaccacctcattttgctaagcaaatcaatctgtttatctctcggcttccctctataaggcatcacctctccctactacgtttgtatagactctgcctgctcagaggaggctgcaccccctcctattacttgactgtgtttctccatttcttcaaacccccaaatcaaaactgtttgcagcctttgttggttgtcccagcttcttaggatctagcctttactctcctgatcagcacttgacacttcacttgtgtcctttcaggattaataattatccatacatgttactggtcttagttcatgtgcactcttatttaacagcaaactgtgaagtgagcagggcagaaattattaagtccacttgacagataaggcagctgaggctcagagaggtgatttcccagggccaccagcctaaatgtatcagagcagagacctaattcaggtttgcaggctccagatcctatgctttcctaagtatagcctgagcctgtttagtataataacaccagcccataactttagcatagctttataaagagcatacttacaattttggcaaccatgacatcatctgttttaacaaagagtctgtgaagtaaaactaggaagattttttttaaaatatgcctttagtatgtttgtctgtacgtattgtgatagatttatgtgtgtgtgtgttggaactatacatattagactacatatatgtgtggaaccattccatttctctaatattttatgccttgtagagtcctttctcatgcattatttcatcttatttctttcacaatcctgcttgaggagtaggagaacaactagtcttggaaatagacttgtgaacccaaaaaaggatgcatgtagctttggttcactcattaagcagagagcatcaggctcacagcaggagtttgataaatgtctgttgattgaatgactcaactgattcacatccaccttgctcagatgaggaagatccccctcctcctctgtcacttttaacatggaaaggcctctccctcccttttttctccccactctgccacagggactcggctgtgtccaacaacaaaacaccccacagcagctccatcagccacatcgagtcggtcctgcagcagcttgatgatgcccaggtgcagatggaggagctgttccacgagcggaagatcaagctggacatcttcctgcaactgcgcatctttgagcagtacaccatcgaggtagcagggggccaggaggggaggtggagaggggccaagaagtgcttcctggccaagggcactgccccaggggcagggcagtagcctaaggaaattagagcatccagcatgcatttttagaacccaagaaattcccagtccaccatggcatattccttccagtccctctcatcccctactgccgagcagagcccctctattttactttctgtctgtagattactttcttgagaagttttttttgtttgtttttgttcgttttgttttgttttgttttgttctgttgagaaggagtctcgctctgttgcccaggctgaagtgcattggcgcgatctgggctcactgcaagctccacctctcgggttcaagcgattcttctgcctcagcctcccgaatagctgggattacaggcatgcgccaccacacctggctaattttgtatttttagtagagatagggtttcaccacgttggtcaggctggtctcgaactcctgacctcaggtgatccgcctgcctcagccttccaaagtgctgggattacaggcatgagccactgtgcctagccaagaagttttttattgctatccgttagactcttacttggcattttcctgaaataccatccatggagctggtagtttgctgattggagtagagtcattgaatttcacagctttatgaatggatagatgttaaaattaggtggcctccttagagctgataatataaatcatgcgttagattcaatcacacagcagttaagaagccaagcgccacaggaaggggaacctgtatccgcagtttgatttctacctattaagaaagtaagcctgtgctaagaccatttgttagttcatctcataaactcctcagtttatttttggaaggttggaatcacatattctggtaaatttatgtcccctttctcataccaattagtaatgtcttccttcacataatttcccccttttaatattttctgctttgaaaccataactaaagccaggccaatagggtttctgtggtataaggaatatccaacataaggcactttttccttttcagggatagcaaagggttaaattaaaggcatgtcttctgtttgctcctggctggtatggtagggggaaaagccaactttccacccaccatttcttaactttgttttccattccaaccatctctctggagttagggcttctgggtttggtgagcttcccaataatatctgcggaaacttcaatggaacagctttagaaggaattttttttttaatatatcgaaagctccaatatcccatcctaatccaactcagtacaagagactatcttgggaacagctaccctttgctttaatcctaggtccaaaaatgttcatattgagaatctgaaatgtaaaagaaaagcaatcataaaggtactcatctttctatcccctactctcttacaagcacatctgtactcctgcctccttgggagaacttgtaatttcttgcttaaagacttcatgttctaaaaggtgctttctggacaggtcctggaacaaaggagaagttaagcctttaaatctagaccttaactatccttccaactgatttcataaccttaggagaatttatttatatttattatttattttgaatgtactgtcaggatttcaggtggcaagtagtatcaacacacattttgaaaaacaataaaaatgccagtgggaaaataaaaatattgacatgtagtgaagagtgtatgtagtgaacattgtaaaggcagggtaacaaggtaataaagagataaaagagagggtatgggtcattattctttagtaatatggattgagatgtacaaaaataaatacaggctaagttgattaaagtagcccaaggcattcctgcaatcattcctcagctccattttgcccactgggagagaatatatccatggagaaattatgttagcaggtgtggtggttttgctgttgtacttcttatttactctcctgtcattccaggtctgcttcaaaacatgcttaagggggaggaaacaatctgagggtttggattaagttttatttgaaaagatagctgtgacctggaagtcagggttgctggttcagcgctggaatgggtcagttagcttcactttgacatcgactacacccctcacatcagctgggggcatcgcaagtgtgtctttactagcatcgattgtaggcaaatcaagttccactcctaaaaaacaatccaaagcatatggagaaaatatcctttaaaaaatgtgggtttaaatcacatgcattaaaattggatctggcttaaaggttacgagagaggaacttgacacttaaattatggagccaagggtggtggctcacgcctataatcccagcactttgggaggctgaggctggcagatcacttgaactcaggagctcaagaccagcctgggcaacgtggtgaaactccatctccaccaaaaatataaacaaaaaccgagtgtggtggtgagcacccatggtcccagctactcaggaggctaagatggtaggatcacttgagcccaggaggcggaggttgcagtgagctgtgatcacaccactgcactccagcctagatgacagagtgagaccctgtctcagaaaaaaataaaaaataaacaaataaattattggatttgcattctttagcctttgtatgtataaaaattcctcgtcccaccctaagtactggacaacctggtatgcaggagagcaagagtgtgagggcctcataaaatgagggagagaaaaatcatgataggatcctgcatcctctggtgtaggctataacgtccggattttacaaggggtcttattcccttgtcttgtgggggaggcccaaaagcttggggagaatgctacatctaatcttagaactggaaatcctgccaaacctatagaaaagttctgcttcaagtcagattgtcagaagttatttttgagggtgttgagattattcaaataccagctatgtctcactgtggggatgaagaacaaacttttagagaagcttctggtgtgaaactgagggtggtttctgtaacgagaggcgtgtttatgctgacataagccagggcagggtctgtgattacaggacctacagtgtggtttccttcctaaaggaaggcatttgatagacatgctccaaattcctcaggattactgaacactggaggaggactgctaccctgcatctgaggaatctaaacatgactccttagccatatcactgagggcccagatgagccagttaatgtaatcattaggatagcacatgagctgctgcaccaatctctttgtactcaataataatggtactcacattataacctggaatgagatcatagggcatgcccacataaagtgaaacatcctaaatttgttagtcagatgttcaaaaccaggcccatagctggattcctggtataccttcttggactccatggagaccaaagtgacctatagtggaacatgatgttctataacgtttttttcctttaggttcagcctccttctatgaaagacattttatataaactagttatgatagaagagacatttcaccaaatacaaatgtttattttgtgatggtaagaatacaggtgattttttttcttatttttgatgctttcttgcatttccaagttttatacaattaggataatcagaaagaaatgaaaaatatttttagaagcaagaataggccagtggtctccaaacatttttgattgtgtgccttctcaatttttttgaacttgcaaccccctacatataaatatttattcatttttaagttataaaaacgttcggtcactgcctaataatttcaaaattcaacatgctctttgggagaggtttagttttttcattagaaattgtgggttccatatttcaaatagtcttctgataatttccaattattttttgcctggtttcttgagagatcagattagattgtcattgttgccttaccccataatgtggctgacagagaattcaaagttctcttgtgctttcatgattggtattatcttcaaactgcagtttctttgcaggaaactcgttaaaccacgtgtctttttgtgaaggttagtttagttaaaactagatagtagataaatctatttaactggacacatgaaaaaaagcaataatttgaaatgtgctgaaagcaatgaacaaatgagccacagtcagccactgagttgtgacactcctaccttccccccttccccgaggagctctctttttcgtgcactacacaaagccatctgccatgtggtcagagtgagactccagcaccagtctactaatgaaaatcctgggaaattttatatactttgtattggcttgataaaatatatgtgcacaatataatatatatacacatatatgcatatttatatcaagatagtttttctaccatcattggataatttggggcattttctgagatgggcatacttatgttggaaagccttagaaatgacactaagaaggatattctagacaagggactttctgaaaatatgggccacctttatggtttttcttttaaatctctaactgtgtaattgcaagcgaggtatgcttaatgcacctgaaagtttatttgagtagggaatgatatatcaattctaaatctatggggttcatgtaaaacaaataggggccaggctaaggctggggagaaatggcattcaaggaagaaacttctgcctagagaagataagctgattataacttactggtggtctcaactcttcaattagttgcacacagaggcccttagcattttatattagaaagagaccattcggtcagccttttacctatatagaaattcaactcagtaaacatttggtgagcacctccttatgtagcaaaaactatgttggacattgaggacataacagggagacacagaaacagagaatcatcatacaatttaagaattctatgatagaggctcctagtttgcagagaacactggaagaggcagatgcttagcccagtcaggatgttcatagagggtttcccaatgaggttacacctgagggcaggcaaaagttggtggctaggatttggcatccttggatgatgccatccagcctctaccagaatatctccagagcccagaaaggggcttagcagggaagggagaagaaaggagggagctcatcatctcactattgtgttgaaccaaaatctccaccttttacacttgggtctttgttctgctctctggaaaaaaaaaaaaaaaagagagaactagtctgctccctcttatttgggagccttaaaaataattgaaaatgtttatcataggcctcttttcctttatctgaaaaatggtgagcttgtatgagttatttctgcagtcccggtgactctaaaaatgttataatgatttctccttagtgtcagccctctatggtatatatcctctattttattcacctctttctggataggacatggtctctagtcactgactgtcttggtcactgtctgctgaatggagcctggctcacatataggcttggatgtgtcctcttcagagtactggctctggtgcagcccaggagataggtacctttttaatgacttcatcacctgtcttgtctagtctttgcttgcttaaaagctcctggttgtcatttgaaagtatgggcttccagtacactgacttaaaaaaaaaaaacttcaatgtcagcttttatattttgtcactcaaatttagtctttttcttttttttttttttgcacagttcttctgcctgtgaaaatagatataaatttaatttattattactatcaatgttgtggctgtttgaaaagttgggcaggtaagacagggctgtctggtgcatcactacaggttcttatctgggggacacagagccattagtctgcacagtcactgttagctgtggatcatctaagagcccatcatcgagtccaatttcgccactttttcttccataaaaaccattcgagactgcaaggccttgctgttctccacgtttgtaacatgccaaatccaccaacattgcaactgtatcaagaaagaagctaagatctatttgaggtcatctttgtgcactcttcctagtgatcactgtcacattttctaagtacccccagaacctttggaaagaacatgtagaatgaatacaatgaagtaaacctaatcctcacaaaatatttatttcatagtctcttctagactttttgacaaattaatttcaggatcactgggaggttttccctactatcgtccttttttaaaaaaatcaggatttttcacacagctttagtattctggcaggtcacctgttttcagtagaactgtcaaaaatccctgatggaaatgttcagatcactctgtaatggggtgggtctggggctgtggacctgaactcaagtaaaattatcaaggttcaaatgctatatgctcctcctttctggtaaggatgcagtagaaggtgttcagcttacacagggggagaaaacattctgacactcaagcataactaggttctagaatgagtgagcaatatacgttataggagctcttcaacaaaagagagatcttttaaaaggagaatagagttccacaaatctcaaaatgataaaaggcaaaggtatggacacaagtataaaaaggaatgaccaagatccctcccaaccctgttaattgacagttgtgattatatcaaggacctcagggtttttttttttttttttttttttttgacggagtctcgctctgtcagccaggctggagtgcaatgacacaatcttggctcactgcaagctccacctcctgggttcacgccattctcctgcctcagcctcctgagtagctgggactacaggtgcccaccaccacacccggctaatttttttgtatttttagtagagatgaggtttcactgtgttagccaggatggcctcgatctcctgacctcgtgatccgcccgcctcggcctcccaaagtactgggattacaggcgtgagccaccacacctggccaaggatctcagttttaatcatgatgatagagaagaaaagaacataaaattggccataaaaataatccaattatccaaattattcaattggtatagaaattaagtaattgaacattggaactcatcaattacagcatttttgcaatatgttctcacattattttgccaaaaattaaaaactgactggatttcattatttccaagtccctttgcttttctggaaatttcttacaatattcccaaaggtctttagctatttaaacaaatattttaactcttcagagagattatacatattactaaaacagggaaatgctatgataactttaaaataatctgctttagaagtcactaatcttatcattgtaagaattgattagcagagaggaactcaacattatattggacaagaagagtaaatgaccatggtactttagctattttattcatcgtggtaacctatatcaaaaattatagataaaatagatcttcccatgcaatgaggtggtttcttcagctgcaatatgtctttccctatcagccagcatttgtagggcagtggagaatatttgtcttccactttcctcatcttcacaaaaataatgatgtcataaaacagaaagatgccattttgcaattgataacccaggtatgtcaatggcatcccatcacagtgaaatgccatggaccctttcttcctactggtaattggaatgagattgaatcttaacatatgcaacatatgtagtgttgattaatgtatataatcacctttgctgagagacagtaatgccgtgatcaagtgtgtagtattttgagttagactgcctgggtttgaaacctgttttactaactttactaattgtgtggccttaagcaagttgctttgctttttttttttttttttgagacagggtctcactctgtcacccaagctggagtgcagtggcatgatctcggctcactgctatctccgcctcctgggttccagtgattctcctgggttcaagcctccagagtagctgggattacaggtatgcgccaccacgcccagctaatttttgtatttttagtagagatggggtttcaccatgcttgccaggctggtctcaaactcctgacctcaggtgatccacctgcgaaagtgttgggattacaggcgtgagtcactgcacccagccaggcaaattgcccttgaagccttggtttcctcatttgagaaatggaaacgaaataatatttcccagcctattgggttactgtgaggatttaataagttaacacataatatgtttagcaaagctcctgacagttaatcagcacttaatacatagtagtcagcattgttattattattcataatatgttttcttttatatatatatatatatttgcttccaggttttaagcagttaaacatcccttcttattctttctcattgtttctcttctgatttgttactgagtcatattaggagatccctgaatgtttatgcagagaacctgctgtgggagccaaagtcatttgctcttgccttacagagaccctgcctgtgttgggaacagatcatatttctatctgctgcaatttaagtctcaataccaaattgcagatgtgtttcctattcatgacaaaggcatctggataaccagataattctatataggttaatattacctttatactgagcaatctggcagagtcggtttaaaaaaaattactaaactctttaaaaatgtactatactgtgctcacttcatcagcacatacactaaactgaaacgatacagagattagcatgggccctgacgcacaaatacgtgaagcattccataaattttttttttattttttattttgagacggaatctcgctctgttgcccaggctggagtgcagtggcacgatctcggctcaccacctaggttcacgccattctcctgcctcagcctcccgagtagctgggactagaggcacccgccaccacgcccagctattttttttgtatttttagtagagacggggtttcaccgtgttagctaggatgggctcgatctcctgacctcgtgatccgcccgcctcagcctcccaaagtgctgggattacaggcgtgagccactgtgcctggccaaaacttttttttaaaaaggaaaagaaatactggaggaaggcagtgcgttttcttgcaaggataaattatgcctggcatttatctaaggccacaaacacaaaatttcttggtctgctaaaaaaaatatgattaatttaaaaggctcatgtgaagtgaagaaaactgaattatgggttttgttttttgttttgtttttgtttttgttttagaagaagaagaaaacaagaagggtaaaactggcacttttctgaagtgagaatagtaaaaagaaagatatcccccaaaatcaattcttggagcagccctattgttgtaacaccatggttaagagcattggacttggtcattaaatgctcagctctaccaccaccagctctgagaccatgggagaaactatatgacttctctgtgctttcatttcctcctatagtgctatgaggattaaataaagttgatcaaacacttaacacattgcctgccccataataaatgcacaatacaaagtaaaatgtcttcttcaatcatactatcttcatcattgttgccaacatctaaacactgatctgaagaaagaactatacagtgagatttccaatgttgcaggtgataaagagttgaagtgggtagaccataggaagtggggaaaaaaaaaagggaggggcaggtgaattttgattcaggcagatacagttcaaaacatctggggaagagggactatagctttctctacacataaatactggggaagaccaagaaaacaggaggaaccaatggagagagctctctgaaagcagagctcaaggtgactgctaaaccaactcctatgaagcaaattttgatggcagaatactggatttggtgtatctcatctagcaggaacaccttgggcttctttttgaagtgaggcttcccattttccatttcccactgcctcttacccttttttaaattttattttggcactttctctgatttcccttattgatgtctctagagtagacaattgttagaatagaaatattgccaatgtatctgtcaaaaaagtcatcatttcctaactgcagttaattcaggagagtgggggagacagaggccactagagcaagtggggaactgaggtggaagtaactgagtggaaggagaaagcaaaataggttgactgaaagcggaatgccctctgggaaccttgtgttccatctttcattcactggcttcaggccctagtttctagcctgaacaaattctctccagatggagttaaatcactaaattcactcactggcacaggcttttcttttcagtcttgtctctctgtattagcaaactaacccatgacccatgttattagataagccagagaaaaatattcgggtctaggtgttgtcgtgaagctcttcatgccagagggtttactctgaagggtggtcagggcttaagcagattgggaggaaggacaagggcgtttcagggctattaggctagtgaagaaggctggagagggcagaacttgctctcagcatcagcaagtaaaccatctgactggttcacaacaagagcacagggtaagcctgggaagctaggtttgttcattagcagtaaggtcaacttaaggtttgaaaacaactatttttctttttaaaaaatgagcctctattgtcttccagccttatgccccagaaagaaggtggggaggaagaacctaatgaaaaaaacattccttgaggaaacagaaaatacttaggaaagagaataatttaaattccagtatacattaaacacacacaaatcagactaattgaaagctgtgggcatcagtgcctgggggagagaagggagggggagtccaacagaaagaggagagagcctgcggacccagggagggcagccttaggaggaggccctggaaattcccattctccaggcttcataacagacctgggttcctcaattcaatggtgtcagatgatgagagtggaggagggtaaggagaggagatgaaagaatatagaaacaccagatacagaatcctggacatatttcacatttagcttagatttgaattcccaagattccagacctctgagatcactctctcaactaaagccctctgacgtgactctcttctccctcaccaggaccgtcggcaccttccactccatagattcctggctatgggactccttggatcttcctgcagcaaatagatacctcagactcagtttcacagaaacaaacagaacctaaaatcaaaagaaaaggcaggctcttcctttcatgcttgttgtcttagttttattctaattccccttagtttgtaggccagaaaatggagtaaaaattgtgatttgggctattttacatatattatctgataaagaacttacatctagaatatatttagaacttttacaaatctacaatgaaaagttaattaactcagtattttaaaaagggcagaagacttgaaaagacatcttacaaaagtagatatacaaatggtcaataagcatttgaaaatgttctcaccatcgtgagtcatcaagaaaatacaacttaaaaccatgatgaaatagcacttcacacccactagcatggttaaaattaaatagactgataatgccaagtgatggtgagggtgtagagcaaccggaacttgaatacgttgctcctgggtatgtaaaatattacaatcattttgaggaaatctgatggttcccttataaagttaaacatacacctaccctatgacctatatataattccacccctaagtaattgtgcaagagcaatgaaaacctatgtccacagaaagacttctataagaactttcacatcaaccttattcatattagccaaacactggaaacaacccaataattcattaggaggagaatggataaacacactgtggcctatatgtacaatgatactctactcagctgtagcaaggaatgaactaaacatacacacagcagcgtggatgaatcttgatacaacatgttgaacaaaagccagatgtttaaaaaaaaattctgtaagatttcattcatattaaattctagaataggcaaaactacatctatgatgatagaaatcagaaattggtgcctagttgtgggttgggaaggggagggatggattggaagggggcacaagcaggttctctagagtgatggaaaggctctatagtttatttttggcgatgactacatgggtgtataaaattgtcaagactcagaactgaatgcttaaaatatgtgtattttgtatgtaaattatacttcagtttttaacatacagtaacgaaaaaggcctagttctataaaaactgtaaaagcctatgtatactttaaattatgcttttttttttttttttttttttttttttaagaaacagggtctctatcacccaagctggagtgcagtagcataataatagtgcactacaaccttgaactcctgggctcaagtgattctcctgcctcagcctcccaagttgcaaggacaacaggtgcatgccaccatgcctagctaatgtattattatttgctttggagagacaggttctcactgcgttgaccaggctggtcttgaactcctggcctcaagtgatcctcccgccttggcctcccaaatcactgggattataggcacaagccactgcacccaggctaaattatctttttaaataatctattttagcctcatcagtctaacccctttcttgagttagagaatgaagtacttttcaaagatggggctttaacaaaaacctactttgcctgccaacccagtggctcccagatcccccaaggatgccccacaataagtaatactgggttttcctgctgagctcagcagttctctaaattgacctgaaaagatgtggggtgtgaagtgagaacctagggcagtgagagtgatattttcaatttccccatttctgcttcaaagagagaaagtacaatttaatctgtttctattttgcttgaagaaaggtcttgttgttagacaaaaaaaatgaaatcctgtgacccagacagcagccccttgtgaggggctgcttggctttcccatcccagtgtgtgtaccccagcatggaatataagagcaccgctcccacttgcttcaatccatcgtctgtctccctgtgtccctgatgctcctggagcagcagtttttgataacttggaaggttatgccatgtgggagctggcatgagacccagcatcatgaaaaccactcaactaaggctctgggatatatgcttagatggcctgggccatcctggaaatgtgtgacctggagtgacactttcgtctcctgagaaaagaggatgacagtacacatgctgtcgccttcaaggggtgtcatcggggtagcatgagatagcagatctgaaaatcacttttaaaaacttttaattttgattcacacaagtggaattatctagttcagtacttctgacttcctagtctgtggatgattgcagagattgtaaaggaagtgtaggatttagtctcgatttgcagaaaactgagagtagacccagtgaagtcatgtgagttaaggtgtagagaaatgaacaattagcaagctgctattaaggcaatgtttgcattcattacatgctttagtattcattagaatcattaatgcctttcaattgattaaatctgcttgaattcctggaggtatgctacacatttatactttgtttagtcactatttttaggtgtcaacctttgtaatagaaggacagaatgttgcacaatagaacacaggaaccagagcaggacccttgggtttgatggacaccagctctttaactgattgtgtaactttgggccattcaccaggtttttctagccctcagtttctgtttttgaaatactacttaatttctgaggacctctttagttatgaaaattgtaacagcaacaactgtgggatggtagacaaagtctttgcagttagtagaagaactttatccctctctggcagggtaaataaccccatctgtctgtgtgagggtcaacttcctctcctagaatatggacctggagatctccaccatgcctgcctcattgagttattgtgaggattgaacatcaaggagtatgcaaaaactttataagccataattcataatatgaatgtttgctgctgttcctttgctgttgctataggcattgaaacactagagagcactcttggagccatgtatacaagagtgcatggcaatgttgcttaaatagtctaagggttgaagaattccaaagcagagacttaactgaggggtggattcatgaataaggcttggaattgtgagccttaacctaacaatctctcgtggacctggtgagcctgtgctgatgacagtggttccctcacaggtgacagcagagctagacgcctggaatgaagacttgcttcggcagatgaatgacttcaacacagaggacctaaccctggcagaacagcggctgcagcgccacacagaacggaagctagccatgaacaacatgacctttgaggttatccagcagggacaggatctgcaccagtacatcacggaggtccaggcatcaggtgggtgacctcgctcattctcctggcagaggagatgatgaaaacaagcataccatctagcctgcaaggagcagtgccacatcgtttattcattttattcctacagatacaaagaatagagatttttacccacattttttttaaaagaaaggaaacgaggccaggtgtggtggttcatgccagtaatcccagcattttggaaggctgaggtgagtggatcatttgaggtcaggagttcgagagcagcctggccaacatggtgaaaccccttctctactaaaaatacaaaaattatccaggtgtgggggcagatgcctataatcccagctactcaggaggctgaggcaggagaatcgcttcaacctgggagatggagactgcagtgagctgagaccatgcgactgcactccagcctgggcaagagtcagatgaaaaaaaaaagaaaagaaacggaagccatgagagctggaatagtgcccaaggttgcccagttaggctgtgctgaagttgggaatagggccagggtttcctggtctgcagacagagtgagagaatcaatgatggcaatcagcacagattcctttaaaaaatggtagcctggaaaaacaaaccagaagcagtcagacattcatatggattgtatacacatgtgtagttgtttcctcttctgctcccgatccctgctgccagcacgcattctccagccctatcctctactcctaagctatctccttgtctccggttcctgtttctcagtctcctcaattgttaatcactggtctttgggtgagtataaacagtgatgataaaaatttatgacaagatcatataattttataacttctcagaaaaacacggctgagttactcagatttaacttcttttcctgctcaagatttattcaaaatttatctaacaaatgagtgagcccttactattatacttcccactccccaagtcatcctttgatgttagaaggagagagcaccatggtgatcttgaggaccgctggttgagaagaaaagaagtcacatggctggtcacatctcaagggagtgctagagcccagatctctaccttccgacccactccactgccctcctaccggggtccttgttggctcaggttcctcagtctccaacacgaggtagacaggagctaaggccatcaactataaaacgcagttgggccatgtccctgcttatcctgaaggatatggaaatcctgagattgtcagggggaccttagcagtcatactgaactttaaagtactgtgtttctttcgatgacctgaaagagtaaagaccagcattcaaagggacttcactcctgaccagaggagagacagtctagtaaattctgttcacttttgtcagcatagtctgtccttgaattttcatctgtgctgtgaacagactgcctctgagacccaggcctgtttcacaggtgtgcagctgaaacccaggcctattcacaggtatgcagctagtgctctgtgtagtcccaggaagggctactcaccttgcagtctgtctggggactttttttttaaatgacagtgcccaggccccatgccctgatattctgatttaactacctctaaatggaacttgggcaacagcaaaaagctcctcgggtgattcaactgtgtggccagggccaagaaccactgcttttattcgtgataattaaatcacaacatctgacatctctggaatgacctaggacagtggctttcaaaatgtgatccccatgtcagcagcattagcatcacctgaggatgtgtttgaaatgcgagttcaagggctcatacctgaactcattacatcagaatcccataacatacatgtttgctgcggttcctttgcagttgctataggcattgaaacagtgcatactcttaaagccctgtacacaagagtacgtggcaatgttgcttcaatagtctaagggtcaaagaattccaaagcagagactgatctgagaggtggattcatgaataaggcagtgttgcttaaatagtctaagggtgagcagagtgtggcccagcaatctgtggttcaattagccctccaggtgattttgtgcaccactgacccaacatgttgctactcagtgtgggccctgggcccagcagcaccagcatcacttgggagcagattaggaatgcaaaattgctggccttatcccagacttgtgaatctgaatgtagatgttaacaaaatctccaggtaaatggtgtgtacattaaaatctgggagtcagtgttctaggacacagactgtaccttattagggaagtaggggaaactgtaatcctttctctgtgattgggaatcttacctggactcgggatttagccccatggcctgccctcatggtacttactgtagctgtctatgcagctacgactgggaaccataagagaatgcacacacaccatctagcagagagatggacagagaagctatgcagggatgctcacccttcatctctcatggtagatgtgtccagcaggaaaaggaggcttgtctgcctggaaacctgcagcacttactaccggggtgctgatgtgaccctgggcaagccaacgtctgtcccaagagccaagtatccatagtaacagaaagacaactgggagttgaaagtccctgaggactgcttatgactgaggtgggctgtgcttggtgtccacctaaactatgagggctgagtggggtgaaaacaccccaggcagatgggctgcccacccccacaatatcctgttctagaaatgagctttgtcaaaagaggtttggcctcttcagtgcctcttactgaggctggctgttctcctgctcctaccacagctagctgtttagtctggcatagcccatgaggcttttaagagaatgaatccaggggttttaggaatgctcactccctgtctatggctgaatgcctggttctgcaggggaggcatctaacttacttctgggcttagggaaatggagggtagattcacagcagagctggagggtggggatggggtaaggggtgagcccaggtgggccttatcccccaatggctgaggaatgtaagacttcagagacacaggactgaggcaataaatggcttggggatttatagtctttgtttaatggactgtatttggactaaaggtaaaataaactgtagtcttagaaaaaggacaattagcaatattaaaacttttgttggtatttagtccatgctaaataagggcttatgctttgattttacagtagcaaatggaactagggaatttttatatgcttcttttcaagtgtgaagtttataatattgagccaggctctactaaatccctctggtgtgcctacaactctaaccaaagtaaaagcctttgcttaacttaacatcaggctcaggaatagagtaaacaggagcaatttcttaatttgctcattgttctttcctcacaatggaatcatctatttgagcctcaagttgggagatggtaggttttgctgaaagaagttgagagaaacatgctggctgaattcaaggtccagttccaccaccaactagcagtctgattttggaagtcccttttctttctctttagactttagtttcttcttctgtctactgtggcacgccttgattcctaaggttccctccagttctcactttccgtaattcagcctagctgccctcatcggccaggccatacttcttctctcccatgaaatctgaccgtgcgactgttacacttgactttaggaataagacaagagcaacgtaccctatggatatgttgtttttgtgatttacacaacgcgttaagttctctctttatacaaggtttgtaaatgagaaatctctggagtttgtggccatgatacttaaaatttaccttgcctgagaagaacccaaccccaacgtttaaaaataaataaattcttaaaataaatcaagttttgtgaggatcactcttctccttgagcataaaggctagaatacaaaagaggaaatcctgggttgaaatcccggccacatgtcttaggacctgagtgtccttgtacatgttcgcctgtctctctaagccttgccttcctctgaaaagtagtgatcatcagaatccttaccacatagggtcatgtgaggatgaagtgggataacatgggaggatggaaagggttcagtgaagcttggcaactagtatattttgtactcctattctagcacatgctgcattctgttgaagttatttgtattcctgtagtttttccagcagcatgaaggaacaaattctttcttccctctttacattcccagcatctagcagagccagtgtcttgtgcctagcaagttctcaatagtagtgtttgctgaattaatcgagaatgaacatcagtgtgggtggaacagatgtaggtaaaaataatggagcacaaataattttactagtgtcaaaaaggaaagaaaaaaaatctgtgggctttttatttttatttttttttcaaaatgaaagctactctggggtgaataggaatgtggatctgaggggctgagacgaagggaagaagaaaccttgatgtagaacaatggttcttaacctgtcggtagattgagaatcacctgggaacttcttaaaaataccaatgtctgggctccatccctcagggaggcttagttaattggtctggagtggacccagattttttttaacttcccaggtgattttaaggtacaaccagggttgagaacactgatctaaaaacctcattaaaggactttgtgatttctgaactgagtgttaggtagagggagtgacacagacagaggaatggagaggggagaagaaaagaaaagagaaaagatgttctgtatctgaggctgataccaatatttaaagaacacaaacagttttttaaaacatgttacaagtatgggcagcatagccagaaatatctaaatcttactctagaccacagtcacctctctccttgaggaaattaaagtggtaccctcatctggtaacaaaggaaagcaaactaacgcttattattgttagctgtggcttttagccctaaagaaacaccagtgcagagcattctgctgagtgtagcagaaggaatatctctgtttcctgtactgtcttttccagtggttcataatcttggttgcatgttggaatcacacctggagctttaagacttactaatggtcgggtcccagccgcagagattctggtgatattggtctggggtgtggttaggacatggtgatttttttttttaattctccagctgatacttgggaagttgaggcaggagaatcgcttgaacccaggaggcagaggttgcagtgagctgagatcgcaccactgcactccagcctgggcgacacagcgaaactcagtctaaaagaaaaaaaaaaattctctgctgagtctgatgtgaggcagagttgagagaagcagtctaacagcattaaagccaccattgtttccaatgatatacagtaggcgagtacataaacacctgtcagtaagattttatatttacattttatacaagccattcaatagttccatcagcaatcaaaagtgtattcattataatttctctgagggaaaggaaaaagtgagaaaatgaatattttaagcctactagatgccaagcactgtatacattgtatctcacttagttctcacaatatccctgagaagtcctctttgtgattcccattttacagacaaggaaatccaggctcagagagggtaagaagcccagagtctcaccattcatagcatacagagcaaacctaagcctgttcttcccccaagctctcaggtactttccaccacagcatatgacctcagttctctgaagaggctcgtttgttcattgattaggtatttattgggtgatatgagtgaagcattgtgctagggcctgaagaggcagagatggatacgactgacatggctctggcgtcaagaagcctgcattcctggaacaacatagataagttaataaggaaccaacctcaatggaagtgttctgattggagtatgggcacaggaaattgtgggggcacatcagaaagaagtctcaatagaactttttaaaaaagagcctgacaaatgatttcctcacaaatacattccgctacttgatggaaagaggaaaaatatctttttgcatttctaagagcccctaagaaaaacagatatatcaatagattgagagcagtaaagtcaacacaagcaaactctgcctgctgccgattgacagatatttaccatttgatgggctttaactaggactcgtgtcagtgtgtttgggggcagtgggagagggggtaatttctattcttctaggtgtggctggaataaatcttcatgttcctcccatttattccatccacaacatgatgtgttcctgaggcatgcagaggtgcaataagcactgtcttcatccattttatttcctgtgtttttctcacataaaacaacatcaaatgagatggatgaaaatgcagggactgagtctcaggacatgctgggagcctgctctgtttgatgtcctaagcaggtgactgtcctctttgataagtaacatgtggtgtggcagaggtgagccatgaggctcacaaagaaagacattttgcccaagcccagcatcctgaacaccagagacacatacagaatgaatatgagctacaacaaatccgcatcaagactggaagtgagaaagagcgtctgcttctgcagatggatcttaaattgcatttccagaaagtaaagataagggtcaggggtcatcccactatgccaagcattgcagaggtagaaatttttgtattcttacttttgatttcagtcaaggaggtgctctacctcatccccttggtaattgaaaatagtaactggaaggagttggctgccaaaagaacaagccgttcttttctctgtctcccacagatatttcaggagctaggacttggaattatgaaacagacacaaaaaataaacatgaaaagatactgaaattattaccatgtaacaccagaaaaaaaaggtgttcccactttcccatattgtccttatataaaacactatttttgcctccagagatgaatttcccttagtatgtacagactttccttatacttccccaactatatgttgcaggtgtgttggtggtggcagtgatggatttctgacggtgtgagttagagtgagggggaaatctcccaaatgggatttattttttaggtagccatatgttgagattggcaggctcctttgggtttgatccccatggaagtatactaccttttggtgacttatctgctgggcttttaagtctgaaccccatcattggttaggatcctgttcttcagcatctcagacaaaagtgtcagcatcaggaccaaacctgcattgggtctagattgttggatgaggagccagggaaaggacttggacagaactaagaagctgcagagccaggtggactcagggatcagaataagcaagtagttcagagttaggattttcctagatctaaggatctgaacaaggccgaataagaaatatgtagacaatccaaatcaagaaacaacatgtgtcacaacttgcaacaagtcggagacagttagaaaccaagaggacatgaatgtgagaaggcagaaagttgaaagtttaaggtaagagttaggagtcagaaaagccacaggactaaggagcagtggtctatatttattgtgtatcatgtacatacagtaatatgtgtatatgagagatattttacatgcatcatctcatttaatcccacaagtttaggaggtaggtagcttatgaggtaggtaggtatgtaaattcatattttacatatgagcaaaatgaggcttctgagagtctaggtaatttgcccaaagtcaggattccagctcaggactgttccaaagctagtacactttcgggtagtctttgagagccaagtaaggaatcaaattcaagttactagtggagagaaggactttggttactaaggcagttcctttgctctctctccgagttcgttcatttctgaggcagaaatttatttgatgaaggctaccttgggcctgctgatgataacgtataaataggagaactggcatggtgaagagaggaagtgtgtgtttgcacctgtgctcatgaatttggaaaagtatataggaaaagtaagacaaggaggtaaacaaggaatggggcaacagcttctggctggcatatattgactcaaggctcccattgtaggtcagatggttgacagtttattaatgttgggtggtttatacataaacattgggaacacttgtcagtgactggctgagcttactaattgtaaatcagtagaaaaacattgagcaaactctccttgagtgggcacaactttaacgtgaagctttttctaaatggataagcactcattatccctgtggtattgctgggttgtatttattaggtgtgtttgcctgagttttataaataatatatgagagctagcttatatttctaacagtgcctttttttagagggcctaagtagttggctaataaaatcaccactgtccatgtgcgacacttgcggggaatttaaaaggaatttttaaaaatcactattgtgcagctactctcattgaagtgaacttaccatctaatgataaattatatctgaccagctaaaaaaaaaagtgtgtcattggccaaagtactgagacagtcttttggtttggtttttgattttccagtatgatttagaggcttgtttgtgaatattctgggtgttggcaaatcccccagcaggaattgctgggtgctgtcatgtctagggatggacctctatataactgtaattcctgttgataataaggaactgatcatccgttgactcctcaggcaaaggatcagttaatacaaaagagatggcgtaattttagcatcccaaacaagggcgcattgtggtgcccagtttcacagaggaatatttagggtttgggagggtatgaataatggctgtttccaaattccagttttcttatgcatattgaagggaatgtagccttcacagtactagctggtttttaattgtttccatttttttaaaatcaggaattgagttgatctgtgaaaaagacattgatctggcagcccaggtgcaagagttattggaatttctccatgagaagcagcatgaattggagctcaatgcagagcagactcataagcggctagagcagtgcctccaattacgtcacctccaggctgaagtcaaacaggtaagcccagcccttcttccttcagcctgggtttctcagccagctgagcctgacctgggacctgctcctggtatgaggtaaggcatacagagccacaggtgcccctttaagtaaccagcacttcgaaaataggtaagttaaggactacttgtattagtttctgaaagcttggctgcggtaacaaatagacccagtgatacaatggctcaaacaacaaatgcatgatttctctcttacaagacaatccattccagagttgtctcagtcactcaatctgttctttctttctatcctcagtcctgtcaagcagtccatgggaaatatacaaatcctttatcaataaatatatttaggatgtagagtcaggttaattaatttggggcactgtgtgcctgacacaaagttaatattcagtaactagtagcaattaccatcactatttccaaagtgtgtatgattattataggaaagttttcttgccatattaaagttgattttaaaaaggaaaaataacttatctgcatgaagcattatgctaggcattttatgctagatctctaggaacctgtgggaacatacacacaatgaccaatgtcacattttaaaaatagtacaggccaggcatggtggttcatgcctgtagtcccaacactttgggaggccaaggcaagagagtcacttgaggccagcagtttaagaccaacctgggcaacatggtgagaccgcacaaaaaattctcaatattagctgaatgtggtggcacatgcctgtggtcccagctaattgggaggctaaggaagaaggatcacttgagtccaggagtttgaagctgcagtgagctatgatcacatcactgcactccagcctggatgacagtgcaagaccctgtttccaaaaaataaaaattacaaaaaatacatatattaagaacagactaagtggtaattgttttaattacctatttgtacaaaggtgggggtgaagaagtaaaagtataataatagttccattttgttgagtgctatgggcctgttacacacatcttcatcaatcctcacaaccattctctgaagtaaactttattctcattttatagattaggccactgaagcttaagaggtcagcagaccatggtcaccctgaggagagaacacaccaccactctccacaggtcccgggggggttcccagcagggcaggtaccacatcactcctgtggttgcccctttctgccccactctacccaaatcatcctaagcaaaaaaccatctttcttttaaacatttttttttcttgtctatagcagctgctggagcttttaccttttttcttcagaaaaccatagctcagcatgctgaaacttttggaattaagcctactgatttagtatgagagccaaaaacatcttattttgtttaattgatgcttgattccttatattaaaggtattccttcctctgatgcctctgtcttagttattatattgttatttattataatgaaaaaaacactgtcttctccactccccatctctcccaatcagtgctgagccatagcccacacatgccatgctaaagatctgtattcagcacagattaaattcctgagccccaagcaaggccgggttacagtgctgccctccagattgtttctgcttaatgacactgggattacacctgagtctccagagagacatgttatttataaggacttggtggaaatcctagcaggcccagaacagtaacgagtatgcaaattctgcaacttagtagttaagactggactttcttttcatatgagaaatcctttctcatttataatctcattttaagagaacatgcccatggggagaagtggtgttatgcttacttttcaaatgaggaaactaaggtaccatggggttagtgctccccaaggcctcttgactggtcagctgaaacttcagcctaggcctcctaaatccaaggtcctacagtttgcctctgctggcccccactcttgccatgtggtcccaggagaaatagaagccctccaacattatgtgaagtgaaatgagccaggcacagaaatactacatgcatgtgggaactaaaaaggttgatctcatagaagtggagtgtagagtagtggctataagagatagagaagggtagaggggaggggaggataaagagaggttggttaatggggacaaaattacagttagaaggaatatgttctagtgtggtataatacagtagggtgactatagttaacaatttattgtatatttcaaaatagctaaatgaaaggaatttgaatgtttccaacacaaataaatgaggtgatggttatcccagttacaatgtgcactacacattgtatatctgcatcaaaatatcacatgtatcccataaatatgtacaattatgtttatcaattcaaaatttaaaaataagaatccttctagctgaatggtctgaggttttcctgacctcagcagtaccatgtatgagaggataggagcaggcatggcctaagcttgatggagagggtggcacctgtctgaggtcagcagggctccagcaggtcatcaaagtcctctgctgcacctacttggttatttccatcagtggaaggtggcaggaatgaccatctgaacaaaacataacgggaaaatcattcctatttgactttgaaatgaaatatataaatttgcttttgttcctgggttttaatttatttttctccagtatcagtggtaaattcaactccctaattctcttttccttcgccgatattaaaatagaaatatatttattctccaactacacatcctatataggaggagactgggctgatgataagtattttgttaaatagggaagtagactgtctatatataaataatccggggtggactaatatctatatacattcccatttataatttcatgagtgggaagacaaaaaaggaattcttttgtgggggtgggaagattccttatttctaccatgacaaaaatgacacaccgtgggactgtcgttcaagactgtacaaaattgctcaaaccagattctcaggaaatctaccaagccctttgcaaaagggcagtggccctcgaggtgccaagggactgctgcttggttaagccaccatgcctcattagacagacttgttttccttgtcagtgtaggctctttccttagggagcgctttgatccagtttcagagaaggcatttgtgtttgatggaaattggtggagcgggaaatactgatttggaagctgttgactcttggaaaaagggagttaatttagatgtcggtattgatcagtgatgctaaatttagacagtagcttgagagtctcttttgaatatagtctcaaaaaagaaagaaaaaggacactttaattgaaatgccattaatgggggcagagagggagaggacagtaatagattatgatacaactatgtcattagagctcatagattaaaggtttagatttgatcatggcccatcataaccttaagttttaccaaaattatattaaactgaagtactgaaaagaaaggaaggcacagacgttagactaaaaattatgttaatggactcagaacaaatgaaattgattgatgcaacttattttctttctgagggtttatgtaggactttatatctaagatagatagcccaaacacccctagagaaatggtggaccttgaagggaaaccactccactgattacagcccatggagcagatccctgaaccactcaatgccaaattactctccaaacccgaaagagtgctctgatagctaccaggaaaattactactatggtgaagatgacctcacatctattagacaattcagaaagatttgaaagacctacctaatgagcataaaactaaatgaatttccatatgtattcctgcaaagcagtgcatttagcagaaaataagctaaaatggatttataaaatgttgtgtctctaagctatgaggaaagaagttatatttatttgattactaaagacattggcttaatttgcttctttgcaccaaatgctggccaaaatttgcatataatcaagatggacatttaggacaaaggagaaaatattagcatgtccttattctcctgtggagaatactgtgttcagttttgttggctgaatataaaagagaggaattgaagtagatccaaaagaggggcagccaacaggacaagtactatccttttgtttcaaaatggagataattaagaggacatatggccacggtctataaaaccatgaaggatgaacatgtgcagtctcatagaccatggatttttagaagtaaggaacactggacatatgacaggctccctgctaccatctgaggagctgattatttttcctgtggctagcgtttcagaaacaactatgccttgtgataaatcatctacaatagtggtccttagagtcagttgccttgagtacaacctcaaagctttgctgtaggtatgaccttgagaacacagccatctacaggcggcttcccagcctacatggttacaaggctcagcctgcccagcttaaatggcatcaccatttgtggatatccacatccacttaatcaaatccattctcctgacttgggcttagctgagctttcctgacatgaagaagcaataaagatcttcatgtccagttccccctcaagctcagactgagctgaacttttggcctagctcttaagtccccaagtagtgatattctttcagtccttcatttctactaactgattttcttggataccctatagatgtaggggcactctttgagttttgaaagtagtgtggaatgttagaactggaaattatctttaaagatcatctaacctattaggtaaattgttgcctagaatgattgatcaatgttaatattcattttacagtttgaaaaatgcttttacattaattattttattttctctttaccccatcccttatgcaaggaaagtgttcacattttacagatgagaaaactgagccttagggagcttaaatgatgtttgcaatgtcacacagctcaaaattagtagaaccaacattttctcattttaattatgatgtttcttaacttgcacatatttgtatgctcacagaagaataactagccagttttatgaacctggaagattaaaaataccagtaatagaaaattataccaacaagggttatcagtgatcagagtaaaaggataatgatgacaaaacagctaaggaagctacatcacatcagaatatgccagtaagctcatacagattctggaataaagctgtcttctcattaagagaggtataaataatcacatcattatccagcttttctctaaactaaaaatcaccaccagtaccatcataatcatcagactttacattttacacattgttgcatcaaccctgcaatgcagaaagggaaggtacaattatccttattttacagatgagaaaactgagactcagaggggttaagtgattttgccaggtaagtaaaaaagccagatttctgactccaaattttatgttatttctctactatgccagttctatgtccaggactgactcattcctagggttcagccccaccctggagctaagccatagatataaactaccatgcatttttagcttcctaaaatcaaatctcccactttaaagtcctggaatacctttttaaacagcatttagtaaataaaaatgaataaggaaatgatgttatataatttaaaaagtaggtactgaaacccatgatgtttctaaatgggaagcttgtaagtagggatcccaccaccatagctataactcatgcttcctgttggctgaaactggagagaaaaattttctaacaaaactgaagagacccaaagggagtcaaattgtcctacagacattgatgtgtgatgcacttggagaagtggtttctctgacaccctcaaatgaatcttcagaccaaacaaaatgcagtgaatcatggcagagggacactgtgagctccatttcccaaagagatgaggcatttgggcatgcagtctgtgaatgcaagtgcccaaagttacaggcaatttttcaaaatcattagcacctctagccaaccagccacagtccaccagtgacaacagggatttcacgcaaacactctgagcagttatttcctgtaactaattgctttacagattggcatctcatctacaatctgctagcttggccatgaattaacatctcaatccaagtagcctagcttcagtgggatttatgacctgatgttatctatgcacaataaggcatgagtcattttttgcccaaggatgaaatttgagaggtgcctatgagttctagagcacgagactgggcttggtattttctaattgttcaatgtgaggaagtagaggggagaaaaatatgaaagcaaatctgaaacagatagtggtgtcttctcctttggcatgaggtgacagatgggtggtatttactgatcttgaattttcagaatagcttttatttcttctccaagaaaactctcagactccctaataaagaaagtgtttggcaatgttctggtgaccagacaccaggtaggttttcagagcctaactcttccagttgcattatttgctctgactttattagctggataattgccacatccccatttcacctagaactgtctagacagtgtcagctgtttcttcttctatcctaatattccctcgttgagttttctttctcccagtgattgttaacatcacatagaagttgtattcagcctacccatggcctctaaataatttaagtcaattatattatagcttactccccttttcctgatgatccagaatatgggttattacttctattttgcttgttttctttctcttttctccttttttggggttgtttacctactgaagttcaaacctgcctactcttggttattttgcaaggtagaggaaattagactcactgctcaggtgtgacctgggtattctcgattacttcaaaaactacaccacacccattatatgcaaagtactgtgataggtactatgtgagactaaaatacagctaatatattgccccagatttcaggaagtttatgttctcagtggggaatgaaacataggttgaaataaagaaaccaggaagtctgtggtgaataccataacggtggtacatacaaaatgatatgcttgcactagatgaagaagagattgtttctagcaggagagattaggtgcaaaagatttccataagttgttgttatttgaactggaccttataaaaaaagaaaaggataccaacagatggaatttatttatttataccatcctatgttccagaaggaagtttagacatgcatacagtacaaccacattaagtaatgtttacactatgtgggtgaggaaattgggacagaggggtgacatggagctgggaataaagcaggtacataaaataagtaccttatggcacaggtactctgtatgattggggagatgaccattttgattatggtgacatttgctgtcctctctccaacagaagataaaagatagtgagctctccaactgaagtccccatgagaggaggcaacagctctggggaaactgcggaaggccattcacctgtgtgcttgtcccgattccctaggttctgggatggatccgcaatggagagtcaatgctcaacgccagcctggtcaatgccagctctttgtcggaagcagagcagctgcagcgggagcacgagcagttccaactggccatcgaggtaacacccaaatctggctgcactgtcctcccttcgcctttctgctctgtacctcaggcagggtgattctcaggtgtgggtgttccttcaggcagcgaaggctgtaccccttctagtagaatggtccagggagccttcctcttacccaagagttgatagggaagcaaatgcaagggttcatcccccagggaggcctggtattagaaaacaagtattcacacttcatatgagaatctttgttacctatcagtaccttcaacctttaaggccactggtacattggtttttttatacattctaaatatgtaccatgtgaggaaatgtaaaactaaaagtttagaagtcacttctggtgcaaatcactcaggtttgaggataaacaagtgcaaaggtcattataaattaggatcctatttttaaccatttggtttacatgtaacccttagatactattgtcagagtctgccttttaacaaggataatgagcattggagcagattgcaccagatatttttaccccgctgaaagcagttgttcaataatgctggtagaacagtatttaaagaataaactgcaaccagaagaagcttatcaacaggggctttttagaaggctatttaaaaataaaacttcatttatgataatctaatataaattttgtcttgctttaagtacccttaattatcctttttaactaggacattgtccttcccagagagacttgaactgattgctttagagtggtgtaggaaaaagagtaggaaatgggacgtgggaactatattaaaaataaaataagttaattaccaatgggaaaagagacagaatgaaaacttcaaagacattcattacttatggttcagtatagaattcaacccacttctgagcgtgtaagaaatgcaaagatgttatcttttactaaaaaaaaaattgttaatgagtcatttctacaacaatcatggcaaaataataaaattttaattgcctgtgtctttttatgcagtaatccaactgattgctagacatttttaagctagtgttgattgattgcaaccatttaatttcccggaaaccatcttggatgtataaacagtgttaagatgcatgatattttcttaggaaccattactagtactagaagaactgtctgggatttgagatttaaaaacaaacttcatattgcacacacagcatcagcaaatcattttctaaggcggaattaaccaaaggaaatgagttttattatcatcagctgtctctattgtagctttctgacacactgaaatatcacagtgttagcatgtattcactataaagaaaaaatcaggattggggttataatcaagaatcagggccagacatggtggttcacatgtgtaatcccagcaatttgggaggccaagatgggcagacctcttgagatcaggagttcaagaccagcctggccaaatggtgaaaccccatctctactgaaaatacaaaaaaaaaagtagccaggcatggtggtgggtacttgtaatcccagctactcgggaggctgaggcaggataattgcttgaacccaggaggtggaagtcgcagtgagctgagattgcgccactgcactccagcctgggtaatagagtgagaccctgtctcaaaaacaaaaaaagaattgggcacatagcagtcaagttcccacagtcataagcagcaacgaagaaaatgaaggctgagcgatcagattagaggtatagcacagttatgaggcatgctgggcagaatgaagacagctcttggccatacctcctctttatcttcaatgaaaaggtttgcctcaatcaaatggtggccaagtaagaccaagtgtcataacacacttaagcatctcaatgagcttttgaggaagcatgggtaaatgtattcacagtgcttgaaatgactatattccacatgactgcatatgcaatatgtattcatttgtgttagacaccatttcatctttacagaatagaggctcactaagcataaacacctcttaatcagttctgggtttctatctggatacaacttgatcaaatattcttggaattgatgttgagatataggccacttagtctcgagagggcatggcagagcagttaggatttctagaagatattgggaatgaaaggtaggcagagtctgcattgcctagaacaatgaagggaacggaaccagaattgcaacatatgctccttctccaggtggcctgtgcttctccttaaatgtttcagttcagactaggttctccatcagaaggaaaatatgccagggaagataagctatttcaaagggagtgaaagcagttgggtttggcttaacccattttgacagtgttactagaggcctttacaatgattgttggtggggagcataatttgacttctttcttgaaccctaagaaaggaccctgggttccatcagggaaaataaaaaagttaataaaaaataaaaagtaaaaaagtaaataaaaagttaataaataaaaaggattaaaaaaaaaagaacttctggtcagatgtggtggttcttgcctgtaatcccagcactttgggaggctgaggcagaggatcatttgaggccaggagtttgagaccagcctgggcagacagcaagatcccatttctacaaaaagtgaaaaattagccaagtgtgatggcacacacctgtagtcccagctatccatctactttggagactgaggcaagaggattgcttgagcccagttcaaggctgcagcaagccatgattgcaccattgcactgcacttcagcctcggtgatagatcaagaccctgtctaaaaaaaaaaaaaaaaaaaaggaaagaaaatagaccttctacatatatatgtatctcctcaagggatatgtaaataacatggggattatgtattgaagtgaattatctcctgcactgttatgccccccagtgaagtaattaagggatgatgtaggaggttactctctagctttattaacctgccaaatttattccttcaactggaatctttttcaactgattattaatgttttaaatgattgcattgttagctgagatttgtgttacatgaagtttcttttcatgtgctgtctatacttgatctgtaaaatgggactgcagtagtaacctccttcgaaaactcaatgtacaattttattattctatttgtaaaggaaatttatgaaccaattagtgagcagattgatacataacttctgtttctctgctacagaaactgaaatgtccttaaaatctagagtgctgcaaggaaaaagaaagaagtggggacaggagttagggtcgtgagagattagctaataaaaatgtatgatattctttttttaaatatgctttaaaaataataatgtattaatggtcatgacaaaatggatcagtcatttaaagctctttaacttctctgcatcttttcactcacgcctcactccaccccctcccataccacgcctgggttgttcccacggacctttctctcctctccttgtgcccagtccctctttcatgccacttccttgcagaagacgcaccagagtgccctgcaggtacagcagaaagccgaggtgctgctccaggccggccactacgatgccgatgccatccgggaatgtgctgagaaggtggccctccactggcagcagctcatgctgaagatggaagaccggctaaaattggtcaatgcctctgtggccttttacaaaacttctgaacaggtgagggaaaagactgtggggcttgtggggctgagattgccagggggccattttctgccttgcagtgtaaatgtgcagtgcttatgtcagcgagaagcctgtcctttcagtactaacatttgaagaatagtttgtggaaacaccacagttgactttcttatcatcctttccatttgagcactggactatggggtttgtctcataaatttctgaaactcaccagatctatagggaggtgttgaaatagaaattgggtgtatactaaatgctagatttgggcagtatattagtcagctgttaccaccatagtgctgtgtaacaaaacaatccaaaactcagtgacataaaacaataaacatttatttttttcttaagtgtcttaggttcagttgattttggctgaacttggtagaactaggcttcgagctgcagactgggtctagatctgttcccatgtctcttgtcctccttgacctgaagccatctcaggcacatttatagttaaaggcaggaatgcaagagtccaaaatctaccatacaagtgcatttcaagtctttgcttgtgtcatattctctttcatctcattggctaaaataagtcacatggccaagccaacattagtgaggcagcaatgcctcctatgaaggttgggagaggagaatgaatagttgctgaacaataattaaatctaccacagttaggcattatgcactacttgaaaaacacatggttctttcattccttgggcccccagtctaatggaggaaacacagctctctgtcattagggaactagaaacacaccagataagatgatgctgctgtgggagaaaaggcaggagctggacagtagggccataacgatgcagtgtgttaccctttcatctgtacagcaatatgcacagggctaagaggatttttaaaatgatttgggtgctgttagggaattctttttatgaaacaggtttaaaacaggagtaattttactcagtgtatagtagtttccttctctgaattgttccctggtagaaataaatcagagaatcattctccttggatgacttacagggaccatcggaaagtcttccttggagcaaatatgacatgcgcatcagagggccctgcagccagggtgagagtctccaccccttctttcagtcctttctgttgcttcagaggaatgactcctttgatggccacagaagtgaggagctgcagactaagatgatagagagcttccccagttgatccctagattcaacacagtctcaatcaaatcccagcaagctttttttttgtagaaattaatacattgattctaagatctatatggaaataaaatgcaaatgcaaagaatacaaatgcaaagaaactagaagagccaaaacgattttgaaaaggaagaacaaacttggacaagtcacactgcctgatttaaggacttattctaaagcagcagggatcaagacagaatcgtatctggtataagaataaacacaatgagacagaatagtggttatagaaatagatccacatatatacagtcagttgatttttgacaaaaaaattcaatgagtgaaggaaagtcttttcagcaaaggatgctggacaactgaatatccatatggaaacaaatgaggcttaattcctgtctaatattatacacaaatgttaatttgagatggatcaagatggtgaaggacactggagtaagagtcaagaaattttaccctgaagtgaccttgccgaaggttactttacccctctggatttctgtttcctgtcttgttaaagtatttctcatttcttctaatcccaaattgtttgcttctaagttcagtcctatcatgggacagatctcaagtactctttttcttaaagtttttacatgtctttaagctgttttatctcaaaacatgagctgcctgcacgtttcaggccttgcagaaagaaaggtgtgatgctagagatgggactagagaagtcacctcaagtttgatgacagatcttctcatgtgatgctagagatgggactggagaagtcacctcaagtttggtgacagatcttctcatgtgatgctagagatgggactggagaagtcacctcaagtttgatgacagatcttctcatgtgatgctagagatgggactggagaagtcacctcaagtttgatgacagatcttctcatgtgatgctagagatgggactggagaagtcacctcaagtttggtgacagatcttctcatgtgatgctagagatgggactggagaagtcacctcaagtttggtgacagatcttctcatgtgatgctagagatgggactggagaagtcacctcaagtttggtgacagatcttctcatgtgatgctagagatgggactagggaagtcacctcaagtttggtgacagatcttctcatgtgatgctagagatgggactagggaagtcacctcaagtttggtgacagatcttctcatgtgatgctagagatgggactggagaagtcacctcaagtttggtgacagatcttctcatgtgatgctagagatgggactagagaagtcacctcaagattggtgacagatcttctcatgtgatgctagagatgggactagggaagtcacctcaagattggtgacagatcttctcatgtgatgctagagatgggactagagaagtcacctcaagattggtgacagatcttctcatgtgatgctagagatgggactagagaagtcacctcaagtttggtgacagatcttctcatgacatgagaagcatgtctggctatgagagcgttcttcctgggacagctttcagcacatctttcagttcagttcataactcaatgaatgccctatccaaagacatctttcatctggctgggcacggaggctcacgcctataatcccagcactttgggaggccaaggcaggtggatcacttgaggtcaggggttcaaaaccagcctgacaaacatggtgaaaccctgtctctactaaaaatacaaaaattagctggatgtggtggtgagcgactgtaatcccagctactcaggagcctgaggcaggagaatcccttgaacctgggaggcagaggttgcattgagccaagattgcaccactgcactccagcctgggtgaaaaagctagattccgtctcaaaaaaaaaaaaaaaaaaaaaaaaaagacgtttttcatcaaaagactttctcagagaaggccaaagatagtcatagcagttcttccctactgccgtatccaaacaagtaatcaaagtctattgaaggaaatccaatcattcccaaagtctactgaaggaaatccagtatccatggggtatttgttccaggacccctcacagatatgtacattctcccatgtaatttaaatcatctctggattacttataatacctaagtattatagtaaatagttgttatatgctattgtttttatttgtattattttttattgctatactttttaactaagtattttcaatccatagttggttgaatcatggatgtagaacccacagatttggaaggatggctgtataggtatatgagtttcaattttctgcatcctcctccaggccctgatactaggctgccttggtttttccactatgggacccaggctgaatttccctccaaactcccttcaaaatgcttttgctctcttctgagttcatttataaggtcacttagcatgacctctcagcatctttagaactaaaaagcttcttaactgtctttcaggttaacccaaatttgttacccctctacaggaaatgtgtattttgtaatagaggttctggagatgtcatgtcctatggtgggatttttgagacatttttccccaggggaggaaaaagatgacattcatttatggcctgtaaaccatacaacataggcaacttcctcctttgtctctgcttgaggctccttactatgggacaagtacagatggtcggataagtcaagtatcttctccaaacctcatttcctgttctacctaatttatagttattgtgagattataacaatataatgtgtaaaaacactgaaactccaaagatactagactgtcttactttcttactttacctactattcctaggtaatgtcatcaactcccataaaaagatgattccaaaatctgtatctccagtcatcatgtctcccaggtttcagacacaggactgtcactgcctcctggatttctcttagatgtctcagaggcattaaacttctaatgaaaaatgtcatatgtgtaggcttctataggctgaaggtcctcagagaataattcctgaataattaatttactgagtcttttcttccatgattcactaggtgtgtagtgtcctggagagcttagagcaagaataccggagagatgaggactggtgtggtggacgagataagctggggccagcagcagagatcgaccatgtcattcccctcatcagcaaacatttggaacaaaaggaggcctttcttaaggtcagagcacattgtcatgcaagggctcagactcctggccttggccgccttgttctttcatcctctttctctttctcttttctttctttctctttctctctctttctctttctctctctttctctttctcctcctcctccttcttctccttctctctctctctcacacacacacacacacacacacacacacacacacacgcagcttcaaacatgcttcccagcccctctttttttctaacctcttccctaaaggggtaagggaatgtaatgaagatgttgactggttaatttcaaagggtgaaaggttacatttccaacatttatttctctcttgcactttttgtatagttaggcgatcaggatacactgttactactactgcaatcttcagatatcccagtatcccgtggatgttgttaactgagaaaaagacatgctttcattcagttgtgtttggctaattaaattattttttgatagtaatatcaaaaacatataagcttagatataaaacatgattaaaatattttataaatggaagatgcaaaaattagggtaagaattaaagaaatgaatttggatgccctatttatttatcaatctagcaattaccaattaccaacacacatgacactgttcattcttctgtattaagagagaaatgccttattcctaatattctgctagagccctgccttctgagggaggaagcacaggcctgctctgcacagactgtcagctggtgtgggaagtccttgtgagcctccttccccagcctttgatcttctcctctgatcgcctctcttctgtgttcaagctcatctaaaggctgcatttgctctcagatttcttgctttcatgttctgcttcctctcaggtttctgggaatagaagagacaatttttataccctgacatgttgccattgattttattcaattctgtaattaactgcctttcttttattagggattttctctacttgactaccaccttgagcttaatttttattttttttaagctggcctctccctgccctcctcctatctatctggtatccgcacctatatgggtcagaacctctagtaatcagctcttactagtaagactaaatagaaattcttctgtgcagagcttatgatgattttttaaagttttccctattacaaagcaaattttaaaatggaacaatttaagtagagcatataaaaatctcaaacagaagtgtaaatatatttcttcataaaattaaaagaaaatgtttctattgaagaaagaaatagaaaaccctctggtctgatgttttccatatgtccctgaaaccatagtgagaagctccctgtcactgtgggaatgatatgcccagtaaatagaatattgagctctttatttatattcattagttgatccacttgaaactccttaagctgagaccaccatcaagctgttttattcaggagcctctgtgttcatggacacaccagcaggcgtttgtgtaccagatattccagatgcctttgttgctaatttttttatataaccagaaaattataaaattttataattgtttctattaattatataataatttttaattatattatttgtaggatcagagggaaagtataagattctaaaattttacatttcagggtgtgtagaagaaaaaaatttcaaagaaaaatgaaataaaatttcagtttatctagagataatttaattctgaaaactatggattaaaaattagtatgctagtatttattactttacaaccagaaaaaaaacctgctttgtagagaaatacagaaagtactaggcttgagaggaacaagaaatactgtcagtcatcctagatcctagatctgtgttgcttcctggctcctgccctttctgggcaccagtcttgtccatcagcacagcaaggagaatgtgatcagccctctctctgccacccacagctaatatgagtcgtaaagggggtaggtaatataacagctgttagtcctttatgtagactggcattcttcaacaatagaatgcttattagtgatatttagatgagggggacttcatgggcaaataagtctgaaaaatgtttgtaatttccatttagatttggaatgtagggttaatagatgtgtttaccaaatttacttgctcaagtctaagtcacactgattttcaagtgggtttatgtttcctgagcttacaccagtggtcacgtaagaggcattctggtggctgaggaaaagtaggctgagagtgaatgttagtaatgcctgatcaacatagaaggagacgagaggtggctcatttctgatttttatctgagatggaatgggcagagacacaaggagtaattcttcacttgaaaaaaggaaagctcagaagggtgagctccataaattggaattggagtctccatgaaccagtggtgacttccagagctctgctccttctagattccttcagagttcttgagcctcctaaaaagtataaggaggagccaggtgccatggctcatgcctgtaatcctagcactttgggaggccaaggtgggcagattgcttgagcccagtagtttgagaccagcctgggcaacatagtgagacctcatgtttacaaaaaatgcacaaagttacctaggtgtggcggtgggcacctgtagtcccagctactcaggaggctgagatggaaggactgcttgagcctgggaggtggagactgcggtgagctatgatcatgccactgcactgcagcctaggcaacagagtgagactctgtctcaaaaaagaaaaaaaaaaaaagcaaaagaaaatatggaaggaaggagggtatgccttctccattgtcttggattccatacacctgctgggacaggggcctcacagctttgtctttcgcaggcctgcaccctggctcggcggaatgctgaggtgtttctcaagtacatccacaggaacaacgtcagcatgcccagtgtcgccagccacactcggggacccgagcaacaagtgaaaggtcagtgagagacctgcccagccaccagtcacttcagcgacagcccctccctgaaatataccatgtacccagttttcacacaatctcaaatttcctgctgcttctccttagaaatgaaaatgtatgatgtgggatggtgtgggcagtaatgattcatggtcaatttttaaacacgcatcaagatctggaaggcaaaaacaaggataaaatttccccaagtattttcatttatcttagagtctggacagcactgcctagtggaattttctgaaataatggaaattgcctgtatctacgctgtgcaatacagcagctactgagctagtgcaactaaggaactaaattttaacttgtatttaatattaactaatttaaatgtaaattactgattttgattcctggttaatatattgaacagcacaagactagggtgtcttatagcctaggaacagaatgtggactgagaatcctaaaaccaaatgctgaccctggatttgtcactgattgattaagccttttaaaactttagtttcttatttaaaatgaggggagcatctagactcttgctcctcaaattgtagttcccagaccagccacaatgacatccctaggagagtgtatgaaatatagaatctcaggccacacccaaaccgactgagtcagaaactgcattttggcactttgggaggctgagatgggagggttgcttgaggccaggagttcaagaccagcctgggcaacatattgagaccccatctctacaaaaaattaaaaaattagcctggtatggtggcgtgcctatagctctagttattcaggaggccgagatggaaggctcatttgagcccaagagctggaggctgcagtgagccatgtttgcaccattgtactccagcctgggcaatagagtgagacgctgtctcaaaaaaagaaaaaagaaaagaaaaaaaagaaaaaaagaacaaagaacctgcattttggcaaaactgcccaattctaccaaccaggtaatttgtgtgttcataaaatttagataagtgctattctacataatctttaatatctccgaattctagaaagtctatgataataaatatataacttttaaaaattgcctattatctgaccatgtgaaacttaaatcattatctgtggaattattctgaccatgcagaaattagcctttgagtgagtgaagagtttaacaaatgtcatcttgccaaggcagagaaatataactctggagtccgaggctaggaatggaacccaagccgacttggagtgaggagtggggtatgggcttggagacaccatggacagggtagggtgcgtggtctgcttaagaagagcttccctctttgctcagatagctcaagagttggagagaacagagaccactggaaagaatggaatcaaagttccctacagagaggagggagcagagtttctcttccaaatgtgctattctatttgtggtcaggggacctgtggggagctggtattatgtcacttcttccagcacatttgaaagcatatgttctggcttccaaatgtagatgggagcttgggtgaggccagctgcctactgagagaccacatatcccacctacacctctgcgtgctgaagaataacaggcacccagagacagtgggaaatgcctacatcttcttggaggcaagaccaagttgttgcccatgtaaaagctttcaggaagaggggggaaaataatcctgaaactctttatgatttctgccagatctgggttgattccctcagtcacaccatagagggagggagcttcaatgagcaaaactctggctagggaacataaagactaaaagaaatgggtttctactccttccttgcccaattgaagcttccacctgagcagggacctacaatcccttatatatcagtttccttttcacctactacctagactcaaagccagtgccatatatttttggcttttttatgctgctggttgttatatggctgcataacaaccaagaaattcaatgatatccaactgtaaacatatgttgttgaagtggctgtgcattggctgaggagcagcatctcaactgggctcagcagtgcagttgtgcttcagtctgcaagtctagctagcttggctccttcactccaggtaagagcttgtttgctccacgtgtatttattctgggacctgggtcgaaggggcagcagttacccaggagaatttcctatagtggtgatagcagaggtacaaggagcaaagtcaagtctgcaagtacatttcaaggccctgcttgtgttttatctgttaacaactcatttgctaaagcaagttatgtagctaagccagagatcagttggggagtgagcaactgtacttgcctctttgggaaggaatgaaaaagttacatgataaaggcttagatacagggaagggtgaatgattggacccaaaaaaggctgagcacggtggctcgcgcctgtaatcctagcactttgggagaccgaggaaggaggatcacttgagctcagaagtttgagaccagcctgggcaacatagtgagacccccatctctacaaaaaaaaaaaaatgtttacaaattgactgggtgtggtggcgtgtgcctatagtctcagctactcaggtggctgaagtgggaggatcacttgagcctgggaggttgaggctgcaatgagctatgactgcactccatcttgggtgacagagcaagaccctgtcaaaaaaaaaaaaaaagaacaagaaaaagaaagaaagaaagagagagaaagaaaaaaaagcacttagcctaaaagatgaaaaacagattctgtcctcagaaagccaaacttggctggggaggtgagaatgaaggagtatgaaaagtacataaaatcaacaaaaacttctcagtgcaagcacttcactttgggttgtaccatcttcgtaaagcatagaaagttgtactttatagtcttagtaatatgggagaccaaggtgactaacaactcaggctctgaagtcagatttggcccgaatctgaactctgccctttcctatctgaacaaccctgagctagttaccttccctacgctttctcaaaagctttctctaaacctcagttttctcatctgtataatggagataataatggtgcatgcattatggggtattataaaaatgagtgtcttccacatactgagtatgtgatattcatatggttattattgtatattttgttaatatctaatatagcaacaggaagcaggaagaagacataataaaataaatttgattgcttccagcatagaacatactatttaaaacgcttaagacatctatccacgtacccagctattcctgaaacaacagaaaatttagagagggaaatagcatggactgaatacctaaccatggcccacttgctttgctatatgccttgtatatacactcatttaacaccacttttagcttttcttatgatcacatccaaaacaacatgggcccagagacaacaggaagacataattccaacacagcttccctatgaccactatttagaagtgtttagaggctgtgccgttaaagtgctgtgtgcacaacctcttgtgcaggtccaagaacattgctcatgatgtgggttgtcaagccagtgataccagccctcattccactataaatctcctgcctctcttctaatgagtccttaagaatgactgagattcctgtcaaggtccacccatgctcattagactctgggggccaattgaattagttgcttcttaagatttcttagaaccaaggactaattttgctataaagagaatcggggtcatttgtaagtcactggtgttatattcttcccaccttagttgatggaactctcatcaatgggctctccccctagactcctcgaccttgctcgtttctaggaaatcctttctgtatccagcttttgctccctttcttctgatgctggattagtctcatggggatgcttgaaatcacagtcatggtcacctggcacctgggccgtggggctgaaggggttggttggatttgctcagagccccttgtgaccatcatgcatctcctctgcccacagccatcctgagtgagctcctgcagagggagaatcgcgtgctgcatttctggaccttgaagaagcggcggttagaccaatgccagcaatatgtggtgttcgagcgcagcgctaagcaggttgtccaaagctttccctggcactatctcagttctggggagcatacagaggcccatcaccaaggcttagtccagaagagggccacagcagcagattggggatgggagtggggaataaagaagaaagaaagcaggttgtcacctgtcagcagttcagcatttaccaagctctatgttttgagtttggtaccaggagatgtgaggaaatgctaggtcacccactatgcccctaattcgtggatgatattaggcctggcctagaagagtcctcagtctactgggggagaccctctctttgctggtaaatgttccaaagcaagggagggctcattcataaaaaaaaactccagagctacataccaatcaaattgtcagtgtttcctgggtccattaagttgtcccaacaataaccttcattgtagtatggcatgttttcctactgacagctgcctttttggggactggatgagttgtttcctcccataggcgcttgactggatccaagaaacaggtgaattttacctctcaacacatacctccactggagagaccacagaggagactcaggaactgctgaaagaatatggggaattcagggtgcctgccaaggtaggaaacatcccagagcctcccccagatccacccagaactctccattctggccaatttcacattatggaagcaaagacagcttctgtaagcaaaaatacctggctacagtggcaaggggggaagcatgtaaatgtcctaaaggattgtctctttagaaacctgaatacccaaagaattgcagctgctgggtagagcagctgtatgcaggaagtcaattgctatatactgtgcttccagatactcatcttcatgcttcaggttctggaatctgctgtattctttcagaccaaatcagggaaaagggtgtattcatgtaaaaatgtcacatgtgcatgtgaacactgcagatatccacatattcttgcactttgagtggtttgggaagtccaccttattagaagggctagtgactatatatgggtacacaaaacaggtgaatttctccttttctgagctatttccatctggcctcaaacccgctcatgagctaggctaggctgggtctctggggagcaaaatgtgcaaggatgtacataccaattcataccaagattgtgggaaatgctataatagaaggaaacctgattttcatctgttttcacagccaggatttgatctgaggatgcttgggtttgaatgaaaatctgatctgtctcaagttcctctttgtaacgtcctcatctctcacacggggctccttgccacacaggaggcttttttggcatcacttccacacaaaacatatgctcttcccaggttaagagatgttcttgttggggtcaaggtgggaaacatcctatccggagatccctctgacactataaggaatgttcctctggtttggtgtgacaaattaggcccttagcctcattcctgagctgatatttcagaagtggctatccactctatgaatcttttcctatgaactctcaatattggggagcctctccctgcatccttgtgaattttgggcctttttgtctaatgcaaaaagctatgagcacagataagagactcatttcaataccagtaaaagcaaacagcacaaagaaggtggcagatgcacagaaccctattcaaatccaaattaaaatggctgtgaattaacaagttggctttatccgcccttctccaaatagggcttataatgagccattaacaggctgaatagtatgagatccattggtgttcctgtctgcatagggtggatcacagcagatacccagaacgtcataggatcaaaatctttccataatcaaagtggaaatgtgaagaattgttcagtcaatcttattcatcctacctttgtaactgtcttcatatatttctcctctttttcattcacatagctactaccctgagctgtagtagcttcctaatttgattgcatgcctttggtctttccttccttccaatccaccctgtcctttattgctattcatctttaaaatgctactttggtcacataaccacccagatcaagaactttaatgattttccaatgcctttaggataatgctccacaactctacagctgtgctaccctacctccccagttttattttcaattattattttatgcaggctttatgctccagctgaatggatgtattctctgagcctctgagagatacatcatattcttttttgtctatgtgccttttttcatacatttctctgcctggaatacccttcccttccctctagtttgtgctttttaagaggagcccctcctttccactctagagcctcctcctctatgatccttcccacataccaggatatgatccagctcatccctgcactacggcccttgtccgtataacccttcacctggcacagaccatctctcctccagtaatctatgcaatgttattgcctatataagccgacaggatacttaaagacaagaaccacactattcattttgagttccctaggttacctaactgcattttacacattcaaaggaggctacaaccattcaagaccataaggaaaaaaggaagtttgagtagattcaccccctcctcatttatatttaatatgaatcttctactttggctgtctatgttctctgtccctcctgatgtaactatcatgttccaaatctcatggttattcatattagaatatctacaggataacaaacccagttgaggagcttctgattagaggcagcagcctcctgccccaccctaatcccactttccagaggtaaacctcttctaatcagctgtctttgattataatctttataaccaataaaatgaatttgaaatggaaaccaaattgacctttagccacaagagaatacatacagtggcccttatggttgaatagggcagtggagtacattgaatttaataatactgtggtccaaaggaacagaccaagtagaagaaccattggatatagaaagatactttctatgtaaaagctcacaaatacaagaataaaaatgaaataaaaagtttgaatgaggaaaaaaggaaaacatcattttcatgttgtggtaggcctatagacagtccattaaaagtatagaaatggtattttcctattatgggtttcaaaatgtataaggggtcaaggcacacggagatggggaagcttagtcatcatgacatttgaaagaactccatttcttctaaaagtaaaactttttaaagattatcttgtttttcattttttacaaattccatggtttttactatattcacaaagttgtgcaaacattgccactgtttcattccagaacattttcattaccctagaaagaaacctcatgcccattagcagtcactctgcattccctactctcctcaacccctggcaactactcatctgctttcagtctctatgggtttgcctgtttgggcatttcatataaatggaatcatacaatatgagatcttctgtgactggcttacttcccctagcctaatgctttcaggattcatccatgctattcgcatgtatcaatccttttgtcctattattgctaaatagcatgccatttcattgatataccactttttgtttactattcatcagttgatggacatttgggttgtttctggcttttggctgtcatgaataatgctgctataaacctttatattcaagttttggcgtgaacagatgtttcagttcccttatgtgcatacctgggagtggaatggttgggttatatggagttctactatgtttaactttttgaggaactgctaaactgtttttcaaagtaggtataccattttgtactctcaccagcagtttgtgagggttccagtttctccacatcctcaccaacacttgttactgtgtctttttatatagccatcctagagggtgtggagtggtattcattgtgggttttgatttgcatttgccaatgactaataatgttaagaaaatacttttttaagctggtaatttcatctctgaaaatgaaagaagccttgagataaactggacttaattcatcttgacaaaagaaaattaagtagtaatgaaagcaactggagccttagctgaactaaactatgatttcctgagattcagatagcaaggaaagggaacactggggttgtcagatggtactttagaccgagagaggtagaatctaaacagttcagataaaagataggcgtgatgctatttctgagactcttttttttttttttttgagatggagtttcactcttgttgcccaggctggagtgcagtcatgtgacctcagctcactgcaaccttcacctcctgggttcaagtgattctcctgcctcagcatcccatgtagctgcgattacaggtgcttgccaccaggtctggctgatttttgtatttttagtagagacagggtttcaccatgttggccaggctggtcttgaactcctgaccttaggtgatccacctgcctttgcctcccaaagtgctgggattacagacatgagccaccgcgcctggtctttctgagactctgaagaggaatatagttcatatgtgatggaaagttttgaaaattttggttcttttatgtataataacaaacaatcccctgctgaatgaatcagaagatgtatttcaagaaacctattcacctgcacaaggagctcagtaaatttgtgtctacaaaaaaaaattgataaggaatatcaatattccttattattatctcattataaggaatatcaataatgaaaggcaaatatagaaaattatgagattataagattactatcaagaagacaaaatcttaaagtcttgtaaaatgtgctaaagtcaaaagggctttaaaaaaatttactcagagtgaggctcactgattagaggaagatcataaccaaagatagaaagaaagggaaggaggaaaagagagagtggggagggaaagagagagggagggatagaaaaaaaatagaattactgaacccctcttttgaacctctgtcttttccagcagataactagaattcaaaatggagaggcaagacataaattaggggacacatgaagcccaagataagtgagctctcaggtctagatttccaggcccagatgaattatggtacccaaagtttcccttttggccacaagatcatgtccatacttctgaacttttcattcaagaactgctgcagtctgaccccattttattagtttctataagttactgtctttggaggaaagatttgagtttcaagtgggcttaggttgaacgagaaaagatatgtatggccacgtgtggaaataaagaagatagaagcgatgtgtctgaacctcccagaaacccagaaaaagctcagtgactcagccccatgggaagaacaagaaatgtggcatagtgtcacctctggagatgaaaactggaatgtcacccaagaccaagggtgtctcaagcagccacgtcatctggtcatcatctgagagtggaagaccagaatctgtataatgttctaccatttctataccacagcttcctttttcttcttcctctctgctttctgtgatttcacttctactctgcaagcaatcacccagatccctgtctgtacagtttaaatcctcagggaaacaaccccaattgacccagcttatttctagtcccctatttagacacagcttttaggccaggacacctcagaagtcactggctgcatcttgatgggctgccctcataagacaagtttttacctctgatctcaaaagctgtgaccaggcatttggcaggtcatgtggtgccaccacaatcacctatgtataagaaaccatttcagaatactcccagtggggaccatggccatggttgatgtctaagtgcacttatccaattcatgggccaaatttatcatctacttcttcccaataaaaatcttcaactcttgctggtctagctttactcacctccaaacacaagatttgctcattcattcattcagtcaacattgatggtatgcttactattttctagacactggagatatacaaatgaataagatataatacttaccttttagggttcatggtctaatgaaggagacttataaataatgtgatgtatgctaaaatagaagcatgtatgtgatactgtgggaacactgggaaggcattgcccacttgttttttggggaggagaggagaggaaaaagggcattcaattgagagtgggaatgagtaggaaccactcatcacagcaggagaggcatgcaacattcaacatggctgcagtgtagggaatgaagagcagtggagacagggctgctacaaaggtaggtggagccgcatggggaagggcgtgtctacacttccctctacctacttcctaaggatgcatctaaactcattttactgtctctttgctcctctagtccccacacatacctagaatactcttggtcacaaactatttgctttgctgactccgaatcacaattttgatgttttaagatataattttctctggtagagctgccctagtatggctgctgccaccagctggctgtaaaaccctttcttataggtggagtcactttaccaagagcagagaatatgtatttccaagacttttccataaacacatggtctctgttttaagtaaatagaaaaccaaagaaaattgttttcaggaaaaataaaaataaaaaacaccctacatgcaataagatgaaagtcctcaggatgcttagacactggagatatataaatgaataagatgattaaaaaggggttcaataattctagtttagatagaatcaagtagattctattttgaatagaatctgctaattctatcttaaccaattctccctgttattactctgccttttcatggctgaggagatgtttcggctatcctcacacctacctcctttccttcacaccaaagctcttgccctttatcttccagtgccaggcaccagcctactgtcctgagataggagaggctccatgtgccgagtgagctactggagagctggatccctggtccctggtccctggccatgtgtgcggcaggcagagcactctcaactctcctctctgacgccctctttctccagcatttcttgggagggttgatctctcatgggaggggctgtagataggcctggaaggagcagatggggtgaggatagtagaataaagaaagaagggctctgttgttttttctgctgttgctccagtgatgttttgcctcagtttccctgatatctagattgtagcatggtttaaaccttggacccactttcctccagtccaaaagataatttttcttcttagaatagtatttaaatgttctttcctttccctgagcaatttcagagtttgaaaatccaaacttaggattaaaaaataagcagcagtctgcttgttgggtgtctctctcattcccatgacttacccagcttaagtactgcttctccgtgagacctcccctacccatgcctgtccgccttcattttctccttttaaaattcctatagtgttaactctacattctcccattttgacattcaattacataatgccctgagttatttacctactctgtgtgaaatgaagatttttttccttttgtttgacccccaagccctaaactatagctctttacacagtactacggaccaagtaggtattgaacaaactcttgctaaaaatgaaattaatccagtaaacatcagagttctactttacctagtcctataatagatgatggctttattaacctctttctcctgctctctaatggaaactaaagacaagattctggtggtgacagggacagagttaactcttaaatctgctcattgtatttatttagatcctggcatgtgccaacttatatgaggtttagagctggtacagtggagagggaaactaggaactaaagggcagagacaaataggctctgtttgctcactggtagtatgaagttggaccagccctaagcctctctaagcctcagatttttttcatctgtggttcaaagagacctgcatcacttccctccacctacttcctaaggatgcatctaaactcaaatggctttcagatacagtaacacactatgtaaattaaaagcatattaatgtaagagattcttacatcagtaataataatggttaatgtttatggcttactgagttcttactgtcttccactgtactaagcattctacatttgtcaactcatttaatacaccagccctctgaagtaggatcagccctccgtatctacaggtgtcgcatccgtggattcaaccaaccatgaactgaaaatgtttttttttcaaatggatggttgtgcctgtactgaacatatacagactttttttgttcttgtcatcattccctaagccatacggaataacaactatttacttagtatttacattgtattaggtattgtaagtaatttagagatgatttgaagtgttcctgaggatgtgggtaagttgtaagcaaaaaccacaccatgttatataaggaacttgcatatctggattttggtatccatggggggccctggaacaagttccccccaccccagcactgagggatgactgtaatattatgatttcctttttgcagatgaagaaatggaggcacagagggtttcaataacttgctcgagatctcccagttagtagtaacaaagctgggatacatacccaggtagtcagctatgaggtatctatggctgctctaaacaggaagagaggatttggggtgaaggggcaggagaataaatgtaatccagtaacttaaggccatcttttggggcagcaaacaaaggagaaggtgaagcttctgattcagctggccgatagctttgtggaaaaaggccacattcatgccacggagataaggaaatgggtgaccacggtggacaagcactacagagatttctccctgaggatgggaaagtaccgatactcactggagaaagccctaggagtcaacacagaggtaggcaggggtattgtcctctgggacatcctcccttctcatctccctgagcaccactgccctcatcgccatggaagaaaagcatgtttccagagcagttcttctgagctattgactcctagagcgcttgacttgtgtggcttttctagtggggagtgctgggtggatcttgctgatccattaaccttcagtcccctgtgattagtactctatacattacaaaatcgactggccagtagtggggcctatggctacagaacagagtttttctctgtatagagttaactgttgactttgagaaccaaaagctttatcttggcttcataagtaccatcttccacccaattatgttaatcagcaaatgattagagtccccagtatatataatagtactctttcaagaataaggggtgcaatttgtacaagggttatttgacatttcaaccgaacagaggtacaatttgccatgaaccagggaagatggacttttaatctcttctttataataggggttagtaacctgtgaattaagagcttaatacagcctggcaatttaatcctaggatgtctaattcttaaatcttcaaataggctcatgatctgaagcagagcagcctggagagtgaagtggccaaactacctaaagttgagagagttaatgtctcccccaggctttaatctgtgagtttttatctaggaagttccatcatatataaataccaaatggtggttaaaattagcagggatgagcaatgagaaagttcagtcattgctctgttatttagctttctgtttccaagggaaatttcttgtttaaataaatatatttgatttgattattttcttttgacaaatgaaagatgtttttatatctttatgtgtttttgtttcacatctattttaaatggttaagaatcagtcttagactaatttacgggtgtgtttagatttaattaggaccaaaggccttggggaaatagacacataattatcaaatatgttcattgttttttcttactatggatatttaccctaaacatttgacctgaacattttatttctctcttatttgaaaaaacaataatgataccatgaagaagagtgcttatgggtatgagtctgtaagatccctcatgtttttatccttctccattatatctttttttcccccttttaccacctccctcaactccagtgagttgctttcccaaagcatcacaaggtgacctttgtgatccctccatgtgcaggataataaggacctggagctggatattatcccagcaagcctttcggatcgggaggtcaagctgcgggacgccaaccacgaagtcaatgaagagaagcggaagtcagcccggaagaaagagtacgtgttggcttccgcccagctagctggctccccgtgactatgctgggctttcaccgctacttgtccctttggatagcttaatatgttctcatggccacctacagggattgggatggacagacataatgtttgcattgagaatatgggttccctctgaaggctttgaagtctctccagtctgtccttcacctgaattctctttacatttcagtaacttcctagacaaacccttcctcatagatcatcacattttacttcacaatgtcaaaactcaacttggaacaaatcaaatattttttcttctcctccaaattttattctgccttctgattttttttttaagttttttattttttgggacagagcctcacggtgtcacccaggctggaatgcagtggcatgatctcagctcactgcaacctccgcctcctggattcaagcaattctcctgcctcagcctcccgagtagctgggattacaggtgtgcgccaccatgcctagctaatttttgtatttttaatagaaacggggtttcaccatgttggccaggctggtctcggactcctgacctcaagtgatctgcccgcctcagcctcccaaagtgctgggattataggcatgagccaccacgcccagcctctcccttctgattttctaattcccatcaatagtgtcactaaccttctagttttgtctggattatttgcaaaaacttcccatagctttcctgctgctggtccctgcccaattcacctgcacagtgatgccaggtttacctttctggagtacattttattattgctaatatcaatactcttcctgccaccagcacctacactttttatgtcctaaacattacataaagtgcctttacacacattttctctttgtatctttctatcgcttctttcaggcagctatgattattcccattttacatataataagtcttagaaaagtcaagtaattttccccaaaccacacagatggtgagcaatgaagccagaatttaatctagctttgactcttcagcattctttgatttctttccattatgtctctcaccagcttcaaattgtaaatggtttgctactacccctggaataatgataaaactcaaggtactgctatcgtttgtcctcatctaagtcaattttacttcaaaatactttctagttcagatcacacccttcagtcagatcattttcactgactcctctcaggtctaagaataaattgtatataattgagaatactctgctggccgcgtgtggtggctcacgtctgtaatcccagcactttgggaggccgaggcggttggattacctgaggtcaggagttcgagaccggcctggccaacatggtgaaaccccgtctctactaaaaatacaaaaattagccgggcatggtagcacacgcctgtaatcccagctacctgggaggctgaggcaggagaattgcttgagcccaggaggcagaggttgcagtgagccgagatcacgccactgcactccagcctggctgacagagcaagactctgtctcaaaaaaaaaaaaaaaaaaaaagagaatgctctcctttctgtttgttattttccctttcgtttcccttcctttttttcctgtttggttttattttgctctgtgtaagtcctattgattctttaaaatccagctcatatcctatgcctctataaatcctttatctacagcccccactgtcattggcccatccttttatgaactcctttacttctgtactgattcccattttacttattcagccaattcttaagcatatgtccctagctagattgtagactccttgaaaacaagaagtattttatactctgtagtatggatcaagggactagcagaaaaatgaagataacataattattgatcaagaaaagcttatagtcaggcagggcacagtggctcatgcctgtaactttggggggctgaggtgggcagatcaccttgaagccaggagttcaagaccagccttgccaacatggcaaaaacctgtctttgctaaaaaaaaaatacaaaacttagctgggcatggtggtgtgcacctgtaatcccagctactcaggaggctgaggtatgaaaatcccttgaacccaggaggcagaggttgccatgagccaaaattgctccactgcactccagcctgggcaacagagcaagaatccatctcaaaataaaaaagaaaggaaaagaaaatcttatggaatataattggatatagaaattgaaaccttgagggaagggcaggacgttatttaaaatcacaaaacaaataaggactgtaacatcaatttctttacttgaagttgagggatataccactgggccagaagaaaataaggcatgctttaggaggcattccagcatcagatgggccctcctcccctgacttgctctaggtattcagatttcaaaaggaagaaagaggtgcttggaaattggtccagtgagtgaattgtagatgttagaatgtaaagctgccacctaagtttactcctaggtcagcaatagcccatgaggagatgaggcagaggaaaataggcaagaagagagtagaggatgctgagattcaaacattttgcaagaatctgaagtagctgaggttttcataaattgaactctgttttctcagaataagaatgaataggggccagaattcatttagtgagctggaaccaacttatcattagattcctgctttgctctctaagtatctcagctccactttcagaaaagtcctgactccaggtaggcaaaacacatttttcttctttggttgtttggtagggagttgtctaccaacatttcactctaatcaagaattacagagcattggacagggtaaacaatgaaccgtaccaatcttataaaccatttcttgacactgcttcctttatgctggagttacaaagtaacacatatctagagatttctggaggactttataaagaatattttgacactctgtttgtgaattactagaaaaaaatagtatgtcctaagattaagaagctctatatagtttattttatcaagatgaagtaggaccacaggttccttggagatgaagaaactaaagctgctgtgtgaatcagagcttgttcatatggggagtggatttgtttgttggggctgctgtaaccaagtaccacaaattgggttgtttaaagagcagaaatgtattgtctcccagctctcgggactagaagcctaaactcaaggtgtcagcagggttgattccttctgagggcagtgaggggagggtctgttccaggcctctctccttgatagcttgtagatggctgtttccgtgctcacgtggcataatcccagaatatatgcctgtatcaaaaattcctccttttgtaaggacatcagttgttagatccaggggccactctactccagtactgcagtgatactgtttccaaataagaccaaaatctgaggtattggaggttaagacttcagcatatgaatttcagaggcgtcataattcagcccatatctgggagggggatgaggggactatacctggccagatcttcctccttggttccttctgtgacaacaaatagccagaagagattaaaggatgggtggaaaataaaatggggtggggatagcagaggtaaattgtgaggaaagacaggtaaaactgcaggaagcggatgagaacaaaagaacaattctagaaaacttaaggcaataaaatcaaaggcaagttctcaaaggccgtcagtttatgttccttctgatctcccttctgtcctcatttcatcgcaatctacagctcatttaatcatggaatgtttcctgagcacctaccatgcactaggcatgttgcttacgtgatcttgtttaatacttgcagcaattctgtgtgatcagctattttataagtaaggagtctgagacctggagaggcaagtcctacctctggttgtaattcagttcctatctgtctgactccaaagcttatgcactttttactctaccaatagagttcaattcaaagaacagaaaaatatagaatataccacaacgaggccatgtatcgtaagtttaacaattgtctaagcacattgtattatttagaggcccaaggaggaagagaaccctctctttaaagatgcataacacagacttctctttatgggggactgagaagcagtcacttattactaatttatactgtgcttatggttgcacgttcagttttctacacatccgtttatgctgtaaacaagtcccattggaaatagtactgaaatagctgagaggataatctaggtcagaggtcagcaaacatagaccaaatttgacctaccaactatttcatatggtctataaactaaaaattatcttttatatttttaaataattggaagaattatcaaaagaagaatattttataatgtgaaaattagataaaattcaaattttagtgtccataaatgtttttattggaaaacagccacacttatttttttttacacattgtctatggctcctttcacatgacaacagcaaagttgagtggttgtgacagagaccgaattgcccacagagatttattatctggctctttatagaaaaattgctaacccctgatctcggtgtgttggacctcttttcctggctttgaaacctggtttattatgatactaagaactgttttggtatatatctacaaactctactgaacagaaatcttcattctgggagctgtaggagaaatgtggaaagctgagattcaagctatctagtttagttggtgagacagaatatgaacagtcctacatgcctgtactcacatgaatatcaccacagaatcacaagtattaatagtaggactggggtggaaaagggagagagaatatggacctagctgagcacaaacctgctaaagggttacagggccaatggtcaggaaatatcacaagtatcataggaagatacttgtaggaaagggaaggaattttgaagaaaggaaaagacctgttgatgaagtagaaaaataagacatttaagaatgtcatacatgctggggtggggaagtgaagtttgaaggaggagagacattatatctatatccaagtaaaagcccatttgtttccttctagatttattatggctgaactactccagacagagaaggcttatgtaagggatttgcatgagtgcttagaggtgagtcttccagtaatccgttcacagctatattggaaaaatgacatccttgccagcatcaagtcctcaattggaatttggtgctattggtcttctcccagagagtaatgaattaaaaagtcaacaagaggaaatctttctcctaaagtcaacaataattacatgagagtttaaagtacttttgaaaagaaagtttaaacttttctcagactggagctagacccaggaacaagaagtgtgtaaggcacttcaattcaaaataaaaccatgacacagtcagtgaacttaaattgggtctgaaaatctgcatcctgacccccataaaagtccacacacatttaataaatgacaagagactgtggagtttgtgttcttgctaaagttcaggataatgaaatattcaggttttatttctttctcttatgtttacttaacacgtcactttttaaactctgcacgcatttacagtttgagtcttgccccacaagtttgagcacctgtgtattttgtctgtattttatatggcctgccagacttgccagtgatgaaactgttactgtcttacagacctacctgtgggaaatgaccagtggtgtggaggagatcccccctgggatcctcaataaagagcatatcatctttggcaacatccaagagatctacgatttccataacaagtaggtttgtggagggtctcagaggtgcacacttaggccgtaaaaaccagacaacagggttcccaagaagtggatcaaaggcgattggtgaatcttatctggtcagttttctaaggcagttgctgtcagacttcttttttactcactcccctttctccataattgtccgaaagtcctagtggagagtaaagtcaagtattcagcagtgctcctccccatctctcctcaacatcctcatttattcagccagaatgaatagcaggctttgaagaaataaaagtagcttctcctcattaaatcttgtgggaaatcctgacgttagaattcatctgaggctaaccattccaccttgtgatctttaggttttgaattccattgaagttttctatcaacctaaatatttcctccatcctcattttatttcacatttcttgacagtttggagggaaggatatcaaccgatactctgttttgttggaataagtagaattgtagagccctaaaacttcacaagtcattgtttccaacttgatttaagaatttttcccacaccatacaaaacagcatgttccatggttaacaaaggatcagcaaaaaaattggcatgataagttacataaccaaccaatagaaataactgtgtttccaaaatacaaatagaatctcaagacacaaagaagaacatgggcataaagtcttagagctctcaggaccctgctgcagagcagtgctgtgccaggctagcagaggcatttactgagttgtgtaggtttgctggagatagaagggccatgtgtacaggtgtagcagccaccctgaggcaagactccagaatagcactgtcccatggaaccttctgcaatgatggaaatgttctatatctgcagtgtccaatacagtagcactagatatgtgtggctaatgaacacttgaaatgtggctagtgctactgaggaactgaattttcaattttatttaattttaatagattcagatttaaatagaccacaagtagcaagtggctgccatattcgatatctcagctctagaatagccctgtgctaagaatgaccaagaggcaagcaagaattgggtgtaaaatgatcctgggctgtaataggtccagataaggggtggaaagtcactcctctctcttcacctcctggttattaattcctggtatgtcatcagatggcatcagtttaaagagaacataatatatgtagctcccatggcatgcaaaccttgtgagattattgaagcaatacgctctgggggaaaaataactgtttgactttctggaatatgtgatataagttcccagtcttttgtttttttaatcataaattttaacacgatccatttggtttgtctggaaatttccagatgtagaaatatcatgtcctcatgcttatcactgataagagcccaataaaactatttgaccattgatcccaaattccatcatctgagcccagctcagtatcatcccatctccctcaggatatctgagaagacatcggactggcaaacggtaagtcgtgttaccttacttttctggcttatggtctctgggatttactcaacaagtctcactttccccatgttcttagccaattgactaactacggaagcctagagatcacagcacgcactttctgggagccctacatttgccaatcagtttataaggggaatgaatatacatttccaaattgatcacttgtaacaaaatagctaacataatcatgcctcttattctgctgtcatgatatcactggtaaaccatggtaaacagttttgtagttttctaaatagctgaaaatctacctaccagttacaatatatagttctaagaaatccttttaaaaaatcaaattaaaccatagagaatctcgcatgctgtaaatcgaggaataaatccaactatcaagaacacagctacccagcacatattatcgagttagaatattatgaagaaagaaaaagaaaataacaactagcctctcaacaaccagagaagatgccacaaaaattaagttcttgtcttttcatagaagcatctttctatcctccctaacaacctctttacctcttgattatatagtttgtaagcccacagctatttagaaacagcaaacaagaatcaagaacttgagtgagtagtgggataccagcagctgtctaaagaagacaaactgcaaaaacagtaggcaatagaaccaaaaaaaaaaaaaaaaaaacctcatagtggtcaagggctactcagtattggtgcaaaccattctgtatcccaccatagggcccaatacagccactgtgttacagcatagcatacttaatattagcagtaaccctgagtcatgaatatgttccgcactaaaggcaaataactgtactgcatttagaaagctattgaccaaaaataaattaatggtttaattatctgcaatttaaggaaatatctaagaaaatcaagcttcatattaatttcctacaggatctgtgggctgtctttactgtactcataatgtatgctttctgcttgtgtcctacaaattttgattaatgaagaaaacataacacctctaaaatctctagtaaataagagatagaatggcagttagccaacttagaaaatgcaggaattgtaaactctaagggacagcttagaggggagaacatctttcactgcataatcaggtacctggcacataagtaaacattgagtaaatatttgtttggtaggtgaatgcatggatgaacaaactgaagataaaattactatttgcagacttatggctaataccattcaagtcataatttaatcttttgtttgtaaaagtctcaagacagagaaaaccattaggtatgattttttccccatcactacaagaaccatctggaagagcaaaataacttaatttctacatgaaggagtttcttggaagcttcttactggctggaccatgcagttgtcctaatacttatttattcttcagaaatacttgtccgaaattgtcacttctgaatatgaaaaaaaatcaaaggatgctttttaaccccaattgtttgtattattccaaagttgcaattaagcattgtctaacggaaacatgctcctctcatttctagtgcatagctcaggttatctgcctgtaatccagagagagcctatgggagggagagcaggaggaaggaatattgggagattgagagattgagagagaaagggattgagattgacacgaccttgctaacttaattagctaagtcactagaaaattagcacctagaccaagggttatgtggtgaatacatatcttaactagatagtattgatctgtctaaatggtgtcactttgaaaaattgcaaccaggattagttctctctcttgctctgtgtgtgtgtgtgtgtgtgtgtgtgtgtgtgtgtgtgtgtgtctgtgatctgtctgtctcaaggacctttgtctttataggtattgaatggggaaattccccagcaccaaaacttctttaaagaacagtttaatatgtagaatttaatacctgcaaacattggctttaacacaaaccggagactgaagtggaatgatacttcgttttgccctccactctccccattttgcactacttctctttcctacagaaataactatataatcatgaaatttacttatctacacaagacttagacctattttgattgcattttataagcattcctggagcactcagacaggagaatatattccattagtagatccctagacagtaatgattttgttaatgcagtcttcccattttgcctagcatacaacttgtaattcaagaaaataatttgttttcagcttgctgttattagatttgcaactttgctgtggacagctttttgtttaaaatgctcatcaccttctgttaaatctgaacttcttcctttttggttttttggagatagggtcatatgtgagtctgagcaataacattttcataaaatctctactcccagcgctcagagggtcctctcaaccatcaagtacaaccctctccatgtacagacaaggagacaatcccagaggagtcgttacttgcccagtgtgcgcccctcccctttccttaaaagtgaggatttagattccagggcttggtctcccacttcagcactctctccccttctctcactccctagaccaccaatggtggctgccacatctggctggtttaattcatagtgaaacagcttccatgtggatcttagaatttgatgaatatttctacccatttctcccagagctatgtcattcttgtgccacacccctacaacaattacctgaaataaatcagttttcagcaaggtctagattttcaaattagggaccaaccaccaaggttagatgccccttctgcacactccctccctccaggcttggctggaagctattagatttggccttggccaccagccactgccctcccaacctggtgttccctgctccgaaggagcaggaccagagatgtgtgaggttgaactgggagcactgaccaggccagggtcagccaggagcagtgaggggtgagcagcaggggtaaaatcgaggctggggaatttagggaagggcaccccaatgagcgactgaaccacagccacatttcagtcaacttcccagagttcctcccttgggccaaaggtggctagattggagatgaagctggtaccctgtgattgaacccagcctctgccctctgggttctgagaatgacatatctgtctgcaataagggtggaggtgggcacaagtggagcacaaagaaaatagcctcagttggagagtaggaaaggcctcatggagaagggggcatttgagatataatttaaataaggggtgggatttttacaggcagggatggcttccttgatgatggaataaagtttgaacaaaggccctgcaagggagaaaagtggtgaagtctagcagggaggttgagagaggcaatagggggtttgggagtggggctccatcctgggtcatgggaagcagagagaggtctcattgtcgcactcccaggtaggctgggtcttctcacatccatgtctgtaagacgaggaaaagaaaggagaggtggtgggcagagatagtgcaattcagaaatgtagggagagacaaaaggaaaggaggagagagagctaggtggatagaggataagtgagaaaaccatgaagtggacagataataaggagaaaggaagagatagagaaggagagaagcaggagagccagagggaggcaatgacggtgggagggtggataggtaggtagggtaggtagtcaggcaggtaggtaggtaggtagatccatctgcggaaagaggccctagggaaaggggaggggatgaggagaaggagatcgagggaaagagatggataaagacctagaccttcccagagctaccatcctgttgagggagaatgagcaaggtggtgtttttcaaaccatttttatcatgaaccaaagaaaaagactgtacattatgccctgatatacgcatgcatatatgctatatataacagggaagttaaattttgaaaaacacctgcattatgtgtgatgcactgtggtattttgtgttaggctctatttcttcctcctcctcttttttaaaattctggttgccacccataaattgattttacaaccccttgaaacacaaggggggggttgatccatggctgcacggcagagcgctagctccaccaggtggtgagagaagggatgtgcagttcaggccactggggaaaggccgccctgtcaggctgctgctaccttttcctccctctttgcccctcctaccccttcccaacacacacacccttgcttaaaatgtgcatgttctatgctttctaagcttcttcccccactccaaatgcctttggtgttagtggtttctcacgtatggaaaatcatagaattatcaaatataaaagcccgaaagaaatcgttaaagataatctagttctcccttgctctatagaaactgaaacttacaaaggtttatgatctgcccaaaccaaaattagtgacacagccaaagaatccagctgtcattttcttaatagtcaaatgttaaggaaagaggaaggggaaggcctgttgtgatttttctttggtccccaaacgcacacttgaagaggtaacttgcagaacccatcagaggagccctatacaaatgtagctgtggtcttgttactgttgtttgtgttttcagtaagctatcaacattggggctgattatagacgttagggaatacccaaaacaagacaaagtctaaacacttcgtttggatgtgtcaaagtaatgttaatttttgttttacacactaacttcttagcatccatgcctggttgctaaacaccaccttattggagatgagtaacattaagcataagattaatcttttgtattttattttaacattaaacttggtatatatctatgcaaataactttattcatctgatcacacaaattagacaaagttagaagatattggcaaaaacatattcaacaggtaaccatgcagcaaggtaaattttgctgcttgtggttggaggctgagagtgtgatgtgctgaatgggcgtccagccctgcagacctttcctcttcatccctaacctgagctaaagtgtcaagtgtgaaatgaagggacaaagccaggtgcttctcatggctcagcctgggtgatccaactgtgctggaactgttacatgaaaaatccagcacctttccctgagtgtacatgaccctccattagtttaatacctgctccagtatgctaaccggctatcttagcccctatggtctagagcctcttatgttctaggctctgaatctgcctggtcattaatggattctttagaaataatctctagctctacttgcatgaaggcagttacccagccttgctttgaaaagaaggcaatgtcctggacttcctataaatacatgaacctcacacctttctccccaccccatttccgacttaatttttaaatgtatgctccacgttgttcctctttttcccgttgccacaacaggccccttcccctatcaccacctctggcgttccaacaagcaaatgcacattgacatacaaggtcatcaaatagttatttccatttagatgcagactgcacccttgatgtaaagtctgtttgctgacaagattgtgcgctccttaatgaaggatacacttccccagaagcagtgagattttagaccaaattcatcttcagagagaataacagaaccagtccagtacctttgaaatagtgctgtttctatcatatttaatgacaaaactcagaaagctttctgttaataaatgccagcagtttcatttcccaggattgtgtacaaagccaaaaggaagcattttcctcataaagtaactgcataatatattaaattataataatttaatagagtaatggcattgccttgatcttgacatttctttaaaagttttattcctttctgaaagaaccccagacattcacacaaatgacttgctttgctcattccttcacaatttattacatgtaattattggagtagtgagggccaaattgctgctatagaacagctaaggtgaaatgtttcatcatttgtgaagagagttgtgagctgttttgctttaatttgaattcatcatgtctatttgaagtaagtagaataatatggatcagacttacataatctgtcatcttcataagcttccaattaagaagtaaaacagagtttaatattgccacttactttcaacatttacattgagatggtaatgaatatcttattcaaacttatcaattggtatgcctggcacaagctgaataggttttttaaaaaaaaaaatgttcttagctttctccccctaaattaaatcctatagagccgatgtaggatttgccatctggaagcatcctggaatctaggacagttgcctttaaatgctcatctatggactggatgtgtgggaattacccaggaagcatttctaaacaatgcatttgctcagatagtaaccccagaaggcaatgtacaaccaggtgtgggaccgctaactagagttttccaagagtgttccttgagacaaagtctgatactcgccccaaaagtgctgcaagcacaaagaagtttgagaagcactgcatattgtatttacttcagaggtttatagtgtaactcaacatattataggattttggaagttcttcagcaaaaaaaaccaccttagcccaacatttcccaaacaaggtgaccttggaatctaaatgttacataataaccaatcaagattttcccaggatatggtttaggagaaagtaacctgctgcagatttttcagcaagggcttggtagggagttccccctaaatataagtctccaggagtggggaagagggtcagatacatgtttaccaaagagaatatgagtttattaagattgagaagcactgatcatgaagaactactgtttatttagtgtctactgtgtgccaggcactgggttgggttctttttacctgtggatttattaaatccttacaagcacccccacaaagttttattattattattattattattattattattattattattatttgagatggagtttcactcgtgttgcccaggctagagtgcaatggcgcgatctcagctcactgcaaccctccgcctcccaggttcaagcgattctcctgcctcagcctcctgagtagctgggcttacaggcgcccaccaccacgcctggctaattttttgtatttttaatagagacggggtttcatcatgttggctaagcttgaactcctgacctcaggtgatctgcccacctcagcaaagttgttatttaaagatgaggaggatgaagctttggaagaccctttcacaactgtgaccaagtgtgaatgctgattctttaacttgtgctcagttgtgggaggggaagaaagtcagacctgggggtaggcagatgggtgagctagtggtaactgctgttaaaaccttcattttccagcactttgggaggccgaggtgggcggatcacgaggtcaggagatcaagaccatcctggctaacatggtgaaaccgtgtctctactaagaaaaagacaaaaaaattagccaggcgtggtggcgggcgcttgcagtcccagctactcgggaggctgaggcaggagaatggcgtgaacctgggaggcagagcttgcagtgaacagagactgcgccactgcactccagcctgagtgacagagtgagactccgtctcaaaaaaaaaaaaaaaaaacaaccttcattttacagaaaggcattcctcatgaaaattatatgctgtgcatttaattctggttatagtatttttgcttcctgaggattttcaaattgtgcatcttcccataggtttttggtagctgctatcacaaaagtcagggtgttgctctattgaaattgatcagattttaaataaaattgccagcactgtctttctatcaatgatcaattctttagacataattatcattgtttacttcaaattaaagtgaccaggccaattatccttgggtcataagtcaaggaatggctctccctgagtcatcatgggtatccttgccacttctgacacaataaaacaattttttatcctgtgtggaatgtcctgatccaggctgttttaccatttctttggctactcttaagggagaagggcccaggctgggcacggtggctcatgcctgtaatcccagcactttgagaggccaaggcaagaggactgcttgagcacaggagtttgagaccagcctgggcaacatggcaagacctcgtctctattattataaaaaattgtttttaattttaaattaaaatgtgtgtgtgtatatgtgtgtgtgtgtgtgtgtgtgtgtgtgtgtacctgtgtgtgtgtatatatatgatgatgaggcagattgattcttttctcaacagaaaagtatatttccctttgggtcttaaactaagtttgatcctcaattataacattatatagcactttttaaaatttgcactttaatggtcatataaagtacatattagtttaaatgtgtcacttgtagttctttaaaaggtagcaacaaatatgacactttattgactttgagcactacatatttgcatttctgaagcccaaatatcattataattactctttgattcaggtcagaatactctaaaatcacctatgtaaggacaaactgggtacagctaggagtctcccagattttttttaaatggctttttgcttatcgctaaagcaatgctcatttgtcgtagaaaaaattaaattgcagatggacaaagaagtcatctattatcccatcaattattgttagcattttggctttccaaataggacttgccaaacatctttaattgcacatacatatttttaagctccaaacaatgtcattctatgtcacggaaggaggaacacatacaacacatatgtgaaatccataaccacttgtaattaattatactgccaaaatgcgtggacaatagaagctaggtaaagttagtcaaataacatttttccctctatggtacaggtaagtagtagagtaatgcagaaccactttatatcgtgtatcctttaattcaatttttgaaggtaatgtattgtcacagttttaaaatcaaaattagatagaaaagtaaacattgagaagtgtcacccaccactgtcctctattctgttccttcacctgcttccctgtggtaatgtcttttcttagttttttgggttggaaataagaatacgtaattcctactgagacaaaaagttgcatgttctacatattcttctgtacctttttccacttagcttctcccagagttcttccatatgaaaacatagagagctgtgtcttcttttcatagctgcatagtatatagctctgtggatgtaccatagtttaaacgctttgttctttacagaccatcttttgcttgtataaacagtgtcacagttaatactcatgtatatacatcattttatatgtgtagaaatagctacaggaaaatttacagaattcaaattgcagagtcaaaagataagcgcattcatgatttaatcggtactgtcaaattgttccttgtaaagatcgtagcatttccacttctgtcactatgtgtccccaaagcctcataatcactttttatttgaaaaatattttgttttttacagcaaataccatcctaataaagcatgctggcttgttagaatttatatcctatgaacccaaaccaatgatttaatacattattttgaagtcagtgtaattatttctttattatttattaacgtggaaaggagccatggcacagatatccacactggtggataacagttgtaattcaattcagctttggaatatattgtgaatttttacccattaagttttctttcctaatggtgtctgtattataaaacattgtttaatacatagtttttagtacaaattggctactggtggaagacagaggccaaaaattagaaagaggccagtgtaggctgaatttttttctactttatctctaggatagcgatattttattttgtttctttgaaatatctatattatttaaaatatttatgatgtgcttagattacttgtgtaaaaaagtagattcttacttgctgataaaaagtccaacacaaacaaaatattttattatttactttcacttctagaagtgttcactccgagagaaagaatattattttaagtagcactaattaatcaattaacatacattttaatgaaattagttccgacattaaaaactgcacctcaccatctatcacttagacagtagagaagccatgtataaataattgagaagttatggttgtgctggcctcagtgcaatcctctggggggtcagctgcacagaggtgtctgattcagtctttttctcctcttgcagcatcttcctcaaagagctggagaagtacgagcaactgcctgaggatgtgggacactgctttgttacctgggtaaccaacctgaaatccttctcccactgcccatacacatggcaccactcttcagtgcctgacctaaggactggagtcattgccagtctcacacaagaccaggggctactgagagggaccatgagtaggtctgagagaagccttgggaaaagttcttagacatcaagattaagctccatcttaagctgtctaagaactttctaaaattgtgaggttggaagagtggaacaagactaccacccctggcagaggaaatgtgtcagctcagtccattagctattgttacaggatatggattagggaattagaactttaggaagccacctaaccatttaaaaaaaattttttatctttaattttgtggatacatggtaggtgtatatatttatgggggagacaaaatattttgatacaggcatgcagtgtgaaataagcacatcatggagaatgggtggggtgtccatctcctcaagcatgtatcctttgagttccacctaacaattggttacattttcttctttaatagggaaaaacagattttttgggtatccatcccaatctgacccacaagatgagtgactgttcatcctccttcatgctgttatcatgggccaagtaaaggggctgaatgtaccagattctaattatataaactgaaacgttagtcttcattggctctctactccgcattattctgaactcaggctcatgtacaatatatgaatgcaaacatctccagggaagtccacttaggacactgagtgcaaacatggaaatcctcccccagggtcaagcgttctactatttaataattacctgataataacttccacccataaggggctaattgcctttcaaagtgtcttcatgattcagagagtttatgttctcaacagccctatgtgatagacaacactatgtttatgttttagattttaaacatgggaaaatttcagataagataggaggttgactagttcactgacatgtaataaatatcacagccagtcccacaactcaagacctgattctcagataagctttttttcatgaaatcttaatatttgcttccaagcactcttgtttcttcagaaagtcttagctaccatcttattttgttctaatacattttctacccctaaatatatgagccaatacaaagctcatattaatgctgataaataatttatgatcccttgcacagcaaacatagagaatgacaagattgaccattaagtaaagggttttttttttgcatcttctttcatgaaatttgtggatttcctttacaatcagtcataagaatgatttatcatcatctcctaggtagtacatagttccaaaaactggtttcagaaaattttttgattggataaaatattcatcttttgccaagaattatcccaaggtgactttcttaagtctcataatcttaatatatgagtgtaatgcagaaatgaagggtagaagaagttgtttgttatgtattgaaaggcagtggtcaagaccaggaagcctaaagtcagatctctgcttagttaagtgactttgaattcccacaggtagcagagccctgtgggaattcaaagtcacttaaccaatctgtgccacagttctctcatctgcaaactggggatgataacagaactcactgtatagaggtctcatgaggaccaaatgagttaatacatgtaaagctcttagaacaatgctagcataaatgaaacctgctgtaataaacacatatttgggctgctgtctcagaagaggatgccaacacaaagttccaaaggcactgagatgggtagcatttcaccaaataagaaaagtatttggtggccaaaatacacatacctttcccagtaacgctaacccagagagtcttcagagtcttgaattttcacccagccgtaaggttcttggcttgaagcaacaatctagttaggaaccattgtttagcctctgccccagggggtcactctgctttctttttccccatgattgctctgggaagttggggatggcatagtcccttgccatgcccctcaacctttctccaatggagacatttagagtacaagcagatctacctctgagataatacttcatcttcattatttgtttttgtattcagagcaaatgctgtcctttttcaagatggggagcacaattgtagataatccaaaaaagggtaaaatctgtaaataagttctgtccaacttcagaatatatcaggatatatgagttgctttttctgattctttccagcacaaactattattaaaaggagctcagtttcagaagctttctccacgtgctgacaggagaaagacatcccaatgtccgttaggggaccatgggggctggatgagcatagaacatttgccatagaaaatctagacactggtgtctgagggtcttaactgtacagcccttgctgggtccttcagcatggtggacagaagggaacaactaatgaatgcttatctattattatctttgttctttttaggcagacaaatttcagatgtatgtcacctactgtaaaaacaagcctgattccaaccagcttatcctggagcatgcgggcaccttctttgatgtaagctgtgttttccattcttgagcagctgatgagcaggtggaaatgcttctctgctttggcataatggatggatatttagctatccttttttcctaatttttctttactggccactgcaaaccttaagcatggaaaaaaagcaaaaacagtatatgtctgtattttgttttatctcatcctatcttgaccaaagtgattttgtacgaggcaaatttgtctccatgcctccacaccaaacctaggaagtcataaagcacatgtttagaggagggccactatgatgcagttgttgattaatatatttcacttctgcttcatatacagctctcacaaatgtagtgtttccgaaagtgtgatccttggacctcagtccacatctattaaatcagaatctcttgcggggagcccaacaacctgagttttaaggaggcctctgggtaactgaactccactcaagtttgagaatcacttctctaatgcaattgattcaaccttttttggaaaaaaaaaactgatatctgaatcccatgcctgaggttctgctatgattggcctgactgtggcctgagcattgggatattttaaagtttctggtgagagtgatgtgcagccagggctgaacacctctgctataatagaagccaggagaagagtgaggctgatgtgccttgtcagatcctttggtttggaattatgacacaatcctgttggcaaatggtgggatctataaagccaaaagtgacctattggctttacagtaagcaaaatcaaaggggtccctgcaggattcaaaggatgaataagagggaaagatgaaattggggaaaaagaaaatttagtgagaggcagactatagcagtgatggctattttggcagtcatatcagaagtgacagaaactagaaactcagccctttttaaaggttatctgtctatatgcctacctgttttcatttttttcataaatatttggatgtctactttatgcaagatagtgggctaggccccgtggagaatataaagacatttaaacatggtccttgtactcaagtgtgcaaaagaaaccttccctgagcatctttctagcctggcactgcctcaacagaaatgatcctacaaatgtcttgttgctcagtaaagaaatgacacttgaatggaaggaagccagatgaggaaaaatgcacatgatttttttaatggagcattaatatggaaatggctctatgtatcccacactagaatacctggggttagatttggaaccacagaagaacccaagaaaagtgctcctctcacctgatattattgggtatcatattggatgccctctgccaccattacctctgagtgagaatctttttcccttaggatgcttctgttgattattcatgaacaatatccagaagggtctttttgaagttttaaatgcattgtgtcctgtcttccacttagcacttttctgacatacatgtcctgtgctctgagcatgtctcaaactcttctgcttcctgtctttgctcacaccgctctctctgcctaggatagattgtgtcctctccacacaacacaaacacacaaacacacacacccttctgtctctctcttcaaaattcttcctatccattaaaggtcacatgctgcttcctgcatgaatcctttcctttgtactttgtatctttgttatagcatttgtaatgatttgccttttggcaggtgaacaatgcacctttctgttactcacatctccctccacctgtgagctccttgagatcttatgcctgattcatatttgtcacatctcagtgcctggcaccagaatgtattttcccttagtactacatacctcgcatccccatttctagccaatttctaggctttgataagtcagatatatccccaaatttcccaccctataccccgtttccaacatagtgcctagtgagcttctacattagttggaaagactgatggaagccacaaaaccagtccagtaggagttcttaaagtctgccctggaagcggggacagaagacagtaaactctccggattgctttcaaaactttccaaaaggcataatctttgcagcttattttcattccatcagaagagtttccctaacttctacacttaggaaccatctgctttaggccctcattctattgctttcaaaactttccaaaaggcataatctttgtggcttactttcattccatcagaagagtttccctaagttctacacttaggaaccatttgctttaggccctcattctataaatgagataaacccttaataaaggcagtcacctaatatccattactgtaaagagaacacagagaattaaagtcctagaaaggcttacacattcacacgatccagaatttttttttttttttttttttttttgagacggagtctcgctctgttgcccagactggagtgcagtggcgcgatctcggctcactgcaagctccgcctcctgggttcacgccattctccctcctcagcctcccgagtagctgggactacaggcacccaccaccacgcctggctaattttttgtatttctagtagagacagggtttcaccgtgttagccaggatggtctcgatctcctgacctcgtgatctacccgcctcggcctcccaaagtgctgggactacaggcgtgagccaccgcgcccggccgatccagaatgtttgacccatcacacagcatgggtgtgatgtctaagcttggtttgactgatgtaggcccctccctctctgctccacatgcagctttccttaagctgggcttttcatcagagaggaaagagtgccaaaggtgcactgttgcttgtgctttcttgccaaagctcccagataaactcacaaggttcagttgcctgaagagagtcaagctgcatctgttttgcccatcatcctcaaacaagtcttgcaagtacacacctctgggaaagaggcaaatggtgacaaaattgctactttctgggatagaaatcatttctgataggcattggaataattttttaaattattattatctctcctccacccttcttcatagccccataacaagtcctatctagtccatctttaaaatatttcttttattcttcccaatgctttattctcactaattctagcttagggcatgcccctacattgcatacctggacctactttaaaataacagctttattgagagatgatttcagagatcatacatttttcccatttaaagtatgaattcagtgtttttgtgtgtgcgctgacaggtatgtgcaaccatcccttcagtcaattttagggcacttttatcacctcacaaagcaaccctgtatcctttagccatcaccccccagctctccaccacaaaccccaacccacaagcaaccaatgatctactttatgtctctacagatagatctgccttgcctggacatttcataaaattgagtcataatacatggtcttttgtgactggtttctttcacttagcataatgttttcagagttcatctgtgttgttgcatgcatcagaacttcatttctttttatgtccaaataatatttcattgtatgaatattctacattttgtttttccatttatcaattcatggatgtttgggtttttcatgcatagatatatattttttatttctcttgagtatatacctagaacttgaattgctggatcgtgtggtaacttcatatctatacacctgggcttttgcaatagcctcataacttgtctttctgtctctatttctccaagatttacccccatgttgctgttaggtatatatattactctttctgaaacattactttcatcatgtgtttttttctcttttttgttgtttgtttgtttatttgtttgttttgagacagggtctctctctgtcatccaggttgagtgcagtggtgtgatcatagctcactgcagccttgaccttctgggctcaagtaatcctcccacctcagcctcccaagtagctgggactacaggcacgtgccaccatacccagctaatttttgtattttttgtagagatgggatctggccatgttgccccggctggtcttgaactactggatacaagtgatcctcccgcctcggcctcccaaagtgctgggattacaggcgtgagccaccatgccccgcctgttttttctgtttaagatctgtgatgctttaccattgaaaaacttaccatcatatcctaactcttttctaactcaaacccatcaatgacccaaccttgcatatctaactgtatttttcacttcttatagaaggtgggtgtgcatcctctgtaccattcagtcatggtcctcatcatcatctaaacacacaatgattatttcagccgatacagttttgtgtttgatgtaagtgagtgtcattcctccaaccttttacttaacccacccccactgcccacctcacctcttagccccaggtgaggttgaggccttatctctactaaccacccggccactcccaaccccagtaatctctcaatttttattggctataccatttcctctattgtcttttgttgatctctagttcatgtgcgttgagtattctcatctagactgtaagctttttgaggggagggagaaaaatatacctttctctgacccttagaacccctagactttggggagtagaagatcattttggaggtaggatagagagtagattaaaaggagagactagaagcacaaacagcagttggaggccacggccctagcctgggcatgagtgatgagggtgatgtccctggaaatggaaaggaaagatttgtcaccagggataacagaggagaaatgactaaaattgactccatggtttctagcttaggagacctgaagaatgaaggaggtgctatttatcacaatgaacatttataagaaataaagtgatgaccctaagttgggatgtgttaaatttaaagagaaggatggtattaataaaggagatatatccttgtgctattttaaggagactgaaggcagggaaacactcctcaggagccatcagaatagatgtcagagcctcattctctgccttccctgtactctcatctcccctttttggaactgatttccttttactcctacttcatctctccttaccctccgctctgttatttaccttattgctctcttttctactgttctttttctccatttttgctcaatttctatttgtttcacacacttgcttctttccctaatccttctccctttttactctctctcctattttctctatatgcatcttggtctcttttgtttctctttttactcccctctccctatgaaagaacatgttctcatacttgtctacctttttctctttcttcctctcttctgacccctgcctttctcctctcagagttcacacacatgcacacacccctctgtgtctaattgcacattgttctcatccctgcaggagatacaacagcggcatggtctggccaactccatctcttcctacctaattaagcctgtccaaaggatcaccaaatatcaactgctcctgaaggtacctcccctcccctctacatccccctccactgcctactgcctggggcaagggagtcccagctttggcccctaaggataggaatgcttccacctgaagacctttcttctacctagggcagaacttcagcccacactggcatcgctgtcctatcccatggaaatccagatgcctattttaaggcagaagggggagaaaagggagcaggaataagttgtgactattttctcatctacctaccactgcacagcttttagcaattgccttctcaggcactgactggctcctagaggctttcttgtccctccttacagaagcagattcctcctggtagcccctgcttttgatgaaatcaagaggcagagtcttgccaggcacagtggctcatgcctataatcccagcactttgggaggctgagatgggcagatcatttggggccaggagtttgagaccagcctggccaacatggcaaaactccatctctactaaaaatacaaaaaattagccaggcatggtggtgtgcacctgtaatcccaattactcgggaggctgaggcaagagaatcacttgaacccaggaggcggaggttgcagtgatccgagatcgtgtcactgaactgcagcctgggtgacagagtgagacacagtctcaaaaaaataagaataataattaataaataaataaaaggtcagagtcctaagggcagtgccagtttacatgggtagtcgaggccagggtggcacctaccattgtctgtgtttgtcaagacgatgaggattttgagggaaaatagtcaaagggtacatattaaaacacaagggtattcttatatctgtaggttctcgcatgttaggggttcttctggagccaaccaagagatttggattttccttcaaaatcttatctttaaaagttaaataaccaaatatgcaaaacactaagtaatttgggttcatccttgtcatataagaatgcattgatacattgaaaataatgtcatttccacagaaagcctggggaattgacacaagtagttaaataacccccatctatattaatacctaaagtttaggggtagagttttccctcatttgaaatatcctgctggttgctcctttaatgcaaagataaagggatagtaggggacatgttataagtacattgtgtaatttcagagaaaatctgatgtaattcagctcatgtttagagatgtctgcaaaaacttgcataatctcatttcactgaacctgaaaaccagtctaattttaaatctgccattctagtcacactggagtgagtccaccattcccagcccatggaatctccctggcttagcactatgagaggcgtgagggcagcagtgcagtgaaggtgcaggaggctgtgccctggtagggttttctgtcctctgagtcagagtggggccgtgccacatcatttcccttcagcctcatccctgcaattcttctccttcctcatctccaagaagaggctacagacatctgcttccagtgctccagccaaccaaccctgcagaaatggcttaaagtgttacaactggacatcacaccctcggcctttcctgaggactagtgtgagaaaagagtgtgcagccaccccagctgtcctgacagaactgctttcccttctttgttttttgaaatttcttatatgaagacataataaattcttgtgagatctcaggacaggggtgtagggaatcctctctcctgagaaatgggtatacgttctatctttagatgacagctgcataggccattctttacgtgtggctattagaaagttagcattgaattttgtggttgcttacagtagaatcccttagcccagattttgtgtgtaattatcttcttctttcctatcccacttgatgcttggccttttaaaattatttttcatggtcgggcatggtggctcatgcctgtaatcccagcactttgggaggccaaggcagatggattgcttgaggtcaagagttcaagaccagcctggccaacatggcgaaaccccgtctctacaaaaaattagctgggcatggtggtgtgtgcctgtaatcccagctactcaggaggctgaggcatgagaattgcttgagcctcggaggcagaggctgcagtgagccaatatcatgccactgcactacaccctgggcaacagggtgagactccgtctcaaaaaaaataaatgaataaaataaaaaatgaaattatttttcttgtgctaacagacttaaaaaaattgatttttatggttttgaatgtatgtatcccacccaaaggttgttcaggaattggtggggttgtgaatttaaaaaggaaaaacaaaaggaaagaaagacaaaccaatgctgactcaactatccacactgccagtgtcttaaatcaactaagatgcagttctaaaagaaatatagctttttacctctccctttaaccctgtaaggtgtaagccccctaggatgaattatgtggcatagacaagggagagaagttgaggatggaataggcttgtgttttgctgtgggcagtcgaaggagtgggctctggacctttgttcgggaattgagtgttttaggaagaattgcctatagaggtagctaagaagtggaaaaataaagtggcaggaatttgattgtgaggaagtcatcaaattatttttatttttttaagaaaataggctgggcacagtggctcacacctataatcccagcactttgggtgtccaaggcaggtggatcacttgaggtcaggagtttgagaccagcctgaccaatatggtgaaactccgtctctactgaaaatataaaaattgcccagtcgtggtggcgtgcacctgtagtcccagctacttgggaggctgagacaggagaattgcttgaacccaggaggcggaggttgcagtgagctgagattgcaccactgcactccagcctgggtgatagagcgagactctgtctcaaaaaaaagaagaagatagttttggtcttttttaaatgttctggtggcacagtgcctgctgagtaagagaaaaacagtttgctgagcttttactataaataatatgggatttattttcataaagtcagttttatttcaaatacatgtatatttaattgtcagtatcctctgggttcatcactttaggtatggcgtgaaagtagaaactttacgtcagagtgctcaatattcttcatgtaaatctgctgtggctttacaaaaggatcctaaattaaatgtggagccttctccttatcataaagtatagcaaggatcagggaaaatttattggcccagctggtagattggtagacttgctaaattgttttgggcagggggggattaaactaattcatgttttctgtcacaaattgaagcatatttcttgttttttctcttatgttttgcctcaggattttctttgatgatatatgaaaataagattgggaaggttaaaataaggaaaggggtgggagaatctgagaactttaggttggcagaagtaaataccactttctgaacaagggtgacgttatactgactggagccaagggcaaagctgagcactgatcacttctccctctcaaacatgtgctctagggggtgcacttcttctttgtacactcaaagctcccttattcctaggggaatgtatccaaggattggatttttcgatcaaaccctcactaattagatatcttaccaagtataaagcttgactaaaaatttcaaggatacaagtaattccaagacagaggtgacacaggaaagggccaggaccaccagtgcagctccaagccctttcttgcagccaggatgtgctgcggccaggttgatctacaaggtctgtaaattatgtatgtcacattgtatcacttgccctgaagagagccaattggtcatgaaagatattccctttttacttagatagttgcatagcttatgtgacaccttccagagagctatgcctctaaagccacagattctaggattgtttaccataagaagccctagacagaccagatttatcctattaaaagcatttcctagataagtcctctcttgctagcaagtaccattaggttatttgtcaagaggtctgtcattaacgtgtttacaagatttgatctggtgaacttctttatttctgggaaaggcacctccactcaacatgcatcccctgccccctcgaggagagagtatggtttgcagatctgttgcttaaccattcccttctcagtgtcaaagggagcaagatacagtgaccctgataggaaaaatgaaaagccaacattcttctggtttgggcaaaaatcattccaagtggtcttatgattctcaagatagttggaaatgatctttcctccaccaaccagatactatatatcttttatggggatggtgatgactgagtctccaatgaggaaatacaaaagaaaggacacactccccagctccccaggaggtaaaagaaagagggtattgcccctggaagcctcaatgggggacagaatataggagagacagggttgatgtggtggataaagtgccagacttggattcaggagacctggattcaggcccctgcatagcctccactgagttatataacctgaggaaaatcacttcatctctcttaatcgcacttacctcatctgacaatgaaatagcctagaagcccatctattggccccagattaggaactcctgatccatatgatctaaaaatattttattactctgggatgtcataagcctattaagtctccaacctcaagttgttcccagtgggatggaagtcagcattcaggctgtagaggcttgtaaataaaagtggtgtcagcagtaagcatgcagggatatttgggtactgcatagcacactctttatcttccctttatcctcctcattcttctctttattctctttattggattatacaatactgcacctctgttcacgtgctttgccagggtagtcccttctctaagagggcagtccagtgacagagaatgcctcagttgctgccttacaggtcaagccatttgggagttgggttggattgagttagtttgggctagattgggctgagaatgctcagtgtgggagaaaaatagtgcttgaattcttagagataaccccttttaccccacctcactttctttatagctcagagggaaccattacagagagcgaagctggtctataatttccttgctgggttaggtggtgggaggaagctgggggagatggccctaattatgtccggacttttttttccccaggaacttttaacttgctgtgaagaagggaaaggggagctcaaggatggcctggaggtgatgctcagtgtcccaaagaaagccaatgatgccatgcatgtcagcatgctggaaggtagctgtcctcccagcactggggaagcctcctctcttccttgacacgggggagcttgtatcatgggagggaagtggcatgaagttagacaaggtgcaaggctggaagagagaagaaatgacaagtagttacataggcccttgtcatgtgagaggggctccacaaggaccaatttggctagcaccctgcttctaggaaggaccaggcctaagccactggaggttatgtggacatgttgctgcccatgagacagtccaggacaggccatcaccctcactgttgatgtgctagagcttccaacctacagcagtcttgttagtctgcatagcatctgcattacattgccttggtcatcacaatgaatagaaagcctgatcacataaacacacacagacacacatacacacaaaacataccatcttcagccttatgctctttttttgttattatggtaaaatatacataatatgtataacataaatttaccattttaaccatttttgaatgtacagttcggtggcattaaatacattcacattcttgtgcaaccagcattttgtcctctagaaggttagtaagtccagccaaacaactctgataagacttcagtcagatgaagctatcttcttgggaccagaaacctgtagagtaagattccaataaagtggtcttaacactgcagaatgagtgggcagagcagccatactggggtggaatttgttagatgagttaagatttaacatttttttgggaggccaaggtgggtggatcacctgaggtcaggagttccagaccagcctggccaacatggcgaaaccccgtctctactaaaaatacaaaaattagccaggggtggtggtgcatgcctgtaatcccagctactcgggaggctgaggtgtgagaatcgcttgaacccaggaggcagaggttgccgtgagctgagatcgcaccactgcactccagcctgggcgatagagcaagactccatctcaaaaaacaaaaacaaacaaacaaaaagacttaacatttttaatgggtgctaaaggaaatgtgtatagtctgttgcaaatatgtaaacacgtgggctgttttttctcttctggactccatcctactccgccaataccaccaacaccaccttgggagacttgatacggtctccatacttcccagaccatccttagcaccagaagcctcaattcttagagcaaaggagccctggctattttccctaggctgagcaggaaccatctcaatgtattcctgttgacatttttctccactcctttcctctctgtttgtaccttcccctccaccccaccctggaagtacctgcaagtacccagctcctccagtctgtccctgacctatgctctggatccagctactccatgcatggtctgtttaccagcagcagcaacagcacctgggagcttgtcagaagtgcacattcatggactcaccccacacctactaaatcagaatatctggggaggttggagggtgggcagtaatctgtgttttcacaagctctccaggtgatccttatgcacagtaaagtttgagagcatctcttaaaaacttcaagtggtataaatataaactgttgaaggcttgtgcaaagtaatcaaagggaggaattctagaaatggaatataagaattaaggtaggtcaggcacagtggctcatgcctataatcctacactttgggaggccaaggtgggaggatcacttgagctcaagaccagcctgggcaacatagggagaccttgtctctacagaaaatacaaaaattacctgggcatggtggcatgtacctatgacccagctacttgggaagctaagctgggaggatcacttgaacctgggagttcaaggctgcagtgacccacgatcatgccactgcaaaaaaaataaaaaataataataagaagaattaaggtaatgaatgacacataaagaggagctgaagacactcagtcaggcagtgtttgtcctcaaccccactcatagctacaagtcaggaacagtagaaagttgtggaggacaaaggagctatgggatttgcccttgcaggaggccaactgtgggtgtgtgaaggtgtgaggttgcataggacctttgcaggagattccactaatattggttatgtatataaaagacatggtgcaggaagggggcaggagagatctaattgcaattctcagagatgtctatggaagtgttcagcagtctctggagttagcagagagaaaaaaacccttcagtaactgaagactaacaataagagaggcctttctccaagaggggggtggaacatggccccctgactgtggcagtagagaaactccacagggtggaaatggatgtttttcagggttcgacgagaacctggatgtgcagggggagttgattctccaggatgcctttcaagtgtgggacccgaagtcgctgatccggaaggggcgggagcggcacttgttcctctttgagatctccttggtttttagcaaggagatcaaagattcttcaggacacacgaaatatgtttacaagaacaagctactggtaggtggggcaggtggggtaagacaagactccctgctttcatagaacccatgggcaggaagggatctggacacactcatctcatctcctccccggcctccacaccaaaaccatcctggacaaatgaaaatgtctcctatttggaaagcaccccactcacctcccacgtctgcattgtagagttcacagttcttctttctgtttgcttttagcacctccctcttcaccttccctccctggtacctgctaatcaggcacgtgcctgtaggtcctttcatcctgggtagatgaacagaatatccaatctgttaaagtttgattgacagaagcccctccctcggtcctctcctctttgttgcctttcccttcccaccccagccctaagtttccccactgccctccccttccccgcctctcataggcatttcctgtctacagacctcagagctgggtgtgaccgagcacgtggagggcgatccctgcaaattcgccttgtggtctgggcgcaccccatcctcagacaataaaacagtgctgaaagtaagtactgctctctgctaggcacaaactagggttggggataatagaagtgggggtgggcaagtgacacctcaaagctaaggcccagagactctactgagccatgggcctcttttgggaatggcagcatcacgtgggcattgagaagcaaattctatcatgaaagtagacccagaatctcaaagacgcatggtctcctcaagtgcatgcacatgtgtgaccaagagggaagaaagcagggagtggcttgtgggaccagctcagcaaggcccgcttaaactgtgctctgtccgtatctcttccttcaagtggcaagaacaattgacgctttgacaaaagacaccttgatttgctccacattcatttgacattttttcctaaataacttccgtgtaaaaggtatagtgcctagtgtggtgggggataactatgtataagatatggaccttattccctgggaacctacattcttgaacccctactaaatcacattagcatggggaccatgctgatggagagaaatgtcaagagggagcctttcaccagaagacggccttgaggagtcattgcagctctctggggcacagcagtgatgttagcctgtctgagcagcgataatgcagatgatgaagttcccagcagtcatttgcttgtcaggaaagtgcccatcaccaaggaaaaaatggtccaaccccgacaaaagcttcacatgtattcactctgaactgccagcatagctgctacctgttgtgaggcagaattaccagaaaaaaaattctaccaagacaaatgggatcatcataaaatgatagcagtgcctttagttaacagagcttgccacaaacccaggactgatttctagtcagtacaagtctgtggagccatgctaggtgaacatcctgacatatatccatactgattgggaagtagatgctgcccctcccagtgcccaccagacctccccaggatctagcaacccaggtgttaatccctgtcccagggggaacttccagatactgttccacctccagggcagatatcaggattggtcagtgccttatgagttatgaaatactttgacagttactcccgtacaagtaattctgcattgaatcttgaggtcggagcactgttctgggagttggagaagcctgtttctggtattgaagagtcataagtatgaaatgagaaataaactccccagacatttggaatccttgaaaataacagatgaagactgcaggagggttgagaactgtttttggtaaggtgatgggagttggggttctcagtctttctccctgtggcactctaggcctccaacattgaaaccaagcaggagtggatcaagaacattcgagaagtgattcaagaaaggatcattcacctgaaaggagctttaaaggagccacttcagctccccaaaacaccagccaaacagaggaacaatagtaagaggtaaccagcacctctccctccagcactgcctgcctcacaggcttccgggtgcgggaatgggatgaatctttgcttctgaagggggatgtgcccagcaggtggcactctccaggaaggcctgtgagttctacctaggatgagtcatctgatctttaagcatctcactagtgtcaaattcagcagggcttcattgagcacctcttatatgataaacactctgctaggttctacaagataaaaggaagtgtaagatgagtcgattcccttaagagccatctaatagtcatgtctgacacatgaaatagaccagaagaaccacgtatagggatcataaattctataagaattcaaagaaaggggactttagatgagtcctagagtggaggaactctctggactggttggatagtcaaagggctttgtgtactgtaatgtgtggagtggtggtttcattgcaggtcttactgcaacccccacagagacctcaccttcattcacctatgataagcaacgtcattgggcagaagaggacttatatctttctggatgcttctgaatcccagtttcctctaaacccatggatgacttcttaagtatttctttcccaagtctccatgtgacacctacacttacaatgactcttttgggggacagttccaaagaaagcatacaaaaacttcacgtacattttgaagaaaaaaaaatggggttctagcagagatggccattggtgataacaggttcttccctcctcccctgtacctgaatggaataaatctggaggatttagttgacccttaggcaccaaccaggacaagcagggtagggagccatttcagggcctatgaagccgcagcagcattggtcctgagtgaggtggtagccaaaagaagggtgtgactatggtggagaaacctccatggggcggaagccccaagacctgcatgaccaggataagttcacctcctcagtgctgcatggacaaattataactgctctggtgaaggggtcattttgatgccagttatctatgtccagagtccaggtaaggagggggtggactaaagtctagcagtggagacaggccatgcctcagggaatccctactttaataaataaattagaaaggaaacaattacaaagaaatgatggtctaggatcatagtgaaagaggatactcaggtgaggctgactaggcttatttaccctgacatagcccctttttcctatagtaggagagtttgagcatttccagaacatgggaaaggcatatcttggaaatgcccccaccttttctctgctcccaccttttctcttgtcctacaatgggtgggtgagaaaccttggcatactctgcagagaataaccaagcagtctttaattccgttatcttggattcctggatatggggacagtttatagaggagttcattggttggggaatactacccacagtcctaggtggcctccccacatccccccagaagtggcttcacctggagtggaccagaagggcccaccatgggccagaatagcgggaagcagaaagtacagccagctctcaactgtctacacatggtggggagcgctggcccagataatccaaaacaacagatgatctaaaagtcctttatttttggttttgaaatgcgtcacataaagtctttttacagcagattttccttcctatgaatgtgtggcttatgttattaaaataaattggcatttcccaagcccacaaatgatggtgagagagcagttgacttagaaatgttctggatgggagaaaatactttttatgatgaatagacattgtgtgtatacatgtgcacatgcatgggtacttgcatacacacacacatccacatacattcacacatacaccagagtgcaatcatttagaccctttgaggtgaattcgttatttgtggcactttgttcatgtggtaggattctcaggctttcagtttccctgtcccctgatgccattacttctccacaagcagcatcagggtatcttttataaaagccccctggggaaaagctgtcatttcctgtgctaattcacccaactccaactccacatctcccccagcttttcctggcacagaccttgcagccttcatcagtttccagacatgcaatcccttttggccatggctgtgggcttggtacaggatgggggcacagttctacagctggagagctgaaagaacatggggacagctgtgtggtccggggcccaggaaggggtctaaatgccaggagtgcactcaggagatggccttagctgacacacagaagcacagctggctccaaagctgctgtggaacctgtgactgttcaccaatctttgagaaaatgccttggccttctgtatcgataagaaatcattataaacatgcatgagatcctcaaaacccagccagatgaaggcaataaattccttctccacacccaggagttgaaggtctaatatcaggaatttcccaaagttaatatcccctggagacaatattccacacaacctgttttcttgaacagaagaaactcaagtttaaaagaaatcttggccgggtgcagtggctcacacctgtaatctcagtactttgggatgccaaggcgggcagatcacctgaggtcaggagttttgagaccatcctggccaacatggtgaaaccacgtctccacaaaaaaatacaaaaattagctgggcatgatggcaggcacgtggaaacccagctacttgggaggctgaggcaggaggatcacttgaggtgaaggttgcagtgagccaagatcatgccagtgcattccagcctgggtgacagaataagactccatcttaaaaaaaaaaaaaaaaaaaaaagaagaagaaatcttgtcacttctgttttctttataggccagctgtaaatgaaccctcatcttaattacagcatgtacaaaaacttgaataccctgaatttgggattattaaaatgacctaatcacctggatagaagcctaggctctaagtaggatatatatcttcctactgcctcttacagacccgttcccaagtgtgtgtatgtgtatgtatgtatatatatatatatatatatatatatatatatatatatatatatatacacacacatatatacatacatacaccccctctgcagcatgggctggaggagttttggggaagggggtcattttgcatttagttatcaacatagtgattatgtgtttactaagtgcaagaagtgacatcactgaaaatcacatagggccactctctttagcaggataattttagacaaatccctgctagaaagtgctgaggcgctgctctgcccacccaaccggaaatccttgtgtgctctaaacccacagtggttccccccacccccacccctgttttttttctcttcttcctgcagggatggagtggaggatattgacagccagggggatgggagcagccaaccagacaccatctccattgcttctaggacctctcagaacacagtggacagtgacaaggtaggacagagtcctaaccttccttcccctgagacttcttgatggctcaaccacccctggagaggtacccctagagaatttctctcactatggatcctaccttcaggagccagttgtctctttgtgccagccaaggaggaaagaacagggctggaggaggcatgtcccagcacgagatctggtctgaggggatggaagactgcggtggttcaggctgacctctcacactgggagagtttaacagaagtgggaaggctgagcagtgagggagtctaggtttcttctctttctgagatgccccacctgggcttcttgggctgctgtgccttctggggggatggatctcagtgaggctgagttggaatagtgtcctgagaccttagtggctgtgattggctcaaatttacagtgatttgagaagagctcatctcaaagttagaccaagattaaaggtttgggaaatggccacagagatgctgtttggtagcagcctgttatccaaagggactctagtggaaatgatgctttcctctggccagattattggggctcagttgctgagagacaggaggaccaggaagtggtatacgaagggtgtagttgttgtgtgagaaagcctggccacttgctttctaacattttggagcaagtaagcaaaagttagtagctctgatgggaaagcaaaagaaaagaaactgtagcaaaggctctgtgtatctgccccagctaggtgaggaatgcaaccgccggaatttgtagcagggggaggaaagggtccatgtctgagcctactctcatttgcttactctagaatccaaagagtatgagatgatcttttgttgcctcttagtgatcttattaatgaagttctgggtttccaaagactatttgtccctagtttatccagacctagtattttggcctgctccttcaggctcagacagcaggctgtgtcattgcttcatcttagttttctaagttataggtatttcttttaaagatgatctgcattcattaggatttttcctattttttcttgctgggagaaaaaaaaccattgagaccttagtgtggggactgtgccccgaacctgctgaaattatggtgccaaatcaccctaatcatgctttagactagtgctcaaggtcattcaaggtaattctgacaactgccctcaagtttttaagccattttctactgactatcagagtggatggaaaattaggtttttttccacttgtgaaaacatacaatgaaaaaccatttctgtaatttcctgtctcctctgacctgttgtctagaaatataacctagtgttcctagtgtataaaaagtgttcctctttaaacagtcagtgggtggtaagtcaagtgcagtgtttcccatgttgagacatagattattagtgtcatggtccagggaattcatcccttccagctgctaatccatcttcccagcagctctgactttgacacagacccctatgctagagccatttgttttaggaagacctcagctccagctattccttgtctttctggcaaggtatgtggggctggactagaagacctttgacggcagccattttactattaatgaggggtcctagtacttagactttattctacaagtaaggaagcaggctcagagaaactaagtgagtcacccaagacaattctagtagttagtgggaaggcaggaactagaacacagatctcctgatttttcgtgttttcccccactctgaaagtcaaagcgttgaattcctgatactaggatgaactcagctggtcagtttttctgcatatttcacagaaacagtgctcacatattcatgtagaagcacccatcatgtgccaagctctgtgctggatgctgtagagagatgtggactatttgttgagtgtgaatctctacttatgtagttttttgtttcatgtctgtctcaatagccaggtcattgagccccgatgaaggcaagagctgtgtctgtctgtttcattgccgtactcctgacatgcagcacatagaggctcaggagatacttgtggaataaataaatagagggggcaaaatggctggtctcaggaaactccaggattaagaggcagctaaaaccagtggtctgaaagcagacagatatatgaacattgtatttttaaatatgctaaagaaagatcaaatcccaactaccttctctggccttaggagacatgagcaggtcaggagattctatgttatgtgtgtacacaaaacctagaaaattccttagacatagtcacactttcaaaataaggggaagatcagtctagtactatgcactgtaatttaaatgttcttactcttctaacacaaaacagtgataacagggcagccatgtgtcctccgtgactgcacttttcttcttctgttaaatcactcattggtatgtttgaacttgtagacgttatcagcagtgtcagattttcccctgactatactagatggccagggaacgctggtttctaagtggtcagatgaacagtctctgaaaaaaaggaaaataataaagtggactgattcaggtaaactgactcatattcaacagaagggcaaacaagggtgctgtgggaggggaaggggtggagacagctcacccaattcagactcatctaacagtaggcttctagaaaaatgccccagtcttcctcttacaatccagaggaatgacagtaatagtttccctgtctggctgagtagatgaggaaagcataaccattaaagagccatgacacaccaacttggggagctgtggcggctccaggatctcctccaaccactccatgtgtgttacgtatgctgtggtgtggtggaaggagttcgatacacctaggttcaaatcccagctctgacactctgtgtcacattgcataggttactgcaccttcgtttttctgtaaagcaaagataataatacctatctcactaagtcattggtaagattacataaaatatttgcttgataaccattagacattcagtaaaggttaattcccactcttactagaggggaagcaaaggtttagatactatgaataagactgcacaattatttggcagactgtgagggtctttgaaaatgcttgagctagttctgccctgtggttttattgtttattaactgtcagcaggttcttctctgtactagacctaaagtgatgtagcttcaactcacctgtctataaaaagaactttactctcttttccatctgctagcccttagaatctaaggtttggatatttgctgttagcattggctcatgggttattttattatttaattagttatagtctattaccgtcacgtattaattttaatgctcaaattgtaccacgttttaccagtggcagcccttaagcctttaagtgttgaaagatgcttgtcacatcttttctccaaatcatctctgattagaagtcctcagtttctgtgtctgttccttatatttatatatttttcacatccaggttgccttcatctggatttactctagtgtgtaatttctacataaaatgggtcctataaatacatctaaatacaaatacatctaaatataaatacatctaaaaggtacataatactgcagaagtattctaactaatgtaaacatggctccttgttccaggactagctgctgtgtgcggatcctccttaaggtatgccatgtttagcatatgtgtccagtgctggctcagaaaatctccatgcccttttttatggactgcccttattcaggcaggtgacttagtaacctgagtgtaggactactttatgtctattagattttctcttatttagttccatctcagtgttctagcatgtattgaatacaaattatcttgtccagtgtgttagccatatcgctctgcaatattggataaatgcatcttctgcagcttcatccaaattcttgctaaaaagacaagattgggagcagaagaccaatgcccaacacccctcctcatttctcacatagggtctgtaacttggaaacctccttgtctgactcttctttaacatctccagggaaagaaatgcaaccacttttctctatagcagagaagctgagctgttttcttaagctgtaaatcctctcttgatgagaaaacagtctaatattcttaatcctacattaaacactgacaacacaatatgggtgcctcagtaaatggcattagtagcttttccagggttgcttttgttcaatacttaaatggatctgtatagcttctaccttacacctgtctaatgcaaaagtggtagttccccaaggggcaaacaggtgtgctcactttgttccatggtggtctgagcccaccttccctattctgtccaggagtaagttcatggttttctgaaaaggtcattccactgtaaatagtcttttgactatatgtgcattactaaatggcggggctttgcagtcacactttagaagaaatctacaattatagaattctagccaagcagggctgagtaatgaggtgacagccaaatatcttcttgtttaacctgatggatatctgctgaatccagctaatggtacaaaagtagccatctgcactgtaatagttccagtgcatgtatttgccatttagcccaggcatgctggaaacataaaataaatgcttattgaatggaacattacaaacctatcctagttgggatactctccatctgaaaatcactataaatttccagacatgtccgggttggctggagagagggagattgaagtgaaattgacttgctggtactcttctctgaaaaaattataagggaaggaacactgctgaaacatttcaggctggtgtgtggtttgaagaggaacttcagtaacaagctaatgtgagctgaggtgaaatgtgggctgataatggtgatatgccaaagaagaacagggaaatacctggagaacccctgagattttcggatataactcaatggtttttaaaccctgaattatcacatcaatgtagtgggtcatgaccaagattttgttttaccaattgggaaggaaggcttgggtaggagatggtaagggtccaactaaggggaaattcaaaggattcctgcagtgtcactgctgctttataataagccgtagcatgacgccagttaacaagaggcagggcagcctggctgcaggagccttctgagaacagacctcctgtagagccttacctggttcatcagaactgacaatttcatcacctgcacactgggaggccactagatgcaagggcagtagccagagagaggaaccactccctgcaccaggggacgcctagcccctgtgttggcatattcccacccacttcgttcatgaactgtgcagaggccctacctactctacagcagaagctgttctccatgctaggagtacagcagtaaatgagaagaggtcctgccatcttccagcttacattctggtacatagaaaaccagaaggagaaaggatggccatttctagtcttctgtaaattgcgtcagagataaaagactgcttggtttttcttctgagaaaaagtgggctaatgctgcaactgaaaggacttgaattagatgtaagacattattttccctgtagggattagtgcttatggaggacagatgactgagagaaaaattgaaagtctttacttaaatgggctcacaaataggaaaaaagcaaaacaaaacaaaaacagaatagggatggagttaggacaactcaaaggtcaaaggagagcaccctaggtcccatcccctagaaggagtctccgactgagattcccatgcctgtgatttgaggatgtgctcctacggggggaaagagggaagggaagcagggtccagtggggaaggagtgaaggctggtcccttccagagctctgcagtaggaattgcatggagtttgccctgccttgaggcaagggggccagccgtttgtgtcggttgtgagctgtgagcagccaacaggcacaagagctgggacatgggtgccctggcaagaaaggggatctgggtgggctgccagtagtgtctcctgcagggaggaaatgtgatgtaaaagaaaggggatgggttttcaaatcaggtatggattcaatccccaactaggtaccagctgcatgacctgagtggtcctttaatcacttcatacctccatctcctcatctgtgcaatgaaggcagtgatttctacttcctgggattttgaaggactagctgagattctatatgaaagagcacagaagacctggggtaggtcactgcccaggggactgtggggcactcatgtgcaagaaaacaggcagcaacatgccccctagagtttcaaggggccacagaccactgtgttttgccactgaagagaaaaccaaacatctggaaatgtggagacttggcagcattaggattgataaaaatcttagcacttcacatggtaatatttttcacttgacacattcttgaaaaccatcacgatggtccatccaagaccgggtctccagcatgtggctgtgacagcatgttaggtttagctgtggtccctggacagtggcaccacacactggagatccagcccattaagtgtgctatcttaaaggcaggaaaaatgggataggtctctgggaaaaattcctcagcactagtattactctgccctttgtctcagtggggctggaggggcccatgaaatatttcttattagggagagattatgctgcctgccatttagtaaaaaacacttcaaacccttaaataaatacctgaaaagtatatataattgcacttcctgttaccagggcctggagtagatatatctgaagtctaaacttgggctttataatatagctgcgtaatctcgagtctcagtcacatcccacacctgacagcatacaggattagaattgctgtataaatccgatagaaacactctgatttttctcaaggacttgatattcaccccaaagtaggaaaaataccatctccactctaagcccaaattgtaatttcttttttttttttagctttcttaataattcaagtccagagctaggtttgaaaataactttcttcccagtatagttcctttgttacttttatctgtggtaggcaggtggctggaggaggaggagaaggagcagagagcaacaaaatgcagaggtttctgtggtactcggtatgcctgcagctccccacctctggctgccctctcacctcccagaagcacaactccatcctctcctcagagacattcgacacagtacaaatgtgtgggcttttcagaacaagttgataaagtgtgaggaatcgaagtcacaggttttcctctaagtgaaatttcttcaaataaatgactggcttccagctgttgcataccaccaaagggtatgaaatatactttgctgaaaaatacaacctaggttcacagggcaaaatatttcatatcagcattattttacttaatattttgatttatattccatagcttaaaaacctccctcaagaaacccatcattaaaattgccaatcgtctgcaaaagcaagtaagtttcataaaatatagcagacagtgagtagtttgctgaacacacgcagcttgcaggaaacctcggaagtgctctcgtggtactcagagcacttggacccgcataaaaatttgtttcaggtttatacaagtacttgttacagaaatagggacactggaaaaggtgatttgccagtagatgagatctataggtgatagctgcaagggtaaccagagactagatctgattcaatgtgagtttggaatttgaaatcatggaatcttaggaaggaaaggaaccttagagatcatctagccctcttccttctgtttaaaaaaaaaaagtgacttgcctagagtcatgaagccacttaacagcagacctaagattcaaaaccaggtcaatctcctgcctggtaagttggattaaaagcagtgcttttgtagtaaccttgatggttcagcttgatccttgcaacagaaagaaaaccctactattaccctcccatccacccactatgctgaatgtccttgcatcacctcccactctgccccagcaaatccacagcaacacaaagtaaattacaaagtggttctgtagcccagtccaggggcttcagggttggcatgtggcaagtattaatgcctatcacagactcattgatgccaagtactcgtgactcacatcatagccttggtgggagtgtgattctgccctagacagaatcttccagcctctcaagcaaattctggttgggctctgagagcttggcagtgagcactgggatgtggcaaggcagatccctgcttcagagctgcctgggaggactgagctgccagaaccagttcagccccaccacagcccaactcaaattgaaatccactttattattagaattttggtggaaggagaaagcaaatctgagagcaagccaagatgttaaagtggattagctggagacagtccaaggcaaacaaggctcaagtgagtacacttgcagttctgccaggggaaggggtacaagaagggagatggcatggttggagggaggggaggggagagcaaagcttggagcctgcaggtagagaagtggtggctttcagggcaaggattttactggagtgttctgtacagaccttttgatgtatcacttaccctttcttccttctgtatcaattaaggagaaaaagttattttcatatagaacaaaatgactgaatccacattgtcaaaactaatggtaggggaaacagggaatgggaaattttgttcttcaaaagttgagttccaggatgactagaagtgatattggaagtgtggtacctagaggcaagctcttctggtaggcatgaaaataaacttaaaaactttaagcagaaggagttgggcatggtggtttgcacctgtaatcctactactttgagaggccaaggtgggtggatcagctgagtctaggagctcaagaccagcctgggcagcatggtgaaaccctatctctacaaaatatataaacaaaaattagccaggcatggtggcacatgccttagtctcagctcctagggaggctgaggtgggaggactgcttgagcccaagagattgagacttcagtgagctgtgattgcaccactgtactccaacctggagtgagaccctgtctcaaaaaaacaaacaaaaaataaaacaagaaatctttaagcgaaaatttgctagacaagaacctctggagccaaagcaatgtagagtaggtggggcaggctggaggtggctttgaagctgtggctctgctttcgctggagctccctttaccgtatgtgctgtggtataaaacataacaatgtcatctgtggccataacatagaattcttggaaagatcttgttgaccagacaagtgggaaaatgtaactcttttttgtgatcttgagcttgggttgaaaattcttgcctgggtttcacctacctggcagtttagtgtcacttcatcacttctggtgactactgccaaactgtctgccacaaccaaagtggcagttggatgatgggagtgggtgaatacatgggtgtgtgaggtgagaccttccacattgctaaaaagccggctttgtcaagagaaacaagttcgaagatcctctatggtgaaacagtgaggacgtaatgtcctcagggcttcttccaggagtggtcagtagtagtagatgccagttaagggcaccttgcctcaggcttgagagctcttcttttggggagaaaactgctaaaagaagatgcagaactgtatagatcagaccaggacagatgtccactcctattttcaaccagacacttgccccactactaatcagccttctcatccttctcccgccatgtcccatgcagatatggccctggttgtgttgagcacgcatgttctcatatcaggctggcagtttgttttcagtctctcccatttgtaggaacttaaagttgagtcttacatgttcagaatgttcagatagtctaatttttttttctttaagaattctagttctttttgaaattgctaattgcagagagaggtatacattaactagaatttcaggagagatgctttctgcatgaccgctgctgatcctggctaaagaatgctttgtgaatgctcctatatacattgctttctgccctgtggcaactcaactgcaaggacttaaatacctctttgaatgttatgaggtgctggaggaaaacccaggctctattttttttactacatctgtaccctctctcctgctagctagtgtcctttctgcaagaatagaatttttaaagtttcacttactgtttgctgttcctcatttacacatggaaaacagattggcttaatgagcaatagaagatattaaaaattcattatattttcctttacttgggattttcatgtaggctgtctttttatctcatttactaattaattcatcagtcattttctgagcttctaccatgtgccaggcactattgtagacacagaggatatggcaatgaagaaagcacacacagcaccctcgtttcctgcttagacctttctctgctgtgctgatagcctgaatatgcccaattttgagacatttcagattattgtttgaaaaaaagaaaaattcttcttgaaaaaggatttgaaggtatatggagtgggtgtagtttgttaaagagaggtacttcaaatcatggaacctgaaatctgtaacttatttcacctccccaccccacttcatcctgccacccccaaaatgagaacggtcacggttcttaggcctttttccacacagtctcttaaaggggaatgcttactgcattaatttaaaaaattctttaaaaatcttaaaagagaaagacttctaaaatatgttctctgacatttaaatttaagacaatactgccaacaggggaatatgaagtcccaaccatgaaatttgctgttatttggagggcaaactactaggaactaccactgatacatgcccaaacagaaagttctgttaacacggaagaatgaaatttaggcagaacagaaaattatttcaagtatattggtacactgaattcattcttttattgaacaaaatttaattgtgtccattgatgaccagataccacggagattcagaatatatcaaaacaacttctatttctgcccagtcttctgagttcacaccccaattgataatatgtgacagtatgtgatgatagggtggctatatacacattatatgtatttatgaagggggacagttgtacttgcacttcctttaagccagttgttgtgctaggcctcagagaagttacaaagacaaatgtgccagatgagatacacatttaccacccaatatgttacatttaaaccagaagcatactttttgaaagataaattttgcctgggaaccaaagaagacttttacatcagaagtgaaattttagcttggccttgaagttcatcttcctttctgtttttccttctttgtatcaattttggtcccaaaatatttattctatattattttttaattgaaatgtacagtatttatattacctaactgaaagttatgggtcaatctgattaaatgttacttaccatcttatttctatagataaaatgtattcttaagtacaaacatctgatttatatcaaactttctaaatttttcaaaatgcaaaatatatatgcgaaaatgtacaaacagaactgaacaatttaatggataattatgaagtgaacatagatgtaaaaaccatgcaggtcatgaaatagaacattgctggcttttcagaatccccgtttgtgcccctccctggtcacaaccctggaggtcaccattctccttgcatgcataatagtgtctttactttttttataattttaccttctatgcaggtatccctaaacaatttcatctcaatgtggctgtttttatatgactagaatcattctacatatatccttttgtgtctcacttctgttgctcaacacttatttttatgggattcatcgatgctgatgtgtatagttcattcattttcatcattatatagtattccattgtgtgagtataccacaatgtatccattctgtacatgcaatgtttggggcaattgtgaacaatgctgctatggatattctggtatacatacccctgtgcatgtgtacttgaatttctctagggtataaaactaaaagtaaaattgttaggtgataggatgtgtgtgtatattttcacctttacttgaagatgtcaactatttttcaaagtgccgataccaaatttacactcctgccaatatatatgaagttttccattgctctatatcctcaccactactttgtattgttagacttcaaaatttttacagatctggtggatgtgtattgatatctacttatggctttaattcgtgtttccctgcttactaatcaagttgaacatcttttcctgtttgtattgggcctttgattttctcttttataatgtccctggttcaagcttttacctgtgtgtacagtgggttgtttggcttttcttatttatttttagaagttcatatattctggatattagtcctttgttggtcatgtatgtaatatgtttcaccctgtggcaaatcttttcgttctccttattgtgtcttgataaacacatacactttgatattctgaaggctatacattggtaagttagaggctcatgtgatgtgacatatgaggcatctcttacattttgtatttttttttgagaccgagtcttgctctgtcacccaagttggaagtgcagtggtacaatctcagctcactgcaacctccacctcccgggttcaagcaattctgctgcctcagcccccagagctgctgggattacaggtgcacaccaccacgcccaactaatttttgtatttttagtagagacggagtttcaccatgttggccaggctggtctcaaattctgacctcaagtgatccacccacttcggcctcccaaagtgctgggattacaggcatgagccactgctcccaaccacatttagtattttagggtacagttcaccatttgtttctccacagaatagtgtaccaacatggaaacttaatatataatgcaagtttatgttaatccttaagtatgcctctattttaatgaaggaataagaagttgacttttttaaattaatgtttgttacatttcactctatacattatatgcaggtaatagagatgcagcaatgaaatatgctagaaaaaaggtactaaatttgttggttttggatcttagatgtctgacaaacagccaaaatctaggaagaaactagcaaaactaaacatctgttgctcacaggaaagcctttcaaatcttaattttatatataatccttatgatctttgccatctagttactcaacccaaaggatattagaagatgagaaagttacttctctataggcacatgtattgccacaaaggctaaactgttgacagcaagggaggatacagaaaagctatgaaagcaaaagctgatggaggaactaactccaatagtgtggttctatttagtgaagctatcaggagtgctatatggctgggtgtgttctgaggtcatcgcttgtatttcgcactacaccagaacaaacaagcacaatgtgatgtgtttggcattgtgggcaagagagagatctagaaactgggaccaaatgtaattaagaaaactaaagcttccagtttgggaagatcagagaatgttccacgttagattttactgaatgggtagaatttatccaggcaagattcgtgttgggagcaaggaggaagatcattccaaatggatcaaacagcaagagtgaggggtaagggagaaaggagaatatagggtaagtttggggcatggagagtcagtatgcctggttcaagttcagggtttgtgaattaaggtttgggaaataaaactggaatgattggctgagtcacatcatggcagatgctgaacaccattcaaaggaatttagactttattgagtagcacacaaaaaatgctgagggttttttttttgtttcagcatgatgattatagaattacgtttatcctcaccttgatgcgtcattgtccttttattctttcattctctagcctccaaaacagtctattgttagtccatccacaagttctggatctccttctttgtagctgccgtcagtgtatcaactcagcacctcttctctttctcatattgtcaaacacctccttttcctctgccatctaatgcttatttgttacctcatgctcccaatgagaactgctcttgaacttctactcctgaatcttctttctttaaaactccccattcttcaacaatagtttttgttgcttcacttctgatatctatgatcaaaattcgaaacacaagagtatgtctctgaagtgactgtactgctaatgccaatttcatattcacttacccattcattctccacattttttttctgagtacctactaggtgctaagtgctgctctagggtggaaacacggcagggaaacaaaacaggctggttttcatatctggaaatgcccactgctctccacattaatccatgcccttcccctcatccccacagagccacctacactaatattgcccctctcctctccccttcccctagtcaaacattattctttaacattcagggcatacgttgccctgaatttactttgtatttgccatgttgcttagcataaagctgtactcttaacaatgagttgaacactctctgttcctagcgcttgcctttcaccctgggatccagcaccgtatttccaactgtctatgacataactgcatttggatgacctcttgcattctactcgacagaactgaaactaaactcatcatataccacatccttgatctactcttttctcagattccatccacagctttgtctgtagacatcgtggccctccttcactctctatcctcttgctcaagtgacttccactggaggactctcatgatagcatattcctcagcctgctgcatattctgtataataggcaaggtctgtccctgggagcttctagaagaagagcatggctcccaaaccacatagcactttctaggacctagagcctccagtgagcaggccccttccctctgcccctgctcctcccctgggtcccaggcagtctgcaaacctctcctccaatgtgtgttttccagtacgtgtgtgatcagcttcagtaacagataatgatctcaaaattgccttcatctaccaaactatactgcatcactgtgtctccaaaattatttatctgtcctgagaggtacatttctgacctcaggaaagtattcctggaacacatcttcatcattagagtgattactggaatcccatccctcagcattttgtgagactgtatctccttctggtttgctattgtttctcatgggttagtttttaatctcaaccactgaatcacaagatccatgaacacaggcttatgattgctactgtgtgttacctgcagcacactgaggtagaagtagcttttcacagaaagagcacaaacagtaatttgaatgatatgttttatgtatatatctctggtttgtgtatatttatgaatttgtgtgtgtgttcctcagtgtgtttcccatatactctgtaagaagtattcatctatgtggtttgaggggcaagaacttggatattttccctggccattaggccagtgacataaactagtaagtcgggtcctccacaagctcatgactgtcgctggcgcaatacagggcttacctgagctgtagcctggagttatttttgcccccacttcctattctctctcaatatgaaagactaattttgcttttaaacatgaagggggtggccaggtgcggtggcttacgcctataatcccaacactttgggaagctgaggcgggtggatcatgaggtcaggagtttgagaccagcctggccaacgtggtgaaaccctgccactactgaaaatacaaaaaattagccaggcatggtggcacacgcctgtaatcccagctactcaggaggctgaggcagtagaattgctggaaccacagaggcagaggttgcagtgagctgagatcacaccactgcactccagcctgggaaacagagcaagtctctgtcttggaaaaataaaaaataaaaacaattaaaaatttaaaaaaaaacatgaagggggaatatgtatgtgcacatgtgtgtttgtatgtgtgtttatgcatatgtacatacatacgtatgtgcatgtatgtatgcatatatgtatatatgaagaaaatacaccagaatgtaaataatgggtatttctgggtggtgtcttttttagtttttgtattatgtcttacaacatgacataataaatttaacaaaaacctaatagatattattttttaaagaccagaaaggaacaagattatcagatagttgctggggtccaccctctgcatgaaccaagggtgagggacgagcaggtgcctagcagagaacagggtgatccgctctcaggaccttgggattcaagaaggcagtcagacagtgaattcaggctgacttgcaggactggcagaggttgtgagctgaagaactggcaactttgtttggttgtgaaggtcaggagccttggactgtgaaaagaaagagaaagaaaattcagggggtagggggctgggagcaggaaggggataagaagttcttgaaggtttaccccaaaaccccgcagtctagagacctgtggaaaaggtgaggaaaagcttgaaatatagcttcaaattcatgagacattttcatgaagagatatgcagtgggagagagaagcagacgtgtttccagtttggtgtttactttctgtgattccagagggaggggttcccagagtgactcagcatggggacacggggacccaggtcaggaggacacagagagcgcccactagggaaagcgtttgccactgtgtgagcagcaagcttttaaacaggaggtgggtcaagacagctcccccgaacccattaccctctcttccctcctctcccacagtctaaggacagagggaaggttttctggtaaagaaactatttctaacctttctaaattggaaacaaacaaaaaatgacatgaaacaagtattttccaggatgtctctcccacactgcctaggttcagagttctctcagagggttccctgagcagagggaaaaatggcaagaggaaaaacatagattgaatgttgctggctgtggctgatgtctttgcactggggtgggtgtggccagcctgtcactcaggaggcagcataacaggtgggcatacctccgcaccacctacgaggccttcctgctcatcgctgaccgctcagccagcctgtctttatcagtaacctccttatagaatttgggaagaagagccctggggtcaacatgagcagcaaacacaaacatctagattcaaaaggagacccttcaggcagagtaggatgcatgataaaacaaataagaaggtcgcaaaaatcagtccttgaaaagagctgacctgaaagtgtgtttcatggtattaatttatgtcttctctctatgcagtatttaatatttttgttactgtatatctcagtttttaattctgatggctgcatcaagtgatatttccagtctgggctctggtttgaaacctgaggtggagaaagcctttttaaaaccagttaatatagtattcacagagttcctctgtaggtaatgaaggaacacagaatacataaagtccctgccaaggacagaatcccccaccccatctaatggaagagatacaggcttttccctaaaagtccctgccaaggacagaattccccacccgatctaatggaagagatacaggcctttccctaagaagtcactgctataattgggcaggcagagaaaatcacaaaggctgcctgcaagcaagccatccagaggttaagcaactaacagtaaccactgcctttcttactgaactcctaatatgagcctggcattttacatgtactctctcctgtcattcccacaacaattcttcaaggtaagtatcattatcctcattttgcagatgaggaaaacgtcactccaagaggttgaataatttacccagggtcacacaaccagaaagtggcagagatgagatttgaacccaggtgtttctgatatccattatgcacactgccttccactggccaagtccactaaagaaaacaattggatgattcaggcaaaaacacacaaagcaacattttggcccaaataatataaattctatcagttccctcttctcataagctgaataaaacacacttgaatttaaaaaccaagaaaattctgtgttccatgtattgtctgttaatcactcactgtcttctgtgccaagcagagcatggcatgagtcaggaatttagaggaggctgtttattctgtcttagccatacgaatagcaattcaagcacatccctgcctccatggttttctaatccatcagacaaaaaacattggaaacatgcagtcgactgaagatgcatttgaaaatctattgcaaaataactgcctcaaattcttagtggaacgagaaaaggtataatataataaacatgttctccttttgtggctatttttctatcactggatgtccaatgaatgcaaaacgtctcactatagctcagctcttattccaaaagtctaacattagaatggggcctacagtatattaaataaacagcatttatatgaaggagtctgtacatgaatagggggagataggggaaattttagcataccctcccctcataaaaaagaatgctgagaaggtttggttaataaaagccactgtcctataaagtgggtctcactgattcttgcccctgatggaaaatgccaaagacaagtgcttctggacaatgtgtgctggaaaatgtgaaaatgtgcttgatatcctgcaaaactcagcttttctgatgttggagtgattggcataaagaaaagacctctgtgctaagcattccaaggcaagtgacccttagaattaccaggcaaatatttcaaaaagttgatctcaggctctacactggcctatggaatcagaaagccaaagtatagagttattggatatgaaatgtatatgaactctaagctgagagctgttttctcaaagaagagaaattactggcatttcaaaaaaaaatttaatggtctctttttcacacttccacttaaactttttccactagtccttgccctaggccagatttttgaaaaatcatctcaataatgtcatgaatgactatcatttttaaagttaagagctatgcattgatgtttagtttaaccactcttttaaggtaccaagtgggctatataaaataatggcttcctggataactgtgtatgtattttctcagggcttaagggagcaagtgttcagtatcacccatatgagtttatcacctatttcctatttctcacacatcaaaccatcatgagaaagatttgtggatatacagagatcatcatagcttaaggtttaaaaggggataagaaattttctttaacccccaatggatatatataatgaagtgacccaaaccacttcaggttaggtcctcagggacaggatagattcttatgtgaggaatgctttccaagatttttagaatccacaaacatacaaatgtacaaatattatttagaagatggattctcctttagaagaggcaacatgtacagtgattaagaaccgctttgaagtcacacaaaccttggttcagatctcaccccctccacttgccagctgtatgatcctgggcaggacttctccaggcctcagtctgcaaaatgagggcaatggtattacccactccatgaggttgtggtgcagatcatgtgaaatgatgcatgtgaaacactcagcaccttgtcagacatgtggtaagcactcaataaatgttagctattaataagaacaataaaaatatttttaaactgctatcctcttcagaattttaacaaccgtataaagagcagaatgccaaactcagcatttataagactattaaatcctgccactaaaataaattctgtaggccttgtagcacatctataaaaaaaaaaaaaaaaaaacctggtaatgacagtgaattatggtgtgtgtgggggtgtctagctaatcaggacagctgatgccaccttccatgctaatgacattacacacagaaaaaatgtgatttaaaattcttttttttgtttctttctttcttgttttttttttctttttaattatattttagttctagagtacatgagacggagtctcactctgtcacccaggctggagtgcagtggtgcaatctcggctcactgcaacctccgcctcccaggttcaagtgattctcctgcctcagcctccctagcagctgggattacaggcgcctgccaccacacccagctaacttttgtatttttagtagagacggggtttcactgtgttggccaggttagtctcgaacgcctgatctcgtgatccgccctcctcagcctcccaaagttctaggattacaggcgtgagccaccatgcccggccgtgatttaaaattcttaagccacttttgccctgtaaagttgggctcagtgagttcaccagtccttttgctgtgagttacttcacaaatgcatgtgtatagctcctggctttcttcagaatctcatctcctctctgaatcctaagtataccttatattcctggaagctcagggtaactgccacttcagcttgatgctgaagtattttctctcactaaatgaacagtttttgcccagctggagttcttactaagagagtttcagactgtttttctcatttccatgcggcaagtgtgatagaacctttcacatcatggagctgagccacagtcaatgtgagactgtgagattatactctggaattgatcctgaacttttcttttggccaagagccattgctctttagaatatatcactcttccaagagcattacaagttgaccttccttgagaggtcatttttcttaaggaaacagtgatttcattgcttcagatggcccagtagagatggtggaagccatgctggatatggaagctgggtctccagcttggctccccactcgttcactctctcactcaggaattcactccctcagccagccttgcagtctacccaaaccagctgcatgccttggaaaaattacagattgtcacctgtcatggtccctggaaacagttaaatcatgaattttaagtccattactgtcaacgatgtactatataaatgggtaaacttttgtcagtttctttctcccaattaaatgttatatagcaagatttgctggtagggcacagggaccctaaaagagcttaaacaagaaaacaaataaaggatatgaaataaacactaatgatcactgtcactaggatctcacatttaatgcatccccatttctattattcctgactactcctgcttatgggtctggaacgttgggaagccactgcaggactggtctacaggcgtctaatgggatgaaagcgtatggatttgagttccaaccaagttagtaaaagtggttcatcagtgatcctcctctggattgtggacctggtgggcttcttctgaaccgtcagaccaaggaaagtcttacacacactgtttcctctatatcctcttctacaaaatgattgtgtatttttcaggttgcactctgcactgggttactagaaatacagtaggttgcactgatgatttaactctgttttctataagggctacgggatctcatgcagatttttgcaaagttatatgcaaatcacagagcccggcccttttcttaacaggatggcaaccttgttcctcggtggcacctgggacctggagatcctttctccacttacgtttagcgcgcatcctgggacttgtccctgcagctcaccgggttagccgtggcaccgttgggacctcccaccaggactccaatcacccacctctcttgagacttctctggcagggctggtgtggggtgcagcctttgctcagagggcaacatgttccaagcaaaatctccccgcctgggccatgggctcaccctcggggctcccttcttctctactgggtgcaattcgaggttgctgagcttctctccaaagtctaaaatggtggggcagtagggacctgtgagaggcccaatggcccaatgtacttcccccagatcccactcagaacagcaggtacgcccaggctcctgctgccctagaggtctgcaacatgagtgaagaggttaattagagggacacacttatctctgaagtttttctccaggctgaacatttctattatcagtggcccctaatctggaaaaacccatcattctaatctagcttgtatccccacatcatgagaaagagggaagaagaagaagggatgatgtgtggtagagaagatgagggttaactttagcctttcccaaacactggcaacaaccacttcctcaacaatttttctatttgcttcagcctactcagattttttcaggtttttctagctcctccataacctcactccctcccgaggtctctggttcaaagaccaccctaccagcccctatttgcttcaggttatcctgttgagggtgggtgggaagagtgagaagatataaatgaaaaactggccacatgttgataattgttgaaactagatgatggtacgtggacattcattataccattctccccacttctgtatttgtttgcaatttttcataataaaaaagttttaaaagtcctccagtttccaacacactcaagagagagccccaaccccaaacacagagtttcatggaaaccccacaccaaggcaagaggcagagatgatgattccatttcatatatacactcattttctaactttttttaaaggcccactgctttattttcaatagattaaacctgatttctgagaggtcctgaagttgggcttatttccctggctgggttatgggggagggcagggtaaagggatccttaaaaaagtttacacttctatgtatctcacaatcttattgtgaggatgtgacttgttcagtgttctgaacttttcgaaggaatcgtgctctcaatgcaaagtgtcattctctggaattgcacctggctcaggaaaggactgtctttgtacttgaatttaaatccaatggagaactttaacacgggcatttgcatgactgagaattgctgctgtcttttttccgtatgtcactttcttgaatgtgttctaataaaatgattctaaagcaggctgttgatatacagtgatttataaatactttctgttgagtgctgaggcccttaattctctgccaagaacccttcccatcccactttccagaaagatctgtcaagctggggacagatgcaatgagcgtgtgtccggcatgatggcggcaccactgcaattgcagcactaatgagaatcatatcaaccacagcaattttgtcttctggttgcctagcaacagaatttgtttttcagaataaagataatcataggtagaacaggagtgtggtggggggaaggcagaggagggggcagggcaggaacaggagtataattgactcccccaggagggaatgagggagcagggtagaagggagagaaaagcagccaaaaagagagaaaggcaaacttcaaactttcttttttcagtggtagtcctcagcacgttcaagtgataatcaatggtaaaattttatttacaaaattaaaccttttgatatcaagctatagcaatttacaaatctcaaaatctcattaggcaaactggaagcaaaagggaaatatatatatctctgaaggtagatattttgagaaacacttttaatcctaatctttatgcccctccagccaagactagctagggcaggggtccccaacccctgggctgcagactaactaatgcctgataatgtgagatggaacagtttcatcccaaaaccatcccctacccacctgctcgcccctcccattcatagaaaaattgccttccatgaaaccagtccctggtgccagaaaggttggggaccactgagctaaggcactcccatgagctagtaacaaacttgggccaactctttgggaaatgaggcattgttaagaacctcatggcttaaaggcttcataaaaggaaggggaggcagaaccagtcaaggaggtttccattcactgggcgcttttctgacaccaagtaccaggaagacacttgatatcctctaattttcacagccatcctgagaggcaggtagtactttgttttccaaatgaagagaagtagataacttaaactcacagccagaacatagcagatctgtgattcaaattcagatctctcatccccaaatccatgcttttccaggtcactgggctgatggcccaggtgcccagcctggggtcttccttgcacacctcccacaggtgttcacatcaaggaactatgcagttctgtatgccctcggggtgcagaccagtgtcctgctcttccttgtgtgattggagatccctgacggccagggtctttgcagcacacatccatgtacccttgccttgttgtgtagagcacaggctgatgaggcggaaatcaccatttggttttcatagggatttgtttacttagcaaatatttttcgagtgcctccaagcgctgggcattatgaagtgggtgagtaaacagtccctgttctcacagagcttaccagtagaggagacagatattagtcaagtaacacatgagtggatatataaatacaactgaaaaggaccttggagatcattgagatcaactgatgaaactgagacccagaaatgctagttgcccaagcaatttgcccaagaccatgtagcaagttagggccagaataaagactagaactcagaactcctgattttcattcttaaactgttttccctaccctaatatgtcacactctggtctgctgcatatccataatagactgcccccaagccccagccagccatataatcatgttgatccatcaggacactattgccatttttagaaaaaaacagagagtattttgaaatgataattaaagagtatagtgaactaaatccctcagggtggcacttaccaaagcttgttttcagagttatctcggagcccagagcagaaacagagagaggcaaggctcccatgctgtagcgacactgactaataagggtgcttacaggtgtttcagtgttttggtctcaccccaatactttctcatctcccagattcagcagttgcttattcactcattaattcaacaaatatatactgagtgcctactaggtgccaggcacagttcttggagctagggacacagcagtgaacaaaacaggctgccctcatggagcatacattctagctgggagaaacagacaataaacaaaataaataacacagcatattagaagaatcaaagaaaaataagaaaggaaggtagggagtgccaaaggtagagatgcatttttaaatagggtagtcaggaaaaagaccttcctgagaaaatgatgtactcagtacatcattttctttatttagtgacaaataaatgtatgtatatacatacatatgtacatatgcacaggcatatatacatataatttatataatacagatacatatgtaagaccttcctgagaaaatgatgtactgagtcatcattatatatatacatatgtacatatacacatacatatatatactatacatatacaaatatacaaatgaattggtgataaatatatctctttaagtgtgacagtgcatttgacatgatttaacatgtcgctgtgggcctagctctgaatagccagcatattgtgtaatttgaaaagtcccacaagctgcttcctactccttacagaaaaaggaaaagaaaaaaaaagcttctcatggcatgtaccaatgcccaattcctagcattccctttttgtggggcactaaagaagtagttctcaaacttgagtgtacatcagaattgcctggaaggattgttaaagcacagactgcagggctgcacccccggagtttgtggttcaataagatttggatggatacaaaactttgcatttctaacaaattcccaggtaatgctggtggtccagggaccacagtctgagaaccactaaattaagctgttatagctaggaggttcctgttaaaatgaagctattgcctgagaaatgaggcatccattcattaggatgcatggatgttatcaaagtagttatccttaaacagcagaatcgtttaaaaattggactatttttttgaacaggggtaagtttcagaagccacagccaaagaccccaagcatggaggaattaaacaagggatgtgtcctgaaaggaggtgccaacagtatttcattatttgtctatcaatgctttacattttcataacgtaatacttttataagcccttttgaccactactttcttttgaccagttaacctactaggtgggcagtgcaaatgaattattacattttataaataagaaaattgagacaaaaagaggttatatggcctcccttgagctatcaagtctgagactcccagatctcttactcctattccatttttctttctccattaacatttttcataacactagctatagctttcgcctgagacatctattctgggatcattaaaatccaggacatacagctgctcttggtcttttgccctgttcagaatcccacttgctgcaagtagattattcatataagtgattaactatgtcacgtcctaggccctgcatcagtttcttctgccataaacacatttttattcttctccactgggtattttacggagaaaatgctaactcattttgttattagcctaagctagaacttagcattatgaaagcaaacctgctgggggaaaacacacataatcctttccaaaggcaaatagaaaagacattttgattatatgtaccattgctttcattccattagtagagataattgaaagttttctgtttcacgaaagtacccagcaaaatgagagtagattttgttatatctgatgactggttaatcacattcttgagtatttaaatctacctacccctccacaaaaaatggaaatgaagcataaaatccttttttccagttcttgtccttctagtcattttctccatgtctgcactgtctcctcttggtgagacagtgaggtctcccattgactctcatggtagggaccctgtgggtcacaaggagctatcttccttctgcttctatactgtctttgactatccagcagcccaaggctttagaagcttaatttctaaatctgctctcatctgtcacccaatacattgatattcttacatcttcttccttctctactgccattgggaccattcatttattcagtaaacatttactatgtatcagacactctaagagccactgaacaggctacaaaaatgagtttgaaataatcctatcctcaaagaacatggcatgttatagaaccactccctaaatcacatggagtcataaacatccggatgtcttctctatgtgggttacagtcccacgcaagctgctccccattttcattctctgtactctatgctcaaagaaagctagttgatgagttttttcagctccaacataaaataggcaccattaggaaataaaatacacctggggaagagaaaagtgggatgaggaaggagaactagtctgcgattctgagtacacacagagataggtatgtatcggcagcccaaaagcatggtaaacagggagcagtataggatctaatatctgctgtagacattccatgtgtggaccatggaaactgatatatgtgggtcataaagcttggatgactagaagtttcatattgatgaaagatccagtgtgaatgtggttttgctgagctttagactccaaagtgtgctgtgaaaatgactatcctttaaaaaaattaatgttcactgcaacacaaggactgaacataagagaaaacaggttgagttgtgggagagagtggaatgcaagattcaatgagctgaatcagtattagagaacccataagaaagattcagatcctagtccaacaatgtgtatgtatgtgcatataggtacacaaatacatatgcacaggaaatgtgtcaaaggccagtttttatgaggatgagtctcttaaatatatttcaaacttataatccagaaaggaagacaagtttagaaaaccaaaagtgcagtcagagttaaagataagattgttaggtgaccacacatcttcctcccatttgtgtggagctacctgaaggtgtagcacctttcacactctcagcagcttagaggggctcagcctctgaccactcttttttagattgggcttcgtgaatagaatcacaagccaggggttcagggtagatatgcagctggttctcagatctgtcctttgaaacctgtttttactggttctgaaaacctgtcctggccctgaagagagttttctcagcacagtgcttatatccaggcttactaatgaccatcaaaggtgccagtggcatgatagtacagccaggcctaccatgggtggatgtggacatggataatggtagccgtagttagaatttagagagttcagaaatagcagtgatgggagagggggtttctatgtgtctgcttttgagtttctgggatggtggaataaggaaagttattctatctgtaaggatgtccagtgattctgttacctattaatggtgaccttctaatcagctttatacctaacataatgtggaggttttagatttgcctgtgttgagttctgctgggtggttgttatggcatgcatctgagtaaagggaagtaccaggttgggggtggggataaaaaataattgatgtagaaagagagtttagattttattggtatggcactgtcactccgagagtgacctgtaaggatagcactctgagtgttgctctggtgtctcacagattcacgaggacttgcctgggatcttggccttgagaaaagcaagtggttgataaaattgattgacacaattgagcttctccaaggccagctggaagttagcaatgaaaataggaggctttgtacttctcagactttcctgtgttctcgtttgctgttaaggatgctgacctactgctttatgttttggtatttctgggactattcaaccaacaaacttgtaggagagccacaggtataaccctcaaagccaggccaacacagtactctctgtctaccctgcaaagccacataggcaggcttggagatggaataggtcattaaagaggtggaggggtgggagggggacagggtccttggagtccttgattgattggttggtgttgtagaataaaagtgatgacatttcagtttaatggcacagcaatatgttgcttgtagggctacacacattcacagccttccaggagaggccatgaagccatcccagcatttctggcttctgaggagtgaatgattcagaaattaaagtgagaaaataatgagcctagtgagtgtgatggtcattcaaaggggattgcttagatcatcaccacatgccagtttcccaacatgcctcagacctcaaatttggctataatagtaaaaaatctggataacttgttttttctcgattaaaagtcttataaaaatacatatggagccaggtgggtggcacatgcctataatcctagcactttgggaggctgaggcgggcagatcacttgagcccaggagttcgagaccagcatggccaatatagcgagaccctatctctaccaaaaaagatacaaaaattacccagcatggtggcgtgcacctgtagtcctagctacttgggaggctgaggtgggaggatcacttaagcccaggaggcagaggttgtggtgagccaagatcacaccactgcactccagcctgggcaatggagcgagactgtgtctcaaaaaataataataataatgataataatagtgcatatgggagcaggggtaggaggagtaaggatgtggagggttagatagagtagcaccactagtcacatctttggtaaatgtttgacatgagaagggctataaagggttatgtccaaaatagtataatgattgggattctggagagtccctccactatcagagactatagaaatggctaatacctcccccagaggccaatgaaggagttacgtctccaaaacaagagaatgtgtattgctaataattagtgactctcaagaagtactgggtatccatcacatcattcatttattcatccaacagctatttattagatacctactatgtgtcaggcactattctagacaggaaaaagaaaacaacaacaaccacagacaagaattcctgccctcatggagtttatattctggtggaaatacagacaaataagtaaggtatataaaatgctagatgatgatacatgttatggtgaaaaataaagctgcaaaggaatgtagggagtgcaggagatgaggaaggagtgcagggagaaactaagatccaatgactgacacaatcagggctacagagcactaggaaattcatccagatgatctcaaggcagatagtagtaatgagtctgtgagtgtcgggggaaatggagaggtaagggttttgcaagaaacatacagaagattttataaatctctctttattacttcccacaaaaagcatgaagattggctgggcatggtggctcacacctgtaatcccagcacttagggaggccaaggcaggaggatcatgaggccaggagatcgagaccatcctggctaacacggtgaaaccccgtctctactaaaaatacaaaaaattagccagatgtggtggcacacacctgtagtcccagctactcaggaggctgaggcaggagaatcgcttgaaaccaggaggcagaggttgcagtgagccgagattgtgccactccagcctgggcgacagagcaagactgtttaaaaaaaaaaaaagaagaagaagaagaagcattggggagaagcaattttatctaggagcaagtaggaactctcagataagatagcgtctgccccagtcttcatgcctccactgaagcgaagagggtgcccagaaatgtaccccagaagtcaagtgggaacctcaaactattcccccatcctttaccagcagtcaagagaagcctttctgatatgacatcagcctaggtttgaagaacctagattccattcaaagtgatgatgacctcacctatggtgtggttaaacatccttcaagttcacatggcgagattcgtgaaaacaaatcaaggtttggtccaagttctatatgaatctgggagccaagaattcatactattcatgcactgtttataaatcaagggaagcttaaaggggcattgcagattctgaatagtgtgacaggtatttgttttgtccctaagaggtttaaaaatattaattccctttggctacttcctcctgattcccagcagactgtacagtccctccagtctagtttgataaagtttcagcagcagcaggaagcatggtttccaacaatgcctgcatggagacccaccatggtaactagtacaaggacagagaaagtcccggtttgctttatcacaaataggacagaactccaggggacccagtgaagaggtgcaggaattcctgttacggtctttggataataattcatatagagtatacctattgcttggttccctgtgcccaagtagtaggtatgttcaacctagatctgaggccatgacagcaggaatatggctcagtcacagttgtgggtaaatgtagcttccctatgtcctctccccaagccccacttaggactcatcaaatttatgcagcagactcgagagttaaggagaacctggctctctcctcccaactgcctcagtgtgccctcaagagacaagcttttaaagttgaagccaaatgggaggggagcttagagtaccagcacacacacccaccctcccattcattgtgtactagttaccatctaatgctaaggttagctctagagagatacattgcaagactaagttcaggaggttgtttgccattgctatgttgaaaaattagtctaagatggcattggttagcctttccagataatggctgaatggggcaggttcattccaactcaggtcttgttataggagccaagtaatgtaacagcaaacaaaatcacattctctatgtggctatgagaaatcaaatgtaatacttggttattttctattttcttggatctatacttgtgctcagcagggggggctctaaacatacccatataggtcaaccatctttttgtcctatcctgataaaaatttaattttgaacatgactcagactcatctgtagattgcaaaaacttttgaacttatatgtacgtgtagatcattagctggataaagaatcagtatagttttataaaattcgtgtcaaatcatactagtacccaaactggtaattgccacaggataagttccatgagggtagggattcttgtctgctttcttcactgctatatccccagtacctatgctagtatctgacacattgtagataatgcaagtacaattacatagcatgtacagcaagtgcagtctccttagtgtacagaaacagagagagaaaaacttcccatctttagtgcaagcagactggtagatgaggacctcccctgttgcagtgctgaagagtaggaagttctccagaatgatgttatacttggcaaaaacaaggagcatgctgcttgagttccagttcttgataatgcaagagtggaagacaggtctgatgcatgatctggtaggcaaaactcaaatccagaatcgagggccagggtcgtttaacaggtagggcctgttaaacctagcaaattatagcgttggagcttctttgctaggttttcaggtagcaaagaagctctaaggccataatcaaggtggacagtggaacccaggtgcacagccagatgtgggaaactacagggtggtttggtcactgacaattcaaataattctgataaatgccaactcttctctcaacacagttttattctacacatgagcttttaaatgtgctacttgacttctggggccctgtagatcatttctaattaagaatggaaaatgggaagatggaaaaaaaaaaaagcaccaagggccaagaacaatgaacaagagaataaatccaacagggcacatgtcaaataaaaaagaaagaaacaactgctatgagaagtcagatttgaaaaatgtccctcatttggtttgcttcactgagttggttaccaatgagaaagactgaagtctcaaagacagtgttgattgcaaatgcgcttctctctgccctgccccacccccatctcattcaacattcctgaagctccaggaaatgaaaatgtgagaatcaatccatctattgtgagtcagcccaagaaatggtcaacagtggcatctgatgccaattccctggtagcaagtgaagctgatcttcagcttgattttaatgagctttaggactgttccaaaaatacataaaagggatagaaaatatccttaattagaagaatcatatagtccatttgggagagagaaaatataaatactcagggaacaaaattcataccatgtaggataggaatagctattgcattatcctgagaggtccaaaagttagaatgatctcgcctccctttttatctctgtccaacaccgaagatgagtcatttgatgtaatggcagtcatcttcaggttgtttttgtttttttatttgttgcccaggctggagtgcagtggtgtgatcatagctcactgcagccttgacctcctgggctgaagtgatcctcctgcttcagcctcttgagtagctgggactacagatgtgtaccaccacacttaactaatttttgtatttttttgtagagatggggtctcactgtttcccaagctagtctcaaactcctgacttcaagtaatcctcagcctcccaaagtgcgaggattacaagccgggttgttttaagaactgctagtaataatcatgatagtagtagtaacaacaataataaaatccagtaagtcggctataattgcattcagtttgtatttgtcttagtatggccccattataactctctccctttcttaactttatttttcctgccactctttcaaagttcccggactcctaccaatactcatccctaagacaattcaatcgagaacaaaagtgaatatatctgttgggataagccaagttttgctatggtaacaactctaaaaatgttggtggatttaaacaacaaggacttacttcttgttaacactacatgtttgtaatgtagttttatccatagcagggggctctgttcattataggccctcagggattctctggttgaccaacttctaaagttgccagttaccatcccagacagaaagataattctgaatgttcttactcccacaattaaatgctccaaactggaaatgactcaacaccaatgaccagaactagtcacatagacctactcaatcacaaagagcccaggaaaagcaattgagttatatatccagaaggcagaaatatttggtgagtgtcagaatgactaccttagcagttaacaacaaatcatacttgcaaataatttacatttggactctaatatttatattttggctttaactcaaatagattttcaaattttggctctactcaacagatttgtatatgtgaatttccaatttacaccttgaagtagtgttatttatgtttagctcatggtttgctttctgttaatcttggtattagtccattctcacattgctataaagaaataccagagactgggtaatttgtaaagaaaagaagtttaattggctcgtggttccacaggctgtacagcaaacatgatgctcacatctgctgggcttctagggaggcctcaggaaacttacatggcaggaacaggagcaagagagagagtgaggggggaggtgccacacacttttaaacaaccaaatctcacaaaacttactcattatcacaagaacagcacaaaagggatggtgctaagccattcatgagaaacacctccctgatccagtcacttcccaccaggacctgcctccaacattggggattataattcaacatgagatttgggcagggacacagactcaaaccatatcagtcctactaccctaatttctactcacccctgtccatgaatgataggtctcatatgtagggggtcagtgctaacgtcaatgtttaaagtataaaggtaagaaagcttcgtgttcttcttggaactttttcaagacttagagaaccaattcttagggtacaatggcctggtgagtctagtgggacatgagccttctgtatcttagagcttaatttattatattattcatatgctaaccagtggagttctctattggcatctggcataagattctctacacagtagatgatgcatggtagggaagtgaacttactgaatccccaatagcagagtcactgaccaatgttgcaaagcatgttttacataagtgtaagaacatgccacatatgtcatgtcacctcttataagtaatcctataagattgcatgacattgctctagaaatcacatagttactccattattacgtagcttgtggtatcactgccagggcaaattccaatgtaaaccacattcagattatctgcaaacctgggcaagaaaatgtagcactgtaatggcatagaacactgggttggaatcaggaaatttagttttgatcctaattctgctattgatcaggtatatgagctttgaaaaatgtgttagcccaatcatctcttatccacacctttttcctaggctgggcatggtggctcatgcctgtaatcccagcatgctgggaggctgaggtgggcggatcacttgaggtcaggagttcagaaccagcctggccaatgtggtgaaaccctgtctctactaaaaatacaaaaaattagctaggcagggtcgcacacatctgtagtcccagctactcaggaggctgaggcaggaaaattgcttgagaggcggaggttgcagtaagctgagatcccaccactgcactccagcttgggcgacagaggaagactctgtctccaaaacaaaacaaaagaaaaaaactgtttcctaatctgtaacagtggaaagtaatataaactgatttctacatttccttcttttttaatcagtatactttcctattagttcttaccaataattccatgacttttatgggaaaaaaaaaaaacaaatacacatcctaagtaatgttgaattggaaaaaaacatatttatatataaataataacctaattatatatataattatatacataattattatctatactgataaaagagacatagatactgtaaaatagtaatttttaaaaaattgtttatggctgggcatggtagctcatgcctgtaatcccaacagtttgagaggccaaggtggtaggatcacttgagtctaggagttcaagagcagcctgggcaacacagcaagacctcatctctactaaaagttaaaataaaaaataatttaaaaattatttagcttgaaatataggcacagatgttttcagaaattaacatatatgctccattttctctctcatttatttatccattcatttaaaaatatattgagcaaggccaggtgcagtggctcatgtctatagtcctagcactttggtaagccgagttgagcagattgcttgagcccaggagtttgagaccaacctgggcaacatggcaaaaccccatctctactaaaaaatacaaaaaaattagcctggcatggtggagcacacctgtggttcaagcttctcaggaggctgagatgggaaggtcacctgagcttggcaagttgaggctgcagtgagccaagatcgcaccactgcactccagcccgggtgatgggagaagtgagagcctgtgtcaaaaaaaccaaaaacaaataaagaaactgttgagcatatgtcatgtaatcagctgggttaagtgagtggagaggtgcaagcacattaaggacactggcaagagcattactaaaataatgagccatgcactttactctccaaaaggtgaagcataattccccactctaactatggcctgtgtatagtaacttattttcaaagagtacagtgtgaaagggagggaaagagtaacttcacagtggagaaatctggcaaacactacctcagtcaggttattatcaacaggttacctccatcaaacatcaacagtgagaggtcacgttgatagcacgtacccttgatatgatgtggtgctcttcctcaccaaatccataaccccagtctactcatgagaaaaacatcagatacatccaattgagaaatattctacaaaatacctcaccaaaactcaatatattcaaaagcaaggaaatcttgaaatactgtcacacccaagaggattctaagatgacatactaaatgtaatgtggaatcctgaatgggattctggaagagagaaagaatattaagtaaaaacagggaatctgaataatatatgaactttagttaaaattggttcatttatcagaaaaccaaacaccacatgttctcactcataagtgggagttgaacaatgagaacacatgggcacaggaggggtaacaacacacactggggccagtggggacgtggggggccaggggagggagagcattaggacaaatagttaatgcacagagggcttaaaacctagatgatgggttgacaagtgcagcaaaccaccatggcacatgtatacctatataagaaacctacacattctgcgtgtgtatcccagaacttcaagtaaaataaaataaaaatgagtcatggcatctaagctacatatgaaggaaaccgatgaagagagagtattgatggattgggagaaagtaaaggactctatgaactggaagtctagtggggtgatcaaaaggtgtgagtacctgaatgagcaaattggaaggagaggaagctgtggtaaggaaggaagatatgaggtgtctaattctaagcaagatagagaagtaagaaccagatttccttcctggcctgaaacaatttttttaatgggcaaaatataagaaacaataattttcaagacactggacatcagacaacaaggacagtgtgatccctgagagacaataaacaaaccaagcgaaccctgcaaataccccagcttactgctttgagtttccaggcgtcaatgcggggaggggtagaatgcctgtttctagccagagtaaaaaaatctcaaattcccaggaatcaggaagagtactcagaagggtcttaacctgagtagtggggaataataaatcctagactaaacttggctctgtttctgcctatgagaccctgtctcaaaaaatataaaaattaaaattaaaaaacagtgcatgattatatagtaaatgaggtggatggggggatatttcctataaagaagtttttttttttaaaacactagcaacttgtaaacacccttgaatatattaaaatatataaaatgaaataaatttggaaaaagattatgtacagatatgctcacaaaactcagtcatcatcagtcactccaagtgttccctgtattcacttcttacaccaatttacagcttgtttctcatcttttcttttaggcagagactttctggctctgcttataccagctatacttaagttttccaagagtgctacagcacaacctgatatgaaaacttgccccttcagtctgcttcaatctgtctggtcacttgggtttcagatcaggagtgtcacaggcattgctgtcggctgagcactcataattagctctctggtattcccctcactctctgtctcctttgtcaatgagatatggttttttgatccaagctgcttttgaattttcttttctcttctgatcagaatagaaaaacacagagattaaaaaacatctccaacctttccttgtctaccttcataagactctgtcatctagatcaggatcagaaggcttggctgcatataaaagaaaagccccaggtgacaccggcttaaataacagagaagtttatttttctttcacataacagataactgcaggtaagcggtccaggactggtaaagaagatccacaaagtcctcaggcacccggctccttctaactgattccttcaccattcccagggtttagtctaattctcatatcctagatggatggtgttccagggagcaggttggaagggaagggaaaatgtgccatcccccatattaaaaagaccattgcaacaaacactaagagttacatcccattggccagagtgtgataatatgcctgcaatagctgcaagggaaccagggaaatgtagtcttttactgggtaacaatgtgtctcccccagccacccaaaatgagtcttcgttactaagaagtaagggcacgatggactctgggaggcacttgcaagtctttgccatccatactcttttttttttttttttttttttgagatggagtttcacacttgtcaccaaggctggagtgcaatggtgcaatctcagctcactgcaacctctgcctcccaggttcaagtgattcgcctgcctcagcctcctgagtagctgggattacaggcatgagccaccacgtccggctaatttttgtatttttagtagagatggggttttgccatgttggccaggctggtcttgaactcctgacctcaggtgattcgcctgcctcagcctcccaaaatgctgggattataggcgtgagccaccatgtccagcctccattctattttgtattaccagaaaaattgctagtagcaatccattgtacatatctaattagtttcctcctccacattgtgtacttactttgtacagaaaaagatgttactttatttgtgcagaagagtattaatgtatagcaaaggtatccttgagactcataactcctaacttattccatatatcataaagaagcgttgtatttttccttcttaacatttaaaatatattttaagacagatcaatttttaaagagttatgagacattttcctcaaaattgatgatgccacaatgaaaagcccaaagttataaaccagtaaaaggcatttaaaatatacactctacacttatttctgaaaggacttgagaaagttcaattaaaacactaaaaaagatgtgaaatttaaaaagtaaacataagagaatccacatcttcatgcaggggatgtagaagtttcaaatttatgatgaggcgaagtacagcactttccatgtacttcagcaaactccagttgacaataattgaaaacctactccataagagaatttttttttaagatagagtctcactctgtcacccaggctggaatgcagtggcacaatctcggctcactgcaacctccacctcccggtttcaggcaattctcatgcctcagcctcctgagtatatgggactacaggcaggtgccactacgcccagctaatttttgtatttttagtagagatggggtttcaccatgttggccaggctggtcttgaactcccgacctaaggtgatcctcctgccttggcctccaaaagtactgggattacaggtgtgagccaccatgcctggccaagagaaattttttaaaaccacgatactttcaatccagtgaaaggtacaggaatgtagacaaataccatccaaggcaaaaaatgtgctggaatagagatacaaatatcattctgctagagtgaaaaggtagggagatgttactgggaactgctggtggtgatgatgcagacaggagctgcttatggaggcgattcgtgaatgaggtggcctttgaactggcctcgaggatggaaaaggatttccagaagatgacagaagtgtggtttgggaaaggaaggaaggaactattccaggctgagaaaaacatcataaataaaagtcaagaagttgggaaaatgttggctctgtctgagaatcagcaagcataggtgagatttggcgtgcaggatctgtctaggtagcagatgagtaggaaagactgagaggttgatctgagaaaccttatgtggtatgctcagggatttggacctggttctctgggcagtagaggaataggagaagaaggaagatgagcatgctcacattctatgacctctgttttctcagtaagtagtgagcaaatcttctgttcatgagatgtttgttagtttgtaaagaatgtaaagggtttagaagaggataatatggtaaggaatcaaaaaagaaacaagcaaaagaattgtgagaaacgtcgaagtccccacggaggtgttggaagtgaatttgtcttcacatttttgacaaaagtaaaatgtattagattaaataacattttggcttttgacaagtgcaagtacatataccatgaggcaaaaacgtatgtaccttctctcaccactgccttctttcagcacagcaggacgattttgagtgaccttgatataggaaccaaagaaggtgatattgaagagccaaagagtgtttgtgtgtgtgtgtgtttgtgtgtgtgtgtgtgtatgtatgtgtgtgtgagagacagagaaacagaggcagagacagagacaggatgcgagagatggggaggagagaggagcactatttgtcttaagtagttaagaagaaattatcactgggtgatagttgttggtcagaggagaaggttgtgtgtgtgcattgtgaataaggtgggacatttggatgagtttttaaagcagtgctgagtattctgggtcaaaatgacactaaaagaagataattttccatagagaaacttgtacaaagagaaacttagatgataacctaagagatattatctggtggagcaggagggagacagacctttccccttacttctttcacaagggcattgtaacagtaaagatgaatgtggagatttaagcagaatacctttcagaatgacgaccctgtagcagagcgaatagtggggccccaaaaggccacagagctcagagtggctggagcaactctcccaccacactcacgctgagtcttggcatctccaccttgtaattctgcctggggaaagctgcgaattggagcactaagttagaacttaagaatgcttttcgatctttttttgaagatttgctttatagatgaagaaataggtccggagagagtcagtggcttgcccaagatcactgtccacataggggcagaactagatggccatccagactcttgactcatagcccagtgctcctcctgccatttctaccatgctgtcgcatggtgcctggggggctggtgcagatcactgtgaaagtgccactgagttctgtgcagccctgatggctgcacgtgccactcccaaagatgcaactatggggatgtgatctgtagcctgccagatgaaggggagccaagggaagcagtcagatggggatttcaggaaatgctctaaaatgggtattgagagggttttagaagaaaaaatctacttaccaccctgtttcagggatattaaaatgcagtgcaaacctcccacatgcacttaggctttctgtgccttctggggactgatagatcttctctctaaaatgcattgatcctctgagggagatagaccacaaagttccaaatcctctcccatctgagaggtagaaggctggaagctttaaaacatcgaccattgttccattaggaaggatgagcatgacaataattatctaacttttgcacagctgagcacccaactcattgagacccaccagacgcacctgcacacccctggcaggctgcaagctctatggctcagcacaaagcaaaacagaggggaatgcagatactttgcccagaggtttagtgaggtgctgaataaagaaaggactatgaccactggtgtttttataggaaaacctgagagaaagaaggtagacaagccttgggttttccagattcttttgaaggaaggaagggagaaaaaaagagcaagagtcagagttttgtatatttttgtgcatttgactttatttgtatcattttgtgtttttttttgagataggtctcattctattgcccaggctggagtgcagtggtgtgatctcagctcattgcagccttgacctcccgggctcaacctcagcctccccagtagctgggattataggcatgcatcaccacaccaagctaattttttttggggggggggacagggtctcactgtcacccaggctggagtgcagtggcatgatcttgactcactgcaacctccgcctcccaggttcaagcgattctcctgcctcagcctcccgattagctgggattacaggtgcctgccaccacacccggctaatttttgtgttaatttttgtattttttatgagacagggttttgccatgttgcccaggctggtctcaaactcctgtgctcaagcattccgcccaccttggcttcccagtgctaggattacaggtgtaagccactgcacccggccacatttaatactttaaattattataaatgcatatgtgataaatgagctatgcaaagaagtcccttttatttttagtcacccattcaggctcttttagaagaaaaatatatgtcagggtagccatgcgcccaggtctatatataaagcagtttatggagcagttctcattttaaagaaatctgtcgtgtagccagacgatgtttcttggtttctcatttgggagttttttagacataatatgataacatggttaccataggtgtaaggtgaagggctagctgggtgggtagccatgcacaggtatttgagactctgaatcatacatatacacaattttggagagctggagtggaccttgaaatcttttagtccaacccttttgttttacagatgcaataaccgtggcttagaaagttaaagttgcttgtccaagccacagagctgggaatcatatccagggctcttcattttcagtccagaactcttgacattgtatctctctatcatggtgctgtgaaggtcaattttttggcagatctagggccactccgtgggcaccacttaccaaaactaagccttatgtgaggcactggtttatgtccatcacagctgacatttaggggttcacgatcatgttccctagctgcatgccagtcaaccccccacagcagagcttaggaactatgtaagtattaattgttctccctattactctgggctgactgtcacctctttagcacagttggaaacagtttcttaaaaactgaaaaacagttggttagttgctagtcacagcctgttctgtgagggagtggaacttatttcctgtgtcttggtggcataaaatataagccgtctttggcgacagaactgtttttgttacctaactgtcagaattcatgaaggtttttgtgtatatgtgttttgttttagaaaacccttatgattcagctgggcatggtggctcacgcctgtaatcccagcactttgggaggctgaggcaggtggatcacttgaggtcaggagtttgagaccagcctggccaacgtggtgaaaccccatctctactgaaaatacaaaaatcagctaggcatgatggcacatgcctgtaatcccagctactcaggaggctgaggcaggaggattgcttgaacccaggaggcggaggttgcagtgagccgagatcacgccactgcactccagccttggtggcagagtgagactctatctcaaaaaattaaaattaaaattaaaaaaaaaacccatataattcttggacctttataaccacgcagttttattttgctaattttacatcagtcctaccgactttagttaaattcatttagttgcttggaaaagagctctctcaagataacctggatcggccgggcacagtggcttacgccagtaatcccagcactttgggatttcacttctgatcacttgaggtcagaagtttgagatcaacctggccaacgtggtgaaaccccatctctactaaaaaaaaaaaaaaagcaaaaattagccgggcatggtggtgcatgcctgtagtcccagctactcgggaggctgaggcaggagaattgcttgaacccaggaggtgggagttgcagtgagctgagatggtgccactgcactctagcccaggttacagagggagactctgtctaaaaaaaaaggtagcccagatcatttttttgccccaggccgagatggtgccactgcactccagcctgggtgacagagggagacgctgtctcaaaagaaaagcccagatcttcttagggtagcttttcatgggccaagtgcccaccctagtccaatcacctgtgggcacagaatggactggcgttatgtgatagaagatgctgctgcctcaggcctgccttgtcagcagctataagcagggcagcttcttgtagaaggggttgtggccatgttagacaatgtccttggcctgcttaatttaatattataatcaaaataaaataagtaaatcatcagggaggcggctgaaagtaatggaaaatagaatttaacaacaaagagtttgtggttcagttttcagctctggaacttagtagccgtgtgacttggagcaactttgagcctcaaatttctgttgagggatttataagggttaaatgaaatgatacacatgaaaacactttgtcaactatgaagcaccacacccacgtaaagcatattatattacctcctgtaagtccctcgaagcataaaatattccatttgtaggatttttggatatccctttctaaattgaatgtcactttccggcacaaagcttgtacctctggtttcagatgactaccccttgttgtcagaatctgcagaaatagcccagagagctcaaggttgttaccctttacacatagctgacccaaactgcattattcctagagtgctttgttcagagagaataagttgttagcattggcattcctttgagtcctctgacccaaactccctttatgtgcagatgaggaaccaaggcttagagaggttaattgacttcctcaatgtcactgatagtaccagagtaacgctcactcaattatctattgctccctaacaaattacttcaaaacttagagacttaaaacaatatttattatgtagtagtttctgtgggtcagaaatccaagattggctttgcctggtgtttctggcccagggtttcttgtgaggcggtagtcaaggtgttgcttggagctgcaggcatctggaggtttgactggggctagatctgcttccaaggtggctccctcacatggctgtcagcaggcggcctcagtttctcaccttgcggacctctctctagggctgcttaaatgtcctcacgacacggtggctggcttcccccggagtgagtgatttagtagagaacaaggaggaagcagcaatgccttttatcccctagtttcagaggtcacgcatcaacacttccgtcatattctacacattcgaagtagtcactaaacccagcccacactcaagtagaggagagaggaattcaattccaccaatccctgaagggtgaggtattaaaaaaatttacggactttttttttttttttgagacggaatctcactctgtcccccaggctggagtgcggtggcgtgatctcggctcactgcaagctccgcctcccaggttctcaccattctcctgcctcagcctcccgagtagctgggactacaggcacccatcaccacgcccagctaattttttatatttttagtagagacggggtttcactgtgttagccaggatagtctcgatctcctgacctcttgatccgcccacctcggcctcccaaagtgctgggattacaggtgtgagccaccgcgcccggccttgtggacatattttcaaaacaccacaggtttcttttaatgtggcattttctttataaatgagtttccatcagaaatcagcaggttttttttttttattacttgatgaaagataattctcattcggcagtaattagtagaagagaaattaatttataaggatgtcttctcaggataatattgagaaaacctctaatgtgaacaaaagggtaaaacagggagagaacagtataagaaaagaaagacaagggaaaaacagaagcaagggtgcattagattctgacttctgtgggcagagttttctttcaattcaggaaacactgagtgaacagatgctatgtgaatcatgtctaggggcaggggtttgaaggtacaaagcctctaggtaccccaactctagttgcagagcatgacccatatatgtaactagcccaaatataaataacatggaagcttacattaaattctgtcatgaagttacctaagcttatgttaaatactgtaataaaggaaactgtcatgtgtgttgggaacatgaaggaaggaaacaattcagtagctgtggggtttgtaaagccttgcagaagatatgcaaaccactccattaccatacatgcacactggcacttttcatatcctttccttgctttatttttcccttcaatacttatcacaagggggccaggtgcagtggctcatgcctgtaatcccagcactatgggaggccaaggtgggcagattacctgaggtcaggagttcgagaccagcctagccaacatggcaaaaccctgtctctactaaaaatacaaaaatgagtcaggcgtggtggtgggtgcctgtaatcccagctacttgggaggctgagacaggagaatcacttgtacccgggaggcggaggttgcagtgagaggaaattgcactactgccctccagcctgggcgacagagctccatctcaaaacaaaacaaaactatctatatcgatacatctatatcgatatagatacagatatatctatgtatatctatatatctatatagatatagatatagatctcactatgtaacatcttgattattttgtcattatcttgattacatcctcaagaatacaaactccatgagggcaaaagtgtttgttgtgttcagtgctgtatccccagggcctaaaggagtgcctggcacataataagcactttgtaagtattgttcaatgaatcagtaagataattaatcaattagtatggaaactgagctcaatcctaaaggggcaggacaacttggcagatgtggactggagggtagggtgctctaggcagaagggaagctgaccaaagccactgtgtggctgggcctgcagactgtagttgctgtggaataaggtgagatcagaaaggcaggtactagaggatgtttgtgaaggagttaggattttgttgtacacaaagggagcccacttaaattttaaggccaggagtgatatccatgctttttctctatgatcttgctgcatttaagaatatgtgataccaggaaggttcccacaattcctatattacctaacatttgatttgctacacattgaccaataatcctacctcttttactgtagcagctagctcttcactcttcgtttgctctttttttgtataggaaatgtaaaaccctctaaatattgaggtctcttatgttcttcctcctttgctggcgagcctgaggtcaacattagaccctgggaaattcagtggcattggtagtggctgtaacacagtagttttatgcctagggaatgaatcataaatttattgctataatttcaagggtccctgatgtgtagggtatttttcttttctcaaatcttatatgctgagattttttttcaagaatccatttcattgctgctggcagcaactgtaggcagtgtgggaagctcacacagggacatgactgtcctagagcccaggggtgagggacctctgcttcctgccctttgctagaagagatggagtctctaggctgggtctcaacaacctcaacccagaggccagggcagggggttgggccccacctgctgtgagggggctatcccaccttaattgtggatgtctcatgtaacctctgttcagcgtccccattaaggaaggtatgggatgctggctgagactttatgatgcagcctcaccttgatgatgcttctttgatgtcctagagagcccagacctctctaaaggaacattattttagataaggacagcaaccgtcttaactctgaaatctctcagcccaagctcagaacataaccccacccacacgtgactgagaaaagagatgcattatggttgagaaagcagagatcacacataggaattttttccgtaagtcgtctccctttttctagttcccttaatataaacagaagcaactagaaaacctggagagtaacttactatgggaaagggaaggcacttagccactaatcccatttttaaatacaatggccattttcaaaagaagataaccaccattgtcctttttgttgacaactctgttactttgtcaaagtgcttagtgattaaaaggcagtgatatggccagtctcacctgtaatcctggtaatttgggaggtgggcagatcatttgagcccaggagttcaagaccagctctggcaacatagtgagacccccatctctcaaaaaaaaaaaaaaaaaaaaaaattagccaggtatagtggcatgtaccttgtagtcccagctacttgggaggctgagctggggggatcacttgaacctggcaggtcaagactgcaataaaccgtggtcatgccactgcactccagcctgggtgatagagtgagaccttatgtcaataaaaagagtgagagagagagaaagaaagaaaggcagacagtggtgattttaacagtgacttcatatggactccaatatagaagagggttgttgtggaagctgggttgggggttagggaaagagaagtacaaaatcagaatgcctccttcaccatggaaaccttgtaccctcacaatataggggatggtcttagacccaaaagcgcccagtgtggatccatcttagatgcagctgaaaggagagagggagtgtctcggaaggatctcttgtaggtctcagagtctagtgaagccttttcagggagatgagaagcaggtggaggaggctggtaaaaatgcagtttaggaaggtcttagctgtgagagaacttcgagaatacagagacatcctggcccatatatgctggggatacatgtctgtgggcttggggcaggtatttgggaactacattctgtcctggctgtgaatccagaggcagaatactcacacggatttgttgaatgaatgaatgagcgaatgaatgaacaaagaacttgaagtcagccttaaaggagaactttctatgcagtctcttccttttagaaaccaaattggtttgaagtcgaccaaaaccctccagaaggggtggtcaaagcaccgggagaggagcacctcttttttaaattccattttaatttattttaatttattttaaattttatttatttatttttatagaggcaaggatctcactgtgttgcccaggctggcctcgaacttctggcctcaagctatcctcctgcctgggcttctcaaagtgctgggattgtaggtataatccactgtgccaggccaaaataatttttatttatttagtattttttacagacaaggtctcgcttggtcatctaggctggagtgcagtggcacaatcgtagctcactgcagcctccaactccagggctcaagcaatccccccacctcagcctcctgagtagctggttctacaggctcataccaccatgccaactaatttttttatttttgtagaggcagggctgtgttgcctgggctggtcttgaactcttggcctgaagcaatcctcctgcctgggcctcccaaagtgctagggttatagggcatgagccaccatgcccaacctgtacccagagtgactgtctctagattggaatccaatatattgcctgtagctaaagtcccaggagagcaggaagggagaaaggatatctgatggttacaatgtggctcccctgtcatgatgctggttatggttgtgcccctccccaccccccagctacccccttacccctatgtataccaaaccttttggctcaagcaggggactctcttttttttctcttacatgtaccaaacatgttgtgaggttgatactaccgaccatctccatagctaagagctcattcttctccctgtttgctaaaatgggggcataggagccttctcacaggggcaatttccaggttttctataacttgcccaagtgttcctccaggttctgatttttcctaaagataaaaagaaatttgctctccatctaagcactgccacaaggaactctcagcgagtgtggttggtattcccaagggcctaagttttcatcaccaagtccttgttcactttcttttttataatattttgtccaggacatatttcaagtcaagctggctctctctagctaccaaactcataactacaggggaaggggtacaggaaagaaagaactgtaaaaatttataagataagtagaactttctctgctttctctgaaactatctggctgctctcaatccatattggtatggttgacttatatttaaaggaggataaaattgccctctcttcccagtttttggagggtctgccatcttgactttgtattttgccatagctattaaatcttaaatctagcccaaatattctaatgggacctacattttaattatctcccatactatctagcccccatctcttacagctatcaaatggaaggcaaaactgtccaattcttctgaaccctctctgctcagcaccactgagccattcagcaggaaaatgggacagaaggtctagaagggagtattccatgtgacctcagtggctcaatcacaccaaataataacaacagccattaagtaggtatcaagtgttcacatgcattataatctttttgttttattttgtttgagatggagtttcactcttgttgcccaggctggagagcaatggtgcaatctcagctcactgcaacctccacctcctgggttcaaatgattctcctgcctcaacctcccaagtagctgggattacaggcatgtgccaccacgcccggctaatttttgtatttttagcagagatgaggtttcatcatcttggctaggctggtctcatactcctcacctcaggtgatctgcctgcctcagcctcccaaagtgctgggattataggcatgaaccaccgtgcctggtcccatgcatgataatctttaattgaaacagcagccctattaagttggtacttatcttaatctttttgaatgaggaactgaactgagtgttctaatattattgacgaggaactgaagcttagaaagagaacttatatctttaacatttctacagtaacacagctaacagctagtcagtggtggaacttgaattcaaactcagggctgctgagttcaaaacccagattataaatcaccatgatgtagtctataagctcctagacttaccaattccctcagcctcctctatcttgccactgccaactgaaacacagattatggactagaaatactgacttttttttaaggaaagaaaaccccaagaagccaacacacacacacacacacacacacacacataatcacacacacacataatctcacacacacacaatcacacacacacacacacaaaatctcacacacacatacacgggtccttctgactaatgccaaacacagagctctgggatgccttattgttgaaacaatgccataaaataggagaaaagtgataaaactaagaagccactctaaaaatgactattcagtaagccaaatagggaatactgttttattttagttttatagtatatacatatatacacaaaagttttataatatatacatatatacacacaagccatccaaaatatgtccttctcaccgcttcagtgttaaaatgtgtaagatgaacaaaattagtcccaggaaggggacatcactgtagaaatcactgtgaaagaatgtgagagaggtggggaattgagagttgtacttgacctccaaaagcaggaaagacagggtctggagaggaaaagggaaacaattgagatggaacattgcccatccatggaaatccagaggcagaaatggccaggacacatttggggcaccctcaagagatcaagcagataaaatacacagacaagtagtggaagctggggttgaagaagtgggtggggaagtgttatgaagggctttgaatgccaggacaaggatggcagagcccatgtaaattctgaaataagagagtgttatgagaagaatggacagtgggagagaccagttaatgaggagacacctgcagaaatggagaggcaggtgatgaacacctggatgagcataggggcttccaagagacaaaggaaagacttaatagctttgcaggactaagtgatagatcagacataaggggtagagaaaagagtctctctcaaatgactacagtttctccaaaaatattttgagattgggatggacaggtagttcatctgggctgagctatagtggagggagccggaagggaggaagaggaagaggcctggtacagggtaagggaaagagaatctgcaagactgggccccgatgctacctagttttgtgatcagatcccattacttgccctagtctctgctttctcatttctaaaattaggaatttcatccaggaaacatgtattgggcccccaatatgtgccacctactgtatgcaattttttttgtcttatatttcctctgagggctggtggttgccctagccagtgtagtatgagtctctttgggaccagtcttctgatcaaggaacccaagcacgtgtttcctttagaaaagcctagcttttgcttccctctagtggctacttagtgccactagacctctgcctttactctttttgtccctggagagccagtctgaattgaaaattaagaagttaagaccaggcgcagtggctcacgcctgtaatcccagcactttgggaggccgaggtgggcagatcatgaggtcaggagatcgagaccaccctggctaacacggtgaaaccccgtctgtactaaaaatacaaaaaattagccgggcgtggtggtgggcgcctgtagtcccagctactcgggaggctgcggcaggagaatggcatgaacccgggagatggagcttgcagtgagccgagatcgcaccactgcattccagcctgggtgacagagcaagactccgtctcaaaataaataaataaataaataaaaagttaagatggagctggatcataaaccatgcacatgttcaagggaacagtacaaagtgttccctagagggcatgtcatgatggttggtatccagagaggatggtgagaggaggagacaaaggaggcatgatgtcatgaaccagaggtgaggcatggggaagcagtcagtcccaaagcaaaaccaaccaacaatagcagatgggagcagaaaatcacattaggactcacccagtaagtgggttaacctgagcaaatggaaagtatggggtcatagataaaggcctgtctttacactgaagaaggtaaggtcagggataaggggaaaccctaacagtaatttgctgagggcaaaaacttgacatgaagatgctttaagatgctgggaaccctttccgttgctgataccaattctactcattgctgggcacatgtgctggatctggggtggtgccagcacagctggagatgggctcatgttggtggtgctcagcaactgacctagaaagaggcagatgctcgagggtcctgctggctcctagctaagcgggcgtgaagatgttattgactgttgcagccaagggagggctcacaaactaacaagataaacagctctgagaagacacaaccacagcagtagcaagtggagcaatggactgaggcagcactggtaagagccaatcactttctgagggaccccattccccaaccctgggccagcatccctcatttctcctgttgtcacattcagcatgcatacacgtgatgtgtgtctccttagagactgtaagcatggtgcaggtagggacatcacagctgtctccctgactgctgtatgccccatgcccagcacagcagctggctggtgaagaagaataagtgcatggatgaggaggctggactcattaggcttggagtcctgcctttgcagttagctattaggatgcaatctttagctagtcattttacctctctgagcctcaatttcctcatctataaaattggatgataatgccaaccttatgagatctatgagggtcagatgatgtctatgaaatagtttataaactataaagggccatacagatgttaattattatcttagtctgcctgaggatgaaaaattaacaagatgtctgctgacatttcttctggcctgagagacagtgaccaggagtatttgctttctgaatcaaagcatttagaatgcgctgtttcttctgaacacgaatctgtaagtcaccccgctcccagccagaccccttacagaggcaggttgttcccctctcaggtgctccgcatgtgccctcttcccatctccagtcctggcagacaggctgcccgtccccagattacctaacaataattagaccaaccagagtttcctggtcaaccagaggagagcttggcctctttccaggaattagtttgccaggtttctatgtgtgactggataccttgacctccaccctacaaccacagtgtaaataaacatgtattatctaccctgatttggcaaccagttccaagaattctcttcccagtctgattccaatctgttgtttctctaggatgcccagtataggaagagcagaaagtcacatccgtggccctacaaagggaaattatagcctaaatttagggtactaaatctttgaaccgtgggtttgggaatagtttactatttttttctttctagtctgccagattatctcaagatatgtcattaagggtgctttggaaattgatttatttttgtttgtttgttttttgagatggagtttcactcttgtcgcccaggctggagtgcagtggtgcaatctctgctcactgcaacctccgcctcccaggttcaagtgattctcccacctcagcctcccaagtagctgggattgcaggcgcccgccaccatgcccggctaatttttgtatttttggtagagacagggtttcaccatgttgaccaggctggtctcgaactcctgacctcaggtgatctgcctacctcggcctcctgatgtgctaggattacaggcgtgagccaccgcgcccagccctggaaatggatttctactccctcgacacaagatatcagtgcaagaaaacacatctcaagtgcatgccaagttatgattactggataaacaatatataacatctattaagcatgtaatgcatatcagggtttacctgtgttaatgtaatccttccaataactctatatggcaggaattaatatgattcctactttacagataaggaaaatgagccaaagagagactaattaacttgctccagatgatacagatagtagcgattgagacagattcaaacctaagcagtctagctccagacccagtaatccacagaaagggaaatggttacccacatctgaataactgaggtttgatgacattttgcacttctgtgaaaatcgtctctggtctttggcctggtttcctctgaagctcagttttccagtgttgcacagtccatacagtagacaatttgcaggaatgcctggggctttcagagaagcccgtaacttcttctctctctctaaccatgaattgctctttttgatcaggtttcacccagccacctctcctccctcttctataggtagccttgggattttcagaatcatgtctatgagctctttcctccttccaaagctatagggtgtgttgcaggaaatgccttcctgtgcaagcacaatcaaaacagcagtatagacagcctcagttaagcacaaaggagccaggagatgcctccctgtagacaggacagttggacagttacctccagcctgagggtcagtgttgcagaggcaaagttgccagtgggttaatcctcccagccgcatctctattgacaacttgtgtgggttccccaggggcaatgagatgaagatagaagggagaataaataccagttgctactactgcctcttctttccccgaggagagtatggctctgcccttctcacccaaacttgagtcagtgtctagttagatgttctctgaagcctaggcagggagtacagagataaagaacaggcacaggccaggcaccgtggcttacgcctgtaactctagcactttgggaggccagggtgggaggatcacttcagcccaggagttcgagaccagcctgggtaacatggcgaaaccccatctccactaaaaatactaaaattagccaggtttggtggcatgcgcctgtaattccagctacttgggaggcagaggcaggagaatcacttgacctgggaggtggaggtttgagaagcccctgtgaattaagttggggtttttagtaggctacatgctcaaaggaagccagcagcacaacttgaccaaaaggccctcagattacattctcctttttcagggttgttgttccattttctggaaaatttccttgacattatcttgcaactcatctatgaaatgtctcatttcagccataacatttttaacttctgagagctctttctcactctacaactttttccctttatgtaacagcttgttcttttttcatggatacaatatcctctcttatctttctgaggattttatagtgttactgatgttttattgtcctgcttgcattttgtttcctctgagttcctggtcctttttctgtttatttattttggtctctgttagagaggtttttctgaaaagtctggtaatctatagctgaatattcacatttatgactgaggcacaaaggctgactcaatattctgtgtaaaggaaggaacttgttgacttaaagttctcactgtgaagtgatctggcaggacactggaggttttgggagcagagagggatctctaagtgtcagtatttgagtatctgtacatcttttggtttctcccatgaatgattctaaaatctccctaacatgtttatatgtggctgctagcattctgggatccaagagggacaaggatactagccatctctccattctacatttaagccttcactgaatttcatttttcaggaaagtgcgcataggatagaagagggatctaggagtcccatcttcctgttttagccccacctgtaggtccatcctcagtgccgtctggtgcttccactccctggggctgtctgagggttgagcagagataactggcaggagcttgaatctcatcttctcattctaccaagtcagtatcattcttgcatctgctttctatcattaaagaaaaaaaaaagttctcagcccggcgcagtggctcacgcctgtaatcccagcactttgcgagtccgaggtgggcggatcacgaggtcaggagaatggcgtgcacccggaaggcagagcttgcagtgagcggagatcgcaccactgcactccagcctgggtgacagagcgagactctgtcccaaaataaataaataaataaataaataaataaataaataaataaataaataaagttatcttgtttactacctcccattctctttgttcttgtggatttgtgtctccccccactaacaccttatgttgtttttgtcaggtttaggaattcatggagatatagtcacatgattaaagggcaagataaatttggttgaaaggggctgagaaaaaaaaattaacagttatctgtaagatactaataggaataggtgggcagccaatgggagacacctctcagacattgtaactaggcatctcagttatatatcaggcaataattcatggaatttattcactcgcgcattcaacagatatttatcacctgctgtgtgccaggcattgctctaaactcgggagataggaccatgagcaagacggaatgctctgctcttctgtatcttacataggataagagtaacacataatttatgtaaacaaggcaacacattaatgataagtgctcaagaaaattcagtagcactgtgtgttagagattcaatatagaaactactctatttatcaaatattaaaactggaagcagccctggagtccaatttcctcatcttaaaaatgaggaaatttaggtatgaagaagggaaggggtttgctgagtgtcatacatgggtaaaacctgcaccagcaccaaggcctcctgattcccactcctgcattcttcccactattaattactatgcaattcacaagacctgcaagaccaggggaccatggtgctcatttacacaccatgggaaacaactaaaccaaacagctccttcagttgcagttagtagaagccacagttccagcaagcaaagataaagtaaattgtaagctttagcctcttaattggacctggcagctccatgggcttccaacatacaaactgatgaaatcccagagctccacgacaatgttcctaaatgcccagacattgctttacacatttgctaaaaaaaaaattataatcaattcaagataaaagcacagcactaagctcttttaatggaacctagtttctggagaagccttcagagttttatagtagggcgaggacagaagtttagtagaggaaggatttgaagcagctatactaaagcatcatcagcaatttggggctttcctgaagcttctatagtggccctagagcaaaattggaaactgtctatccgctcccccatttctcccctcaaagtgttacacctccttgaaatatttgcatttttccccattacctttgttgatttgttttagagattgttattgttgatgttatcattactttcattataaagcagcacttatgtgagaaacactgggcaatactggagatcagaaagccagagggaaaattacccagagtgcaccacccaacaataccagtgttaacatttcaacgaattttccttctgtttcctatgaatagggttgctaagttgttgatgatgttcacacagttatatatacaactgtacgtcttgtcctcttaaaaaattttttactttatataagtatttaagctattacaaagctttataaataatctaatggctgcataattaattactcacttagtagatatatcataattatttaaccattcccttcctgttaggttttttaagtaatttcaacttccatgttagattcaagggttacacatgcagttttgtcacctaggtatattgtgtgatgctgaggttttgggtacaaatgatcccgtcacctagatagtgagcatagtacccaataggtagctttttaaccctcatccacttcccactgggtagatttttatattttagtattggggcaggggggcggtgatgttattgttgtaaaattttcttcatttgaaaaaatgctattatgagcattttcatgcttaaagtacagctgcatgtcacttgtgtggtgcatctcatctttttgcatttggaagggaatcatagtctggtttgaggtgtttcatgttaagggacattacctaattaaatgaaatcactttctgatggaggaattccaggcattagcagcaggtgcagggagtgttgaggggaggagagaaagacagtttttgcacaggagttggcaggacttcacggtgcccttgaaactgtgccaagtagatatgctccagctttacattttttgccagccagctctggcctcctgtgaggctgttcatatgtagatgttaattcatgtgaacttggtgcctaaggctggctaagagttgtggaggaatcagatgatcagatggaagaagttgcagggcaggcagccaggggaggaagaggaggtcggacttatctgatgggcgctcttgggcacagctccccctctgtcaagagtatcagatccaagtgctctgcaaggcagtgtcagaagtcagtattcacagttagaaggctcagttggcaagtattgagggcaggtatcagattctggggtaagggggcttcttcacatggaagcttcctggaaagcaatgcggaatgaagaggcaagagtgaatcctcattttgcataagggattcctcggtcccaccatgtctttgtttttatcataacaggaaaagtatgtgctgatttgagggaggtctgagtcaccttccctagtgagcctcagggtcagttcttctagttagggcaaaactccatgaagattactttaaaaaaaaggattcacttacataataatgtatatgcatatatacagttgatacagtctgttaccaaacaacatgccatcaaaattgatgtttaaaatttcttctgtactcctttcctcccaaatttaaataataattcactaataccgccagaatttttttttttctttgagagggagtctcactgtgactcccaggctggagtgcaatggcatgatctcggctcactgcaacctctgcttcccaggtttgtgcaattctcctgcctcagcctcctgagtagctgggaatacaggtgtgcaccaccacacctggctaattttttgtatttttattagaaacagggtttcaacatgttggccaggctggtctggaactcctgacctcaagtgatccaccgccctcggcctcccgaaatgctgggattacagtcacgagccactgcgcccagcccagaacttattttttagacaatcatttagctctctctgcttaaggcactatcctaggtgctttaatactatctcatttaatcttcacaacaagctgtgaagtagatactgtcattatccccatttgacagatgaagaaattgagacaaagaggtgaagtaacttgctcctggtcacacagttggtgaggagctgcagagcccatgccctaaacgaggctatgctgccttggagaatggagcagagacacagaggtgcacaaatggaagctctgaaatgacaacaggagaattcttcaggggtcctgtcctcactctctggatgccattgggaaaccatcacagaataactgtgtcttttccataacatgaggaagctcaaagggacaatctagctcacacagtttatacaagaaggaggttcagttaatccccaaatattaatcatgtaaaaatagacctaaatgaaaatgatcatttctggtgaacgtgagaactttgaaaatgcagatggagttacaaagagtggttacgaaatgtcccttatgtatgtagcggtccatgctggaaagaagccagcacagctatcactgtggagctggaggaaagtgaggacaggaggagctccttctgcccctctgggaagcattgcggagggtgaaggaggccgtgtccacccagggattggtcagcaggggaacaggccccactgggaatggccaggacccagaaaggagagagactgggaaagtaaggacaaggagttggatggtgactcagcagcaggcacttggagggaagccaggcagacaattagcatcaagaaggcttagcaggccttaggcagggttctagggaattaggcagagaaaatatctgagagctcctgggaagggggccaagacttaggcatgaaaggccagacagggactcgctgctggagtgggagcatacagtgaggggagtaagatgagagaagattccagaagcaggggtacaagatcagagaagaatcaaaaacataacctgaatgcatgccgagattctgtgctgcctactcagctcccagcatctccctgagtaggaataactttggtcttagaatcttaccctacagcatccctggaggagaggatgggagggactgttgcaggagcagctctgcctgacccctcaaaccatttccccagcaccctcccttgttggccattctttggaattcgcttcttgccagggtagggacctggtgtagtatatctttttgatcaagccattgaggtgaagtgaaccaggatattcatcatctatttgaaccataatggcttttgggctgtatctaaagcttgagcccggttgtctacaacgtgtgagcatggaagaaattgcccattgatcttgtttccacttcttcctttggctggactaggcagcctacaggaggcaaacactgccatctagtggcgtatctaggcttctcgccaggaactgtgtcttgaattgtagagagacagaagcctgatttttatcctctcccgtccagcccatgggtctgattgtaacccaccctagagggaagtgggtcttgtatctgggtgccatgctgggctgtttgcaactagagcttcaggccccttctgctctaacagtctgcaaaaggactacactcatccctggattcaaccatgttgccctgaaagggctgcaagttgcatccccagctatgtgtgagcttggcctcaagaagcaaccctgagcccctggcgtggtcgcagaggagcagctctactgaggtgcagaagctcagtgatagagagtctctcagttagaaagaatttcagtcatctaggccggcattctacagagtccattagcgaggtggaatcaaattagtgggatgtcaacagcaatagagaaaaacataaaatagaatgtcagagtggagcttgtgtttcagtgataaatctattcacatgtagtgttccctggtcaaaatatgaagtgtatttcttacagagcactttggaatctgaatcccagcactttgggagactgaagcgggaggatcagttgagcccaggagttcaagaaaaacatagtgagaccatgtcgctacaaaaataaaaataaaaattagctgagtgtggtggtacacacctgtaccacctactgggtacacaccggtcccagctactcagcaggctgaggtgggaggatcacttgagccagagaggtagaaactgcagtgagccaagattgcaccactgcattccagcctgggtttcagaatgagaccctgtctgggggcagtggaaggcattcccaggccctaacccaggcctactgaatcatgatgtgtgattgaggggtggagcaagagaaggaactgctagggaatctccattttattagctctccacatgatttttatgtatactcaatgcctaaccactgatattgacatttctgagcttgaatttcctgatgtatgagatggagatgatagtaccacctggttattgtgaggaccaagtagataattaatgcaaaggtattttgctaactgtaaaagtactctagagatttgaggtgtttccatcccacaaaatccttctctctgtgatgtttttaaggaggatagcaccaggagagtgggggagtgaagactgcatttaatgggaccaggagagttaaatggaaaaatattttcttctgtctccttccaccttctaccttctaccttctgtcctgcagatttcctgatctgatcccaatggcagtcctatggggacgtggttagcacagactccctgccctgtaactggtggtgatgcatattgccaacatcagtctgatgcattattttaaccgtttcaagccccctctgatatcgaagtccctttagtgtaaatctctcacagtcctgaatgctgagcttttggtcctggtgggactgttaattatctactcactgtggcgttcactgtgtatgccactgggcagaagcttcccagaatgtgtgtgaaatggctacacaacatatttggacaagtgcactaatatggccactggtgcagaaaatttgggccctgaaggcttaaatcagagatgcacagactgaagtcgaattcctggaggtggtgcaaggactttgcctccaaactgcttttggggtgaactttagaggataacaggctaccaagctgggcctcagcctcctcattccttccgttccctacctgtcactctgcctctaagtgcagctgctcttccaagagggagactgtacttagttctatgagacaaactaataaccgaatggattctcatggaaatatgaagccagaagaaaggggggaagtggggccaaatccccaaggtgaaaaagtgagaagtctcagcattcagccagtaggggttgttcctgtcaaccccttttattgcttctgccccaggatcagtgaattaggaagatgccagtgtggagacaagccagcatggagcatgagggctgggcgtatgctcctaagtaagaagtggcccgtcttcccttctgattcttcctcctggtccccagtgcctgagcctttgaggctattcccctcccagacagacattgctttacttctgcctttgaattgaagccccattctttttgtagtcctcgtagcctcgattttaggctgatggctccagtaaggggtggggatgggaggtgttgcaggggttagaaggaaggaaggctgtctcttccattattccctatcatctagtgagaatctaatgggaggggtgagttagaatagatgcccatacaataggagtctgagggtggtagtcagggcagggacagggcacagggtagaacccttggaaggagtaaaggggcatatagggaaggggtttaacggcacaattagctgaagcttggcaaaggaataatgagctctaacgaagtaagaggaattagaatcaaagccctggttctgggcaggcttcagactgtggctacagctagaaagcctgagtgattgaatagcactgtgctaattacatttttttcttgttttctttcctgttctcaactctccttttcatcttctgccatctctctgccctaaacaccatttttcctctttattccccttctcttcctccttacctctgctctcacacatccttcgtcccctctcaccaaccctctcccatatttctccccccttcctccatgccctcctgttctactccctccaccaccaccctccaaagctctctggtggatgtgagctgacagtggtcctccaggacttcagtgcgggccacagcagtgagctgaccatccaggtggggcagacggtagagctgctggagcggcccagcgagcggcctggttggtgtctggtccgtaccaccgaacggagcccgcccttggagggtctggtccccagcagcgccctgtgcatctcacactcccgaagcagcgtggagatggactgcttcttccccttggtgaaaggtaggagaacagagcgggtgggaggcacagaccaaggaggccatgagcgctggcctgactctagctgaagaccaccatggaagtgacctgtctcacagacccatttttaccctgtggggtttctttgggacctgactgtgaagagaatgggttgggaacttggagaggaagagctcccgagtaactgtgtgtgactttgggaaagtcatttagccttcctgagtcagtttcatcttggaaatgaaggttgaattaagtaacctccaagatctcttccagttttcccatcatatcacactacattcgggaaagtcctcttctacctttggccaaatatggtttagactcatcctttctccactgacccactcccgctccacagcaacttctggctctctgacccccgaccaagtactcacatgctgacctggagacaccaggcacacccagggaggagccacagctgagtcagatctgatccttccctcagcccagccaggctttgaggtccatgactcctttatgtgccttcaacagataaagtattctagccttggcttttattgtatgtaagctctgtgttcccttcacatgcctgtttactcactttttctcatgccagggagactaaactcctcatgacagtgtttctttaggggtggtctctggattagtaatatcagcatgccctgggaacctgttagaaatgcaggtgccagcctgggcaacttagtgagaccctgtctctacaaaaatttaaaaatgcaaggcggcacatacctgtagtcccagctacttgggaggctgaggcaggagaatcacttgaacccgagaggctgaggttgccatgaggctgcagcaagccaagattgtgccactgcactccagcctgggcaacagagcgagactctgtctcaaaaaaaaaaaaaaaaaaattaaaaaaattagctgggcaaaatacaaaaattagccgggcatggtggcgcacgcctgtagtcccagctactcgggaggctgaggcaggagaatggcgtgaacccgggaggcggagcttgcagtgagtcgagatcgcgccaccgcactccagcctgggcgacagagcgaaactccgtctcaaaaaaaaaaaaaaaaaaaaaaaaaaattagctgggcaaggtggtgttcacttgtagttccaactactcagggcatggtgaggcaggaggatcacttgagcccaggagtttgaggctgcagtgagctatgattgcatcgctgcgctccaacctggctgacagagaaagaccgcacctctaaaaataaaaaatcaaagttaaaagccaggtacagtggctcacacctgtaatcccaacactttgggaggctggcttgaggctaggagtttgagaccagactgggcaacatagtgagacccccatctctacaaaactaaaaaattttagccaggcatggtggcacacacccatagttccagctactcagtggggggctggggcaggaggatcatttgagcctgggaagacaagattacagtaaaccatgcttgcaccactgcactccagactgggtgacagagcaaggtcctgcctcaaaaagtgtttttaaatttaattttaaaaaagaaagaaacgcaaatgatcagaacccccactcctccagagccggtgggtcccaacagtctgtattttaacaagccttccaggtggctctgatgcacatttgagtttgagatccactgacttgtgaagtccaagtggcagaggccttgcagccaagcattttacactgaggaagccaaagccaggccttagttctgggcttatttttgtaactggccagataatcagcagcaggcatgccttctatgcagacctgtgctagatatttctaggagaggaagatggggacgagggtcagcatggagacctgctgcaggcttcctgatggttaactgtgaactcagaacatatttaaaacactccggtgtctggagtgccatctggtctacctccaaagcctgacttcctttcctccactagatggcagcagcaggctgaattgtttgtgctgcatccagccttccagggttttttccaccaggagaaaaatgtcagctaagaccgacgtcctaattctcctcgtgccctccactcccaatttaatcattgcctgctttcccccctgtcctctgaggactaaggagggactgtgtcaggaagttgtgtgggaatttgaaattgcaggcacaagaggaaaatcaaggaaactcaggaatctggttccgcttgaagtctagccaagaggagaagagggtacacagaaggtagattgtgagggtaaaatgaggtaatggagacaaaacacagcagtgcctggcattcaatgcactttagttgtcatgataagtttttgctattatatcatttgccatagattatccagcaaaataactacacactcccacaagtccagttgagagacccatctgcagagacaaaatcaagcacagcaattcatttgccgcaaaaggctaacgttccttggatccccaggtgtgggtcgttttcatcaggagggactcagcttcaagggaagatgagacttcctgacctagacctggcctcctagcctgaggctgggtaaaatgtgcactccctccctgctggggctgccacatgtgcaacttcgcaggagcaaacccaaggtggaaagccagagagcagtgtcagagtcaatctgtgatcccgaagtgggaggtggaagcattcagggtaagaattgcacaggactgggggttgtctcgactataggacagattagtggagatttaactaaaaataggagatgaagaccaggaatggaaaatagaggcaagagacaaagctgggagggaggctgtcatagaactttccagctaattctgccaaccagcatagcttcttaaaggtaccagcagtgcctatcacccatttctttggctttttatttccaggttggttcctgtttccccaagcttaggccaattatgctgagctttcaaatggcatcctgtgaggtcttactatcttctcacccatgtgagctctgaatacagaggtccccgactcccaacagtcaaggacctaagtcggccaggcgcagtggctcactcctgtaatcccagcactttgggaggctgaagcaggtggattgctcaggctcaggcgttcgagaccagcctgggcaacatggcgaaaccctgtctctacaaaaaaaatttaaaaattagccaggtggggtggtgtgcacctatatagtcccagctactcaggaggctgaggtgggaggatcacctgaccctgggaggctgaggctgcagtgagccatgatcataccactgtgctccagcctgggttgcagagtgaaaccctgtctcaaaaaaaaaaaaaaaggacctaagtctgcattctccatggagcactccttatgcccttaactagaccccatttgaaagtgtgtgcagttatgcacatagcccagcctcaaaaccctttccctgtctctctggggtctgcccagagtgttggccttagctaagacccaataagctattccttctcttattccagctggctgcctgcttggcaaaccgccttttcttctctcagcagtaatttgtctccagtgggtgctttaccttataagttatgcacaactagattgagaataaaatgttcctctgggggttgtggaataggacagagtggtctcatctggtgtcaggaggttggaatcaattcctttttcaattcccataagagaactggtcctcttagcatttgcagagagcaccaagtcagcactcttgcaggctgtgtgaagcagggactatgtgtgagggctaagcaccttgtgagtgctcaggccatgactatcaccccagaaatggggacaaaagaaccacaggatggttcttgatgatccactagcacagggttcccaacgctggctgcacatgagaatcatctgggagcttttccaaatgacaatgcccagaccccacctagaacaaatggaatcagaatctctggatggggcctgagggtcagtatttttaagtgttccataggtgaatctaaggtgcagtcagggttgagaaccactgcactagcccggtctcctctcttccaagagaacactcaggctcaggaaagcaaggtgacctccctgaagccacagggagtctgtggccaagctggagcagaccagggctcccagcacctgttgagcttctgggtagtgctagggctcctctctgcccttccctcctctgccttctgtgggagcagtggttggttatttcctcctgataagtcttggtgtcattcatgatggggttggtgaaaaagagtggggctgtgtgtcagaattggggtggggctgcctttcctgctactttactgccactctgacatcttagggcttctcactgggattgggccctccagccctagtcctgcctttccacaggcccctctcactttcacagcagcaggtggtggagggcagcacctcccaagaggcaagcctttgtagcagtggtttccaactctggatgcaccttagaaaccacctggaggaggtttctaaaaatactgatgcctcatatccaccccagaacaattaatccagctgccaaggacctggacatcagtatatttttaagttcttttgtgaaaaaaataaaaagaaaaaaattagccgggcatagtggcatgcacctgtagtcccagctattcaggaggctgagatgggaggattgcttgagcctgagggttcagggctatagtgagctgtgttcacgccactgcactccagcctgggcaaaagagtgagactctatctcagggggaaaaaaaaagaagaagaacaaacttagtgattctgatgttcccttagggttgagaaccactgctttgtggactcagcacccccagggtgtcaagcttaggagatacttaaagatgtattagaaaggttgagggttaatgtccagattatataaagaactcctgcaactcaacaacaacaaccaaaaactaaatttaaaaatggacaaaggacttaaacagaaatttctccaaagaagatatacaagtgaccaataagtacatgaaaagatattcaacatcactaattattgctaggaaaatgataatcaaaacaacaataacatgtcactgcaaaggatggctattgtttaaaatgtgcacacacagaaaataacaagtgttatgaggatgtggagaaattggaacccttgtacactgctggtgggaatgcaaaatggtacagctgccatggaaaacagtatgggattcctcaaaaaagtaaaaataagattatcatatcatctagcaatccaacatctgagtatatatccaaaggaattgaaagcaaggacacaagcagaaatttgtacacccatgctcatagcagcattattcacaatagtcaaaaggtgaaagcaaccccagtgtccagcaacaggtgaattgaatatatacatacaatgggatactcttcagccttagaaagttaggaaattctaacacatgccacaacatgaatgaaccttgaggacattaggataagtgaaacaagccagacacaaaaggacaaatactatatgattccatttaaatgaaataccttgagtagtcaactttttagatgtagaaagaatgatgattgccaggggctggagggaatggggaattagtgcctgttgggtacagagtttcagttttgcaagatgaaaaatgttctggagatggatggtgatgatggttgcatgacaatgtgaatggacttaatgccactgaactgtacacttaaaaatggtgagaatggcttttaaaaagtattggtcctgggtacttctgccccaggctccaataaccagtctaggttcttctgtacctggctgtacaggacacctgtgttccttttcctgtgcactttcttccctggctggggctgagggtctggagaagctgtaaggaaatacctctctgcttatgaaaccaagtccaaggcttcccccgtgagcctcagaagcagatgctctagaggagagggacagtggcccatggcacccctggcttgttcatgaggagtcctctccctgaaggcctcctgatgatttctgctgttaccacctacttggcctcaggaacagcttccccatgctgcagaaggtggtggagaaccgtggataaaacttgggctctgaaggcaattaccatcaacagcctgagaatgccgggcaagtttgataatgtcgacttgtgttaagtgtgtcaccaactcacaaaaatacctaacatttattgagctttaccatgggtcaggttctgggttgctttatgctaatagcaataatattttcctcatcttacagataaagacactgagtcttaaaaagattaggtaatatgctcaaagtcacatagctgacaagcagtgggcctaaatttgaacccacgcctgtccatttcccaaggtctcactttaccactgtgttctacaccctcccaagtctgaaagcctttgagacaggcactttagtttattctcccatctgacttggcttgttagccagtctagctgaatctaagagcattaaccccattatagttacacatacccaccttcccactctccctctcacctctggccccaaatgccccactctctaggaggagtggtagtaatcagagacagattttgtcctgtgggtgctttgccaactaataagattctgatgtcctcagctggagcagaatgactccaaggagcactctggacagcaggctgagcttagtccaactctgatagcggcctgccaacccctggtgctggcccagcctgttcaacagattgtctgcaggatggaagtcccctgcactttctgctgccaggagccaaaatgccaaaaagttcaggctcctctgcctaccaggagagtcctccaaaggtctttctctacctcttacttttcagtataattctgcattaggagccctaccctcaggtttttcatttatgccataatgcctaacatggcttcactatgggaggctaaaaaaataattagaggatgaatattccctaaacatttcctttcaggtacgaagtgacatgttataaattgcagcttgctgatttactttatcctacagtcctcaattgcaggattgaagtacgatccttcaatcctcttcatttgtataggattgtactggtaattgactagatgtgaggtagtcctttgagattcagaactcacttcctcatagaagcagaagtatacatgggagtatgatcaatgagggtgagaacaggtttccacactagcccacaacattttcctttatattagcatagctgaattaccctatgtttgcaatgaaaaggtgtggtatggtgtttttaaaaattataatactgttgggtaagaatagctgaaacccaaaaataatgcatttgaataagaaatgttgtaatttatttgagtactgatactttttgaagaaaagtatgtttaaagatagatggagagagtctaaaaggagctccttgacatttttcagaatcataaaaagttagagttgaaacttactctttttataactggataaaaccggttcttgaatagatttaatttgactccagaacattggcttcttttggctcctgggatcttagaattgaaaagcaggtgaaaggtgttctagctcactctctttccaaatacaagaaaccccttccacaatgtccttgacaagtggtcagctaagcattacttgagcacttctagggactgggagcttattacttctagagcctgttggattttagtgtaattctaagggctagaatattcctcatatattgcactgaaatccaaacactttctacccacgtctccttctattctcccccgtccgagccccgagtgtaaatccaccagtgctaattattattctccctctccttctgatctgtatctagaagaaagtaatacaatttgcagataaaatgttaaacacttctttcctaagctatataagcctagcaatttctccataaatccttttattaaacgcttagagcagaacaaaatgtttttaattaaattcaacaatcctgacttgtttaaagtgattgtttgtgtttatggattaatagtcctttccaatgtccttggatttgagaacttcacagtccatccttacccttgaactttgggcatcccctggtttctcactcacagacacctgatctgttgtcctctctgggcatagagcttagaggcaagtgccttctactctgagactctctataggctggacttttttcctggttattccctacagtcattcatattgctatttgttctaaagtagcatttttattaccttttattcatgtcttcctgaattacctctaggatcctttccacttctaaaaatgtctgtttttttctctctgcatcaggtaattacctttgttaatttaaagggattaaccaaagtatcctgtgtttattttattttttttctattttttattttggagacagggcctcactctgttgcccaggctggagtgcagtggcaaatagctgggaccacaggtgcttgccaccatccctagctaatttttgtatttttttgtagagatgaggtttcgccatgttgcccaggctggtctcgaactcctgagctcaagcaatctgcctgccttggcctaccaaagtgctgggattacaggtgtgagccactgcacccagccaaagtatcctatttttgatgcatataagcatagcataaatatcttcattttgaggtccaattttttaatttggggtgcatgaaatctccatttttgtagtaaaaaatggttgagactgggtgcagtggctcacatctttaaccccagcactttgggaggccaaggcagatggatcacttgagctcaggagttctagaccagactgggcaacatggtgaaaccccatctctaccaaaaatacaaaaaattagctgggcatggtggcatgcacctgtggtcccagctgctgggggtggaggtgggggaagggctgcagtgggaagggaggtggaggttgcagtgagcctagattgtgccactgcactccagtctgggtgacaaagcaagaccccatctcaaaaaaaaacaaaaaacaaaaaacaaaaaaaaaaacaggttgaatgtcagcaatttcagttaaaaatggcccaacctaatgtattgtaatctactgttttttttccttaaaagggtactggcaaatctttgaaaacggaacagaatttagttctcagggaatcagatggggtgggaagaagacagggtatgaaatgagaagccacttattttgagtagaatgtcacctaatcttcctgggtttagcttccacatttatgcaaaaggaagctgataaagatgcctatgtaacagagttgctgggaggctcaagggtagaaatgttaagtaaaagtgatttttaaactgtgaggttggttttattattatgtgcacaggctgattgtttaggataaaacaaaagttgtctgtggctttacctcggtatgcagtagactataaaaacatggtctgtctgtaatcccaacactttcagaggttgaggcaggagaacctcttgagcccaggagttccagaccagcctgggcaacagagcgagaccccgtctctaggaaaaatttttaaaaagccgggcatggtggtgagtgcctatagcctcagctacttggagggttgaggtaagaggatcacttgagcccaggaggtcgagcctgcagtgagctgccattgagccattgcactccagcctgggcggcagagcgagaccctgtctccaaaaaaatgtcttggggtggaaggcctgagtctgaatcctggtcactggctagatgatgaccttgggtaagacacttaaaatctatgaaataagccggatgtgatcatacacctgtggtcctagctgtctgggacgtgagagaggatggcttgagttcattgctgcagtgagctatgattgcacaactgcactccagcctaggcaatggagcaagactccatttctaaaaattctaactttaaaaaatctgtgaaattgattaatagcacttaaactccaacaaggtagactttgcagtccagttatgccccaccaaaggtggtcagttaatgtgaagttccctgcctgctctttgtctaagttctgatacttctatagggctgagtacagggtgtttccagcctgaatcatccccaggattgttcaaggggtcagggttctctttctagtttccattggttttcttttttcttttttttaccagacagggtctcactctattacccaggctggagttcagtggcatgatcaggcctcactgcagccttgacctcccaggttcaagtgatccttctgcctcagcaacccccaagtagctgggactacaagtgcgagccattgtgcctccataggttttcagaggccccagcacaacctcctgtctgcactggctcccttccctcagtctctattcctaacctaccctgggtcctttctacagtccaccaacagcaggtccatctggctccgtgatttcccaagaaataatggcttaatcctctcataactttcttttgactttaacccagaggattgagataatatttgatatatttgagctaaaaattcaagtttttccttggcttgtacctctggcacctctccatgacctattctctgtcattaattctgtggtacttgaaggtaacatttggaccacattatggagatgggctgacctgtgtgatgggggttgtgctgacactgtgagtgttgggtgtatatgaggggaccactctttaattcaaagaagagcaggacagagaggagtttcgtggaaactgcctcaggcctgctttgttctggttgagatgtcctgcctgtggctacatccatctaatactatttaggacatgaaagggcttagaatcaaagcctcaaataggaacatgtcagggcaagccacatccttctctaaatacaactcagtgtcgtgctgtctccaagtagaactgaagcaggaagacccaggtgtccatggaaagagctggtctctctgggtccctctgcagagatcctgcatttttcccttttgtagccagcctgctgtgactttgcttatgttaaatgccaatttcaacagcatgttttcatgcctgctggtgcccactgtaaatctgtgacatctacatgatgatgatgccccttatcatccagaggggaagtcaggggcaaacttgaatatgctctttggagccaatgaaccagctgatggagctcagagctaaaatgagagcctcaggatttgatcccagagaagaaaggctgccactgactgctttctgagaagaagctggagatgatagagaggaggttaccccagcaaacagaatgttcccccagaggaaagatggtgcagttttcttgcttacagctagctaagctgaacactttccccctagaagaacacggggacccaggaatgacatgcactgaatgtgacttgaggaaaagagaaggcaaggcaatggtctggacaatcttgggatgtgcccatcctgtctgctcagggaagggcagagatgggaggacctcaaaggccttgaggagcagcccttgcaggccacagctctaggagctctcagcaacaggattctgcaggacagagcagtcagcaccctcctctcaccgccacactgccttccctgtctcacttgctccttgagaacaactcctcaccgaggatctatgtgggggtgaaactgcagccttaacccaaaccctgcaaacaagcatgagaagtctttccatttactactaattgccattctgaataccagccctctgccctatgggcagttactgaacagcctgcccctttctttgcccttgtggtaggactgggttgtcttgttttctccccgtatccactaaccccagccagaatcttgattctcagattgtgcccacttgccttactttccacatgggcctctaggccacaggaagtctggctcctcacctttgtacacaggagggcgaacagataattgccccgttgcttgcccccagctgcagggaggtggcccaggctgaagacccatctcagttcagaatgttccagtgtctcctgtctcatttccagtaaaacgaagtcctttctgtgactgcaaagaggctccacaaaacctgttctggagcctattctctgacttcatctcctatgtattcatttcctgttgctgctgtaacaaattaccatgaacatggtggcttcaaacaacaacacaaactcattatcgtacagttctgtgggttggaaatgcaacatgagtccccatgggctaaaatcacagtttcagcaatcagggccacattcctttttgtaggctgttagggaaaagctatttcttgcctcttccagcttccagagaccaccacactttctccatcttcaaagccagcaatgttgcatctttctgatcctccttccatggtaatgtttcccctgggccacagtgggaaaggttctctgcttttaagaacacccaccattacactgtcctcaccagaatgatccagcataatccccttgcctcgaggtccctaacagaatcacatttgcacagtctcttttgccatataaggtaacatatttataggttctggagaggaggatgtggacatctttggcggacgttattctgtctaccattcacctgaccagcctgcctcactgagccattaccaatcaagccatgcatacgctcacctcagggcctgatcttttgttccctctgcttggaacacaccagataccccagatcctcagagacttggatgtcttgctgtcacacttccttctgcttgaatgtcacctgattagagaggtcttccctaactcccaccctctcccatcacagtgtatactcccttctctgttttacttttcttcattgcatttatcactacctgacatatttgttaatattcctctgcaaatcccccctaccaatacagggattttgtctactgtgttcattgccctatccccagcatctaaaacagtagctgccatgtaagaagttctcagtaaatatttatagaaaggagggacggatcatgcatcagggacctctgcagagttcttatgtgaaggaccaggctcagcatgtagaacggtaaaggaaactggcttaagctttagcaggaggacttcaggatgggaatggggaatcatgttctgatgctaggagtcctgattgaggaagtcttctctggggacgtatgggttaagtacctctcatttatttggactggttgaaggatgagcaggtcattatccacattccattattggcagatgtacatcctttctattattggaaatcctcaataaactcacctgagttacatcaagacaaaatccactttccatttgactcatcagaaacctctgcactgtactccgtgaatgtacatgctgctgcagctgctatttgtgcctgtaggagggaaggtggcgttggcagaattaaaatgccatcccacatagtggacacttagcaatcataagtttaccttaattgaaactcagagtgatagactggcactcttatactgccctactttgggaacactttgacctacttagaggtaaacgtttttggaagtagataaaacctggagtggtttgtttttagcaattccagctgcagccatctttcactttgataaatagctcatctgcccctgagctcaggccagctcaggcggctgctcagtacagatatccaggaacctgtccttgttgccagcagttcttcctctctgtcctcacagaagaggaatgttggccattctggggagacatctgtgtcctctcagtatggcctgaaccacccccctaccttgaacctggttcagacaagacagtgatcagtaatacttcctggaaaaaaaaaaaagagggtggctgcaggctgagctggggcctctcttaaggataagtgagacagctagaaagaggcaaacaggtgtcaattgggcaagtacagaggaacacatttaaaggtcagtaggtgaagacatatggactgagctcagtaatggttcagtcattagagtccaggagctgtctgtcaccaagtggatgatggtacccacagggccagcagtggtgcagtggttagaccacactaaacagagataagaaggagaagagattactatgcgtgattctggcaagcacactttttctgtacaccttactgttaaaataacgcatattacctgggaatggttacccacacagatattatacacttttgaaaaaaaacatatttgggctggacacagtgggtcatgcctgtagtctcagcactttgggaggctgaggtaggatgattgcttgaggccaagagttcaagaccagcctgggcaatgtagtgagaccccatctctataggcaggtgtggtgatgcatgcctgtagtcccagctacttgagagactgaggtgggagcccatgattttgaggttacagtgagctctgattatgccactgcacttcagcctggatgacagagcaagaccctacctccaaaacaaaacaaacaaacaaacaaacaaacaaaaccccccaccatatttggagttcaaattaaatatagaagcaatgtacacattgtacctcctctctctaattgaagtgtttctggttactgatgactattgtctcaattcctctttttcacataaagaagaaaccccaaccttatgtccagtactattctgtttccatttcttttttcttccacagaaaattaaaccaacttctgctagaattcaccctgttcttctttgtcttttctcatggaacaggccttatttaatttacattttccttataaactcccatgtataggttagcttagtgacttacaaatagtaaatattccaagaccaattatttgttgaataaatgattagtacttggaaagaatcttagatgtttaggccacagccacaaatggaggccagggcttggtaatttgggaatattgattagccatcccgatatcagcaatcaggcagttcatagatcagaaatctacacagggaagatgagaattaaggaacctgcagttagcaaccagggagcatggcaggcagtggaagaatgggtcaagggaccgattgtcagagtttgagaaagtaaaaccatttgtgttcaagtgtttcctaaactctacaatgcaggaactcatccacagtgtgagtggccttgggccctaaagtccgtggttctcagccatgacttcacattgaaatcctctgcagagctttttaaaacccatagattggccgggcttggtgacgcttgcctgtagtcccaggtactcgggaggctgaggcaggagaatcacttgaacctgggaggtggagattgcagtgagccaagatgtgcccctgcactccagcctgggtgacagagtgaaactccatttaaaaaaaaaaaaaaacctatagaatccaaatatgggggtgagtgctacaggtgagaatcacccctgtggggaaaggagagcaagggaatggttggagtggagttaaggagatcagggcctggcctctgcactcaccaggaaccatgatcacggctcaccaagcctatgctctataaaaggtcacagtaagaagggtctcctatgaatctctaggcctgaattggggcatggttgctgttccttctttctctatcctgagctttaagaaatgtggggaaatgattgtgatttagtaaaattcttttcctgtccatctgaagagaataaccctaaaggaaaaaaaaatggcatatgtctgttagtgtaagagacaggtacctgaggtcatggtccagtgttactgaagactgtggttaatgtggagggagaggcagtcacactggtgcctgatgtcaggcctgacattgtggtacacctggcctactacatctgcaggctgataccagaaattctttggggttcactgttgttggaaatgagggtgggacataaagtggtcacgtaggtaggcagaaagccttattcatgtaaaatggacttaggctgcaggtatcactgaagacaaagtctgccaaaaatataaatgagactcagccatctagttgaaaagtaagactactttaaatatattgcttatagctcaggagcttttagcctgaactttgggagtgggtgggtaggtatgtgaaaaccctgaaataatagacattcaactggcttacacaaaaaggaatgtataagcgaggggcgggcacaagtaaggtccaggaataaagctttaggaagaagcctctctagctattcaaatgatatcatgggaaacctacctctctctctcatcttttccctgtattggcttcattctcggagagcttcttcccacattgttatagcaaaatacccccagctgctttaggctaacattccatcaacttagaaatcttgttgaaagggatggctgttttctcagatgttcttgctaagatcacaaggtttatgctcattgcataaactcgagtcatgtgctaaatctgaaccaatccctgtggctgcctggccacacccaggtcatgggcttatctttggagtagagggtggacaaggggaagatgtcagccacacccagaaacatggtctccaaagggaggaaggctggttcctcaaagacaagtcaaggtgctgttacaaaaagaagagggcacaaatgccaaatgggcaaggacaatgtccgaatctcgagtaggtctccatgtgtttctgtaccaacaacatcagcatcacctgggaactcatagcaatgcaaattctcaggccccaccccagacctactaaatcagcagctctgggaatggagcctaataatctgtgttttaacacaccctccaggtgattctgatgtatacttgagtttgagaaccaccgcactgcaccagtggttttcaaactatgctgcgtattacagacacctggggaacttttaaaatacttgcgcccagttgcacccaaagtcaattgatctaaatctcagggtgtgtgtgggggtgggtggggaggggggactcaggcagcaatggcctcagacttggttccacctcagagcctaaaaaatgctaatgcctaatatttttaaatgcttccctcctgattcttatcagcaccaatgttttaaaatcatattctccaccatcccttctaaattgtcttgagaatattaacttaaaacatctggatgcaggctggagaatctaggcatctattaaccctctcaactaataaacctggtcacatatctgatgtggattcacttttctctcacattcatgatgagtctgtcctagtagctagcttcagaaggactgaaattgtttttgttcaccaatgtagacccagtacctagaacagagcctgacacagagtaggcactcagtaagtatttgatgaattaacgagtaggtccacaaacagttagtgtccccatgttgtttgagatttccttgatggccaggtgtggtggctcacacctgtaatcccagcactttgggaggccgaggggggcagatcgcttgagcccaggagttcaagaccagcccagggaacatggcaaaaccctgtctctattaaaataataataataataataataataaaggaaaggaaaggatttccttgttaggttatagacattggctagtctcattctggaaggcatgtaaggatggcaatgggactcttgggttattggtgtctaaccctagaatgaatctccatgatggccaaaaatgtgttgaccttgccaacttaagataggaagaggttcctaatggttttatgcctttaaattgagagtaggatgaattcctgggttataagaattagtagaggctgggtatggtggctcacgcctgtaatcccaaaacttagatgtgcatggtggtgcacgtctgtattcccagctactccagaggctgatgcaggagaattgcttgaacccgggaggcagaggttgcagtgagccgagatcgtgccactgcgctctagcctgggtgacagagtgagactctgctcaaaaaaaaaaaaaagtatcggtggaaacatgcccagtggatccattttgcctatagtggactactttagggtctactggtatttgatttctaaagtaagagttgggtctttctcaaacatgtaactcaagccagtttcagcaggatgagatgtcattagtctcttgcaaagaattgtgacaaaaaagtgatccagtgttatctgaacacaaaaaccaagagggaagatttgagtaaaaaacaaactggttattccccatgaaattttgaagcatctttgaattcccatcataatgcccccaaagtgtaaaaagagagggattgggtgggtaaaccaaatattgaaccttggaccatagcatccatactatggatcacaagcaaataaagttaatttttacagacagttttggtctgggcttgcaagaaaaacaaaataggtattgtctttggtgacatggaagagagaactaaataatagtgctggttgttgtgggtcagaactggaacccaggataactatgtgaggattaaggatcctgcagtaattcagtctggcaaaatgagactgaccaattatcaggatggtcagtgaatcaggaatcttgggtgcagacaacatgagctattttttttttttttttttttgagacagagtctcactctgttgcccaggctggagtgcaatggtgcgatctccgctcactgcaacctccgccttccgggttcaagcaattctcctgcctcagcctcccgaatagtggggattacagacatgcatcaccatgcccagttaatttttgtatttttagtagagatggggtttcaccatgttggccaggctagtcttgaagtcctgacctcaggtgatccgcccaccttggcctcccaaagtgctgggattacaagcgtgagccactgcgcccagccaacatgagcaatttgaactgtaatttctctgtttttgtatgtgttagaaagagcaccagagattcatttcctgcttgacagtgacgttcttatgtaaaccttgccaagagaaaccatcagggagatggcagtagcagaactagagggtagatttttgactttatgttctactgttccaaaggggtgaagctttttagagcttttctttagaattaaaccattaaagcctcatcatagtttattaattcagtttcttcaaaggtaaaacaggacactactttacaaggtttttttatgaggataaatgagatagtatatggagaacatggaggaaactgcttagcatataaatgctcaataaatgtaagctattattactcattaggtcatgcttcgatcatttactggtatcccaaccatgtggcagatgccttggcacattttttttgggggggttgagctgggggggatggggtctcactctgttgcccaggctggagtgcagcagcacaatcatgagtcactgcaggcttgacatccccaggctcaagtgatccttccacctcagcctgccaagtaactgggaccacaggtatggtccaccaagcaccgctcatttatgtacttattcatttatttttattatttgtagagacagggcctccctgcatcgttcaggctggtcttgaactcctgggctcaagtgatctgccttggcctctcaaagtgctgggattacaggcatgagcaaccatgcctggctgtcacatagataaataaagcacaaatctaagcatggttccaactgggaaaggaagccccaaatcctggtaacttttaaaagccttgtcccatgagtgtgtttcttccaggaaggcattggttacctgggtgatcaagcttctgtttttcattcctcccacaaacttcccttttttctgatgaatgggccctctttatgagtgttgtgtgtttccagcaggccctttgccctaaagctggacacaaaggaatgggagagacaccctgtgagtaatacagtggttcatggaaaggtcccactgatgtggtccaagtgggcttcaagggggttgtggaaagcaagcttggccttgaaacatgaaaaagatttaaaagatagggatagggatataagtaaaggaatgataggtctactgggcatattgggccgaggggatggtgaatggaagtcttgcaccgtaagtaagatgttcgaagtttctctgtaggcattcattcacctggaaatattaaacttcacctctgtaacaggatgttagcccagaaacatggcctgagaagggaggaggactggttcctcaaagacaagtcaaggggctgttacaaaaagaaaaggggacagttgccaaataggcaaggaaaaagtctgaatctcaagtaggtctcagtgtggtcctataccaacatcagcatcacctgggaacttgtagcaatgcaaattctcgggccccacctcctacctactaaatcagcaactctgggagacatccatagatatttttaaattctaccatcggctgtatgtggtggctcacatctctaatcctaatgttttgggaggctaaggcaggaggatcacttgagcccaggagttcaagactagctggggcaacatagcaagacccgagaccctgcctctattaaagaaaattttttaaagaaaatctacaaccgtggaatataggaattcttttacattttttttttaaatggggaaactgaagataaaaggtgaagtgacttgcctaagttcaaacagctagcaggtggcaaaactgagctttgaaggttggttgtatgattccaaacccagagtgtgttttcacgtcattacagttggagagctgatcaatatgaggcactgttatcattattagtaatcagcattacacggaaggaaaggaaagggttggggacggtgttttcaatacagaggaggctgtggggagggaacgggtgaggctgcgaggaagaaaagggcatccttgagtcttggagcatctaagtctgcccctctcttacctctttggccccatctagttgtattttttaagccaacgcccattgtggtggcctttgaagggaggaagttgcacataaggagtacctacctgtttggtgccaagggctcaaactccacccgtttgccccgtgcccacagcgttggtgccacaggcagcgttacatgaggctccggccgctgctggccaggtctcctgcccacagctggaccttggaactccgccccttaggccctccctccccgcctggcccctccccgcttcccaaggtggcagtggctcccagtaagtcagagctgcggccgcggtgcggggagagcacagcggggagggcgggagccggctctcgggcggcggcgctgaagtttccttcccgccgcgctctcaccccgggctggcgccccgtgccatgcgggagcgctggggcggcggggcaacatgaagggcggcgacagggcttacacccgaggtccctctttggggtggctctttgctaagtgctgctgttgcttcccgtgtagaggtgagtggctgtcggcggccttggtgccttctgttagccagactggtcgcgctcagcgcgagggagggtggtagggagggaagggttggggaggcctctggggtaggcggatggggctggggatcaggagggcggcgaagtgagagagtttgctgcgatccgtttcacagtttcccagacagaacgcgcgcgctcgctggctggcggtgaggttctgacttggatgcggagctgctgtttgggaactcagtcacctagcagcgactttggatgtcagggcgccagcctgctagggagtgggatgcggacgcgggggtgggaaggggacgcagagccgcgtgtgtccctatagtggcggagaagtacctcacctctcatttacacatggatctcagctgcgggattaacgtgtgactcctggctacaggaatgtgtttgacacctgtctgtacaccaggaactatttttgccaagtgacaattttctcgtgggactggagcacatttttttctgcctgggttttcacaggccagcgtggatttgtagctccgggccggagcttggctcattaattaacaactctctctgtgcccagttaggactgtatttaattattctgctaatcttaacgtcgtggaagagacttgcaggaagcaaccaatttcccccaaagcagccggcgaacaggagggcgagaaggatcacagagggagggttctcaattgtgtggcttcttctgaaaaaaaaaatcagaaccttcccaaataggataagcagatgctcctaaggctgttcatgtcactttaacacacgctaggatagcgggggaagactgtttttgtgtgggtagaaatgagaatgtagccccctacttgacatttgcccttttaaaaagtttcaccttttgggcctctggcctccacccccatttacaataccccacccagtctcccatcccatctgctatgcaaaatcctaatggaactttctggctgagttactggtgaataaacttcatccaagccacctttcagcatcctctgtgccacaaacacacaacatagccctgagaaattttctatcctgagcagatataaggttaccaaaactaattaaatctgaatgacttttcctgcgcgtcattaaggtcataatcttagcatcagatggtctcaatctctgtatttaattagagcagcctggaaccgtgtggttttgagctctagaaaccagaattcagatgaagaaggaatgtgaggggccagggaccctctaagtctgattcagaaacattcaaaaccaaggctgggaattgagggaaagggggaataaagcgcggaggaagcaggaaatggccaaggggaatctgagtgggtgggttcgctcgaaggctgccctgctttccccgcaaagagtttctctgcaggatttcttgggagtccgtttcctgtcagacagaatgtgggggctggggtggtgcttatctgaagtccccacagctgcctccttgagtccagatgtgtgacagccctggctgcccttcagggtaactctctgggcgtcttgctggcccttgctttgttgaggaattgcccgactttcactctcgctgtgatgcaggggagggctggggagctggctccagggcctggtaagtgcctcctgcctagggcctgtgaaggcagtggctgctggctccgtggctaggagaggaggcgtgcgagtggctatcgtaggagcgggagctgaaaaggctagcgaccctcagatgaagactgagggagtcagaggtccaagcaatgagaccagtttaaaagggaaaagaagggtggcaaggtgggtgcccggggccttctcctgctttactcctcactcccctagatctgaaatgtgtgaagatgaaaaacgggctcatcagaggacgatggtgggggaggtgagttagccactctccaaagaaaactcctgcctgtggctaggctgggggtcgtgtctgaggtgttgggcatgccctgaggctccctcaggctcactctaaccgaaaacagtctccactcagcctgtaggcatcaatttgaaaacagattgaaaagataaggtctgtattgagcctgagtgcatggcccagagtccgtggactctttgggaagaggcttgcccaattgcaacacccaaaagggctgaggggagagtcttgaggctgtctctcaagtggagggtgtgcactgcaggggactgactgcctcccttttcagttgaaccagttcctctggtcttagggaaaatacaatggaaaggcaacctccacactccaccttgtagataaaggcggccggttgtttggtctctatcccttctctctcagggagaacttggctgtctcctgcggcttgagtagcttgactctgaagcaatgactcagagcccactgctgtggttcccaaggcaaggggacttgaccatctgacttccagtcatgcaggatttaaaggatacctccttctaaagtctgaggaaaaggacaaaagtaaaagaaccaagaggaagtggaatgttttggctatttttgacttgaagctaagtgagctacattgggatttctctggtgaattctgagtggttgtaattgtcatcactagggtcagagtcaaggatttagataaagtacctgtgtggtctttaaatatcacatttgaggaaaatatggatgaatttcactgaacttatcttttgatttggaagagtatggaaagcgactatcttgtatttttccctccacccccaccctccactttttttttttttttttttttttttgatacagggtctcactctgttgcccaggctggagtgtagtggtttgatcatggttcaccacaaccaggatctcctgggctcccacctcagcctcccaagtggctgggaccataggtgcatgccactaccccaggctaatatttttattttttgtagagacaaggtctcactatgttgccaggctggtctcaaacttctgggctcaagtgatcctactgcctcagcctcccaaaatgctgggattacaggcgtgaaccactgcacttagcctttttggttctattgagtatgagtacagaaagcaggtttgatgaaagatgatttttcttccctatcttgaaactggtgttgaaaggcaggaaaactgaaaaccaaggatagaaaggaaatagatatcgggtaagaaggaagaaagaaggcaaatgcatttataactgcctttttgaaggtgaaaaacaaccaaaagtgagataatggcatgcatgtgtctaaggggtgataaatcattgatgtcacactctgtggggagttagttttgggatagctttgactagctagactgtccttcaagcctgaaaaagtgggtcagttcagaaaagatttcaaatcacctggaaattgctaagttatgtattgcactggaatttgtgatcaaggagcccagagatttttctgacctttctaggtagaagccagttttagagacttaattttgttttgagatggagtctcgctctgtcgcccaggctggagtgcagtgggacaatcttggctcactgcaacctctgcctcccaggttcaagcaattctcatgcgtcagcctcctgaatagctgggactacaggcgtgcaccaccatgcccggctaattttttgtattttcagtagagacggggtttcaccattttgtctaggctggtcttgaactcctgacctcaagtgatccactcccctcggcctcccaaagtactgggattacaggtgtgagtcaccgtgcccaaccaagagacttaagtttctagtcaactttcattagctttaggtatgtggacaaaagtccccttttgaaagcttttcctgattaccatcctccacagtgtgcatgggatttatttatacttgtttattgctgtatcattgtccttgcatcccaagcccacgtgccattgtgtcttcacatttagactgagatagtccagccacctgaacatctcagaggtaaagagaggaaggaggtgggacttacccaaactgaatcacttcactggggaggtgcagggattggtttctatgattctttctttacttgggtagtccttcctgcttgtctctgatgtcatgggctttgggtaagtgtatggggattcacagggcatccaaaggcatttttatctataactttgtcttatcctactttgttccagaattctcagccagaaaccttatgacttgacgtaaatatctcttccttggtccttaaattaatatagcccatttgataaatggagtttaatatgtgaaaccgtgacaccaagttcctttacaaaggtgttggtaactgcaaaaaggaaccattatgacattcactgttgttgactttaattcaccatccactgtaatcccagcactttggaaggccaaggcaggaggactgtgtgagcccaggagatcaagaccagcctgagcaacatagggagatcccatctctacaaattaaaatattagctgggtgtagtgacatgcacctgtagtcccagctactcgggaggttgaggtgggaggatcggttgagcccatgaattcaagtttgcagtgaactatgatggcaccactgcactcagcctgggtgacagagtgagaccctgtttccaaaaaataaacaaaaataaaaattcaccatccaggggataaaatccttggggccttgatgtgtatccttttatttcttcatcttctaggaaatgcctttaccatgatggaaactgaattgattatttagcatatacagttgtccctcagtagccacaggggattggttccaggaacccctgcgggtaccaaactttaaggatgttcaagtcccatagtcggccttattgaatcttcagatacaaaaagtcagacctctgtgcccatgggtttcgcatcccacaaatacagtattttttgtcagagtttggtgaatctgaggatgtagaacctgtggatacacagggcctactgtatgcttttgcgatatgtctcttggttttctttgcctcccagggatgtactctatttctatctttcttttttctttttttcttttttttaaattaaatgtctcagcagaatcaaccagggatatactcaacctgggaagaagtagcacacatatttactgtcttcaacccgaatcctatgcttctctttccatgtctgattatctaatctactgaatggtgataggtgtatcatttattacctagatacagtatcaattagtatctggataacagtactgactgccagtcaaaccacagcatggtagaaatgggggtgtatgaaggtggtggggtgaggtggagtttggaaactgaagctgaatatccctcctgtggtacagctgcatgcccaacaatcactgataatcctgtaggcaatggttccatagggtataggttcataaatcctaccttgggaataaaaggtgcaaattatgactctgtatctgttttttaatgcaaaataactttaaaaataaaaataaaaaagcaagttgaatgttgaggactttactcttgagcccatacaacactgggcataccttctggagtagtgttgctgatattctattttgtggtattccttttaagaatcttcatactgttttcttctaccctaaaaacattgcccatctttttgcacttgatcttagccaaaaggccaagaagtgattgcccatctttttgaagtgctactctttcagtgagtagcacatcctgccccttccttcagacctaaccccaggcttttcctgaaggaaggctctggaaaaggctgaggtctgaaacctgagggtgtcttctcaagcagaagggactaaatcatggaaagctacagccagaaggaacaccaggaatcatttaattcctcctactccttttatacaggagaaaatggagatccagccttttagtagcaggatcagaactagcatccttttctgatattctttcctcaactctttttcattcctgggcatgtggcttgtcttcgtctgaacagaggcaggactgacccaactgagaagggtagagatagtacccaaactctaaatcgggtgttgactgtgttgatctgttgtttctgggggtgaatgcactgcctggagccatttggaattaaatgtacctgctttcaaatgtggtctgctttcaagggactcttctgtcccaaaactgaagatgtcagagaccaccatcacatctctctctcccagagcagcttgtacacgttttcttagttaatatctgttcatgtttttctctctggttcaacttaattcaggtcccttttccccgcccttttttgtccttgttctttccttttctttttttgagacaaggcctcactgtgttgcccaagccggtcttgaacttctggacacaagcaatcctctcatctctacctcccaaagtgctgaggttacaggtgtgagccaccatgcccagccattgtccctgttcttgaagcttaccctttcacagtcattgcatctttgaacattgctttttgtgtaacacagtgttttaatttatttgacaaatgtttatgctgactgcatgccagccctgtgctaggtgcttgggagagtggacaagaaggaatctaatgacatttaccccattgagctgtgaagattggttaagacaatgtaagtaaagggcctagcataatgccaggcatataaagtgctctaaaaaaattagctattaaccatagcagtaattgtaatactagacatagaccccatcctcaggggactcccagctaaatatctgtaggtccagttggtggtaacactgtaaatgtaagttccaaagcaatttaatggccctggctcaaaccattgtcaacagtgcctcagtgctgtggagttgtcactgtggggaagaaaacttgtgatctagatgtgtggtgggaatttcctttttaaaaaacttaattagaccaataaaaaaccacataacacttccagtgttgtaatttctttgtgttacataaaagaagattcaacagaagatactggcaagagtctgggcatagtggctcacacgtgtaatcccagcactctgggacgctgaggcaggcagatcacctgaggttgggagttcaagaccagcctggccaacatagtgaaacccccgtctctactaaaaatacaaaaattacctgggtgtggtggtgcacgtctataaccccagctactcgggaggctgagtcaggagaattgcttgaacccgggaagcagaggttgcagtgagccgagatagagccactgcactccagcttgggtgacagagcaagactccgtctcaaagaaacaaaaaaaaaaaaaaaaaaaagaaaaaatcctggcaagaagcctacatatccctaagttatccttctcttaggggcaacacaaggtacaagaactggagaatagcaacccgatttttgaagtttggatgctgagcatctacattataaaaaaaaaagatagccaattgctttttcttgcctgtgccttgactttggttagcaatatcattggaaacgtttttctcttctttttggccaatatttattgcacatcttttatgtttgaggctttgttggttcttcttcagactgtttttgcctagataaaaatcataaccggctgccctcaggccattattccagcccccatggtgctggatgtttcactgaggctccaccagtatcttccccctcccttgtaggtgaggcccacgggtggcttgcctccctgcctgctgtaatcaatgactaatagagcatatcttttgctcttggcagaactgtgttacaattcctggaaggaggggaaccctggttacacctgtgaggcagccaggaggctgccaggcagcttttgccaagtgaaagagcaaagatcagagttactaaaacaggttgttccacattctttttgcctttctggtgaccacagtgaggaaactgtcaaattgaaggggagggaaaccccttctgctgctaggtcaaagcagtacctcctaaaatgtttctgtttccaggtatgtgctcttcccagcgcaggattagttgtgggcttgtatctcttcttttacagcatctggtgtgtcatcagctgtcaggatattctcagtttctgctctctctccatgagaatcttcatattgctcctgtggggaaagggatgttatcttttcccattcaaaggggaaaccaagccttgttgtttaaaagaattgcaaacacattgtttgccacacattttgtatctcagtttcatatctgtgcagtgctccttctcttctttgtctgcctactcacagaatgacttagagcagaagttctcaaagtgtggtcacctgggaacatgttacaaatgcagattcccaggcaccattgaccaccctgccccgcctcaccccacaactgagggatgggctctagcagtctgtgttttaataagccctccaggtggttgtggtgcacgctcaaatttgaggactactaacttagtgctgctcacttggagggaaaaggtagatttcctctcagtcttgtctttttctttttgatttgttcttttctctcttttctccctccaccctcccctaacctgcctcctctccccagctccagcaaaacattccataatggaaggctccctgtgtccctggggaattcttggtttgagacattgtagaggcccatttgctatttgctttcacaggggtgtcagggaataggaattaggaatcaggaattatctatgtcttccacgagcttaacagcccaaagatccagtaagggaggttgttgcatctttcttctcacttaagattactttgcttttattttgttttcctcattaccctctcccgccacattcccctgccaaacgaggtcttgccatattgcccaggctggtctctaactcctgggttcaagtaatcctcctacctcagcccttcaaagtgttggcattacaggtgtgagccaccacacccggcctcctcattactcttaaaagtaactatgctgactacagaaaaaaatcaaaacttaggcaaacaaaaagaccaaaatagcataatcctaaccatctagagacaaccactacctaatcacttactatattcttttccgtatgtttaccgctttttacttaaatgggttcatttttacatgctgcttttataacttgctttcatttaatcttctgaacatctttccctatggatgcatttccaggaattttttttggagacagagtctcgctctgtcaccaggctggagtgcagtggcgcaatcttgactcactgcaacctccgtttcctgggttcaagctattctgctgcctcagcctcccaagtagctgggactacaggcgtgcgccaccacgcccaactgatttttgaatttttagtagagatggggtttcaccatgttggccaggatggtctcgatctcttgaccttgtgatccgcctgccttggcctcccaaagtgctgggattacaggtgtgagccaccgcgcccagccttccaggatattttcaatgactataaaagtgtttcattgcagacaagacttaaacttgacaactattagtattagtttaatataatggttaagagttcggtgggaagatcctgggaagagtcctgggttaagaaatagatctttccaggatcagattatataaacagactaattcttgtcctgggactgacatatctccagtcccacttcccaccttgcctttctgcaggaccagtgaatgatcagcctttatctctcctccccaggagatcagcaagcactgtggctggagcctcaggatttacccctcccctctttttcttagttatgaggtattgggaatcttctcaccctggggccttctcattgtgcagctgatgtcactgagcaggtccagggatttttctttccttttttctttttctttcctttttttaaatttttttaaaaattttatttatttatttttttgagatataccatgggaaatagttcatttttaaattattgcaactaggaagagaaccttgatttttttttctgagaaaaatcatacataaatgggaaaatttgaaaatacagataagtgaagataaaattatatcacttagagataactagtattaacacaacatacattcttttggtcttttttttccatgtgtgtttttttttctcagaaatatgatacagaagtgttacaaactgttttcacctaacatattgaacgacttctactacattttaatgaatgtattccatggtatactggagccagctcagctcagacagggattgttaaatagtcaggatttccagagcagattattaaactattagtagcttgagatcagccatggtgggagtatttataccatggaagttaccagacaccatgaattggggcttcttgttttatttagagggctggtttattagtataccactatatacacattttatcatgtaaatgtgatttgttctgattgaaataatctccctattttaggttatttctgatttttgctgttataaacactatgtaatggcaatcatggatgtcctagtacacatccataattacttccttaggatacattccttgaaatagttccagaatcaaagggtgtctggaattacaagaacttgttaccaagtaccctcagtttcataccctttgaaaggaagaatgtactatttttgttttaagaggatttatgagaaacatcctctagtaccaagaatttcatgtctctcctgtttacttctgtttacattttctgaatgaattctttttatataaggaaataccctggctgagagtataataagcgaatgcctttaattcataggatatagactgatatgtagggtataaaaagtatattttgtggcattctggaatgaaaggcaatatatcatgatgattacgaacttggaatcaggtgccagaatgaatttgaatcccagctctgctgtaactctgtgcaagatacataaactcagatagaatgattctacaaatagaatgatatcatttcactaattattaaaaagtagaaacaaacaggtgaaattagttttattgtattgcttttaacccaatagctcacagttttttcatctcatatttcatttcaaaacaatagctccatcttaaagaaaaaaaaaaaaaaaggaccaggtgcagtagctcatgtctgtaatcccagcactttgggaggctgaggcaggtggatcacctgaggtcagcagttcgaggccagtctgaccaacatggtgaaaatacaaaatttaactgggcatggtggtggtcgcctgtaatcacagctacttgggaggttgaggcaggagaatcgcttgaacccaagaggtggaggttgcagtgagccaaaatcgcgccattgcactccatcctgggggacaagagcaagactccgtcttaaaaacaaacaaacaaaaaaaccccacaatagctccaaatatcatatcaacatacaatcaatataaaaattgagatgctttacattatttttttgtaccaagtctttgaaatctggtgtgtaatttaaatatacagtacagtttcttcagtttcttcatctggaagatgaagaccatggaatctcttcatagggtttttgcaaggcttaggtgagttgatgtatgtaaatcacttgcacctggcctgtggtaaatctaggtaggtgttggattattactatcattaataagtacatagggtcgggcacggtggcccacgcctgtaatcccaacactttgggaggccgaggtgggtagatcagttgaggccaggagttcgagaccagcctggccaatatggcgaaaccccatctctaccaaaaatacaaaaattagccaggcattggtggtgcatgcctgtagtctcagctacttgggagactgaggcgtgagaatccttgaacccgggaggcggaggttgcagtgagccaagtttgtgctatggcactccaatctaggtgacagagcaagactctgtcttaaaaaaaaacaaaaacaaaaacacaaacaaaacaaaacaacaaaaataagtacatagatgtctctgtggacctgtgccaaccatcacattcagatggtttcattaattccttaatcaaacaggaaattaggctgagcactttttgtgttgattcccaaatatttgaatactgtgtggcagatattaggctagtgacatagaaatcttaagatatttctctgccccgagttggtcccaagtaaaccaagttgggagctattccataaatgtgaaacagtgataacaaaaaggggaaaaaaagaaaagaaaaatcagttgctaaagacaataaggggaacagtgctgcgaggtcctgccagattgctggctaaaataattacgtagaagctgatgtgagcatagcagcctgggatgatctgggaggactccccaggggatgcagggttctcactgcgtgctaaagagcaggaaggggtttttaaagggccaaggacatagtgggagcaaagcagcagggatattcaggggaccacagaggaaaacttggttagagctgctttctaaagctgcactgtccaatccagtagccactggccatttgtggctactgaggacctgaaatgaggccagtccaaattgagatatgctgtatatgtaaatatttaaagcatctcaatttttatattggttatatattgaaatgatatttggagctattgttttgaaatgaaatatgagattaaaaaaaaacttttggagctactgggttaaatgtaatgcaataaaactaatttcacctgtttgtttctactttataataattagtgaaatgattccattctatctgtagtaaattttatatatctctgtagagaagatagtgaagtgtaggacggtcctgcccttatgtttggaggaacagggagggtggagtactggatctagtctgagggaagacccagctctttggaaggaatctggagggccaaggaccccagtgaattggaactcactctcaggttcctggaactgtattttagccacctgctccagtttgattccacagaaatctgtcccacagtggccacttgtttctggtatttacaaacgtccagagggattctgggggaaatcagctgctcctctggaggcccaagtccatctgaaatcacagcttgatttccagaacctaggagagagaggtccagctggtcttgatgaaatcaagggctactccaatggcctggaatctccaaagaaggtcggaagactttcttgagacatcccaaggggcttcccgtagccaggtgcaaggtgaaggttgacctgaagccagaccttgattgccagtgtgctctaatttaatccagtcctgtgaagtcttcccagagatccagtgaggccagtggctgccagagtattctggggccttgctggaggcctcctgactcctggtcccctcaataatcagaaatctaaagaggacaaggaactgctgtcataattttgcagtgtagaggggcatcatatataggtccttctctctctcttcccctcattaccccctctgtctcattcacacacgttttgtttgtttttttgtgttgttgttgtttgtttgatgttgtttttgtcattgtttttgagacaggtgacatttgctctgtcacccaggctggagtgcagtggctcaatctcggctcactgcaacctccgcatcccaggcccaagccatcctcctacctaagcctcaagagtagctgggaccacagtagcacgccactacgcctagctaatttcttatatttaatagagacaaggtcttgccatgttggccaggctggtctggaacagctgggctcaagcaatctgcccacctcaacctcccacagtgctgggattacaggtgtagccaccacgcctggcctcacacacatttctaagtactctcaaggaaaagaacaagatgctctgagactatctggggacaggggtggggtgggggttagattgggcagtcgggaccctgcctgaggaactgacatagctaccaagagtcttgttactacccctcttctggcccgcaagtgggtattatttgtgttctctaccaagtttaaaaagtatttccgaaaggttttgctaactactatgggagaacgtaaggtagggaagtagagtaaaagcggcataaagctggatagccttatcatgctcacattttttaggaccttgcttgaagccgacttgcttcaagagctctcctgccgttctttggtctataagaacctctgaggaacctgtacctaagtcacaaaggatcactgccagggctcttacttcctgatttgcaacctgagtctcgtcataattatgttggcactgggatccagattaaaagaaccagagtcccattccctgcaacccaccttggcctttcccatctgtctctcatttctgttctgaggcattgccatccacagctgctgcctcctgctgcgataactgttattcagggtgtgctggcagggttcagctgagtctgcatgaccctctttgggcaatgctgtagacctgtttctgtaacatttgggacgttgtactcagtggcctttacgatcttttccaattcccattccacaaagggatttaaaaaccagagataatcctgtttgtttacttgggttctgcttcaaagcagaagacctcaataaccttttaaggttttttccagcctttctaattttgaagttcccatttctttgggctttggtttagaaattctacccctttcccaatttaacttacagcttcaccaccaactagtgcttccattttagagtgttagcagccaactctgccagagtgtctatgggttccacacacagcttgtttcccagtgaattcccagtgaggtggtcaagtctaaatttaaactatgacccttctaccagcatatgcaagccagggctgcaagagcaaaatcagaactgaactgttctcagtgagatgtgtgtgtaggagttagaagagaaagtgggcaaggcttcccaaaaggtagaccagccgcggggaaagaagagcaggagttcagggtgaggataagtgcagttatcccaagggactgttggagtttattgtagcatggctgggtcccttggagaaagtcagccaaactcaccatcctctgtttcctctcattgtaacataccaatggcataactcacctgggtttgtcattaccatggcttcttgccaagcattatggcacttgtctcttattccaaagtcacagatccttggtttatgagatacaatctgcacattatgttatattggtttcaactcttgtttggttgcctggctcacatctttatttgtgtttttctgtatcaatgggtacgtatttcaaagacaggacagggcagtggctataattctggttgtggaatggctttgccaagtcaggtactagaaagtgaaactgcaaagcatagaaactgatttagtttgtaacgtttaactcattatgatttagtgacacctccaatttgtatttatatttgtgattagcatcctataccatgaaatttatatatatatatatgtgatatcatatatgtgactatatatgtaggacatttttagagtggcatcagatgtgattcaaatagagcaatctttattattctgtttgattgtgattgctaacatatattttggaagtagcctagaggcaggtttggagaggctaccttgagtgcatgtgtttttccaaaatgccccagctcgaagtaaagaggaaaaccagattacaaagcttctgaagctggggttctagcactctctgaaagtgcccagggtagaatcataaacagggctatgactaagaaggaacatgggccagttggccctcttgtgctcatgcgtcattttctctaagtaagctagagctttttgtgggcaattctctgtctttagttcagacctctaagagccaagcatgggttaggagggtcagactgagtccccctcctgacgttagagcttactacatgtatggcattagtctggtgacctaactttatggcaatgtcttcatctgcgcacttggggaaatacaggcatctatccctgagggtggttgtgaagattcaagtgaaaaagtatgtgtgtatcacttagggtagttcctggctacctggtatatggaatgcactcagtaagtgttagcttgagaacagcaacattcttcccattatcagacatttctctaacttatagggtaatagctttaaatgagccattatgtaggatggaagtagattaatgactatttctcaaagcttttaaggaaaacagacttgtaacctaggtctcaaactattggccttttgcccaggttttgagccctgggagtgtccgtgttcaaaacaagttgctgatctggtagatcctatggctgattcacgatgacaattgttattaaaaagagatggtctcctcccagtgtgttggattcttaagtaattcttcaaccaggtcactattaaggacctttatatgtatgtattagtttgtactattatcctgtattcatgttcaaagttgatgatcttggatgtattcctttagtttctaccattatctgctatgctgtggtaaatattctgccttttacggctcagaaatttctattctggccagtgtggtggctcatgcctataatcccagcactttgggaggccaaggtgggtggattgcttgagcccaggtgtttgagaccagcctaggcaacatggcgaaaccccatctctaggaaaaaaaaaatagctgggtttggtggcacccacctgtagtcccagctactcagtaggctgaggggggagtatggcttgagtgtgggaggcagagattatagtgagccaagatcacaccactgcactccagcctggacaacatagcaagactctgtctcaaaaaaaaaaaaaaaaagaaaagaaaaatttctgttctgttggcagcaacccatcagagcttcttgtattcaataaccatacataccagttttaggcaaaaagaaatgacattttggctaaatatactattggttagatttatagtttgcagtaggctttttccaatagtgaaaatcacatatagaccttcatgttcagtaggaaggaagaagtcagaagtcccccaaattgactttccttggtgctgtctaccctgagttaagtgatatgcccatccttgagttaacgatccactgagtgaaatatttctcttattgtcggacctaccctgggagtggagactcagcaaggacagggtttcaactcacaaagctgtgaaatctggggtgctcccatgaagagaaatggatgctggggagatggatgggtgccagcagatgtcctctatgtcaagtgtcaacctaggacctgtagtctaatgagaaactatgatgagtttaagaactgaaatccctctgccttccctgttgtacgtgcccagaggacagaactaccagctcttctaaaggagtgaggggaatgtgttcaggggaggccttgtggaaaagtgacacagggctgggtcttaaagggtcaggagggatatactccatctaagttaggcaaagaaaatggcaccaggaaggacatagagacctggataggaatggaatatccatggtaacgatgaacaggtgtgtgactgtagcatccttaggtcttcagcttttgggagtcagcctatatgtttcacaaatgacaaagctgaggcttagagagattaaatgattctcccaagagtacttagtttgtgtgttcagtcctggtttcttctcacttactctgctggccccagttaattccagttttcgtggttttttttttgttgttgttttgttttgtttttgttttgtcttttaattactacagtggaatctagtgcaatttcacatcatgtgcctgaaaccatgggatgggttagcacttccagaagcagccttttcttgtggggtattatttttatttgcatatgtaaaccctctgccgccaaagctcttaacacaagcattgcctggcatacacacacagacttttataccctaaatagcagaggcctggaaatgtttgtctacctttgccagcatctgactgtgattatctttaaccacagtcacacttgtttgtctcctaaaatagtattgactctccggaggaggctgtttctagtcttcaaagccctcccagatatctatctccttctacctgcctcctcctggtagccttggcagcctctaattgattcacttaattttcttgctccgtatggcaacactcctgaatccttccttaaaattcacagacctctccttgtggattttacctcccggagcccacctgttgattcaggcaactgaagtgtggctctgcttgagatgttcctcagctattcttccttcctgtccctggctctccctacaggtcatgccaatatgcaggtgtcgacttccccagaggatagtagcccaaaggccaagctgtgtctgacctatagggagagacccagtcaatttttgaaatggagcatctctccccacaactctcccacgagcatggatattaaaaatgtgtgtccttgctttgaggttctgtctcagagaaagtcaatattcccatatgctagtctattgggttcctttgccttaaagtaaaggttgcctcattttgactttgaacttgatgggggcaaaagggggagaatgaaggtgtttttaccttatagtatctaactatgccctcccacctctctagaataatacattataccaggctagaaaaactgcttcagatggagcctggtgatcttatttgagaaggtcattctcagagccatcactaggataaagagagtgaacaacatcagctcacacatgtgattctgtgttgcatgctttggacttggattctatcaccgagagatcccttctctgaaacagttggggtgaaacatgggtggtagacccaaaacccccacaaagtaagaactctgaacaaatagatggtcaggactgctttcacgttttttttttttaaatttattattatactttaagttttagggtacatgtgcacattgtgcaggttagttacatatgtatacatgtgccatgctgatgcgcgcacccactaactcgtcatctagcattaggtatatctcccaatgctttcatgttttttaagctttctctatgccttggatagtgtattctccagagtgaggatgtggaagttatgcatcgagcctgaaaagagccactcttggtgctgctgttggactatattgctcttcccaaaccacaaaggttgtttctttataaccttgtgatcatagaattgaaagttaaggtgcttaatggtggaaaatagtttgggaaacgaaggttggagatgagctcatgaaagccctataaatatttttatgatccttaaaataaattattccactaaggggaataatagtgattactatgtaatttccattctattgggttagaatttttcagagtttttcctgattcaaaatttgaactagatgttttttaatttcgtttaaaatttttaattattaactaattattttagagacagggtctcactctgtcacccagactggaatgcagtggtacgatcatagctcactgcagcctcaaactactgcactcaagcgatcctcttgtctcagcctcctgagtaggtgggaccacaaggatgtgccatcatgcctggctaattaaaaaaaaaaaaaaattaggccgggtgcagtagctcatgcttgtaattccagcactttgggaggccaaggtgtgcagattgcctaagccaggggttccaaaccagcctgagcaacatggcaaaacctcatctctacaaaaaatatatatatacaaaaattagccaggcatgctggtgtgcacctatagtcccagctactcaggaggctgaggtgggaagatcacttgagcccaggaggcgaaagttgaagtgagctgagatcacgctattgcactgcacagggtctcactctgttgcccaggctggtcttgaactcctggcctcaagggatcctcctgcctcggcctcccaaagttctgagattacaggcatgagccagcacatctggcctaaattcctttctgtgtgtggttatagagataataggtgcattggctggatgcagtggctcatgcctgtaatcccagcactttgggaggctaagaggcaggtggatcacttgaggtcaggagttcaagaccagcctggccaacatggtgaaaccccatctctactaaaagtacaaaaattagccaggcatggtggcacatgtctgtaatcccaggtacttgggaggctgaggcaggagaattgcttgaacccagcaggcggaggttgcagtgagctgagatcacgctattgcactccagcctgggcgaagaaatgggactccatctaaaaaaaaaaaaaaaagagagagagagaataggtgcattaagatagtttcatcccactgtggtcctgtatccaaatggggcccaaaactgtgtaagaatatagactttgaagctccatagacctgccttggatattggttctgtccccctgattatagagctttagtactgtaggggttttggtgtcatatatctaataaatatgcatgtacacccaggtttttaagctgctgtgcttcacccatggcagtgtgattcgtcaaaataaacaagaacggagtagcacttggatctgcctccatcaccaccccttccattacacgagtgaaatcccctctatcccaacacacacatcaaaatgtaatgcttgccgcagctttttgcatctcttccaagagggaggcttgattggaaaacctacttctgattaaccaccaacttcaccctcctttatcatttcagtccactgctgactttctctgatttatccccatcatgaatagcttaaagacttgacttaacatagtcatgcatctgttcagcaaattttattgaacttaagcatactgaaacttaagctcacagtttcagaaaacacagagagaaataaaatcacattgattggagtttgtgtacaagaggaattatacttcggggcaattatattgttctcatttggggcattcctttggccttgcatgatacttagactggagtgtctcctctcttagatgggagtcctcattggtgacccaaaggaccttggaaactgcccaagagctagagcccaaaatctcacatgtctgacaagctcagtgctggcatagcttgcagcattcacttagctatgaaaacgcccaggccatgtgatgtgtggcaaggcttcttcttaatcctttcttatagtcctgtctccttaaaaataccataaatttgatttataaaatatgagaaccataaaagacaaatataaagcagaggttctttgaagtttctactttaaaatgtttttcttaacgttaaagtcaggtaaattatatccacagatctcattatacataaaaataaatttcagaaggatttcaggcaaatgtaaagacactataaaggaagttaaaacaaatgatggactaggagaaaatgcgtgtaacctgcctaatagataaaagattaagacccagaatgtatgaagagttcttataaattaagaaaaaagctaattaacccaatattttaaaaaagggcaaaagcgatgaagatgtaagactttttaaaaggcaataaacttttcaaaagataacatctagtaatcaaaaattcaaataaaaacgataagattatgtttcacccttcagattggcaaaattataggtaaggccaaatagatattcatccactcatgggaacataaattgattctctttcttcagggccatttggcaaaatctataaaaattgaaaatgtgtatgtcttttgactcatcaataccacttcttgtactgtaccctaaagaaggtctccatttgtcacaggatttcaagtgataatttttgtaatagcgaacaagaacatggacagtgacattgtttccaataggggaatgattgtggtataattttacagtggtgtggtattcagccatctgaaacaaacagcaaaatagaagatccaaacataggaagatctcccatttgttaaatgggaaaaaatccatacagaaccattcaacgacatagtataaacattgtgcaagaacaaactgtgtgtctatgtgggtgaatgcattgaaaatgagccaagatatatactgaatcactgtggttacttctaggtagcagagtagaattgatttgggtgtggggaagtaactgggagtaagttggggagagatgaactttttaccctataatcttctaaagtattttatgaaatttcatgagcatgtatttatgtatgacatactttttaaagtaatacatacttgtagccaataatttggaagacataggagaaaataaggaaaatatatcaccctataatcctagagaccttgactttactcaactctcattctcactctgctgcccaggctggagtgcagtggcacaatctcggatcactgcaacctccacctcctaggttcaagtgattctcctgcctcagcctctcaagtagttgggattatagacatgtaccactatgcctggctaattttgtatttttagtagagacacgttgaccaggctgatctcaaactcctggcctcaagtgatctgcctgcctcagcctcccaaaatgttgggattactggtgtgagccacagtgcctccacagctggttcagtttttataattaacattgtatcctgctttttttccactgaatgttatctaagcattttccttcagttttacaaatttataatctctcttttttaattttttttttttttttaggacagggtctcattctgtcacccaggctggagtgcagtgtcctgatctcggctcactccagcctctgcctgcctgctcaagtgattctcccacctcaacctcctgagtcgctgggaccacaggcatgtgtcgtcaccgtgcccggctaattttttttttgtagagacagggtttcaccatgttgcccaggctggtctcaaattcctgggcccaagtgatctgcccaccttgtctttccaaagtgctaggattacaggcatgagataccatgccctgccacaaatttataccctctcatgcaacctttaaatgtttattacaaattcacacactttaagtctctagaatagatagtaaatttttcaagggccatgaagagcagatgagtcctcgctctgtctcctcaggaagagtactgataagtagagggcagctgaaccaaggcccaagcacccagagactagttgctggaagtcagcggagaacttacagcatcctgtctcccttcttcccctccctcctgatagtctgtggaccgtatgtttttgcttctccctagctcaggttctaattctggcttctgggagctgccttttctgctgcaggcctgcccaagagttgggaacaaagaccaggatttgcaatggtggccctcccctgcagtaatggcatttaaaagtctgcttagaacacataactgaatcttctgtatttccaaggtttaaaggtgaaagtgctggtaaggataatctagagttgttcttccacttgacagattagtacattgaaagccagcaagattgggttttacctaagatcatgcagcaagttaagagttaagctggaaatcatacgtggggttctttgtgtggcccagtgctgcttttactgtactccttttcttgagcgctgggagcctgaggcctggcctagcactgaaggtaccatgaaaggtaccttagcagcattcaggcagcctggaactctgagacttagccaaagggtcagcggactgaagaaaggtcatgtgggcttgagttttgttcatttattcaacaaatatactgctttacaggtatacatgtgcacacagctacacaaagatttgggaaatgttctgaagtgttaaaggtcacaaaataggtggattacagaaacttttctttttcctcaattttttttttcctgtaatgcttatatattacttttgaaatcctgactttttaaactaagtcctcctgttggtctaagtgtttttatctgttgaggtcatggagtacttcctactttggcataagaaatgggtgggtgatgttatcagccacataaatcccctcttccatgtgagcctgatagtttgggggtctctgacctgagtttgtggaagtcctaagtatgtcatgcaactcatgtgttcatgcttgccagacacacctatgagtgtatacatgtatttgcactagctaggatccttctgcatctgtgactgatgagtagtaggttataaaagtgggtaaagggcatagagcgctttaaatctgcttagaagagagacgtgcattctccctttgttgctgcctgggaaggaaaatgagagtgaatccattccggcagatgactcaaggcattgcagtctgaggatgagggctggctgtcttgcaggcttgaggcctcacagccattgctgtattacaacacaatactgttcactgccatttaatagtcattactgtcattgccatttattgtcatataataagctgtcactattgggttaagtaagtattgttatctcagaggtgggtggtagttatcctcattttatagatgagtaaactgaggttcagaaaggtaaagaggtagaactggaactcaaatcccaaggtcacctcactctacacttggcttctgtattcatccatgcacacagaaacaggcatcttggcttcctttttattcatttaatatttagaacatatttactgagcactttctatgaaatcttttttccccaacaaatgtttattgagtgctttagttctgtgctaagcactcttttagctgctagaagcacaacaatgaacaaaaacaggggaaaaaaattccctgccttcatggagcttttagtgaggagagtaggagcaacaaataagaaataaatttcatagtaagtatttttaaatatagtacattaatattaatagaaatttgaaattcagtcatgccaacagatgaggaggtgactgaaaagatagtctattactcacagttccccaagaggatggggcatcccacaccgggccacagaagaaaacactgaagttgcatgcaggcaaagagagaaaaggaactagggggctggagtctttaagaggtgaggcaaggtaagcaggtttaggactggctagtttgagtaattgtagagggctctggggggacaaggggttgtccctagttgtctgatacctggtcctggggtgattagggcaggtggatattggcccaaaaatgaaagcttgataaagagggtggttgggggtgtgggctctggattggtgggtttgcataggaaaggtgtcgcctctctctagatattaactaaccctggggggggcggctatccctccaggatcagcaataccccagatatcaaagcaaataatacaggaaataaaaagacatggtgaatacaattggcttgactaggcagggtggcttacaactgtaagcccagcactttgggaggctgaggcaggaggatggctggagcctaggaatttgagattagcctaggcaacatagtaggaccccgtccctacaaaaaaaagaaaagaaaagaagaaaagaaaattagccaggtgtggtggcgcacactgtggtcccaattactgggaagctgtggtgggaggattgcttgagcctgggagatcgagactgcagtgaaccaggcatgccactgcactccagcctgggcaacagagtgataccctgtctcaaaaaataaagaaacaatacagttggctagatggcagtaagtgctatagagaaggtaacagggctagggaatcagagtggcagcatgtggaggtgggtgttgtagttctcaatagggtatcagggaaggctgtgctgataaggcagccttttagtaatgacctgaagcaagagagagaatgggctctgtgggatctggggaaggaccgcctaggtagagagagaagtaacatcagagatgggagcatttctcattgataatgttacctaaaactgtgtcaacacaccctagaccatagcagaaagaattaagttgagataccaggtgacttgttggtgtgggaaatatgagcagatagtaaggaggcataggatggccttgtatgtgtgagctggatatggagtgttttgtccagagaccagatttgaatatcctgatggttcctattcatccatatgtagtaagctgtttctccccatatctgttactcatcactagaagaaaaggtgattcttggtgcaaaggtgattctagttggagggagatttatctggctatataacatagagtggtcagaaattaaagattgtcaatgaaaatgaatcctattgcatcacctatgtcacaccccggccccttttaaaacactccagtggcttcccattgcattggggataaagtccagcttcctgctgtgccctgcaaggctgtggttctaggccctgcctactttccaactgcatttcatgtcccttcacccaccagctgcgctccagccacaagaacttccttcaggaagcttgaacatcccaaactcgtttctgccttaggatttctgcatagtctatgaccttggtagaaagccttatttccgtcttcatgtggctggttcactcccatcattcaggtctcagcttaaatgtcacttctcagagaactgtcaccagctactcattctgaagaagtcctcaggccctctctagcccattagtcagtgttttttgttttgttttgttttgtgatggagtctcgctcttgtagctcaggctggagggcaatggcacaatctcagcttactgcagcctctgcctcacaggttcaagcgattctcctgcctcagcctcccaagtagctgggattacaggcatgcaccaccacatccagctaattttttaatttttttaatttttattttttgagacggagttttgctcttattacccaggctggagtgcaatggcatgatctcggctcaccacaacctctgcctcccggattcaagcaattctcctgcctcagcctcccaagtagctgggattacaggcatgtgccaccatgcccagctaattttgtatttttagtagacatggggtttctccatgttggtcaggctggtctcgaactcctgaccttaggtgatccacctgcctcggcctcccaaagtgctgggattacaggcgtgagccaccgcgcccagcaatttttgtatttttaatagagatggggtttcaccatgttggccaggctggtcttgaactcctcacctcaggtgatctgcccgcctcatcctaccaaagtgctgggattacagatgtgagccgtcgagcccagccgtcagtttaattctttaaaactgttcaatactactggaaatttttctcattcatttgttagtttcttatctgactccctctctaccctaactagaatgacaagtttctaatttcagcgactttgtctgtctcctacacttgctatagctcagcatcaggaacagctcctggcatataggaagcactcaacaagcatgtgttgaatgaacgaataataaagtagtatcttcaaatataaaatgttatataaatcgagcctatgggatccccacttaaataatacaagagacattataatgatgcaaggtctaggcaagctccaggaaaagggcattcttatggaaatagtctgattgagtattttctctgcaaaggatatctgcagggatgcctgtagtactggtgacattccataccaatcattgctgatcatggagccaggggttttagctatagtaaaggaaaagtggccttgccaccattaggcaagcaaggcagagtagcaatctttgggcctttggtcccagatgtatagtatttggcagcagagtggttgcctcctttaaaaaaaaaatatgtcttacactccccagcagatttacacttcccagtttgacacagcccatacctctcctgattgttccgtgtccatcttttcatgtttgccttatccgttggtctctgaagacatctgagctttgactcttgccctaggtgaataagtgcccctttctctagcagcttagtgggtacattggatgtttttcctgattgaaggaaagttgaaatactgctagtaagtctcaggattaggctcatggcaacagggcaagatatcagtttgttttatctgcccaaaggcaggggatgcttgctaaagggagtttctggtcccaattatgcaaataacctacatgttataattgggaagtgatctgtccagggtcttgtgtcatctttcaaatccagcctctctacccagctcttgagttgaaggcttattacttgctacaacagttaggtaacctaaatcagtgttttctaaactagaagccaacatttgagcttctaaggttctcactgatctattctctcatcacctacttgccatttctcctgcctttaatgttgttaaatttgattcatgagactggaagtgcctcactgtctactagggtcctagaattctgtttccattcttcagcctgtggcctttccagctggtcagctcccatactcaagactcaagagcagccagtgttctatgtcctgatgatctttctgtatttattagtaacatatttgggtagttacagagccagcctggatttatgtctccccaaaaacctccaacaccattttcagtgacaatttgagatctatagaagagactcatgggttgagtataaacctggcctcagactagctttcagaatcctcacttgggaatctctgtttcacgtgaaaacttcaactggatggattttgtgtgcccacaaaggctaaaatgaactttaaatagaatgttaaagcatagcttataaaatgttaacaaaacctagttctagtctttagtgtaattaccactttctttttctaaaattcttatttatttatttatttatttatttatttatttatttatttattgagacagggtctcactctgtttccttggctggagggcagtggctcgatcacggctcaatgcagcctcgaccttccgggctcaatcaaccctcccacctcagcctctcaagtagctgggactacaggcatgtaccactatgcctgactaatttttacagaaacagagtttcgccatgttgcccagactggtctcaaactcctagacttaagggatctgcccacctcagcctcctgaagtgttgggattacaggcatgagccactgcacctggcttttttctttttttttttttcagagacagggtgttgctgtgtcaccatgtcacccaggctggaatgtagtggcacaatcatggctcactgcagcctcaacctcctgggctcaggcaatcctcccactcagcctcccaagtagctgggactatgggtgtgcaccaacacacccagctaatttattttttattttggtagggacagggtctcactatgtttcccaggctggtcttaaactcctggactcaagcagtcctcccaccttaacctcccaaaatgttgagattactggcatgagccatcacacccagctaaccaccttcattatacactgttcagtctgtcttcaatggagtagaaaattagcctcttctcatgtttgtgatcaggaaattgtttcatgaatggaattgagtattttacatgggaattatgttcaaacattacttatagttaatttgtcacatatatgaccagggttaggcaagccaaaattatatcagagttttaaaacagctgggctaagtgagtatgcagttttacctggtggattagaacactgtcccagtgacagacactaggggatcaaagttaacataactatagtctaatcaaatcaatattgtatgcctcctgatttgatgcatcatttttgggatattcctaccaaaaacacacaccttaaatgtaatcataaggaaatacatggcaaaccaaatgagggacattctacaaaataactaccctgtacttataaaagatgtgcagatcataaaagacatgatctttctctatgaaggacattattggaataactgtcaatatttgaaaaaaacaggatatcactgttaaatttctgattttgcttattgtcctatggttatataagagatgtccttgttttaaggaaacctatactaaagtatctgggaataaaggggaatcttctctgtaacttattctcagtttggaaagagaaagatgaaaaagctaagggcaaaatgttaacattggaggaatctgagtaaagagtatataggaattatttgtactagtcgtgtaacctttctctaaatctgaaattatgtcaaaataaaaagttttaaagaactggtgccagtgggatcatactggcgaatccggttgcagggtgggccaggcagttcattttcctagccgtgtgtatctttagtgtggaatctgtgctcccggtagcaaggaggccagagaggagaaccacagagagacttttgcgggaagagcacagacttggaaagtgtaggatgaaacactgagcttggtcaggaggcttagactgaactcaatcttgtctactgctttttcctaagccaggtagtgaagacctagaagaaaacccacttggcacaggtggttgggagaaggaggatcagattaagactgtagagcctcctattacattaagtccaagagaccctaagccttcacactttctttcctgttccacccaaaaatacagtttaccaaaaaaggacactgcaaacaagcagtctttgacctctagccacctgttacttcctccatatatgcagtttcctcttcttgcttcttctctcaggtttcctaggagaatttccattgtgacattttcagttaagtagcacttaattacagtcttaaactttccagagccaccctgcttaactcttccccccagcctctataattaagcctgttgcagttacctttggttaaggttactactgaagggcacattgtgagttgaatccaggccaggcttcccactggcttctgggtatacttgatgtgatagtacataagcctaaaataactcggctagactgcaacttagctcctactttggcattcataacaggttttgagtttgactgactaccttgctgtcagaataccatctccaggagtctcactcaccctttttcttccagatctagggaataatagccaagctcaatgaaatttggtaaatgctctatgttccctctggggtcatcatctacattagcatattagaggttcccagaagtcttgcagtaaagaaaaaggtggctttcttaactcatctttaattgactgggcagcacttagaacttcttaaggaactggccaggcgcggtagctcatgcctgtaatcccagcactttgggagtccgaggtgggcggatcatgaggtcaggagatcgagaccatcctggctaacacggtgaaaccccgtctctactaaaaatacaaaaaattagccggacatggtggccggcgcctgtagtcccagctacttgagaggctgaggcaggagaatggcgtgaacccaggaggcggagcttgcagtgagctgagattgcaccactgcactccagcctgggtgacagagtaagactccatctccaaaaaaaaaaaaaaaaagttatattgctaagttttgtccctagcttttcattaccagccatttaatgaccaaagaatttgtgttggctgggcgtggtggctcacgtctgtaatcctagcactttgggaggctgaggcaggtggatcacttgagatcaggagtttgaggccaatctgggcagcacggtgaaaccctgtctctacaaaaaatttaaaaaaattagctgggcatggtggcatgaggctatagtctcagctactcagaaggctgaggtgggaggatcacctgagcccaggaggttgaggctgcagtgaactgtcattgagccactgcactccagcctgggtgacagagtgagaccctgtctcacacaaatgaacaaagaatttgtgctggcaatgcaaagatggaggagacctcctctcaaggactttgctcagtgagggaaaatatgtaaacaagcatttatcagtgccaaacaaatagcacaaaaaggtattcagagcaaaaggagaacatgctgggcttacaacgaagaagtccttggtaagcttcagaaaagcagaaaagctaaagggtgtataagcagggaagaatgcaacatagtacagtgaactgaaaaattagactaaagtgaagggttcttataggacactggtcttcaaactctggtgcacatcagaattacttggggagcttgttaaaacacaggatactaagccaccccaatagttcctgatccactagctctggagtagggcccaagaatttttatttcccacaagtccccagatgatactgatcttgctgatctggggaccacagtttgaaaactttggattatcaaaaagtggaactcagagaacaggcaaggtgagatcaggcctgatcgtggaactaccataaaaaagtaggctgacaaattagatactattgatgaagttttgaatgtgatttgaacaaagcgatacaattgctctggtggcagagatatatcaaatgaataggagaaaaagactgggggcagagagacagtctggagctgttatgtagttaaagcaagtagatttaaactatctgagtgccagtgggaatggaaagaaaataccagtgcagaaatcttttttttttttttttttttttttttttttttttttttttgagatggagtctcgctctgtctcccaggctggagtgcagcggcacgatctcggctcactgcaagctccgcctcccggggttcatgcccttctcctgcctcagcctcccgagtagctgggactataggcgcctgccaccacgcccagctaattttttttttttgtatttttagtagagacggagtttcaccatgttagccaggatggtctcgatctcttgacttcatgatccgcccacctcggcctctcaaagtgctgggattataggcgtgagccaccgcgcccagccatgcagaaatcttagtgaatgaaaagtctgctggtaggagaacaaaactggaagttagccttgcccattctgtgggagagtcttcagttatatacagtcatttgtatagtgctattttgagtctttgtgcttattactagggctgaacttgtttatgttcataccatctgaaaagaaaaggagaaaatattactagataagctaatagagttaacggtgctttacggagctcattgagggcttgtttgaaggcctaagacataccatggactcaggagtggccctgatttatggggaaattgggcttacctgccagatatggagcttgggagggctgcatgcagagagctaaatccaggagaaggtgcccactccagcctcggaaattggtaggtgccttgtgccataattagatgaccctccttgttgtgcttgtgatgtcttcgtaggcgagtgcagatttcaggcaatctcagttcctacttatccactaattcttgctggccatcacttgaaaatagtaagcatttcttgtttgtctattttaaaatgaatgttatggtatatatcttaggtatatgacatgatgttataggatacatataaatagttatctgctactttgtatcctctggccaacatctccctgtttcttccccctactccagcccctggtaaccagtgttttattttccatcactgtatatttgactttttttttttttttaagattccacatataagggagatcatgcaatagttttctatgtctagcttatttcacttaacatagtgccttccaggttcatccaagtggcagaattgccttctttttaaaggctgagtaatatttcattgtctgtgtatataaatacatacatcagtttctttattccttggtttgttggcaaacacttagatggttgctgtatcttggttactgtgcataatgttgcaatgaatgtaagggttcagatatctctatgaggtagtaacttcatttactttggatgtgtactcagaagagggatcactgggtcatgtgataattcctttttattttccttcttttttttttttttttttttttgagatagagttttactctcgttgcccaggctggagtgcaatggcgtgatcttggctcactgcaaccccgcctcccaggctcaagcaattctcctgcctcagcctcccgagtagctgggactacaggtgcatgccaccacacccagctaatttttgtattctttgtagagacagggtctcaccatgttgtccaggctggtcttgaactcctaagctcaaatgattcgcccgtcttgggctcccaaagtgctgggattacaggcatgagccactgcgcccagcctgattattctatttttaatttctttaggaacctacatactgtttgcataatagctgtatcaatctacacttccagcatcaatgtgctagggttcccttttctctacattctcaccagcatttgttatctcttgatttttgataatagccattctaacaggtatgagatgatatcatagtgaaaccattttggttttttttttttccacaatgaaaggcctgtattttatactaatataatgtgccctttcttcagtctgaatttgtaaagtttcaccatattctttcagcggctatggtttttgttttgttttggttttggttttggttttgagacagaggtctcactgtgttgcacaggctggagtgcagtggtggaatcacagctcactgcagccttgacctcctgggctcaagcaattctgctgcctcaacctcctaagtagctgagacaacaggagcgcaccaccacaccaggctaatttttgttattatttttagtagagatgaggtctcgctatgttgctcagctggtctcaaactcctgatctcaattgatcttcccaccttagccttctaaagtgctgggattataggcatgagccaccactcccggccttggtggttatgttttgaactcttcagaagtcttttgggaaagttttctactccacagtttagaaaaaatgtgtgttccctctccagaagctgcagcaaactctagcagaagtaaatgggtgtgtaggttgaaataatatctagaatatttactcttagaagagcagcagatctgctttcactgacttttgcttgatcccacatatcaagcttcagaatccaccactggtggaatatagagagaattttctcgcctttaacttccagagacagctagatggggcagtgagtccagtgagtcagcacagcagtatatcagagcagcggccttgtgttttcaggaagtgcttatctaggggcagagggtggagttcattgccctttgagggctttcctccctctgtctctgactcagacagaggattacacaggagaacccgaggtcgaggagaccttgaggacagtcaattgggaactttcattttatcctctgcttccaatgccatcctaacaggagccaaagcgtggggccagggtcgtggggaggacagcactgaagaagcctgcagtagttgagggagatctgcactgaattagaacaaaatttaggagacttctaatttgaagccagaggtgctgacttttgagtctttggagattgcctgttggaaatattcctgttgagggccaatgtcccaatgggctctgaagatgagaaggatccctgccctatgtggatgccactggatctggaatcatttctgtggctcagatatctgtacacattctgccaggacaggagcagccgtattgggaaaagaagggggacaataactagaaacgaactaagatgtggcccttgcttttgtacttttaatttaatgggaaaaaatagatacagatgttctaaatgcataaggattcagttgtacagaatttataaaaacacaaagttaagtctgactgaagtggtaaggtaaaggatgttgagttggtaaaggatgcattggaaaagagactcctaaactaggtctaaaagtggtggcatagtaagtgggaggcaggggtttgcgctatgcatttgagacttggggatgactaagagatggaagatggaatattctgagccaagatgcatctgccaagtttagtctaaagttgtgttaagagtaattgcaagggcaacaagtttcctagtgtcaaggaatagtatttctagctccccccacttcccggccccatttcctgttgctgtcaccatagcagctatcttcattctccagcactaagtggcccaggcaccaagatggctaaccagatggtttgctgagaagccagccgtgccagaacctggccgtacatagcctcaggacctcagctgaatatgcaaccaggagcttgtattctgttaaattttgccagagtattattgtacaccatgcaggacatattatgtaataatacttactgcaggccttatgctgtcaatgcttatgaacaaatatggatttatccattggctacccaggaaattttcacctttggccctcccattacgtgcccttctctagatattcaatttccagtgtgaacaaagatgtatatatgatatttctataatttttatattagcaaattatttctggaaagcaaagaaaataggaatgtttgagtatataatatcttcagacagatgtattgaagtacattggccttatacaactcaagccatatgaaagcaatatgaatgagtttgcaattattcccatgccattggagctaaagcaaaagaacagaaggtcaaaggacccctctgtaaattgttagtggatattagaaatctttgtggtttcttctgatttcagccattggagtcaaagtttccaattcagtattacgattaacaccaggtggacatttatagacctattgaccatctagataaaacaggtatggtttatatggagcaactggaccccattgtcttttaacaatcacatgatgcattatatagaagacatgcctttggggtgtgcttgaataccatcactgaactccagaagaatggattgaaaccgagttttttcatttttgagttgtactactcaagccaatgtagaaaatagtgagccagcctcataagtaatatatttgtgatgcccgcaatccatggaagcctcggatgccacctgcacatatgcttgctctctagggtcccagcctaccccttgcaaagacactgctactggtctttggggacactaagctcctaacactattagaattatcttctttttctgtctgggaattgtagtccttctctacttccaaatcgccttggggtcagtagaaacaaggctaagtcagtattttgtgattagaaaagtaatgggtgacagtcctgtggatgcaacaataaagtattcgccagagcctatgtttgcactctttgatgacttgtgtacagtgtgttctgatttcagaatcgtttggcaaattttacactaaaccagaaaggggagtagcattttttttaggtgtaacattgaagtaagtatgagttgaaactttagaaacaagaaattaaatttctaaattagttatatcagatataataaatttctggtatattcagttcctaccgatgtctatacaggtttctttcttttctttttttctttctttgtctctctcttttttattctctttcttcctttcttttttgtctctttctttctttccttttcttttctttgctttgcttttttctttcattctgctatgttgcccaggctggtctcaaactcctgggctcaagcaatcctcctgcctcggattgctgggattacaatcccaaagtgctgggattacaggtgtgagccggtgcgcctggcctatgcaggtaccttttatttggttactaattgtattagtcagagttctctagagggacaacagaactaataggagatatatatatatatatatttatttatacacacacacacacacacacacacacacaaaagggagtttattaactcacatgatcgcaaggtcccacaataggttgtctacaagctgagaagcaaggagagccagtccaagtcccaaaactgaagaacgtggagtccaatatttgaggataggaagcatccagcactggagaaagatgtaagctgggaggctaggcctgtctagtcttttcacgttttatctgcctgctttatattctaactgcgctggcagctgattagatggtgcccacccagagtaagggtgggtctgccttccccagcccactgactcaaatgttaacaccctcacagacacacccaggatcaatactttgcatccttcaatccaatcaggttgatactcaatattaaccatcacactaatgaaaggctacctaagtagaagaaggacaatgtttgacacagacaatggactggttaggatatgttcagtgcacaagctctcctaggctttattctgatttttgtcttcagttgaagcaggtagcacttatgtgtgttgcatggaaacatgctaaaacagtcgccgtctatctgaggtttcactttccacagtttcagttacccacagtcaactgaggtctgaaaatattaaatgaaaaatttcagaaataaacagttcataagttataaattgcacactgttctgagtagtgtgatgaaatgtcacaccatcctactccgtcctgcccaggatgtgaatctgaatcattcctttgtccagcatctccatgctgtatatgctacctgcccattagtcacttagtagctgcctcagttatcggatcaattgtcctggcattgcagtgcttgcgttcaagttacccgtattttactaaatgatggctcccaaagcgcaagagtagtgatgctggcatattgttattgttgtccaatttcattattagttgttgttgttaatctcttaaggcctaatttataaattaaactttatcataggtacacatgtatagaaaaaaacatatatagggtttgataccatctgtagtttcaggcatccactggggatcttggactgcatcccttccctcatggataagggggagattactgtactgtgattaaaatacctgaaatcatggagttgttgccccaaggcttaggctaataacatcaacgtgcttattctaacccccaagatggtatctgagaccataatctcaacagttgttcaattacctcctcatagagtccttcagaggctcccattctgagggatacccctgtagatagatagaaggaggcaggtgtcatcttcagggaataacctgtgctgcttaaacttccaaatggtgagggagggggaaaattgcctgatagccaaaggatgaggctaccttattctaggaagagattgcaggcattggtcttaggagtggttaaagagctatcattacttactggagatagggagaatctattaccaggtggcaactggtagtattaggtttttcttttgctttcatgagacacagaactttgaagctaaaacttttgacgcttaacatatcgagactagcctgtagaagaacacacagatagaatgaatgaatacacagaaaaaagtcagtcatggaattaggggaggtttttatggttttattaatttttatttaacaaatgcttctctgggtctagacattgttctaaacacttttcaaatattaacttcttaatcctaggagcaaccttatgagataggttctaatattccctactgatgaggaaaccaagatacagagatacagaaaccaaggtaacctgcccagagtcataacagtgcccagtggtggagccagacagttccacctggagatttatgctttagagtaaaagcagtgctgttcagtgtgtgaccacagacagccaaggtctttgaactaagtccaatccacagtgagatgagcccagaaaatgagtgttttgacagttccacaacatccaagagtgtgatgtatttcataaaagtattggtctggccaggtatgatggctcatgcctgtaatcctagcgctttgaaggctgaggcaggaggatcccttgagctcaggagttcgaaaccagcccggacaacatcatgagaccccatctctatcttcttccaaaaaaaaaaaagtactggtccaaaatagattggaaacaagtaaaactgattctttaccacagacagtttgggaagcactgcctagaagaattctcacactcatgcaaatggatttgtacaattatatatctatttatctctatatccccatatgcccaaatgttcattaggaaaatatattacaaaattatgatgtagcctatgaaagaatattattcaacaattaacatgaggctgggcacggtggctcacacctataatcccagcactttgggaggctgaggtggccagatcacctgaggtcaggagtttgagaccagcctggccaatgtggtgaaacaccatctctactaaaaatacaaaaattagcagggtgtggtggtgcatgcctgtaatcccagctacaccagaggttgaggcaggagaatcatttgaacttgggaggcagaggttgcagtgagctgagatcgcgccattgcacaccagcttaggcaacagagtaagactctgtctcaaagaaaaaaaaaattaacatgaatgaactagatctacatgtatgaacatgaataaatctcaaataattttgaataaatgaagttgcaaagtaatacctacattatgataattatataaactataaaacacaaaataatactatattcacataaaagtaaatgtttaacaacatggataagaaagatgcacactagcttcagaagagaatttaactttgatgagggcaattagagagtaggattgcaactgggcaacataaaaggcttcaactatatctgtaatcttttatttttaaaaaacttggagtaaatatggaaaaatgtttacactatatctaggtgatgagtacatagatgtcaatttttttctatatttttctgtattttaaaactatttcatgataaaattcgcttcagaaaattttttttaattatagaaagccaactgtacataccagaacattaggggctctttattatttgcagtgtccagggatccatttgtcttcccatttacttaatgccagtcattggtctttgggcagtttctaaagcttctttgctaaagaggaagcattggttcagagccctagaataggcctagggatgcctagatgctggtactagttttgttactgatttgtgacaagtggttttccacatataaacctttaagcaacttgatgctcccttctataataatggtaaagatgaaaggaacacatggaatgaacttggatgtagagataagattaaatacatgtgtggtggagtcagatctgggtttaagtcttgcctttgccagtcactatgagcctcagtttcctaaaacagtctcattttctgtttcctaaggtgggaatcctaataaataacacctgcctggacttgggatgatttgacgagagaacgatattattgttgtagttattccaaatctgtcacttagctgttttatctagaaagatagtaaaataagttctctagcagctaatggcagccattttccaaaaaagatgggatgagcataacatgccaatccctctgaagaagcgattaactaagtagatgtttctaatctaaatgatgccacattcctttataaccagacatttaaagtgtcttggaaatggtcttatcccaagtcaggacacccactaggtgatgaattacattgcttccagctctgagattcccataacttgggccatggttgcatggctccagttgcttgcatggaacaaacttgaaacaacaaaatagagattacttttggtttttaatttgtactttatactcttgccattaattttcacagaaagcaaagaagcagaagtaaatgacaacaggggaagaggaatggtcattcaaaatgtgcatttgtgaatctcaaaaccaggccatgatgtaccatggaacagaaatcttaggcagtcatctgtctcgcctggtaacgcaaggcacagttaatgtggccggacttctagttctgctgacacgacatgtgctgataataagtcttgaaggcttggattcagtagagccacatggcatcacaggggtctagtgaatgaaaagcttctgcaaacttatcagcagaaagatagcagagaggccctgcttctattaccagtgttctgaagatgtttatcacccagccttctgagaacagtagtttgacccataccaaacacttcagaaacaatgtcaacacacccaagaccacagccagcaaggaattttctgagataagattacagctttttccttaaagagatgccaaccaagttagtcgagctcctaatattccctgagtatagcaacgctgtgagttatccttcataccagagaattttagaagctcaatttttatgcttccaaatacaaatattctgctgctgttttccaagttatgcacaaaactcaagcaatatccaagaaagttccagcagggtcaaggctcagaaagcctgagatttgtgcccatgagaccagccagttgtagccaccggagacagctgtctattggcaaaagcatccattcacctttccttccatcctccctccctccctccctcccttccttccttccctccctccctccttcattccctccctccccccctccttccttccctccctccctccttccttccctccctcccttcttctttccttccctccttccctccttccttccttccctccctccctccttcattccctccctcccccctccttccttccctccctccctccttccttccctccctcccttcttctttccttccctccttccctccttccttccttccttccctccctccctccttcactccctccttccttccctccctcccttcctcctcctttcccctccttcccttccttcccttccttcccttccctcccttcccttccttcccttccttcccttcctttccttccttccttcctttctttccttttctttcttttcttttcttttcatttcttttcttctcatttcttttcttctttctcttgctctgttgaccaggctaaagtgcagtggtgtgatctcagcttactgcaacctctgcctcctaggctcaaactgttctcatgcctcagcctcccaagtagctaggattttagtcatgtgccaccacacctggctaattttttttttttttttttttttttttttgtagagacggagtcttgccatgatggccaggctggtcctaaactcctggcctcaagtgatctggccacttctgcctcccaaaatgctgggattacatgcatgagccaccatgcccagccatatcctttcaccctatttcaggattttatttcttctctattggctgcatgtaggccagagggcctcccaggtagattagacctctagtctaggtctagggcaaagtcattataggaaaaggtgactcagtcttcgagtaggtatgaaaagccactgtaataatttgtttaaatacctagtcctgtgtttgatttaaatatcagtatgcaaaccggcactgtcagggggcctatgtgcgggtgaggtagagctggtcaggtattctcccaagatcatggtgatgatgagaagcatcagcatacacagagacaactcacctttgatttgttcagatgctaatggtatcacttcttgctttgaagtgtctcacgttcatttctttatattccctgtgcacagccctagtgtggttttctgggctctaattcctccttcgcagggctgtgctgtatatagttgccaagattcgttaaaaacaaagcagtaacaacaacaacaaaaaaaactctttttatcatgtcatttcccagtagtctcataataaagtttatactcctctggtttattattgaatgtcctcacaaatttttctatccaggttctctttctccactaatctttatttcatccaaaggatctattactggctgttaacttatttttcatttttcctgcctctgtgcttttgttcctgctgtttctcccttttggaattccttcacccttctattcagatacagctcttccattaaatcttttcagatcaatcccgcctacactgatctcaccctcctctgaactctgcttacttgtcagctaaagtccataccagccctctggcaattaatcacatacagccttgtgaatttatctttattttgcatgcttaatcttgctttttcattttttctctctctctctctgtctctctctctctctgcttctctctattgtgtatggatatctatgtatagctaggtaagaggtctgcgaaaataaaaatctgtcttatatatctttataatacatgacctaatcagtgctccatgacataattattacttaggaattttcactgaggatcttgatttgcatgctgatgctcctgtgcaactttcgaatgcccagctttctcaatactggtagaaacaagcactgagaactaggaagacatctgaagtggacttaaagggctttcttttgaataactcaaaactattctctaaagccaaggtaggtagatgctaatgctgatctcctccgagtttaatgagtattcagaaatcaaggatttagggaaaattaaataaagtttgctcaatgtggttttcctgcatgcccacatctgccacatgcctgttctagcctctctattcttccatggcagcgtggctttccctggacttgctcttcctcaaacctcatccctaaccccatattcagagggagcctagagaactgggcgggtgtagacatgaaaggcccagtagtgtttgtttgtttgtttgtttgtttgtttgttttgagatggagtctccctctgtcacccaggctggagtgcagtggtgcgatcttggctcactgcaacctccgcctcctgggttcaagtgattctcctgcctcagcctcctgggtagctgggattgcaggcatgaggcaccacacccggctccagtagtgtagtttagtgctcaagtctggctgtctgcagttcagatttcaccttgcccctatgagctgtatgtccttaagcaagttaactctttaagtctgcagtttcttcttctgtaaaatgaggataatgacagaacctacctcatagagttatacggagaatgaaatgatagtccacataaaatgtttaggctattgcaagcatatacgattgaaaatagtcaatatatggcatacagcttacaaacaatatgctgagatttaaaaaacaaaacaaaacaaaacaaactcttgttctccaatcactgtgcctttaaaacagtacaagaattctctatactctgtcttgtttctcacacccatgctcttgcatcctctctaattaggccatggccccctccattccactacagctgcttttttcaaagtcaccaatgatctccatgttgctcagttttaagacttaattcttaggtcaactctcctgacctatcaggcagcatttgacacgccgatttctccctttgtaagacattttccacgtgcagcctccagaacaccccaccctcctggttttactcctacctcactggctactttcttgtcctctcgtcttcctgcttctggcttagtctttggactttgtctttatccatacccatgcctctcgctgatctcacccagcttcatggcttccaaccccatctctcctctgacaactctgcaattatctccagctcaccagcactttctcccctgagctccagacttgaaggcaagctgctattcaatttctccactcaggtatctaatgggcatctcaaagatgtctaaacctaaactcctatatttcctccctgagtcctgttcctcctatattcttccacatctcaggaaccccatcctaacctcagacccaaaacctgagatacccttgactcttttttcatatcccatacacacatagtctgtcagcaattcatattggcccttccagcaaaacatctccagaatctgatcacttctaacaaccactaggaccaccctacttctaaaccaccaacatccctcacctggaatagtgcagtggcctcccaaccagtttccctatttccacttgccctcaatatagaaaccagaatgacctttaaaaatataagccagattgaatcactctggctcagaatcttccagtgggttttcactccaggtaaaagccagaggcatagcactggcttaccacatgcttgttgacccagctcccagtagcttttctgacttcctttcttactgatccccccggcttactccaccaaggccaccccaggccttgccttgggacctttgtgtttgctcttccgcccagaaggcccttcgccagatggcgtcaccaccactaggccttggctcacatgtcatgtcatgagactggccctgatcacctcttcaatctgcacccccttttccaaccccagcactccctaatcccttcccgtactttgtgttttgatgtagcacttctcaccacctgtcatacttttcattttgcttattttatttttatagtctattatatgtgtttcccaccagaatgtaaactccgcgaaggcaggagtttctgtcttctgcccactcctgtatccatagtaccgggaatggtgcttcatactttaaaaattgagtgagcgtttgcctttcttactgttgttgagagggttctctggactggggtctacagctggcctggacattctgccttgtgtcctagcttcctgaggatggagctgtctcagtcccaggtttgcggcctgccttcaccacctctgacatggctgtgtctgtccgttttcctcagatgcatactctcattcctcaagcgagaatggaggcaagtccgagtccgtggccaacctgcaggcccagccctccctgaactccatccacagttccccgggtcccaagcgctccaccaacactcttaagaagtggctgacgagtcctgtgcgtcggcttaacagcgggaaggcagatggaaacatcaaaaagcagaagaaagttcgcgatggtcggaagagctttgacctgggatctcccaagcctggggatgaaacaacccctcagggagacagcgctgatgaggtacttacagggggccctggagttgtccatcaggagggccttctgacatgtctccttcctcaggttttgtcaactaggccatctcaaatctccattagtgtgttaccttgagcctaagtgatttggattctttttattcttaagacattggccagtttgatttgtggctgattcagaagctgactagcccctaagacttccagcagacagaaaccatttgccagatttggagataggacctgggcctgaggggagtcatttggtcattagttccctacctctactaaggactacattaaaaccagctagacctgtttagatttagaataaaagaatgaagattgtttcattttgaaaacaggactgtgctgggagattgtagctgttttcaagtctcttgagcagtgccacacatcaaaaggaatagatcatccagagttactccagataactatgatgaacagatgaagattacaataggcagggtttccgctcaaagaaaaagtttaatctaggagtcagtcagtgattaaatgggccttcatgaaaactaatgaacgcccatactggaaggtttgagagactgtagccaaagttaggctggatgaagctgagattctgtaaccaaaagacagtggatatgttttggttggggaaatgagatacctgttttatttggcacacaatcctgctctaatcactgatgtggctaagaaattctttgtgatgtgtaactggaccccctcttgttgtgattttatgctacctgccatttctccctctggaaatggcagctaagcctggcggcatttgggctatggtttcatagccctacaaaaatgtaaaagttaggctctctctgactacttccagctttttcttttcttgctaatcgataagatagatagtttctggttttgcttctttttgggggtgtgtgtgtgtgtgtgtgtgttccccactggtgctcactctcatttgaaataagcaggtgtatccatgtatcaaaagaggaaattgcgactgaacagttaagagtgagttgagagaggaactctcctcctatgtattatttttgttaatgtcaagtccagaaccactggcatgtttgtgacacagtaactaatgctgctcttttgttctagaagagcaagaaaggttggggtgaagatgagccggatgaagagtcacacacacccctcccaccacctatgaagatttttgacaacgaccctacacaggatgaaatggtagaacttctttacttgctcacttaaaagagcaacgtgccgtgcgtgattttgttttttgtgtgtgatgggggtagtcatactctttctcccatgttatctcgtcgtccacatgaatccatgttgataccaattgtgtctctatttggtaggtgtcccttccccaaccctggaggtccaacttcattctaggcagtggagggggtgtgtgcagaattctcaaagtgggaatctgcctggtgtcttgtcctgttgataaagggtaatggctctgtctttggaagcagcacatcctaaaaggagcaattccaggtagttccagtccacaaccattttgtcgtacctgactgtacaacctgcatgttagttgttttccctatagtcaactctaaactctaactaatggtagctaccagtcaagcccagtgttggtcaaattttgcaatgacggtatgaggaatgaagatgctgctaaggggaagttattgtcaaaggtgggcaaacttaatatgcgaaattgcctgactttgctttgcaagattccccggcccgctggcatgcataggctcactggtatttgaaatatcgatgccccctgtgtctccagtcacccggtgatcatcccagttgttctggagcagaagcgtaggttagacgtgcttccaggtactgacccgaggcttggggcagctttatgttctccctcacttgtcactcagtctccttgcagctctgctttcacatcacctttttttttctgccttaagtgttgctgattctcttagactctggacgtggaagcggcaggtttgggttttgactgtatggcactttccatttgctttttcaagtgctgttttgttgcagtggtggtagtggatgtggcagcttgtctacctgtccctccaggctctcctgtgctctctagtgctctgccctgtagtgggacagcctcctgcgggtgtgtcctttctggtgacatctcagttcttattttaattctctctgctttgcatttgaattgttaacccacagacattaactgaagtcttcctctgtgctaggccggaaggacaaagtctagggactctgagatgtggcagctgcccccatgatgtgactcacctagtcgtggcccctcctaggtgatgttggtggccctgtcttcagggccagctctttgactctggattattgggaagagacatagtaggaaggctggtgttataccatcctgggttcctgagacagaagtgctggtgcttcaccttgagatggaaatgagacctgcctacttgtaatgtattttataaacagcgatcatggcctaaggagtagggtgcccatgtctcacacagccctctgtgcaagggccccacttgcataaggtcaccaccttctctctctaattccctcaaacacagcttgtttacagaaatggatgttacattgtttctggataatttttaacccagaattctgacttacctttatttgtgtagccttttccttatgcagaaatggggcagatggcaacagtctcctttcagatacatgaactctccttattcctgcttgtttgatttctgtatgttttttataaatgtttgggagtgggatgaacttcagagcatctagcaaatggagttggatgtattaaaacaatttttacaacactgtcaaaggaatttttaaaagttcaccgttgtaatattgtgcaattgtcttctccttgtttccttctaatctttttcttatgtgtgtacgttttacttttacaattataatatgcatatgttgtgtccaatgttttatttactaccatttcctaaaattgcatgaatttttttcttcctagctgtaattttaatagctggagaaaattttgcttatttgctgttccataatgtgtttgatcagcctgttggggacatcctaacagggtgtttccattgtttgctactatggctaatactactacatacagatcactgtgtatatacagcatttgttcttttgacttctgtccttggaataaattcccaggagtaggattactagattaaaaagaggatagcttgattttccacatggacgtaagctttttcctgcagtccccaagagaggaaaaagaatattgttatatcttccttaattataattattttcctcccatctcagaagcaaagacttaataaagtaacttagattagatgagaagcttcatttttgaaactttctctctaacccaaggggcaaacttgaaggagcctatgtcctggccttgggaacaccactgccccctgctctgataagctggaagtaaaagcacacacaaacggtgcagggttaactatttctcccccagtttcttctcaggtagaagaaggaagaaaaagccaaacaaaaaaccaccatccttcagtgagcaggaagccccaaaccattgaccacacaaacaaccacatggacaactcctcactgctggtgcaggggaaaagggacacagggaggtcctggagtcgtctctctttactatgaacagggtagttcctagctgcttcaggactcctgctaaagccttttattacttcctagtgttccagttcaggggccttaccagagccagctatgctttgtggaggggtaagggtgtatgtgtgtcaggggcagagcgggagaggaagacagagggagagaatataggaagggagtatctagcttgctggtctctaagggtcctgcccctagcatttttgctggacacataataaagatctatatctaaggctgtagtaaagcaaggactgtttcccttttttggacacactcaaggctgggtttgttgaatccttcacaccccaaaacagcaacgggcagctgtgtagtggccaaagtctcgtttgcccacagagcagtagcccccgccctccaagctgttgctgtcagtaggtacaacactagtctgtaggcctcccaggaagtcagtgatttctcctctcccctccttcataggcttgcctaaggatagcctagtaccatccatttgctgctggctagaattcctaataaggggttgggcaggcctgtatgtattacacccacactcttctccctctgtcacctcttccgtctaaacacagaactttgcttcccttccctggcttgagctttggactttctgttttatttcctgatcactgttccttattctttgctaatctgcttttcctctgctgcccgatgtcttgcagtcctcctctttgctagcagcccggcaggcttccactgaagtacctactgctgcagaccttgtcaatgcaatagaaaagttggtcaaaaacaagctggtaagtgggggtcctggaggcagttctgtgtgtgtctcaccttcacactgctccaggcttgcatctgtctgccgttttctcctttgcacctgtcctcattcttcctatgtgattgcagctaatgatggtttctaaaaagctgtaccccagagtcctttttgactttgtttgggaatgggtatagggaattaatacatcatttgggggctgcagtgttgatgaaagttgaaaactattcaagacaaactcacctcattgcaagcctgatccagcggcccacaggcaagtggcattcagtcagtgattgatatgtatttggttagcccagaagctagtacaccgcgatgctgagacccagaacacactgattggatatttgacagcactaggaaattttatggggacttgggtagccttccagcgtgcaaagtctttcaaaagtagactgctgattataaaggggaatgggcaaaagtgtgtggatacctcaccacaataaattaagagagtcagtgcctagccctacaatggggggaaaaactgaacataagccactggcagcctgtctagcctgtgactgtctcatggacccatcagcccgttggagggataggtgatgagtctgagcaggtttggggttttggcataatgctggtgaaagggcccctttttggatagctcattaggatggagctgttcctccactctcctgtttttacatttaagtgtatcaccacaggatgacaattggaagcattttcctttctttcactctcatccatatcacccatttagcttttcctgcaattctcattaggataaatgtctgtgcttctgccagacttctattgggcagtcttattaatcacttggcccaggagctagaggaaaatgatggatgctctctatggaaagctacctaataattttgactatagtaactcccttttcagatatcccagcatatactatatgaatgaggtttaatacatatgagtttattcttttcctgctaaattttcctttctaattaaaaaaaaaaaaacaaaaacctgctgttttcagtacctagtgtcaaactcctgaaaatcgtctattttcctgccatctttccttttcctaccagcaggagttaagtactcttctgggcactacattgactttcaaagacccctctctgactgcttctcacttgctctccctctccacaccaacctatataccctcttcattctacaaatgctgtatttaatttttttcttaaagtcatcctttttctttcttttttgcattttttcttttaccatctgagcatgggccctgaattcattcctggagtattgcagtagccattgcctgccttttctctgctaagtctgccttcacacccaattggtcttctgtaaacactgcttattgcctccctcttggctacataagcagtggtctccaatgggggggtgccctcaggtacataagacaacttactggggtatgggaagaaaatattagagcctctttatatcattttaaaatggttttgtgtgtgttttcttatgtatataatgatagtacagtagcataaatatagaatttataaacaagttacatgtttgggggtacacgagcaaaattattttcagtgacagagatatataatcaaagtttgggaatcactggcctatacataaagtccacacttacctaatattctgatatttttgtagcctgttctccaacctacctttccaccatctagttatttatttggttgttgaactctgttccaaacaaattgttttctttgctatcctcgaactcacacttggctttcttccctccaagtttttgttcatatggccccatttctctggaatgttctccctcttatgtttgcttatctagagcatagtggtcattcagggtcctactcagatctcctcctctacaagggcttctctgaccagcccaggccaaatttccattataatcccatggtaattactaaagccacatactgcctgggacagctcttaagcagctctgtggtgtaatttgttaaaatatcgtaatgatttcatttgcgttttacctccctagctagatggtaagtcatttaggatattattattttttgctctattagtataaaaaagtcttttacacttagtgggtttttcatgaacacttgtttccagagtctatttttatattttggattacctttttgcccactactactgctaagctttgcactgctgacagtctccagaccactaatttgtgtgatcgatggtgttaaacatgtaagcaaagacatagaaaagtcccatcacagcaaattttctagagaagaggggatgtgggatggcattggtgttgattggctttattataggctctcaataaatgtctgttgaatgaatgtcctttctgtggtgagtgtgccataatgaaggatataacttcttccagcaataactactcttgaggacctacagtaagcccagaattagagctatctttggcttaacatgtaaaaccaagctcacgtcacagaaaggaaagaggaagccgtggtttggtttcttagaatcttcctaccaaaatttgattcttggtcctttccaccactttctctttctccccttcccacatgtggtagcaatgtaacaatactaggttgagaatatctcagccatgcttgggagcactaagttgcattttcaccttcgagactcttagtcctattccttatcagttcttccgcttagaagaagaaaagattcagagctcataaaagctctggagtatttatttgactaagtacaactgtgtgatagctgcgaagatagtgagtattatcacaggcttggttaatgaaagtacaatgtacagatcaaaagaagcaatagtattcaaaggtattcaaaccatacacatcatgagctgtgtgtgactaatgcattcgattctttctttcttttttttttttttttttgagacagagtctcactctgtcgcccaggctggagtgcagcggcatgatctcggttctctgcaacctccacctcccaggttcaagtgattctcatgcctcagcctcctgagtagctgggattgcaggcacaccaccatgcctggctaatttttgtatttttagtagacacagggtttcaccatgttggccaggctggtctcaaactcctaaccacagtaatccacccacctcagcctcccaaaatgctgggattacagtcatgagccaccacgcccagccaatgcattctattattctattctaaatgcaaccttctacaatgttcttgaacaaactggaggggcccagaggaggtaaccaaaccatgtggtccatgtaatttgaaggaaagttgaggaaaccaaggttaactatggggagaagttaggagaagacacatgagagctgtcttctagtaattgaagcactgccatgggaatgaggttgcaaagagcaactaactctttattaccccagagggcagaatctagacctgtgggtgggagttttcttcgttccatatgaggaagaactaataaagttctttccactttacagagttcaattccatcttacaggagcatctggtattcttggactttactgagtccttaaagtctttccgctttattggttgctcaagccgcggcacggaattctgctttagaattcgtttggctccctggctccacccaaaggccatgagatcccccatgttcctatctcccagagctgcccctggtgctttatggtcacttggtcatttgttataccaaagcttctgcctcggtgagttaggatctctgctgcacaagacctactgttaaggaacaaaaacagggtttatctgcagtgcagataaaactcccgaagagtcaccacccacccatgagtccttctggacattaatgggcccttctgtggtcttgctatcagccttggtctttaattcgtgcttttgtttattaagaaagatgctcacccatctccccagatagaactaacacactttttctgggttttgcattaagggattatctttgagccaggaatagggctccccctgctttcactgtgtgatttttaataaagccttttctagacgtgtggactgttgctgctggcagtgactgtgtaaggaatcagaagacctaggatttagtcctgcctctgctatctactgtatagtcctgggaaaattacttagtctacttggggttctcttttacctcacttattagtgatgctgattctgtctattcaaatctaatcccaacagagttatgatgataattgagtaggcatgaatgggctttgtaaactgataatcaagcatctacaaatgttagttcttagccacctcgactgccttgtgaaggacagggaaagggaactgtgtcatccttatctcctgtagcttggtatgaagctgggcacatggaaacttagtatttgccagcaatagattggttgggtgaatgttgcagggtaatagtttgacagtctatacaatttggttttatttcccaagtttgagaaacaagagcttcctggccatgtgagaatctagtgtatctctaaactgaagtcctggagccccagaattctactatcttcctggcatgaaagaccaagcctctggaaagaaagcccctaggccaagtgtggtggctcacacctgtactcctagcactttgggaggccaaagcgggcagattgcctgagcttaggagttcaagaccagcctaggcaacacggtgaaaccccatatctagtaaaatacaaaagaaattagatgggcgtggtggcatgcgcctgtaatcccagctactccggaggctgaggcataagaatcgcttgaactcgggaggcagaggttgcagtgagccgagatcgcgccactgcactccagcctggggtgacaaagcaagactgtctctacagaaaaacaaaaaattaaaagagagagagagagagagatagaaaagaaaagaaagcccctttctgagctcgtcattgggtggcacactagcgtagttcactgggctcaggatggccctagtggaccctggctaataatcctctgcctttagggaagagactggccaggactgaactcctatttagtctacttggtggcctggcaccctgagaatgtgccctacctgcttcagcaagactttccaccctctggttctcctattttgacagcattcatctcctccttgggccagccttgtgggtcatggaagaacatggccacagccaggctgtatttgtgtgtgtgctttgcccccctttagaagaattaacttgttttgtcaatagccgggtggagttagcaaaagttcagaatccagatggggaaaaaataatggcctcatcatatccattgcagaggtgtatgtttccagggactgggttcttctagcatgcttctgtggaagagattcccaagcctcgttttttttttttttttttttgagacggagttttgctcttgtttcttgttgccgaggctggagtgcaatggcgtgatcatggctcactgcaacctccgcctcccgggttcaagctattcttctgcctcagccacctgagtagctgggattaacaggcatgcgccaccacaccaagctaattttgtacttttagtagagacagggtttctccatgttggtcaggctggtcttgaactctcaacctcacgtgatccgcctgcctcggcctcccaaagtgctgggattacaggcatcagccaccacaccaggccaattactgaggttcttgtaagaaggtaaaagtttagatttccaccattttttgtttgtttgtttttgtttttgttttgtggaggcagggtctgactttgttgcccgggctggtctcaaattcctagcctcaagcaattctcctgcaatggcctcccaaagtgccaggattgcaggtgtgagccaccatgcccagcctccacaaaattttttttttagcccagttacaaatctgaaatgtcattggcctggaaaatccagacttaagcttttcaactgtgtattgtccctacaccccccaacagtttgcctaggaattacttagatctcatgctttttgtccagagaatattacttaaggattttgttgttgttcggtttttttgacacagggtctcactctgtcgcccagactggagtgcagtggcttgatctcggctcactgcagctttgatctcctgggctcaagcaatcttttcacttcaacctcctgagtaggtgggactatgggcatgtgtcgccatgcctggctgatttttaaatttttctatttttagcagagatgaggtctcgctttgttgcccagactggcgttgaacctgagctcaagcaatcctcccacttcagcctcccaaagtgacagccacagccatatgttatttttttacatatattttattgtgtatatttgaggtttacaacatgatgttatgagatacccatagatagtagaatggttactgtagtgaagcaaattaacatatctatcatgtcacacagttacttttttgagtatgtgtgacaaaagtagctaaaatttatattttaattagttaaataaaattttggtggaagtctaaattagtacctaaagagtagctaaatgtacttatttaacaaaaattccaaatacaattttattaatgataatcctcatgtagattaggtctctagacctgttcatgctacagatttgctactttgtatcctttgacctacatgtcccggtttcctagctgccttctccactttgctggtaactactgttttattttctatccgtgtatatttttgtgtatattttgaccttttaaaaaaatattccacatataaatgagatcatgcaatatttttctttctgtatctggcttatttcactcagcatcatgtccttcaggtccatctgtgttgtggcaaatggcaggatctttttttaaaatttttttttatactttaagttccaggatacatgtgcagagcgtgcaggtttattacataggtatacacgtgtcatggtggtttgctgcacccatcaacccatcatctacattaggtatttctcctaatgctatccttcccctagcccccaacccccagacaggccccagtgtgtgatgttcccctccctgtgtctatgtgttctcattgttcaactcccacttatgagtgagaacatgcagtgtttggttttctgttcctgtgttagtttggtgagaatgatggtttccagcttcctccatgtccccgcaaaggacatgaactcatccttttttacaactgcatagtattccatggtgtatatgtgccacattttctttatccagtctatcattgatgggcatttgggttggttccaagtctttgttattgtgaacagtgctgcaataaacatacgtgttcatgtgtctttatagtagaatgatttgtaatcctttgggtatatacccagtaatgggattgttgggtcaaatggtattcctggttctagatccttgaggaatcaccacactgtcttccacaatggttgaactaatttgcactcccaccaacagtgtaaaagtgttcctgtttctccacattctctccaggatctgttgtttcctgactttttgatgatcgccattctaactggcgtgagatggtatcttattgtggttttgatttgcatttctctagtaaccagtggtgatgagctttttttcatgtgtctgttggctgcataaatgtcttcttttgataagtgtctgttcatatcctttgcccactttttgatggggtcgtttgtttgtttcttgtaaatttgtttaagttctttgtagattctggatattagccctttgtcagatggatagattgcaaaaattttctcccattctatagcttgcctgttcactctgatgatagtttcttttgctgtgcagaagctctttagtttaattagatcccatttgtcaattttggcttttgttgccattgcttttggtattttaatcatagtctttgcccatgcctatgtcctgaatggtattgcctaggttttcttctagggtttttaggttttaggttttaaaaatgtttaagtctttaatacatcttgagttaagttttgtttaaggtgtaaggaaggggtccactttcagttttctgcatatggctagccagttttcccaacaccatttattacatagggaatcctttccccactgcttgtgttttaaggctgaataatatttctctctctctctctctctctctctctctctctgtgcgtgtgtgtgtgtgtgtatcacagtttctttaaccatttgtccatcaataacacttaggggtttccatagcatactattgtaaataatactgcaatgaacatgggggtgcagatgtcttaagaaaagctgacttcattacctttgcgtatatacccagaagagggattattgggtcatatgataattctattcttaatttatttgggaacctccctactgttttccaaaatgtctacataagtctacattcccaccaacacgtaccagggctcccttttattcacacccttgccaacatttgttatctcttatttttcatttttatttttatttttttgctgcctccctgtctgggaatcggaccctgatctcttattttgttcttaatagccatcctaacagttgtgatatgcaaatttttatcaaagaggagcaactaagaggtgattggttggtgtggtaggtggcactggaccagctagcttacccattgtctcatcacatgagctttgatctcttcccaagttacatagcatatttaataaattcttggagtcctcctgtacaccaggctttggaatcaagcacagaattttccttatatggagctcgcagtctctagggttaatgcttaaaatcctctcctccctggactgttggaaatcatttcctcttagattttagtccgacatctctctatgtgactgctagagggatcttttgtttactttttttttttttttttgagacagagccttgctgtgtcacccagtctggagtgcagtggcatgatctcggctcactgcaacctccacctcccaggtccaagtgattctcctacctcagcctcccgagtagctgggactacaggcatgtgccaccacatctgactagtttttgtatttttagtagagatggggtttcaccatgttggccaagctggttttgaactcctgacctcaggttatctgcccccctcggcctcccaaagtgttgggattacgggcatgagccactgcgcccggcctcttttccattttttttttttttaattaatagttcttttctgacgaatataagaaatatatgcttattcaaaaaaatttggaaaaatgacgagtataaacataaatcatcatctagacatattcagtattgaaattttgatatgttttcttctagacccttttaaaaatagtatagttaatcacagagtacttaaaatttaagttctgtttctctttactatcacatcagagacattgtcccaaattatgaaaatatctttggaacgttaagactgacatttctaagtcttaaatcaaaacatgctatttccctgcttacaacccttccatcattggtcttagaaggtaaagtttctacttctttattttaattttaattttaatttttttatttaatagagatgggggtctcactatgttgcccaggctcggttcaaactcctgagctcaaatgaccctctcaccacagcctcccaaactgctggcattacaggcgtgagccaccattcccggccaagtctctacttcttaataccatgcagacaggttccttatgatctgatccctgcaaacttctccaggattctgttttcactcctcatcccctcttcctttaatacctactcacccagactcacaaaacacacagttacttgccaccctccttccctcacactctgtactctgcccacaccaggctactttcagcttcccaggctgcccccatgtcatttgttctttcaccctatactcacaatgctgctcctgcctggaatgtcctcccattggcatatccagtgaaagtctcctatttatccattctcagttcaagcattgcctcttccattaagtctttccttctccatcccaccatagagccacctgctccttttgttcaccctccattgtaccctgtgtctctacaagagtgcccattttggcttagattatggaggccagggagctttgtcttattcatcctcatttctccagcactttgcaaatatttagcatgtagtagatgttcaataaatattttcctgaattcaaaccagtggttacaatactatgtgatgaaagccatgcagggagtatgtaaagagtgtctataggtgcccagagagggggcaggttatgagtatatgatcccagatccagcgcccaggaaatgtgttcattttaaatatggggatgaccttcctccacacttcgtcacatatttgaatctatttgcatttctattccccatccttggattgactatgggaacatttgttgctctatccccatgtaccttttcctttgtcctctgagactatttgtgccctgagctccaggtggggcataagtcctcactgtggcagaaacctggccaccactgcctgttttctcccaggagcagaacagagaattttaggtcaaccctagttgcccttagctggggctcagtatcccaactctagcataggtagctaggtcttcagaggccatcactcttgaattattacaagcattaaaatcaaacccattgttttaggcagactatctagcatatagctttagccaaattctttcttcctcttgtccttgtctctcactgttgccatcccagagagtcctcccctagagatagcctgggctactttgcttatagaacaggtcaggtaggaggagatggaagtatttccccatttgacataatggactcctcagatgttctttgttctgtagaaaggttgagagtggaccacacaaagctggatgctccatgggagtgcccgtgggcagaggtgtctccctgggaaggggtaggagcacagaggataccactgagcagcaattcactagaggaaaacattcatttcttctaagggcaaagggatggaactgtgaatgaacttcagcagcatctaatggtcaagcgagcctataaaccaaggcttgtttcccaggcgttgcagtcaccatgctaccactcaacaggctgcagaacaaaggctgaaacaggacaatggggagaaggagagaagaggaagtaaaaggcatgtaatcagatcaatcaccagctgggcccatctgcccaggagcctgtctctggtgatggcaccaggagacatgtcattggaatgcctgcctgtgtgcttggttgtcaagcctcagcaccagacactctcatttccttaataacaggttacagatcctgtatctataaattgagctaaacccttcttgacctttccatatttttagcctatactgctgctctggatataacaacttccatggctgattacttgttctgtgaatacttttatctcaagttaaaagaaattctctcttgagtttgaagaccctgtcctcttagttccagtttctagtgttggtaacaaattcatgtttagcccttggcacattttgtcagtttgggggtgggggaatggaaggtttgatatctgcttagtgttatgtttttcagattcaaatcttcatattctccatcttttcttataaaatggaccatcaggaacctcattagtttttgatttatttctctggacctttctgttctacctgtttagcctatgttaaaatagagcaactgagagcatcatgacaatactccaagtgcagctcactgaaggccaagctgaagcctttcattcctacctttttggactgcatttttttaaatctttgtgactttaaccttagggctaatgttttcaaaaactactaaatgaaactgtttctgttagctgcagtagctggtttaggcaggcatcttgtaagagcagtttagggccagacacgctgtctcacacctgtaatcccagcattttgagaggctgaggtgggagtatcacttgagcccaggagttcaagaccagcctgggcaatgtaatgagacccagtctcttaaacaaacaaacaaacaaacaaacaaaaaagattagctggatatggtggtgcatgactgtcccagttatttgggaggctgaggtgagaggattgcttgagcctaggaggtcaaggctgcagtgagccatgattgcaccactgtactccagactgggcaatagagtgagaccctgtctcaaaatagatagatagatagatagatagatagatagatagatagatagatattatggctgggtgcattggctcatgcttgtaaccccaacactttgggagactgaagcgggaagatcacttgagcccaggagttcaagaccagcctgggcaacatagtgagaccctgtctctaaaataaaataataataataataataataataataataataataataaagaatagccttagattagtctctcattatttgttttacagttgcccaacttgaccttactctccagcctcactgtgtatccacactacttctgccaatttgcataatgaaatgctaaatgtcactgtgtaatccttcttccaggacacttgtaaaagtgttaagattgactccattttgaatatttttatcgttaacagttccatccatggggacaggggaaaaccccatcatcataggacatttttaacttttcaaaggggttgtacagctattatctcggcctattccttagaaatctgtagagagggaagatttaatttgaaaactgagaaaaactgaagcatggaacaattttagctatctcacataaatcattcagtgactagcaggtctgggattcaaatttaggttcttttacccttagttccctctggagtaccatattcacccttttcacttgttttcttttgtaactgcatatttggtatagaattgcgatcgttagcattacctctggagctcttaactagagatagtcactttgacaatttcattatgtctgggaaattggcagcacatagatgccaagtacatcctggttgcctgagaaggtggcagctctgggctccctgctgcaggaggataaagtctctggtctgctagtgcttcactgtggtttggtgagaacagccttggctactgattttccatgttgtctgtggctaggctgggaggacacagggattccaaatgacttttcaaagtacacttctctaagcctgtttttctctcttttcagagtctagaaggaagctcataccgggggagcttgaaagaccctgcaggctgcctgaatgaggggatggccccacccacacctcctaaaaacccagaagaagaacagaaagccaaggccctgagaggcaggatgtaagtggcttccccagttcctccctgtggtgcacatgtgagtgcggtggacaatggacaaaggttggggaaaattcgagaggggttccccacgctgtttccactgacatctttcattctaagactcagatctgtacagcatagcactgataaacattgagccactttggcactgacttgattgaagtttaggctaaagtatattctgtgagatagcagctattactgacaaagtgtggttgtaggtctgttagaaatttaaaacatagtgataaaaggaaaatggcaaagttgaggaaactatgagactgttactgagggcctatagaatcagagagtctctgaccgtggcagatagtctgatagagatcacctaagaaaacatttccccaaatgtaggaaagttatatatagaggaaggagctgttgtaccaccaagcaggtcctgtctctactccttctccaaaggttttaattttgcatctgtttctgggattagttccaagagaacttcttctccactttgaatagttagtggtaaaataaaattcataatgcagaacaatcccatgttatgcaagagttacctatgttgatatgaagtcaatctgttatttgagttgatcaagaatataccacataccactagtgcaaaagcagaactcctccaaaactttcattttctttttcttttctatcttttttttttttttttttgagacagggtcttgcttggtcacccagactaaagtacagtggtatgatcatagctcactgcagctttgacctcctgggctcaagggatcctctcacctcagcctcccaagtagctgggactacaggtgtgcgccaccatgcctggctaattattttattttttgtagagatggagtcttgcttggttgccctggctggtctgggactcctaggctcaagtaatcctcctgtctcagcctcccaaagtgttgggattacaggcaggatccactgcacttggccaacttttgttttcttgtttagggttgtactctgtgttggaagcagagctactgatgagtcttagacatagctcagcatgtgagagattataagcagtagtgagaattgggaaggcaggtgtgaagggtccctccctgttgttaattagcctgcctttctctctcaaattcatcactcctttagcctagccacagacatgaaaactagcaaaaataagtgaggccaggtccttctgttacctagaaatgtacaaagtgtctatttatgagtttctgtttcctaggaaacaaaagtgagaacatcacagtgaaggcctggtttgaaagcagggctatcacttcatagtggagatgaacaagtagcatgtaaatcttgaaattctgtatttaccccctcagctttgtgagtactcagggggaaccccaagaagttggtaaatggaatagaggttgataaatgccatacccaaagggaaatttcctagcacttgcacaaagctgagtctccttagcttctcaggttgttgttacacaggtgaggccaagttggagctgatgtcttagtcctttgtcaagtcaaagcaaagcttaagtcagaaaggtgacctctgaggtggcaggtgaccctgggaaaagccagtcactactctttttttttgagatggagtctctctcttttgcccaggccagagtgcagtggcactatctcggctcactgcaagctccgcctcccgggttcacaccattcttctgcctcagcctcccaaagtagctgggactacaggcacccgccaccgcatctggctaattttttgtatttttagtagagacggggtttcaccgtgttagccaggatggtctcgatctcctgacctcgtgatccgccagcctcagcctcccaaagtgctgggattacaggcgtgagccaccgcacccagccgccagtcactactcttagcatgtagcttgaaccggcctttgagcagtcatttaagccattgtccagattcaacaggccacaaaagtttgctgtctcttttgcccactttacgcatctcttctccctcttctcattcttgccaaaatccacacctcttcacatcctgagctatcttgaaaatgcagctgttagagtatctcatacctcttactatatctcatccttattctctcctgctgtactttatggtcttgatgaaagggtgttgtataggtgtttcactgtaaaccatatgtgaggccagaggctgaggggtgtagcgaaccaagactcaatccagaagatggcagtggggcgtcaaagggttaaatgagagctctgtggagaaaagatgaacacaaatagtcatttgtccaggagaagaaaaaagttgagaatggagttacttgtcttcaagttttagtcattcaacaaatactggtctaacaccagtatgtaccatcagtgggatacatcagtgaataagacaaataataacaacataagtctttgctctcatggcaagtttaaattctagtgggagaaatcagacaataaacaaaataaattatgtattatgttggaaacaagaaaaagaaaaaaaaatagagcagtgtaagggagatccagagaataaatgaggccatgctgcaattttaaatggccctggcatttgcacaaagaccgggggaggtaaattagccatggagaaaaagtgttctcaagagagagaacagccagtgcaatgaatctaagagattttctgtggaagaccagccattccctatccctgtgaaaggaggttagaagtggttctaaccagtagctgaaataattttagttggaccaaagaataacatttgtttgtaaataacttctactaataagaacttatcatgaaaaacatgccttgttgtcagttcatttggcaattaattgtgcactgccttgcaatgcctgcaatttaaatccttgatgtcacttttcagaatgtcttttaatacgtcatggtctccttcattaacccttcaagggaagagatgacaggtccactagcagcacctaatacagttcccttctctaaaggctgagaagccaaagatagccctcatctgtcagcaaatagcttaggataaaaatatcgcctggagacagagagctggacttcatctccagagggccctcccagccccatattcccactctaactttcctgtgggttttcttttgccactttctaccaggcggtaacttgggccatggtaaagatatatttaaatgctttcatttggccttgccagttccttcctgtggcctaaaacacatgattgtctgtgctggagagggagctgttggaagtgctgggtgcactgataaagaagcatgtgttcctctgcttcctccccattgcccagaggccccaggctccaggaatgtggtggcttctggggctatacggagcaagagtttcagatgaattgcttcctgggttaaaaatggttaccacccttgtgctggggtcccactttgacatctcagaactttatcatttctgctacttgtgcccaaaatgcaattgtgtggtcccaggcaaaactcattccaatcagattggaagagtttgactccagtaggttgcacagcaccaccctgcccctgtgcacaactttagcattttatgtaaagctctttagtgtctggacaaaagacagaaagagtgtttgggtttgaggcttcaaggactcccaagagccagtcagagtagtttaccaagcagtgggctgctgggaaagagcatggtctttggactcttgcacaactgggttcaaatcctggctctgctactcactttgcaatcatggtcaggttacctaatctttctgtctctgcattttcatttatataaaataggttttacaatacctaccttattataagcatgggaaaacccagatgaagggagtggcacatagtaaatggtagaaagaattaacaagaaagaaaccaagagagcaaatgtccttgtaattgttaaatcctgcatcctggagaaggtagtgctgcattaaatgtgtgattttggaatgtctgcagtccatctttctggccttgactgggggttttccaggccagttaccatgatacctatctgaataattgcagcttccatatcttaaaaacttcacttgatatctatccttgtcttggaggacttacaggttggtaatcaaataaatgtctttctcttcttgttaagtgaagaatggagctgaaatgaaggaagaaaagtctcatcttaacccctgcccagcctcaaagctttcagaacgcagttttgccaaaatggttgtcaatctttctgccctctgtctatacaatcgttcagttgtaggtgagggagaaacacatgaagaatagaaagaagaatgctaggtactgagcgtcatttttcgtgtgactattgtatgtcacctggggaagtcctttctggccttggtgtcctcagcccttcagtagggcctcctctagggaaagcatccgtaagcatctttcccaggagataagtgtgggtgttttaaggggtcttgttataaaggtgccaaagtaacttttctgtgaacttaagtgaagatttttggcttaacaatgaagaggaacactcactgttcttaatctcctgctcaggtttgtcctgaatgagctggtacagacagagaaagactatgtcaaggatctgggcattgtggtggaggtaagtagagggttccaggtgggtctgtggtcacccaaccaggagcacgttggaccctacctaggccaaggtgttttaatctgatggttacatgtactttactgtctgagcacttgcagaaatgaaaataaaaatggtaataagtagaatatgtaggcaatatttttcttttccccttgaaataagatatttagagggaagtagtggcctgaatgttatagcatttgggggagcctcttggttagagtggaactcattccactttgttttaggtgaccaagctattgtcttaagagcttttctttgatgtttaactatgtggacatatattcttcagagctatgagccacataggcataaaacagttcattcttagtgggatcttagggcttatacatttccatagatttcaagggtaagtgttacagctagcaaaaagacagataaaagaaaaacccaccaatgagcaaggttgacaggtccacagttaagagtcgacttggtagtaaattaaacaaatctagctctgtagggattcacttaagagggacttagacacttggatgaaaaaaaaaaagcctgagaaagtaaatgggtaacttgaatggcttagagccctattgttaatcatcttgaaagaacatgaagtctaaaagttctcggccgggtgcggtggctcatgcctgtaatcccagcactttgggaggctgagacgggtggatcacgaggtcaggagatcgagaccgtcctggctaacacggtgaaaccccgtatctactaaaaatacaaaaaaattagccgggcgtggtggtgggcgcctgtagtcccagctactcaggaggccgaggcaggagaatggcgtgaacctgggaggcggagcttgcagtgagctgagatcgcgccaccgcactccagcctgggcgacagagcaagactccatctcaaaaaataaaaataaaagtaaaaataaaacaaaaaaataaaaattctatgcctaaagcctacattgcctgctggttccttacatttggcctgagttcccatcctgtgaaatctgctgacttagggttttgtatttgcttattctgaatcttggataaacagattaaccagccatatagaaaacctgaattttaacttacggaaagttattcttgtctttttgtggggctggggggtggaagaggtacaatagcttccatatgcagtccagcccaggagtagaggacgagggaatctgaagactgggaggctgaaatgcagggaactcagacatcagtggtgcgattatggacaagtcatcatccaacacccaggtgcctgggttttcttgtccgtcagatggggataatgctacctgtccaacctcaaaacctgattttaaaacagaaatgaaattctctatgatcacattttatagactataaagtattaacatattaagacttatttctaggccagatgtatctagttctgagcctttatagacctgattaatttggattgggagaaggaagagggacagcttattgttttcttctgtgctctgctttcttaaggggactggagacaaagaaggggatcctgaaactcataaaagttttctctattgctctgcaccaggggttaaagacctggttgaatagtgagaaaccacagaagcatttgtccgcaaactcacgcagagagtgtgggcttgcaggggtgctgtggtgtgtggcatggcccagaaagctttcctgtgaaaatatgctactaaccattgcctttgctgctgcagggcttcatgaagagaatagaagaaaagggtgtccctgaggatatgcgaggaaaggacaaaatcgtgtttggaaatattcatcagatttatgactggcataaggagtaagtgttaatgctgccccgaggatccagtgtcctgggaatccaggacttgagtcctcttcctgcatctgactcaaggagtagggcttaggggagagtcttctgtaattcatcttattattgagaaataatacagttctgaataatgtggcttccttctcttatcccctttctccttttagttttttcctggcggaactggaaaagtgtatccaggagcaagacagattggcacagctctttattaagcacgtgagtgtctcccatcacctcctccccaactccttcactaggctcatttatattcattttaaaatcctggccaggcacagtggctcacacctgtaattccaacactttaggaggccaaggtgggagggtggcttgaccccaggaattgagaccagcctgggcaacatagtgaggcccccatctctacgaagaatttaaaaattaaccaaggctggtggcacatgcctatagtcctagccacttgggggggcggaggcaggaggatcgcttgagcctgggaggtcaagactgcagtgagccatgatggccccaccctgcactccagcctgggtgacagagcaagaccctgtctcagaaaaaaaagtaaataaaatttcttctcttctgctcttccttgagtgaccttctttctcagccctctctaagtttttttgtttttttgaccaccttggcgatttggaaagtggctcttgcccaccacatttatatccttgatattcagctgccttggtgcgtccccaagtgcgcctttgtcctttgtccacgtggaggccagcacggcactctgagattgaacaaaagacacaagatgcctgactgtccacatgtctctctctgctctttcaggagcggaagctgcacatctacgtgtggtattgtcagaataagccgcgctcagagtacatcgttgctgagtatgacgcctactttgaggtaagctgtgcaggctttgctgaactggggtgggaggaaaactcaggccaaaacagccactttcagaaataccagacgtcatccatccatatgtgacccccacacagcaccgttgacccattcatggcaggaatagctgcctcaacagagaaagcagcttcttagctaaattctcatgagcaccttcacttgagaggagctgaggtggcccagtctgggttctgatttgagaatcccccatttgcagaataagcctgaacacagagatggtttgagaagctccagttcttcttaagtgaccctggagcagactgtacccaccagtcccccagggaccacttactaaggagtcttctgttggttgaagggtttgcagccacttcctagtctgcttggtctagcccagaaggatttattttgctgggagaaaggcagcatcatcacttagaaaaagcactcagctgagtgtttggagatctaagtttagggcctggctccataggcttgtgtgtcctagaagaagccccttttccctgcctttgccctgaagtggtggagagaataaggcccctccagcttttctcccaggactgggatgaagaccaaggtgtggaagtactcactgtaaaagcatgggaggaaggcaggaagccagtggtgatgtgtgttatgtgttgttcataacaagtgaacagtcctctaggcaattttacctctcacattacttaaagattcttcaacttcattggaaaacatgcagacctgtcttccatgcctttgaacccttattcaaagcaccccagttcttcagttcctttttcttctaatattgctgcctgtgtttcaggaggtaaaacaggagataaatcagaggctgacactgagtgacttcctcatcaagcccattcagagaataacaaaataccagttgctcctcaaggtaagaagctgggagcctgggtgagggctggagaaggatccatcaggctcagagcaggttctgagctaggggtagagctagcggttctgtctccaccacactgtcccaaaggactgtgaactgtgggaggggtggtagggacgtgggaacttttatctgactgctggttactctgtcagctttgctcccaaataaactgcatggctgttcttcctacccttaaggtgggttgttacttgattttattttttcaattcacattcttactttgtctcaatcattgacttgatacctttaaaaaataagaagaatatgatatcagagtgaactacaagggagaaagaaagggaaaggcaaggctttagaaatattagattagtaatacctaaaatttgattttatatatatataaaatcaatatattatataaaatcaatatattttatatataatcaatatatattataaagtataatatgtatgtatatatttgaggcagggtctcactctgtcacccaggctgcagtgcagtgacacagtcatagctcactgcagcctcaaatgcctgagctcaagcgattctcccttctcagcctcccaagtagctaggacaacagatgcatgtcatcatgcctggctaattttttattttttttgtagagacacggtctcactatgttgctcaggctggtctcaaactcctggcctcaagcagccctcccaccttggcctcccaaagtgttgagattacagacatgagccactgtgcccggcctaattatattttaaacaatggcttaacttgattcatcttatggaactaggaggctaaatagaaaagagagacttaactttcctttctctcctttcttgtcataatccccctttcctttgtcttccctccctctcactcttccttctcccatagctttgaaattttgaggctgggtgcagtcactcacgcctgtaatcccagaactttgggagactgaggcaggtggatcacctgaggtcaggagtttgagaccaacctggccaacatggtgaaacacatctctaccgaaaatacaaaaattagctgagtgtggtggcacttgcctgtaatcccaactactcaggaggctgaggcaggagaatcgcttgaacctaggaggcacaggttacggtgagccaaaattgcaccactgcactccagcctgggcaacagagtgagactatgtctcaaaaaaaaaaaaaaaaaggaaagaaagaaagaaaagaaatttgaatattctgggagttctctctatgttattacatcttacatgactcataatttcatttctcagctactctacaccattgccacttctgctgggaaggaaagtctccagggtgttattgtatttttatgataagttttttcccagctattttactaattttaccccttcccacactcttgcctgcttcccctacttgttaggacttcctgagatacagtgagaaggctggtttggagtgttcagatattgaggtgagttttctgcttgtaatgcttgctgttcttagggaccatattggatatctttctctagaggggaaaagattgtctcaggaggaccgtggatccaggtggacccctctcagacagtaagaggctcttgtaaacagctttgtacctgcttgaggaatggcaagtgttaacacagtgtttcctagaactaaagaaatctgtcctggggtgcactagagcttagccccactggtgttcttttggctcctggtgacacatagtgggaaagggtaaccccttaatatccttcagagattagatgtaagttgcacaaaagcctcagtatgcaattttattcgtgaaggcaagtattatttgagtcaaacatataaagtattccattttcacctccctgtccaaaccctgcagactacttccaagtgaagtcctttgagacaatgtcactatgggattattttaagccagggaggttacagaccattctgacagattattttagttgaaaacctctagtgtttcacaagccaggctaagctgttgcctgggcagccaggaagcaacagagagaagaaagaaaatctgagaaggcaagggaattgatgaacaaaaacaggaaggtagggaaaggaggggctgagtaatattcccccaacatatgctcagtgactgacatggagcccctgtgctgaggaccaacaccctccctctagaacagaaagccccacactctctgagagtggacagccagaaccagcatcccttcctagaataaaggagccaccagagatgaagtccctgttttccagcactgaattaccaagagcttcctgcctgagtgctgttccccctcctgagtaacagttgttctttcccacagaaagcagtggagttaatgtgccttgttcccaaacgctgcaatgacatgatgaatctaggacgtctgcagggctttgaggtgagtctttaagaatgcgtctaagcccactctctccaggacaataggagtccagactgttgcggcttcctccccctgaagccttgtgtcctgcctgtgcctccttcactcaccactatgccttcctacccgggcccctctggttcacagtcctggaagatgcatctctttaggaagtccagcagtagggaggtcataagaagttacagagcatttagccaaaccaaagtcagaattccaaggagattggaaagacccagaattcttttttttttttttttttttttttttgagacaggttcttgccctgtcacccaggctggagtgcagagtggtgcaatcctggcttactgcagcctcagcctcctgggctcaagcagccctcccacctcagcctcctgagaagctggactccagtcacacaccaccatacctggcttatttttaaatattttttatattataaagatggggttttgccatgttgccaggctaggaaagacccagagttctttatgagtgtttagacctgatagtgacctcttcctttcccttcttgattgataaagcagggactgtgagtgacagcagggctatgtgatagaagtggaattaggcaggagaatggaacacctgttttttgagaaggtggttctggcttttcagttaaatgaatagttaaaactctaaaacattacagtacaaagttctgttatttgaagaggggaatcaagtctgcagggaaatggctgtgtcccaaagattttggtttaagtgaacatacaagtttactagggctgccaaaacaaagtaccataaattgggcagcttaaacaacagagatttattgtctcacatttctagaggctagaggtctgaaatcaaggtactgtcaggtacctcctgagagctgtgagggaggggtctgccccaggcctttctctttggcttgtagatggctgtctttatgttcacatggcattctccctgtatcttcacattcccttccctctgtgttatctctgtggccaagtttccttttttttttaaacagagttttgctcttgttgcccaggctggagtgcagtggcaacaaaacctcctcctcctgggttcaagcgattctcctgcctcagtctcctgagtagctgggattacaggcatgtgccaccacacctggctaattttttgtatttttagtagagacggggtttctccatgttggtcaggctagtctcgaactcccgacctcaggtgatccgcccgcctcggcctcccaaagtgctgggattataggcgtgagccaccacactgggccgtttcctttttttaaataaggacatcagtcatattctattagggcttactggcatgaccacttgactttaacttgattgcctctgtaaagaccccatttcccaataaggtcacatgctgacattctgggattttaggggctaggacttcaacataggaattgatgggggcatggaaggagagaaaacacaattcagcccataacagtgaacctttgaagaggaaattgactttctaatttaaacttaataactgactgttattaacgtatatccaaacctaataaattaaccacacacaatatgtttttaagattaatatgataaaattggaactgacacaattattgattggtacctagtagttgttgatccccttagagaaagatgtggatcttttatttcccagcagtctgaaacctaagctttcattattcctttttggggcaaagggattcctagaatttgggataattcagaaataaatggcttgttttttgttttttgttttttttctggctaaactagaatgaaatagatacaagacagagatatagttgactcatactcataccactgtatgaataatttacgggatagtatatttaagttagctttcatgcattggattcatgacattcttgagccaaattctcttctcctccttgccctttcagcccatcccatgtgtccctgtctggttttcatgctttgctgtgacaggaactatgtggatggttttctttgctgtgcatttttcataggctcttggtcttccaaagcaggctggagacattagtgtaagcagggttactcggcagacacacactgagttcttaaccatttttcttccgtcatactgggtggagttttatacattttcccttggcgttacatcaggtctgaggctatactggacaaaccaagagatcccttttgctcttcaaccttgaagaccccatgttttctgaacaggagtctaactgtgcttctctgggtctctggaggaagtgaccactcaggaggagtggtgtctgattgtgctgtctatcccaagttaaacttcacaggagctgtgttgtacatgtgagtgtgtgtgtgtgtgtgtgtgtgtgtgtgtgtgtgtgcgcgcgcgcgcatataagggcacccacaagcacagaatcaagcttttttttttttttgagatggagtcttgctctgtcgcccaggctggagtacagtggcatgatctcagctcactgcaacctccgcctcctgggttcaggcgattctcctgcctcagcctcccaagtagctgggattacaggcaggcgccaccacgcctggctaatttttgtatttttaatatagatggggttttaccatgctggccaggctggtctcgatctcctgacctggtgatccgccggccttggcctcccaaagtgctaggattacaggcgtgagccactgcacccagcccagaatcaagcttttaagttaagcactgctgtctcttgtttttgtcaagccaccagaacctgctttttgcattccttcagctaactgggaagaacagtgagcatgtgtctattccctcagcccatggctttgggcttgagagaagttagagcctcctcttttaaattcctccccactttcagatcctctggctttccctttggtgctggccgagctataacccatgataggttcttgtgtaatattaatagagctttcctggctagctggtcactggcttaatattaactttagaccacagtagagataagcctgtttggctgctgacattggcagtaaggagccatgatccaggcagagggcaggcacttctcaggaacacaaaagaaaaatgacccctctgctgggtagtgtttggaataaggcatcacatgaagggaatggccacatttgtgccaaagggtagagttgccgcctgagaaagagcacctgcatttcagaggaggccctctgattgctctctctgatgtcagggtcttcttgttgcaaagcaatagaagtgcaaggtgctctgacagagtctgggaagactttctgggttgggccatattccctttgaagctgtgaagatgtctctgaaaatctcattagaaactggcaaaccaaataggttctacctcctcagctaggtgtcaggtggcctagtagctggaatcatttttatttttttattttattagttttttaaaatttattcatgtatttatttatttagatacagaatctcactctgttgcccaggttggagtgcagtggtgcagttttggctcaccacaacctctgcctcccaggttcaagtgatcctcgtgcctcagcctcctaagtagctgggactacaggcacacgccaccacccctggctaatttttatatttttagtagagatgaggtttcgccatgttgggcaggctggtcttgaactcctgacctcaggtaatccgcctggcttggcctcccaaagttctgggattacaggcatgagcaccacacccaccctggagtcatttttagaagaatcacagaacccagaaaagtatctaccagcttataaaatatggagacctatctatagtacccccaactttacctgttggcctataactagaaactaagatttcagaatttctccatcctaaaataattgaagaagagaggggagtgacttatcagagtatctgtggtcctgccttcatcacttcccttgtctacaggtgagttcaaggttggtggccatgagaatgcccttggtccttggcccatactgcaaaggaaccaggcaggcaccgttctcagagctctgaggatggaaaggccacttgcagctccaagtgtcacctactttctattgtcctttcaataaaaaacaagaagggccaggattatggcttttctgctaatgatattaccttcctgccttctggcatttgcctggagctgtttctcagtggttccgcagcttgctttccctttccctccagggcccttgtgtgaacaggaaagtggccaaggtcggcccctggatgagtgggtgggtcctaattcagtctcttcctagagccctgaggcttttgttgtcaaatctgttgcccgtatccccagatggggaggttctgtggacccagagggcagtggctcgctccccatttttcattcacttcaccccagcccgtctttccttcagggcactctgactgctcaggggaagctgctgcagcaggacacattctatgtgatcgagctggatgcaggcatgcagtcccggaccaaagagaggcgcgtgttcctcttcgagcagattgtcatcttcagtgaactgctcaggaagggatccctcacccctggctacatgttcaaaaggagcatcaaggtgaggatcccaatggtgatgagaagaggcaaggaagagcccagttcttgggagctgcttccctaagacgaggccctggagttgtgacatccagaaccgtgaagatctttcagccgaataacattcggtcatggaggctgcacgacagtgattatctgtgagctgaagtgacaggctgagccagtctctggcatgatcctgcaggttccctgggatcgtgtcactcacccagagacaaaaacctaagtactgtcctgctagatccagggcaaaatttggaagcttgtcctgaaatagaaactttgaggaagagtaatatgttgctgatttttaaaaaatcttttaaatgtaaaaaggatcaactcgttttcttccagatgaattacttggtcctggaggagaatgtggacaatgatccctgcaagtttgcactcatgaacagagagacttctgagagggttgttctgcaagccgccaacgctgacatccagcaggcctgggtgcaggacatcaatcaagtcttagaaacacagcgagactttttgaatggtgggtgctgggcttggttccttgcagggctgtgtcaggggactccacgacctctgagcttccttgggtctaggttcatgttgagttatgaacccagatcacattttataggtactccaactttgtagttttcagaaacactttagaatttttctgaagctgaatacacaagcacaacagatagggtatgaaaaagaagctccatctttctgatagaagagatttcacttataggacacaggatatatgtcttgtggccatcactaccacctggtactaatttgggcaaaagtctgagataggcacatcctctgtgtctaaggaaccaggaccggctagaaatgatatgtgtttttccacttttcacagcttctgtagtgttaactagagataaatgagagtttgaccaatcagttcaaatccctcctctgctcccaacagtgtgagagcctacataagccacattactagccaaccttaccccttttaaatgagagatgattgctaactttaaatttctgtaataccctgaaacttcctagaagaaaatttgtggttacacagagggtgtagctctttgtggcccttgcaggagctccctcatgggtggtgtgaactggagtgaagtagagttgccactttgtatatatttctttattttttcccctgctggggttttcttcacactgagcttggcatgggaaaggggtatgcgattttaagctagtggctgatctctgctgacttggttagctcagaagtctaaccaagcagaaatagagcttgaagttgaatgcaaaatgtaactagtaatgaagtaaacctgaagactcagaaaacacatatgcctgtatatcgagacacacacacacacacacacacacacacacacacacacacacacacacacaaccacctttgggtataccacctcttcctgcctgtcctgagatccgtcctacatggccatacgtgctcacaggagcgcacacacaggtacatgcatgtacacacgtacaggcccaccctcgggtgtgtcaccttttcatgccagtactaggatctggactctttcaaatgatccaaatacagcattttctggatgtctagaatggaactgaatgctgaagggaaagataaaaggtgccatacgagttgaggaccttgaggagtcatgacatttctctgggccttgtggctggttttgtgaaaaagggagttcaggtagatctactttgcccatgctggcatgctctgtgatgggccagtcttcctggaagcaggacacctggcatcctccctacaatatcagtttccctgtattataagggatttagcacagtgttttaaagacaaatagaaggagatcatgtaacaggatgccacgactttttaagatagaacatgagacttcaaagcaattttgcacttacagaaagtatttttgggccaggctcctggccctcaactgtaaaaaaaatttggtgaaaaacaactagactaagtgatctctaggattcttttcactctaaaatgtctaaaattaaacaccagcccagccctgagggatggtaatgaaagttttatatggcttatgatttctgaatataatatacaacttcaaatgaacacttttgttgataaaataattttatgcaaaaatgtgttcatatataaaaatatctgtttaaattgcattctattaggagtttctgatagattctaagctgaaattaggaattttaaaattcatcaatttgggacaaaagaaaaataaggtgcaacagtaagttgaaacaagaagttattgacataacaataatggctcctgtgtattgaatccttgctctgtgccaggcactatgctaagcattttacatggtttttcacatttaatcctcacgccaacatggagaggtaagtactattgtcctacttttttcaagtgaggaaaaggagactcagaacttgtccaaggtcacagaagcagtaagtgatagaaacaggacttgaatccacagctataggacttcaaattaaggttgtgaaccacaaaactgcagtataggtgctagtgttagggcactcatttatttaattatgatctccctagcaaccaaagtgaagaaagaaacaggatcagacataagacactgtatcgatcagtcaaaaacaaaccctgtagggacgcacagttttcttgattctgagaattaagttatgcaaatggaggctggtgaaagaatacaggctgtccatttagcttatttaagaaggcattctattttcaaatgttttagcacaattattgtaaataaccaggtaatatcacaattccatgtgatgggaattgattcataaaatcagtttgataaggcctactttataactctgctatgtacttagaacttggaactgtatttatttaggcatagtcaatgattcagacctttacttcgttccaagagacctttctcctaatgaatcatggagatacagtcagcccttggtatccacagggaattggttccaagacctcccgaggataccagagtctgtggatgctcaagtcccttacataaaatggcatagtgtttgcatatgacctgtgtacatcatcctgtactttaaatcatctctagattgtttataatacccgatataatgtacatgctatgtaaatgattgttatactatattgtttatggaatgacaagaaaaaaaactctgtacatgttcagtacagaccacaaccatccttttttcccccatatattttcttttttttttttttttctttttttgagacagagtctcgctctgtcgcccaggctggagtgcagtggcgcaatctcagttcactgcaaatctccacctcctgagttcaagcgattctcatgcttcagcctcctgagaagctgggattacaggtgtatgccaccaatacaaaaatacagaaatgctaatttttgtatttttagtagagacaaggttttgccatgttggccatggctggtcctgaactcctggcctcaagtgatccacccgccttggcctcccaaagtgctgggattacaggcatgcaccactgcacctggcccttcccatatattttcaatccacagttggttgaatccatggttgtggagctcacagatacagtgggctgactgtattactgaactaggttatcatctcctaaatacttaatgccacaaaacactcctcagtgagagaggcagtgctctggtgggcctgttattactttgacacatacaagagacaaggatgtgatgacggaccagggccaggcttctacttacagagatgtgtgcaggcatctcagagccaatctttccttctgagacctcaagtagaaaggaagtgtgaccctatgttgagtcctgttgaggtatgtacctatcacagtagaaatatccttgtaattgagaagttctctgggccccagctgttaacccacttaaatagctgttacagtgcaaactgataaaaatgacataatcggccaacctttgaagtcattcttaaagaattggacctgtatgacatttgcctggctctccctctttagttctcagaccttgcaaccttgttaccttaaactcaataaaacaaagctccagtcttctccttcacatcagcttattctcctgtcttctgagttccactgactgccatcctccgagtctccaaacctgagccatcctcgattcttgcattgcttttcccacctaggctgtcacagtctcatctctcccgacctcaccacgcccacatccattccacatcccactggtcccgctctcctagaccttctacctctcgcttttaccattctgtggcttctgaattagacaagaagccttctgtctcatcctctccagtccctcctcctaaccactacaaggtcagtgttcctcaaatgtcgctctctgatgatagaatctcaatttaaagctttaaagttcattccatccaattacttttcatgaccttcagaattcagtccagactcattggactcactttctagacttttcataccatggcacttcccacctcacagacccttctggtttcctcttcctcctagacacccttgactacttcctgttcccctcgccaacacgtcacacttgcttccttcctgcagcctaagtgccagagtctggccacagctctcttccgaagctctttgttattaccaccacacacatattacagagccttctctctctttgcacaacccttggcacctcacatatggcaccgttttgttttttgtattttcattatttaggtagatgtcttagttctcccattgccttaaaaacaagggtagtgtttttctcacttatccacacgatgcctaacacaaagccttggacctaagaggcctccaaatccttgtgggattcccaaagcttagagtaaccacctgctcttatcccacagcactgcaatcgcccattgagtatcaacggaaagaaaggagcacagctgtgatgaggtctcaacctgccaggcttccccaagccagccccaggccctactcctctgttcctgcgggctcagagaagcccccaaagggctccagctataacccacctctgcctcccctgaagatatctacctccaatggcagtccagggtttgaataccaccagcctggggacaagttcgaagccagcaaggtaagtgacaactcattactcccacccttgtcactacgatggcatagcctcaggggttactttaggaagagaaggagtctcggtctgtcatccaggctggagtgcaatggcaccatctcagctcactgcaacctccgcctcccaggttcaagcgaattctcctgtctcagcctcccgagtagctgggactacaggcgccctaccatacccagctaatttttgtatttttagtacagatggggtttcaccatgttggccaggctggtctcaaattcctggcctcaggcgatatggccacttcagcctcccacagtgctgggattacaggtgtgagccactgcacccggccaggaagtagcatcttttaatgcttgctgattattttagcaggaacagcacactaagtacagtctagtctcaattatgttttcctttccctataaactgagtgagttataccagttccctgtggcataaatcatcataaaaatggatgatttttgctaaatagagtagtttcagtgtggatcatcgtcatctaaaagtcacagctgtagtgtttgacaccttaaaaagagttcaccctttctaatgatgatctgcctcgagcacctactgaaagaagttcccagttcttcaccatctattggctgatgtggaagggaagtcgatcatcagtgtgtgaatgggagaagtctgacttggattgaatgtttgtcgtcgataatccacaattcaaacatcaccataaggagagtcaaagactcaaccatagacttagtctacacagctattttgcccctacaaggtaggtagaacaggagagaaatgggaaaagtgctagattaggaatcaggcaaacctggtttctattcccagttctgcaactcacttgctttagaaccttagccgagttagttaacctcattaggcctcagttttctctagaactcagtggctctatgaataggaacacttacattttttatctacatgttccagttttatagttttatttctcctcaaaattattagtttatattggttatattaaaaaattattagtgtccaagttcaatcctgtattagagtaaccacactgatttgttccgtcacatcacctggaaatgattttccaccttaaaaaacaatcctgcctttgtgaataaactgaagtcactttggcattttgtcaaacatatcgggccagatgcgctggctcacgcctgtaatcccagcactttgggaggccaaggcagggtgatggcttgggcttaagagctcaagaccagcctgggcaacatagcaagaactcatctctaataaaactttaaaaaaaaaaaaaaattagccaggcacggtagcatgcacctgttgtcccagatactgaggcaggagaatcacttgagcctgggaagtcgaggctacagtgagctatgactctgccactgcactctagcctaggtgacatagcaagaccgtgtctcaaaaacaaacaaaaagtatatactgaagaatttgtatgtatatcctgtatgtatatacatatagaatatatatgtatatcctgtatgtatatacatatagaatatatatgtatatcctgtatgtatatacatatagaatatatatgtatatcctgtatgtatatgcatatagaatatatatgtatatcctgtatgtatatgcatatagaatatatatgtatatcctgtatgtatatgcatatagaatatatatgtatatactgaagaatttctggctcttaccatgctctatgaggcagccagtcctcctaggaaagttacaagtctgtctagaggcagctgccctgaaatagactcacatgaaaaggtcatgggcagcatctcttatattaatgagtaggggagggtacctggtgcctgcaggaagttgggtaagggtaggtcatggtcttgcctttgaattgggcagagatatcattcttagtcctgtctcaaagagggtcagaatataaagtaaagccagcgcactttcaaaaagagaaaaatttaatatcaaacaatccgtgttctttccattgaaggattgtgacccctgacatgacacttgccctgacctcattctgcccaggtgcttacatacccctatgccagtgccaggttcttcctttcacttgtaagagaacgctggcaggaaggttgtatgctgggaaggggcttccaggtcaaaggcgtgtttatacctttatgtggggtggagccattcaccctggatgataatattgttgaaacattgctattaaaaaatatactttcagagcatgtttattaatatcatgtcattactcaagagagaatgctgcctgctgcctaccctgctagtgggagatttggccttgaaccactgggtagggtgcagagcaagcccatgtgaactagcgtccttgtgtttgtgcccctctcacccttatctcccagcagaacgacctgggaggctgcaatgggacctcgtccatggccgtgatcaaagattactatgcactgaaggagaatgaaatctgtgtgagccaaggtgaggtggtccaggtcctcgccgtcaaccagcagaacatgtgtctggtgtaccagcctgccagcgaccattcccccgccgccgagggctgggtcccaggcagcatcctggcgcccctcaccaaagccacagcagcagaaagtagtgacgggagcatcaagtaagtgcctcgttggcttccccgggagaggagtatgaggattaaaaatattcagaaacaaacaaaagaacacaaaaatgcaaacacatggtagggaattactactgcttattctcaacagtaccacagaaccagtgtttgagtgctgacaccatatgcaacatggggcatccgggctggagtgatccagttttttagttggtggtggcgatgatttttctttccttttggtttataattttctgttcatttttccccctttctcccccacattcattaagaaccctactgaaaccctaggtgacaaaaggtgtgccttctgttgccacatttgacccaccacaggactcactggactggacttctatttatattgtattaagtaactgatatatatatatatatatatttttgattgacaccaaaaaattaccttggcacaaatgccagacctgtgaaggtcagaggcccgctgcttttcccaggagggagggaactttttggttgtctgtggcaattcctctgtacagattgtaactttttaaaaatttcccttcaccccgtcacttgaatatatgttcatagtaatttgtaagatacttcttttccttattttggttgcaagacccttccgaacacattcctgtataaagtattttgcactatttaaagaaacccatatggatgaagtcaggatgtgcaatatgatggcgtcacagtgctcatcgttgtacctgtaatgtaactaatcagtttaaatgtactattttaaatatgtaaaataaattttcaccatgagcatgttttaatgaagttaaagactagttgaccctttttcccctgtttcactattcttggactttcaaatgtgcaaacaattcttcttcttttcctcctcttcttctttttttttttttttttttcccttttctgtattttaggatttgggtgaatgcattggcatttttttttcctacataaaaagtatttttgttgctgaagttctgacccgggccttccctcctaaatagcccctgttgattttctctaacctctgagatgagggaaggtacagatttgatgctgtccaactggttccctgcaactgggcagccctgaggtgctgatgtcaattaatgaccagagtagaaggcagtgtttgactggcattctccgctgctttcccctgctgcatagtaatccatggaagacgtggtgcagggggcttccatgagctatctgagcagtggcaccagcataactgcactgctttggccctctaggtcaggggatagcagctactgacatcaccctggcctcactaggtaaccacaggcccagccaaaaatccacagtggcccctaaggcacaatagcccccatgcattttatcctaagtatacttgttttgggtgccttttaggtaagccttgggataaaggccctcaaagcattgaagtttttactaatcaggggacttgcagagctaactcttaatgatttatcctctaaatatccaggcactaaacacttcttcctccctacctttggttctgttggccacttatccataccttccatgggagggaaggtaaaaggatgtcagaccgagcaaaagagagcagattgaaatacaaatgggtcattttgatttcttgtcagccgctcttgcaaaagggttgggggtgtgtgtggaggggagcagtggactgaaaaaggttgtcagcatttaccagtggaggacactcagcacaccctccccaaggcctgccataaccacaggggtcagagttggttgtgatgcctacaggataaacgtcactgaaaccctgtgtccacatcagtccctgggcttgcaaccaagagatggaagctccccaaaccatgatgacgagttcttctgggaagaatatgaaaccaagcctgccctgccatttatactactctcagtcttccttctgaacatgaaatgttattgctcatatttctagtttttcaccaagcatattaaataacccagagaatttaataaatgtagaaacacacccccacaaggacacacacatacacaacgtgctgcctgccctgggagtcctttcagcagggatctccctgactcaagttgttctcagaaggagccagggacatgggtttgggagtaaagttatcaaagtctgaagttaacaggctgatgccatctaagattagcttctatggctggttctcacttatacaacggttggagcaaggtgctggtatgcaggggacagtagagagcctgactagttaggagatacaagagtttttgaaggagcccactttcccacaagattcaagaatattactgtgattgctctttcctgctcagaaggttgaacctgtgtgttagcggataaatatttttggaacaccttcctcaaagtacccttaaaatcctgatgtatgtggagtgttctggagggatgctctgtattttgcagcagcttccttttcctaaatctcctctgcctctctcccataatggacgctcatctcatggagccctgtctgcataggcccacctttgacaaggagatactgaggggaagccacgtcttacttattccagacaacaattagaacttcattcaagctctgtgacctcacctgaaactgatgatgcctgctcagggtcactgatgctgtttgtgacttggcttttggtatctctgtctttgagatctgatatttatggaatgtaagggctctgctctgagcttgtcttcataggtctgtgaagaagttgctcccaagaccctttgtgggaagaaagaagttaggatgaaaggcctattgaaaagccattgctgctctcacctccctgggagcacacattagttcttgtcccaatagggaagctctaggacctctacaggctgacaaagccatatattcacaaacactgagtgatatggagaatatagaccgagaaactctttgccctaaaatatccaggtaaatgagtggtgctcaactgtttattaagcaaatgtctgccacagaaaatcctgtctgatcaacattgtttgggagtggccctgcccaaatacaaatcatgaggtagaactctcaatgtcatccttttaggtctttctgtctggtcctgggaaagtgtcagtagcatatgcattctagaatatacttcccttgactttcctattctactcttcgccccctttcctcacccatccaccgtgcccttctcaagaggaattcctcagtcctgtgaggcatcatgggtatggtatacaaactcccttattagagtttagtaacctagcattcatattttctttaaatgccgtagtcaaccttgcacatctaccaggggaggtcagagttcatccttgctcacttccagttggaggcgaggtcagccgccagccacccttggagctggtgtgcaggtttggggcctctgaagcccgggcttgatggagcacctcacctgctgactcacccaagggtggtgagcccgccctccacatcgctgtccctgacctgccattttgattggtgcattttttggtacaacaggaagtcatgttcatggcatactctacgcatgagaaagcgggcggaagtggagaacacgggtaaaaatgaagccacagggcctcgtaaacccaaggatattctgggcaacaaagtctctgttaaagtgagtaaggtattccggagctgcgtccccacctgtcatccactcccaccctgcagcattctcacaagccaatttgggtggatgggttattttttttttttcccagtatgggtaccagaggggaagtagtttagcaggattttgcatgcaagatcaatttattttttatcttttatttctcctggcaacttcaattcaagtaagtaccttttttttcttttatacctttctctttatactgtgcagatgttttacagcaaaattatctgcagcattctcttaaaaatgtgagatgcttgattcatattaaatttatcaaagctgccatttggtaccctaggtttgagaatacacacagggtaaagcaattagggatgccttccaaacccccaaccctgtgaaggctgaggtttggaatttaagggccactgtgtccttagtaaagtttcatttcttttccccagagttcagacaacatcaacttcaggccattttacttgcatggacacagtaggggggcacattggtgaagcccaaattatttctttaaataatccatctactactttgaactcatgaattctaagcttggcagactcttatttacccccatcttgaaacaatgtcatctgctttctttaaattggaacctctggaaagatctgccaatggaccaatggacaatggaaactagacactgattattatagcactaattatgctataatgtgtgatcatctacctggaactttgtttcccttccttagcaaagtaagaacaactaaaacccagtctaagagatttcttggggaaaagaaattgtatactctccttcactctcatctgggaagtccagcctcacagaagacaacagtttaaattcgacaacactcatgcttcattttgcttccattgctgtttcccatgagataagcagttgtacacaacccccgcctcctctccctgaaaagagcatgctgctgcccctggtgattctcacccccactttaaaaacacctggttttttctctgcccaagatcccatcgcccatgcttctctgaagttctcctctctctctagcaaaagctacttgtgttctaactgtgttctctttcttcccccttcctcatgctgccaatcaaggagacgaacagttccgaggaatcagagtgtgatgatcttgaccctaatactagcatggaggtagaagcagctattgttgtcctatttcctacaatgattgccttttttgatgtgttctgtaacagtgaccttgctaaaatgaccagccattcaaagataaattgtgatgttggggcatctctgggtatcccatcccagctataaaagaaacaaacaaaaacataattcagttcagtgttggtagaaaactctacctagatttttttaaaaaacaaaaacttgttatcttgaatgcttgctaaatattttctcctttggcaggtttgactttatgtagaaaatatccaatttcattatttgaaacttagaacacattttttcatggaaaacagcactgtaaagagtggatgagtcccagctaaatgacaaggactcatttcgtgtttagtttctcccgcttttgttttcccctcctccgcttctttttctttagccctttatcctcttcatcttgctcttctactgggttttattccctgctcagtgttccagaaaaataacgggtgaagtatggcacctggttgctatgtagagctgatagcaaataaggtgtaattgtagcaactccagagcacacttcagcccagtgctgggcccgtgagcagtggctgtgcccaccgtgtgaaggaaaaggagccctggggagggcctgtctcctggagccacggcagaggcctctccagagatggtgagatggaaacactgcccaggggacatttctcgcaccccaggcttacagggatgtgggagtggaaccaacgcctgtatcaacaagaacatccattccacttccaactcccagtctgttgggttatagaaacgtggctcttacgtggcttgccactgagtaacaaccatgataaatttacaaaccctagacaatgagggcaaacatggagctgactttccttgccattttttcattcagagaatgtttttctccagatctgtgcatccatctccagtaatgggtacaagtttagagatttcttctaagtacaaaatagacaacattaaaaagaaatttatatcatcccaaacatttcacttaattagatagacttttattcttattctaatttgacctaatcccagagaagtccagcaccatgttgtttcagccaccacaaaacccaagagagatcatgaggcctaagagccggtaagtcagctgcagaaggagccaactgagttgaatcaggcccgaggcaatcggctgacaatgggagttctgccaggatagagtagtcccctgtagatgtgggtattaccacagagctaaatctggtaggtgtggctcaatacgtaccccactgtgggagaaagtggaggtggcatttgtagcctaaatgtatcttagagaacaaggaagccaggggaaatttcaggctctgttttccttgcatttcacaggataggcaccagctctcctggagttcacacctgtcagcttgtagatactgggtggcacctgtatccccagacctaagtattgccagcatgtattatagatgtcagctgcaagtggaggaaggccagacagaggcaggggaaaagccaggtacctgtgttccaggaaacaatttaggaccttgtccagttcttgtggactaggggagaagagtgatgttcccactctgtaggaagaaatgggcacagagggatgtggggccaggggagcagcacacattaagaaaattaactggggtcatcgaatgccccattctacacttagataaaaaacatgtgtgtgcatatacacatcttaactctgctttgctaattgaacacattttaaaggttcttattcatctaaggcttttagtcctttgcatgggctgagtgagatgggtcctcaggaggtgctgtggagtgcatgagcaaagacattagaatattcgtgctgaacagaggaaaaccaaaaattgtgttgatgcatgtccgaaaagttttcaaatacagtagttgagacacaaagtttcctttaggcacaaactttcaagtagctggaacctcaaggaggcatgttgttggaagcagcaatatccccagtatgtgtggatgtagcccttatatattacatatacatccttttaaatttcagtgattgtcttttttttttttttttttttttgacgtggagtctctgtcacacaggctggagtgcagtggtatgacctcggcttactgcaacctctgcttccctggctcaagggatcctcccgcctcagcctcctgagtagctgggaccacaggtgcacaccaccatgcctggctaatttttgtatttttggtagagacagggcttcaccacatggccgaggcttgtattgaactcctgacctcaagtgatctgcctgccttggcctcccaaagtgctgggattacaggtgtgagccaatgcacctggcctaaacttcagtcattctctgaatgtgttgccagcttcaaattaactttgagcacatgagcaagtccagagggaaagcaggcaacttggcactgctagtttggtattttcagatgcaaataaataagatatagaaagttaaactgatcaacatgagttgagaattttctcaaggcatgtgtaagtagaaccttattgcaatgtacactgcagaagaagaaaatgatgaggagtgcatactgaagagagaggctataccttaaagatccaaattgaaatataggtgagcaggccacctcttgaaggcctctcactattcaagtggtcatttggggcatcattcccagacccagcctggcccccaacctcacccttgtcttctgaacttgatgctgcaatgggcgttgtctctctgggaatgtgtctgttactcttagtgagctgaatcctgtgctgagggtgtctctgttcctggaaccccagctgacataatgggaccatgcaccctgtgtgttcactccgtgctagatctccagatgttaaatcctgccctgactgactccctttaacctgaggccagcctgttgatcccagccctagctgtgcataggctctcatctcctgcctgcatgggaatgatgtcaccaaaacattctttactttttctcaataagtggaccaaatggttcctttaagggcagtttcctggggtctttacttacacactggctgcttgctaccttcaggctggcatttgtcccaccatggtgttttggggagatatacaggcgcatccttgaaggttaattaagaagaaaataaagcaccttgaatcctaggagtcagatttacaaagctttccaagaatacccaattaggtaaagggaggtaattctgctctaatgtttacatccttttccttcccctgcttgtgaatgttttcaagtacaactcctactcccagcagtacatgccacaccaatgccactgcaagattggctctaggtctatgccatcccctcgtggccaagtctcctgcagccaagtctcctgctgatctgtgaccatacctcatggagaactgttctaaagatgacgagtatcatccatagttcagcttacttctttaccttgtactgattaaactttggggtgggggtgaaaggggggcatcatacatgaaagagatgtttctacatggaagaagagtcaaaccaagctgaaaaccaaacacaagggtaccttaggaacaggttaatagtaattcattttttccagtaaggttagactgccttgtgccttttgcagggctgagaaccacatgcccagccaccacctttttcagtcttgtctctaccccggtatctgcactgacaccccaggctcacgtgttcagggtcagcatctggcctatactaggtttttcttaggacccaggtgaggcaggtttccacctttgaaaagttgtctgagaactgtgtcaatgctcacttctgtttttgtacctgccccctagccccagcattgccacctgcctacatcacaggatggggttgaaagtcctgaactagcctccctgacttgggccttcaaggataaggattctcagcccagtttttacaccaagctcaagtaattacatgcattttaactaaaacaaaacaaaacccaatacctcttgtagcagagaaagtcagttcatcagagtgagaggttgtcatcattccaaaaagaccctgcctctgccccagccattcaacatgccactggcctcatccacaacacagactaagtgcagacgttatcctcagtcatataccagccaccagatatttagcttggggagttaaaaacagtgttgggatcttctgggagagggctctgaaagattagagagagaaagcacttgggaaggtgaagctgattttggaggaaattccccattggagtaagaatcacactttcagaataaacagaacctgggaaacatttagttaacctcttcatttatttatttttatgttttgtagtaaaatatacataacaaaaatttaccattttaaccatttttgagtgtgtggttcaatggcattaagtcccttcacaatgttataccaccatcaccactatccatttccagaacgttttcatcatcgcaaacagaaattctttagtggacccagtaaacaactctctattcctctccatccctgcagccccttcacctttaacagagccacaggaacttgtccttttctgtttgaaaactggaaggtgctctagtttctgaggcagcttctggtttttctgcttgctattcccccacctacaccatcctgcggccacttggtaccccatctccaggttgattttaacctaaaacacagatcctggcagacgagaagacctaactcctagtgccaatttttgtgtataagtgtgttattccattttccagctcaataaaaaggaatatcatttctgcccatcttggctttccgaggctgaagtgtaacttaaacaaaaaccacaaaggcagtatcacatggaaaactggaacaggagtcaaaaacctggattctagtttggataccgccagctatgagactgctggccagttagcctttctgagccccaagttcctctggaaagttgcacagctccaagtgtacaggtgtttatacagtgatgtgtaaccctttgagcaccatgcacgtctaaggtgtgctaacaaaggactttgctctccagcacttctgactttgaaaacattgagatcccgaccgaagaggacgtggaagattctgtgctttggccagcaattcacttttcagggggtgtggcgggaatggcctgggcagatttccttctgagactcaactggagtgtccactcctggctctgggaagtttgagcggccagagctggtacttttttccttcctcaaacctacagttccctggcccgcctttcatgtcctcagatctgaagagccagcctactccccgcaccccactccccgccaactaccacatcagctactctggcctccttatcctagagcttcaaaataacccggccagacggattgaaggaaacttttacacccccagccaggtgaccaacctcctggcatccccagtgtgtgtccactgatgcctggttccgcattttataaaaagaattttttcatgaaaagaaccctttggatgaaaagaaagtgaagcatcacattcctgtcgttttatttttgcaaaatattttctttgtaatatatctgaagggtgtggcttgaagacttcctgcctggctttgttctgactctccatgcagaccgatttatattccgccaccaagagaagggagctgagcttagtggctgcttccctctcctgggagaattttaagaagatcgtccacagcagattcacatctattatgctttttgttccttgcaattgccctgtgaagtaagtagggtagagtttctcaccctcctgggggaaacatgttcagggaggtcaaggtcatacagctaataaaaagagcaagtcttgatggtggtgctttgagagaccaaacttagcatgtgctgtagaggaagtctactcgtatggctcaagtactttcttaacaagggtcaggctcaggccctcttttgctgcacatctgttttaggaggagaatttcttcaacaacttttcaaatctcttgactattgggataattacttggcctcacccacgccctttctcaatgactcaagagcccagccagagcaaccaagaaaggaagtccaattacatgagttggaaatgtctgaactggtttctcaggtcaacatagtcactcagcacgccctgtcatgcatgttccatcgcaccctcaccctagactgggggcctaacccgtttcgtttacgttgtacactaatgagattacaaggtaccattgacccagaagttcctctaagagcctgctattgaagaagcaaagaccatcaccccccaaccccacccccatgctgtcaaagttcactcagcgtgagttcctagtcagttcaatttcacacaatttgattaacacaaggcattgcagtgattattatggaggactaacgaacaatgtaagattggttcccatgcttaaggcttaagaagcataagaaggaggcaggtataaataaatgcccatgttacacagcaaactttaaaacctgctctaacagtcatggtgagggactgattaatcctgcctggagccatttattcattctgtggatatttatgcacccactcaggcactgggctcacaataatagtagctactacttagcagtctttcctgtgtaactggctctgtgctgagctcccaacaacatcatcacataggtactattcgcgttattcccactttatagatgagaaaactggagcacagtgaggttaagtgactttcccaggactgtgtattcttaggtagcctgtctcccagggagcctatgagtgtggtcattgattcactgggcagcagtgtgtgggttggatgaactaataggatgtgggcagtcttagagaaggcagagggtgaggagagagcatgaacaaaagccctgaggtgggaggtgcctggcacatgctgagcaggtatatggtctgagtacctggggttagttatgtaggaagagctgtaggagataaagcctggcagatgggttgagaccagacagacaacaaaggcatggaaggacctgctaggaagccaggacttgatccatggactccaaggaacagcagtaggttttaagcagtccatatgattcgtcctgtgctttaggaaggtaaccagcatctatgcaaacactggtgagattttttttttttttttttttttttttttttttttgagacagggtctttctctgtcatccaggctagagtgcagtggcatgatctcggctcactgcagcactaacctcccaggctcaagtgaccctcccaccctcagcctcctgaatatctgggactacaggcacgtgccaccatggccagctaatttttaaatttttttagaagtgggttctcccgatgttgttcaggctggtcttgaattcctggcctccagtgatcctcgtgcctcagcctcccaaagtgctgggattataggcatgagccatggcactgggtcctcagaacaaatgttaatctgttacatagctccgaagactctgggaagtttaggggattggggcataatcagggcataatcagggccaaatcattaagggataagactccaaaacactcatacataaaggcattatccaaagtcaaggtcatggctaggttggaaatgtgatttataaagaagaagctgtaactccaccactgcatcctcctcagccccccacctccagtcccttcctaactgactcctaggctgccaggagcagctggagaccagtgcatacacagcaacgcacccccattttggtcctttgcaaccaactatcttgtgagatgggtgatagatgctttcattattctgttaaaagccatattttcatcctttttatttttgacagcacactaaatgttctctaaccaaaatattgaggggtaaagggggatatttggactagaaatatccataaaacaatcaatgtacttgacacatggacacatatagagacctgtacccccaaattaatgattatacattttttggaaaaccatatggaatttttttacaaaaattgaccatgtgtgctacttacaaagcaaacctcaacaaaaaacaaggaatcagtatcatacagaccaagtcctccaagcacaatgcaattaagttagaaatcatcaacaaaaatatcctttttaaaaatctcacatctttggaaatgtaaaaacatactcattacaactgggtaaaagaaaaaaatcatagttgaagaaaaacacttagaactaaatgataacgaaaatacttgggagtaaggaactagttgaaagagacaagtctatcgctgcttgggattatgttgcatttacattttttaaaattacagcttgtcttatgctcatttagaaatgagcagaggaggctgtgtgtggtggctcatacctgtaatcccagcacattgggcgggcacaggtgggaggattacttgaggcccagagttcaagaccagctgggcaacatggcgagaccccatctctataaagaatagaaaaaattagttggatgtggctgtgttcacctgtagtcgcagctcctcagggagtctggggcaggaggatcacatgagcctaggaacttgcagctgcagtgagtggtgatcatgccactgcactccagcatgagcaacagcgtgagaccctgtcaaaaaaaaaaaaaaaaaagagcagaggtaggaatattttctaaaactttagaaattcgagtccagtttggccagattgaaaacacgaagggttaaaccttcaaaccctactattatacctaaattcttaaaaattgtttttcttatatctttattttattgctagatctcatcatctaaaattcctttcctgcctactctgaatacaggttcatatgaaacaagtgtaaaaggaatagaaaaaggaaaaatatagaaatatattctgggcagctgtcagttgggtttagggtatttggtttatgtttatttgagcgtttttattccttcagtgttctcaatacgtagttttgagctctgttttgtgactgtgataaggaatttgggaaaaatgggagtggaggtctttttcttctggagtcagttaacaactcattttctagacagaatttcaccctcactcttaagtcttagagtcagtcagacattggctgacaaggaaaatagacgccaagatttcctcaaagctcagcttatggtagtcagtgctggttaatattacctgtaactctttcctcttacctgactgccctgccattttgaagaaaaaacgataaaattattggatttctctccagaaggaaactaagttgctgatggatcacattgtggtggttcttgttctcgcctgggaggaagcgctgccacctgctgccctctgctggtcaaataaaaccagctttaggaacctgtagttctttcccacggtgtctacaccagccctgtcctcccggacttggcccagcattctcttgtgctgtttcacagagagagaacatgtgcattttatgtgaacaatgtcatctttcctccacgaccactatttcgtctatgttttcttttttttatttttttgaaacagggtctcactctgttgcccaggcaacagttgcccagtacagtggcactttcttggcttgccacagcctcaacttcctggactcaggcaatcctcccacctcagcttcccgagtagctgtgcaccaccacacctagctcatttgtttttattttttagtaaagatgaggtctcattatgttgcccaggctggtcttgaactaagctcaagtgatcctcctgcctcagcctcccaaagtactgggattacaggcgtgagcaaccatacccagcccacaaccactattttggattccagctctctcctccttcccatctatcattttacattgactccaacctgtttctaaggaaggaaaacattatatttcaagaaaaatgtgcagcttatataaagccctcaggatcctgcacacaccagcaatgaccactagacaaggtggtcaggaagcctaatttctagtctactaattgggtgacttcagttaatttcattcaacaaatatttgatttttctgctatgtgcaagactcatagcaaaaaaaaatatgactgatggttcatagcaaaaaaaatttatgactgatggtgcataaaacacgggaaagggttactaccttcaaaaggttcacaagtctggtagggcaaatacagttcagtaagacgttatggtacttagcagttcatggtcagagacttagaggtacctacagcccctagaagagtgcagaggaggaagatcactattggctacatctcagacattgactgactgattagattcctgagcaagttcatggcaggacattttctcagctctcctccccaaaattaggatcccaccacttaagcttttcattgatttgacaaatatcaacagagcacatatgtgccaggtatcatgctaagcttggaggcaatactagcgaacaatatggcccattagaattcaaaaaaagagaaaataaaaaatttaagaatataaataaaaagtaataataaataaaacaatatggtccttgtcctcatgggccctgcagtccatagggagccacagacaaatatatcggtaattagtctactgtgtgagaagggtgttctcctccagttcgtactctgatttgcttcaaagaagaaagagaaaaaatgagggaggaatcttctatgaccgtagtccagagtcaaagttagaaaaaaaacattagtgtggaccttgcccaggctcttggtccttgctggaggattttaaattaaaggactgagtagagataggatagatagagaggtggagagcaaagataagcaggtaggcctttgatgtcaatgacaaagtttcacaatgcttttcctaagaccctcccactttgctgaatgctatgatggaacgagcactggaataaaattcaagagctctcggagccagtcctctgtcactgtgatcttaacacttcacttccctatctcacctaggaaatggggatacataacatttgctctgcacttcctccagggttttggaggagcacatgaaggagtttgtgagtagcttatgcgaacttcaagtaatccgcccgcctgggcctcccaaagtgctgggattacaggtgtgagccaccatgcccaaacaaaagcaaatattcctaatttgagtgtagtccttagcagagacactggaaagaaagattgcgaataagacttaattactggttcataagttcttggaaggtctgaaatgaagtcaaaggtcaaatatgtattcaccaacatttattaaataccctttatgtgacagacccttgggctagggccctgaggtacaaaggtgagtgacaaatacttcctgtctttgaagagcttatagtctaataggttcgaccgtgctgtatttttccttcaaaaataattattaagaaagtgagtccgggcgtggtggttcatgcctgtaatctcagcactttgggaggccgaggcaggcggatcacctgaggtcaggagttcaagaccagcctgaccaacgtggcgagaccccgtctctactaaaaatacagaattagctgggcatggtggcgcatgcctgtaatcccagctactcgggaggctgaggcaggggaatcacttgaaccggggaggcggaatttgcggtgagctgagatcacaccattgtactccagcccgggcaagaagagtgaaactccgtctcaaaataaataaataaattaaataaagaaagcgaaacatgctgattgcagaatatttgggaagcccacataagaaaagaaaggaaacaacagtcaccccaaatcaagatgctttataaatcccaagggtagagcctatgtcttagtatttctctacccacaaaactgtacttagagagtatgacaaggtcagttaatgttttttgaatggggacaaagccacccttaaacctaccaccctgagataaccactgttaacatttagaaaatattcttagccttcttttctttgactgtcaaatgactgactgggatgccattctccctgccttatccaaaccaggaagagaaatgtttggcctctttagtgcccccctacaggtgatgcagtgctgctcgtggttgatttaatagtttgagtggagcaaccctttacatccttccccatgccatgcctcgaaaccttttcacacagagaactcttttaggtgtgggaaatgcagtaggttctaccagatgttctcatccactcccccatcccaccccagaaaagcctccggggcaggaagttggtttatccaagatcagttccctggaatagagggggactttcatcaggttcattaaacaaggctgcatgttgattcgctttagagagttaaaaaaaatcccaatgcccaggccccacctcacaccaattaaaacagaatctctaggcatgaggcccaggcattagcctctcgtgtttttaaggctgcccaggtcaggcgttgagaaccactgatttaaagataggctaagcagaggtgtaagtggtcttttgagactagcagagggcattgcaatggccagagttggggcactcagcccagaacttggcttcacaagggttttctgcagcccactttttagaaaacctgggtggtataagcaggcacttgatttgcaaaggggaacgcaaagaaggaaataatgtctttcttccaaagggtttatatggattcctctataagggaagaacacacagaaaccatgcatgttcacaaagatatgcatacatacagggaaataagtgcagaggccccagttgggctattttgtaaggcttgtgagttttctggcttcatgataaaggaaagaagaattttgccaaataagctattaaaggtaagccactttaataacagtctgcttagcagaaggaagatgattaaaatgagatcatctttatttaaataggtattgagtacctgttatttgccgggcattgtgctaagcacttgatgtacaagattttatttaatctttgtgataacactttacactaggtattatttatccccatattatagtggaacatcagttattacgtaattaacatacaatcacattaaacaaaacagatgacctcagcctatctccaaagtccgtgcttttttaaaacaatgccaggctgtacaatctggacatggatgattagtggtaatacaaaagatggggggaaaagtgaccatctcctcaagaagatgtagctttccagaatggctagttggctaaaatgttttccctactgtgaaatctccagggtgtcctgaggcaggcagcatggtatataccaagagccctatcagttcctcccttgaaccagccttgtgaccagagttagtcggcttagtcacttagtattcattttctcacctatgaagtggaaagggttggaatggttgggtcagtggcttcaagttgccccatgcaggcctgggctataggagatcatgcttgagaaagaagagacagacgacttctcttattccccttcatccagagaagctctgttgtttagctgcttgaagagtcgtttcccctgcgtggggatgagtaaagggtaaagggaggacatttggaaggaatccactgtattagtgaatttcaatgacccttccagtttgataggtctcaggtcctctatttttgagtttatgatgctaggaagaatcagtgccaccacactgcttgtgtgcataatgaccaagagagtgggttttctgcctgtgaagggaagaaaagcaactgagaagagggaggacagaaagacctctgctagcagagctccaagttacaataaacctgcctggggccgcacgctgccaggcaggaatgtgaacaactgaattagacagagtaaaccaagtgccaattgttgctaaagagaggttttactaatgtgacagtaatacagtcacaacacagtgggaagttgggctccaggcctcatctccctaaattgtactttctttttactcaatacggtgaagtcccttgttctcttttagtagtttaggattcaagcaattttctgtgtctttttgtttttcagatcttaaatccaaatttcatccaagaaggtgagttaaaaagcattagaattggaaacatggggattggttaaataaattatagttaatccagcactaaagcactggctgtaagcaatggtgatatagttctgtatcaatggacaaggaaagaggtttatgataaattattagatgaaaaagactaaagcttgcgatatgtataatgggatccaagttttataagaagtctgtttatataaagcccaaaagggtatataccagaatgcctacagtaattatctctggattatgacattatggagcttttctttctttctgtttatatttcctatttttttctataataaacagttatctcttttaaacactttttaaagagacccagatgactcaccagtgttatactgaaggttatttgaatcattacatgacatgggtgggaaatgagagaggtgtgttaaaacaaaatggccattttattctaaatttgctctgaatgatgttaatgtatgttgatttgatcacagtggccccagaattccttgtgcccttggtggatgtgacctgcttgcttggggacacagtgatactgcagtgcaaagtctgtgggcggccaaagcccaccatcacttggaagggtccagaccagaacatccttgacactgataacagctcagccacatacacggtctcctcttggtaagccgattgccctaacatcagcaacagcagccccttgcttgacacagcactgagaggctgaatctggggtgcaacttctgctctggtgactgggctctgcaagagaatagctgccctggagcctgttcttgggcaaacacttggacttgattagagagagactgaggagactcaagtgttagtcagagcctctgccactcacgctgcagcctgatggacacctgcagcagcaccagcacacatttcccacggtgctcagcaccacgtagacatacctgggatcaacagaatggtttgtaaagactgtgctccagacccacattaaacaaatagggaaaaacataaacctttatatctcaagtcaagcatgcaccatacttatgaagagtttttacagtcactgccttacattcaccctggtagatgatctttccctacagatccccaagtgaatctctaagtcagaagatttagacttctgatttaagtggcgaaggctccagacctgtagtaaaaatgtaatcctcacatctggacatcctgacattttttgtgcctttcaggttgctgtgaaacagtgagatgtttaattcctcacctaagaacagtgttattagaaaaagaaacgactaattctaaaatgtgcaatagaaaatcaagccgcaaggatgcttctacacacagagtccatttaacaaaacttagctgactgcctcccaatcattgtgtcagcatttattgttactaactatgaattggactgtgtactgttgcttacagtggacaagtggtagcaagccctagatgcttgagaaacattagtggaagaagcacctagaatcaagaaactttcattcattgacttaatttgtgtgtatgggaaaaagaagaagaccatcattccttggtattcccagcagagaccataaagaggccaggtcataaaatatcagtgggtccaagaagcctagtgtgagacgcagtggttggtgaggatcatgaaaagcgccaggggatatcataaccctagggaaggggcagagctgactgtgacttctgtatttcagagcagttctcccctggggatattcctggaccttgtattggggtgaatggggaagttatcatttaggtgatggaatttactctttcttagaaattcacttaattattttgaggatcccacatctagaatttgaaatacttaaaatatttttattcttgagtctttcctttttttttttccatcattcattatcgatctgtgaaactgaaaatattctaggacaaagttgctagtggtaataatactaataatactatgagccagaacttgcatacaactttatatatttcaaacaatgctctaattcttatgtcattttattccttattttatccctcatgtacaacaaacttgagagatgggcatggccagaaaatttttttccatataaggaactggggatgtagagaaacagggtggtaggtagctcacagaccagggactgacctcgggcctgaggactctcagctcagcacaccatgggccaaccctatgggattttacccagcagtcaagtgtctcattactggagtctgaagagcatccttttggtgtccctagtgattctggagaaatcaccctgaagatctgtaatctgatgccccaagacagtgggatttatacctgcatagcaacaaatgaccacgggaccacatcaacgtctgcaacagtcaaagtgcaaggtacagcctctttgttagtcaaaccttttgaaatatatatatatttttagacaggttcttgctctgctgcccaggcatgatctctgttcatggcagccttgacctcccaggctcaagcactccaaccacctcagcctcccgattagctggacatgcaccaccatgcctcgctaattttttttgcattttttgtagagatgggattttgctgtgttttctacaatactttttaaaacatttattttttaaatttcagtaaaacacacaataaaatttaccatcttaaccattttttaaaaaattcaaatagagacagggtctcgctatgttgcccaggctggtctcaaactccaaggctaacgcaatcctcccgtcttggcctcccaaagtgctgggattgcaggcatgagccactgtgcccatcccatctgaaccatcttaaatgtacagcttaaaaataaataaataagtgtacagttcagtggcattaagtacatccacatttttgggttaccatcaccaccatccatccacagaactttttcatcttcccatctttctgaaactgcatctgtacctgttgaacaatgactccccattccctcctccccagtgcttcttggccaccactgctctactttctgtctctatcaatttgtgttactcaaactttattttttcttgagacagggtcttgctctgtcgctcaggctggagtgcagtagcatgacaccactcactgcagcctcaacctcccaggctcaagctatcctcccacctcagccttccaactagctaggactataggcatgtgccaccatgcccagctcattttttaaactttttgtagtgatggagcctcgaactcctgggctcaagtgatcctcctgccttggcatcccaaagtgctaggattataggcgtcagccagcacacctggcactacgttttaagtgaacattataagggctccctgcgacctgggggagaaaatgtccattgtaaaaattcaaaaataaagttctggcaaatgagacgagaacgaatctttgctaagagctgtctgtggcctaccataaacctaccatcaacatgttagttccctggccaagctttatcttcagggtgcagtatttagcccaaggaagaacttcagacagcatggtgtgtctcccacatctgccttgggcctggagaaaggtatgccacttggtggagaaggtcacaggaaaaaattgtgacatcggttaggtaatgtttcctagatgacttataccttggtgtaaaatgccaagttctgcagaaatagcacctgatcctgatttctgtctccataggtgttccagcagcccctaaccgccccattgcccaggagagaagctgcacctccgtgattctccgctggctgcccccctccagcacaggaaactgcactatttctggttacactgtggagtacagagaggaaggtgcactatctcctgctcttctttttcttttctcttcttttaaaacatttatttttaaaattgcagtaaaacacacataataaaatttaccatgctaaccattttttcaaaaatttgaatagagacaggctattgctatattgcccaggctggtctcaaacgccagggctaacgtgatcctcccaccttggcctcccaaagtgctgggattacaggcatgagccacttttattttcctttatttttattgtttattttttttgagacagggtttggctccatcaacccaggctggagtgcagtggtgcaatgtgggctcactgcagcctccacctcctgggctcaagccaacctcccacctcagcctcctgagtagctgggactaaagcgcacaccaccacacccggctaatttttgtatttttagtagagacagggtctcactatgctgcccaggctgctggctgctgtgaaactcctgagcgcaaacagtccacttgcctcagcctccggaagtgctgggattacaggcgtaagccaccgcgcccggcctcctgctcttgtttttctgtcttctcttcgtctctaggaggtccttcagaattgtgaacatattagcctcctcatctttcagaagttgttccttgttgtgtcttccaactcagcacagaggcctcagtgccagattacagctgccttctgatcccagatgtcgagcagctgttttggctaagatgatccaaacctccctgacatatttatgacccagggcaggtttcaaggtgtcttcatgcatgtatccctacttaacatgctcgatcacccagacagggatgatcaatcccattttacagagtgggaggctgaggcctaaagaaagttaagaaacacaagattatagttagtgagaggcagagctagcactagaacccagatgtctacttggataatttgtgatctttctcccagagaaataactagtgtagtacgggtggagttctacaccccctatccccagataaaattaagagaatatatattttttaattgtgccgtttaaaattgtgcaatttaaactgttaaaatttgttacatttacatgctaaaagtgaatatatttcttcagcagttagaaacaactgagacttccatctagttagcaagaattagttaaaataagaagctgccagatagctctaattgttaataacacaactacagttattcacagtaataacacaattactctgaataacattaggaattacacaattgaactgaaagcaagtgcttgctaccctatcccccgaaccaaaaccatttgttttattctactttccattatgcttattattttaactcttctttctccttctttcttattaaacaggccctatgcagttataaacccatttatttctgcatccttcttaagctgttcactcttgtgtctcccaggttagcacaaaagtattaatagtgagctgggagacacattttacaaagttcatgtttaccttagcattatccagttcatagttcagctcattaactaagttctcttgggcaaattgttcaatatttctgaggctcagtttctacatctgtaaagtaagattagcggtctctacctcactgggtttctgtggatttaagacagaattaactttctgtcttaaatctcatttaactatgagagaattatgttgaaaacaccttccacagtattttacgtgtacgtagtgttcaatacatgttactttccattttgtttccatttccaaatgcatattttctctcatgttattaactaaaaatatactcttctggccttattaaaagtttgccatgtgtcccctgtaaattctgtattatctatgtctttttactctggcacttgcacatttgaaagtgaacagaatctataggccagcttcttccacgcctctcaccatttattccgtcatttaggaaaccgaatccaaactaccatagttagcctacaggctttcagagcctgacacggtaaccacaagcatcccttgaattgaatgtgtctattttcctgtctttgtttgctgaaggtctttgaaacaatatccctttggcttttctctttccctctcctgggaaactgtacactaggttctcagatctggcagcagtcagtggcttcgaccttggacacttacctcgtcatcgaagaccttagtcccgggtgtccttatcagttcagagtcagtgccagtaacccctggggaatcagccttcccagcgagccctcggagtttgtgcgacttccagaatatggtgagtcccagcccagccctggccccccaggcagtgggattgaggcacctggctgcctgtcacagactcctgggcacgttgacatgtcaggccaccatgcaagaggcaccttttagaggactaagaagaatgtttctgtaaagtatagctccaagcatcttgggcaaatgttaggtctgcacccatgcctacccctgcacctgccaagttccctggggaatgagtatgtccccaggaatggagagttacaggcaggagtcatgagtcctgtggatgttctctgcccctcttctgagacagtaatacaaagcctcctcccacccgggcacccctgccagccgtaaatgtacctccctgcatgagggactcacccacttcaaatgggggaaagaaaagcaacctggctgaaggacttcattacaacatgaggatttcatagtttcctcacccccaatcatcccagaatttcttttttcaacatgggtataattttatgtagatttgttgaaaaagtaactaagatacacatatagctagctaaatatgagtattttacaaataaggttcttattttgcccaaaacatcttcgtcccagggacattttgaaagagaaaacttggctatcctaaagaaatctccaaatggtgagattttgggcagtgcaagggagtggtctgtgtgtactggggagagcagtgggtggggggcagctgactgtactcgaaagaccatggacctgtgtgccttagggttaagggaattctggagtctccagaggggtttgggaaaccctctaaatcacctctgcccccacctgaatccagaaatgctctccagttccagtcccacagtcagcccggttttctcccagtgactttgactttgttcccacgagcctgtgactcttgcagaaacctacgccctgggtctctgtttcctcagaattcaagatggataagccgccttcagtctcagccaggctgtgctctgggaaacctgagggaactggctccagggtcagctgagccaagctgctcatgtgacccctctcctcccaggctgctcacttgctccagccccggatgatgctgtgtgttttgctatttgtgaaccttggtccccaacagatgacacaaatgcgtattgctgtgcttgctctgtgtgcgtgtgtgtgtgcacgcgtgcgtgaatcattgccaaggaattgacacatcacacaaggtaatactgccaaagaatctactcaggcatatattgtgggttaagctaaatccttcagtataccagataagctcattaatgcctgagaagagcgggataagaagataattttttctttttctttctttctttcttttttttttttttttggagacagggtctcgctctgtctcccaggctggagtgcagtggcgcgatcatagctcattgcagcctcgacctcctgagctcaagtgatcctccaacctcagcctcctgagtagctgggactacaagtgtacaccaccatacctggctagtttttgatttttttgtagagacagggtcttgctatgtggctcaggttagaaagagaaatttctaaaatgtcttttccttttctcctttcttgaccttgtaacttttcccttctctctctgcatcctccttacacccctgattttcacgagcttttctaggtcttcaaagtgttcttttatcccttttaaatttttctcctaaatttatcttataaaatatccataagtcatatttctgattgtactgcgttttccctttgtttaagtagatgggagagagaagctgactctgtcatgtcagtttccccttggatgattttttaaaataacattccagagaatcatggcattttcccactgagtcagactccatatttggtcatgagaattgctttggggttactctggagcttttctgttaattttttctttattcttatatgacatcctcgatattgtaaatggattctctttcttccgaagatgctgctgctgatggtgccaccatttcttggaaggaaaattttgactcagcttacactgagctgaatgaaattggaaggtaatgacacagttttatattccttcattcatgaacacctagcaacatcacatcagaacagtaactttttgttgttgtcattgtttatttcttttacaaatgcaattctctccatagcaagaaaaaaactaaaatattcgtttgtattttctactgttctttttctaacttcttaagttggatgcttcattcatcagttgtcaacctttcttcttttctaatataagaaattaaggcccaaaattttcttcaaagtacaattttagctataggtcctgagttttgatatgcagtattttccttataagttatatgtagttgtcttcaactgtgaatttttctttgacctggttataatggaaacatgttttaatatatatgagatttttaaaggtatgagtttttttaaagtatctttttattactgatttctaacttaatttgcattgtggtcagaaaatctatatggtactgattccttggtttttgtttggacttgctttatgagtagtacatggttactttttgtaaaaatttccacatgttcctgggaagactgtgcaatcactaattgttggatatacatctctatattgcccgtgtaccaagcacattaattattttatgagtatttctaatcccaatcctccccctgccacacacatacactccatacctttctctttctctctctttctcacttgcagtattttggttagagaacatttagtgtgtcctcaaaaataaaacagataaaaatatgacttttaacagaaaaattaaaaatctatcacctggcccacaaaatagtctatgggaaagaaacaaaaggcattcatccctatgcatgctttggtctccaggtggtctgtgtgagggaatgtaggtagatcttacaggttgcccacccgtaagatccttccccccggatgtataaataaaagaatacccactaacgatgggccattgacatcatttctagctctgattagcatttctcagtgaagcataacattttttaactgacgtggttgtgaccgacgttgtagaggaaaccaaaatggtccttctgcctgtgtcttaggcaggagtcacaatatcattcactgccttccgttacagcacctttcatcaaaaacaaactctacctctcctttcctgtcttctttgtgtagccaaacagaagaaaaaaagccaaggaaatttatgtaatggtgatgatgataatgatgatctcagtatctatagtattctagatactaagcagatactatatacaaatgttatttttgtttgtttgagctctactgcttaatacacaaacattatttaatttaatccatacaacactatgagatactgtttgagcagatttaaaaaaaaaagatagagatcggttattgctatgttgcccaggctggtcttgaactcctgggctcaagcaatcctcctacctcagcctcccaaagtgctgagattacaggcctgagccattgcaccaggctgagtatattgtctttttgtcttcttttttctctttttgagacagggtctgtctctgtcaccagggctggaatgcagtggcagtatcatagctcactgcaccctcaatctcctaagaagctatcctcccacgcttgcggggaggatgatcagtcttccaagtagctgggactacaggtgcacaccaccatacctggcaaacttttaaaagaatcttttgttgttgttttgtagagatggagttctcactatgttgcccaggctggtctcaaattcctgggctcaagcaatcctcctgcctcagtctcccaaagtgtgggattacaggtgtgagccacccatctcacccagcctgaagtatattttcagtaaaggaaactcagggtcagggaggttaagtaactttcttaaagccccacaactaggaggtgtggagccaggattcaaattctgggctacccaactccaagcctggtcttgttttactagcatatattgtttctcatcatatcgattattgtccaaaataagctctagtaactgaaatctagtttgctttattatattgaaatttgtgaagctaaacatgacccccaataatgggccgattaaatccccagctagttctaaatgaaattggtttcatcacccggatgccccagttaattcctcctggaggcatgtgtttgctattattagccataggttaagtcatgttttagctaaaacagatggctgatttgatatttctcaaagggaagatcaattttcttatctgttcaaaagtaatcgatgtttttgttttaaagtctctaacagcctgaagcttgtcctctctcctaagaatagtccttatattttcagaagatcttttcaaaatgttgtacattaacagaatggaaataatacatggaaattctttttttttcttttttcttttttctttgagacagggactcactatgttgcccaggcttgagtgcagtggcatgatcactgctcactgcagtttcgaccttccaggctcaagtgatcctcccacctcaacctcccaagtagctgggactacaggcgtgagccatcacagccagctaatttttgcattttttttgtagatacggtatttcaccatgttgcccagggtaatctcaaactcctgagctcaagcaatccacccaccttggcctcccaaagtactgggattacaggcgtgagccaccccaccaggcccaaataatacatggagatgttaatgtgagacacaggaaagatatctgtgccagggctgtagaagtcaatcgacttgcttcatcacacctaaatctggaattctgggcctttgtgactattctgttaaaaggagtgctctggtaattaaatactataaaaagccacagtgcaggaagattctctcctacagcacatccatagaaggaaagggcacttgagtatggcgtgtttaaccaggaatgaactatacaggcaacaatgcagtatagagaaggcaggggattgtcactggaaatgctgacccattgcctatacccattgctatataaaaaggtagcagtaccaggcctccaggtcagatggcaggttgaacacaggcatctatcttcacttcttcctaaacttcattgaaactataatgcagggtttattttattttattttatttttttaagtaggcatataagaatgaggacattggaagaagagacaaaaataaagtattattttcacagaaatacagatgtttttcacagaaattcatgtttttcttctacagaaaaacagatgaaagaatgataaatgaccttcaagacctgagtgagtcagtcagtcatggggtcaaatgagggccagtataatttttgcagcagaattacccaaaagctcaggtattaggagcatcacgtacctctggaagtaggtaaaaggaggatgctaaaattgaaaggattggctgaaattttttgagaagttgagtctcagaagggagtgaaaactgatgtctgtgttcagcctgccatccttacctggaggcctggtcctgctacaatttagattctatacaggcaaccagtcagcattcccaagggataagctggctccaaatctgctccccagcttcaagtatctgtgtgattgtctttcttcatccaagaaaagactggtccctcccttccttccttccttcctcccttccttccttccttccttccttccttccctccctcccttccttcctccctctttctctctctctctttcttatttctttgtttcttttgttgtcgttgttgttttaggacagggtctcactctgtcacctaggctggactgcagtggctcaatcatggttcactgcatccttgacctcctgggctcaagtgatcctcttagcctcccaagtagctgggactacagacacacaccattatgcccagctaactttttaatttttcatagagacaaggtctccctatgttgcccaggttggtctcgaattcccagtttcaagcagtcctcccgccttggcctcccaaagtgctgggattgcaggcataatccaccgtgcctggcctggagttttattttctggaaagggaaaaatggagcatccctgcccttggggacaccaggcacagttgaaggcagtggagccattctgcaaacagggacaatatgagaatgtatgcatgctgggtactcagaaccccagctctcttatccactggacctccagaggttgacagccagggtttcaccctctaggcagaaagcagagggctctttctctgggaactctaaccagcccaaaaggaaagacttaaagatactgattgtggagctttcccaactgagcagtcttgtcaaatcactctgtagtaaagtaaaaggtgacaggcttcacccacaagctcagagcttctaaacatcttttttctttttcttttttttttttgagacagagtctcgctctgtctcccaggctggagtgcagtgatgcagtcttggctcactgcaacatctacctcccaggttcaagcgattctcctgcctcagcctcccgagcagctggaattacaggtgcctgccaccatgcccggctaatttttgtatttttagtaaagatggggtttctccatgttggccaggctgatctcaaactcttgacctcaggtgatccgcctgcctcagcctcccaaagtgctgggattacaggtgtgagccaccgtgccctgccaccaaacacgtttttattcctgaactttcaaaatgagccaactcccaatgccacccaagatagagtaagcccactgtagcctttatctcccactgattacaaccagaatccctggacaagatacaaaaagcaatacctgggtatcaaattaaataatagagatgagagtggaaagacaaaagacttgggctgggtgtggtggctcacgcctgtaatcccagcactttgggaggctgaggcaggaggatcacttgagcccaggagtccaagaccagcctgggcaacatggcgagacttcatctctacaaaaaataaaagaaaaaactagctaggcatggtggtgcacacctgtagtcccagctacttgggaagctgaggtgggaggattgcttgagcctgggaggtcgagatcgcaccactgcattccagcctgggcaacagagcaagagcctgtctcaaaaaaataaaaggaaagaaagtaaagtaaaaacttgaagaatggctaatgacaaggagaatagcagtttccttccttccttccttccttccttccttccttccttccttccttccttccctccttccttccttccctccttccttcccttcttccttcctaccttttttcttctttcctcttttctcctttatctccccagctttgatacaagtgtgggccaaatcaaagaactatgtagcatgcacaaacagcaaaaactccaagaaaaccccacatttctggccaaaggacaaagaaaagggaaccctttgagctggagagaacagaataattcatgcttaattgtttttttgtgtctccttactgtcactgcttcaccccgagggcagtcatgtgaaactgcatgacaatgcaggaagctaaacctctgagggaatcccatctttctggccagacaacttcaaaaaggggcacttgggagataaagaatgcaggggaaatctcaggagaaagcaaaagaagaagatctcctaattctatatgaaatgactcaaatcctgggccaccttccagctgtgcttgtatgaggcacatccaaagaaatatagcaaggctctgagaactggactatgatgtaaaccactgctcagtgactgtttagtctcagactaatctttgtgtggtgctcacaaggggcagacctaaaagcatagtaaacactgaaaactgaactgacaatagaaccacctcccacagaaggtgagacagaacttgcagtctgaacctaaccaagttgattgctgaccaaaacatacaaataaaccaaaaatcaaactcctccagaggattttaacagaatcagtctcacaacataacatttgaaatgtttgggatacaatctaaatttgttcaacattacaaaaagcagaaaaaacttaaaaaattctcgggaagaaaacaatcaacagatgccagctctgacatgatccaaatattggaactatcacacaaagactttaaagtagcaattacaaccatcctctgtaaggtaaaggtgaatactcttgaaatgaatggaaagatagaagttattgacagagaaatagaaatgatttttaaatttaaattgcataacaaaaaatacaatatctaaaatttttaaatttacagcatggattcaatagcagaacaaagctgatggaggagttggtgaaattgaagaggaagaaatataaattatctgacatgaagaatagagagaaaaaatgttttacaaatattagacgtaaccccagggacctatggaaaaatatcaaaaggtctgacattcatgtcattagaactcctaagggaaagaaaaaagtgattggtgcagaaaaaatttttgaagaaataacaactggaaatgtcccaaatttggtaaaagacacaaatttttaaagaagcttggtgacctaaataaaaaacaaacaaaaaccatgcccagaacacattgtaatcaaactgctgaaaacaaatatatgaaaaaaaatcttgaaagaaacaagagaaaaaaacaacatattacatttaggtagaacagtgactcgaatgacagcagatttctcatcagaattcatggaggcaagaagacagcagaaccaacatctttaaaatgcttaaaggaaagagctggccaccaagaattctaaatctagcaaaaatatcctccaggtgaaatgaattgactactaagaatttctgaacagttgaggaaaatctttaaaatgaaagacagaaatcaaaacaaaagtagaagaaaggaaacaaactatatagcaaaagacttccaaaaactctcattagtatccttagataaaagataatattgaaattacaaaacaagagcataatcctgcaataaaaaagaaacaaaaaatgaaaacagaaccttttttaaaattttatttttatttatttatttatttagacagagtcttgctctttcacccaggctggagtgcagtggcacaatcttggctcactgcaacctctgcctcccaagttcaagtgatttttgtgcctcagtctcctgagtagctgggattacaggcacgcacaaccatgcctggctaatttttgtatatttagtagaaacagggtttcaccatgttgtccaggctggtcttgaactcttgtcctcaagtgatgcacccaccttggtctcccaaggtgttgggattacaggcgtgagccactgcacctgacctgaaaaccttaatagaagtgtgggaagacagagttgaggaaatttcccagaaatctgagcaaccggaaaataaatgggaaatagaataggaaaagaagaattagaggactagactagaagttccaatttgaaaaacagaaattccagaaagagagaatagaacaaataaaacagagaagaaggaattgtttctaaaaaataagatattcccagaatgaaaagacatgagtttactaattgagagagcacccgagtgcccaacctaatggatgaaaatagatcatactgcagcacataactgtgaaatttctcaacacccaggaaaagagaagaacctacaaattctccatgaggaaaaggggtcatgaaggattaggaatcataatgctttagacattagcagtcaacattaccagcaacaatagaagttggaaggcaacagaataattccttcaaaattgtgaatgaaaagttttcccaactggattatactcagctaaactcacaatcaagtataaaagtagaataagtacaaattttcagatatgcaagtctgaaacaatttatttcccatgcactctttgtcagaaatgattgaagattgcattctatcacaaaaaggaaaagtattcatagtttactagaggctcaactgtgaatagcatggacatagtgtagtaatgtagatactgaatattgattataattctattgggaagacagtggttggggatagtagttatgtggcagggacagagggaggaaggaggctaaaatctcatcttccacagtgggatgtcaacagaaataattaaaactgaaaaatcaagaagtagccactcaaagcatactattgagagtcatagaagtaaatatttcaataatctgctaaactatattaaattgatatattaaactgcctctcaggccaggcacaatgtctcacacctataagcccagcactttgggaggccaaggtgggcggatcgctttgagctcaggaattcaagaccagcctcggcaatatggcaaaatcctgtctctacaaaaaaatacaaaaaattagacaggtatggtggtacacgcctatagtcccagctacttgggaggctgaggttggaggatcacttgagcttgggaggcagagattgcagtgagccaagatcatgctactgcactcaagcgtgggtgacagagcaagactccagggaaggaaaaatggggatgaattgtttttaaataacaaacctgtaaagatagttgactttttaaaccatgggtctgcataactttgacaactacaaacctttttctaaaaattaagctagcagtaccttgagatggccactaaattcgggagagctatcctcagcattcaattgttttcattgtttcatttcactcctctgcaagaagtaacttatgataatcaaactcacaaagagagtgctgttaaaaccagaatggcaatttattaatttatgatgtgaaacaaaactgccattttgaccaaatatttgcttactgtgccaagaatgatatttggtaaataatatatattcaataaatacttgtctaagacttgttttactgattagtacattatttttttaaaaaaaatttttaaagcgaaaggatctcactatgttgtccaggctagtctcaaactcctgggctcaagcaatcctcttgtctcagcttcccaaagcactgggatgacaagcatgagccattgcacctggccttattagcacattattttatgcaaatatatgatgagaaaaaaagtattattagaaagttgtcttttgagcacagagccaggtcaaggaggcagttagatcatcttcatggtggccatgacacacccatttctgttggaggaatgggctggtcttcagactgttctctcctctgctcgtgggttaggacacctcatgggcagggcttggatggtgctgccttgtcacctcattgaccctcccttcatctgccccattgctgacctgtgccctacagagctctcttgccaccttccacagggcaacagctgtatctgggaaccattctatttcaggggtgggtaattttgtcagatgcaataatggcagagtggttgtatatttctaagtgttcttgtcgatagggatgtaaactgaagtatttatgagtgacatgacattatatctggatttgcttaaaatattccagggtggaaaaaagcaggggatagaaaagagatagatgaaacaaaattgattaaattgttcatgattattgaagttggctgcataggagatctattttgctattttctttacttttgtgtatattagaaagtttccataataagaagataacaaacataaaataaaatgaaatgatggactctttaaaatctttttaatgagagctaagctatgaggacacaaaggcataagaatgatatgatggactttggggacttgggggaaagggtgagagggtggtgagagataaaagactacacattgggtactgtgtacactgcttgggtgatgggtgcaccaaaatctcagaaatcaccctctaaagaacatattcatgtaaccaaacaccacctgttccccaaaaacctattgaaattaaaaaacaaaaatccaatttgcaatggctttacagtctggctttttcatcgtgtcatggccccacaaagagttagcatttgtgctagaccttgaaggaagtagaattggtatgtatgagaaggagaaaaaaataataaaaatgtttttaaaattatcgttgagtagaattcctccttctttaacattattgctgtttctattgttgtatttcacagaaatacatattctgcctcgaaaagaaaactgaactgccattgatggttaaaatggcagagaaaaatgttggtttaaaaaattacattagttaggccaggcagagtggctcacacctgtaatcccagcgctttgggaggccgaagcaagaggcttgagcctggaaagttgaggctgaagtgagccatgatcacatgactgcactctagcctgggtagcagagcaagaccctgtctcagaaaaaaaaaaaaaaaaagctttatattacatataaaaatataatttataatgtaattagattatatataatataaaaagtttttgacatctcaaaaaccctaaaatgctaaagaaggaaaaatggattctctgaataacattataattaaaaatataggagagtaggattcctaataagatctatctgaccacttcccacaaaactttacttatccatgaataaaatatatctagttaattaatgaatgttggcaaactctcccttttgtttttccagaggccgtttctctatagtaaagaaatgcattcacaaagctacccgcaaagatgtggctgtgaaatttgttagcaaaaaaatgaagaagaaagaacaggctgcccacgaggctgccctgcttcagcacctacagcacccccagtacatcactctccatgacacctatgagtcccccacatcctacatcctgatcttggaactgtaagtacagacgccatctctctaaagtcgcctgcatccatttaggttagcttttgcccacaattaatggaaaagacagttacattttatacaaggtcctatcatttgcaaagtgctgcatataacatgcactctctcccccattttataatcaatgtcatttccatttcaaagattaaaaaatcataataggaataagggaagtccttaaaactagctccttaagactaggaatggagaagctgggacttgaacccatatctctctcacttccatgcttattttctttctattatggactcttgggctgggcaggagtttgggaagagcttgtcgacagtaggctgattgacagggtggagttgaaagacagggctctgtgtgtcaattcaccaccatagcaactccattctaccacccaaaaaaattccttccaggggagagccttaccttcaaaacattccactcattccagattttctagggacttaggcaaccatatacgtgacccctagaatagatgtaataaagcaataatgtccctttctccccaccactaccccaggctaagaagagacagtatgttctgtggtttagataaatatcacagagattaaagagaacagagtcttttcagaagtgatacaagtaacagaaatgtgatcagattggtgctactgaggcccttggcctagacaggagacagacatttccgccaaagaccattgccgagtatggctccacaagaaccccttttcagtagagaagtgcctgcattttcagcttttcaactaccatgttagtccggctcttgcgtgcttgttagtctaggtgtgtgtgtacgggatgtttgagtcagtaacttgtcacaaatttatttatgataaaataagaaagcaaaaatgcaaacaagtttggctatttttaaaatcagctggaaaaaaaaaaaaacagaggggacaaaccccatgctgctagcatctgtaatccttttgtgaaacttaaactttatgtagttaagtagttggtagtttgtcactttagacttaacagacttaacagtctctttcagagcctgatctgtttgtagggaacctcctaactcaaaagacattattctattgctagtgaactatacttgtccacagatgacaacatctgtgcttgtgttccagtgaaaggtattgtcactgtgtaccaggttgagttcagctgacccagaacttctgccccttcagacttgccaactgctgtttcaagggaaggtgctgatattgggctactgtagtgcaatggaaagaagctgctcttggaatgaggaatctgggctcacgtcccagctctgtgatttgaagcagaatacttagtttgctggggccccgagtcctcatctgtgaagattgaaattcctccaacttcccagagatgttgcagggattaagttagatgaacagtgggttgaactagtttagcaaacgtttactgagccctcgctatgcaccaactaccatccagaccagggccagggtcgggggaacaaagttatagttataagggtagtttataggaggcagaggtatagtttatagggggaaaagggctgggcacgatggctcacgcctgtaattctagcactttgagaggccgaggtgggcggatcacttgaggtcaggagttcgaggccagcctcgccaacatggtgaaaccccatctctactaaaagtacaaaaattagctggacatggtggcaggcacctgtaatcccagctactcgggaggctgaggcaggagaattgcttgaacccaggatgtggaggttgcagtgagccaagatcacactactacactccagcctaggcgacagagtgagactccatctcaaaaaaaaaaaaaaaaaatagggggaaaagatatagtttttgccctcgaggagttacaagtctaatgaggaagaccaatagatagataaatggatgattttaatataacatgataaatactaagaaagaaaagcatgcattggagaagattgctgtgagaacataggtgcttggttggacctgaagttcagggaaagtttgtggagaggcagtgcctgagctaacccctgtgctggatctcattatcctgttatgcttatttggcaaatacttatgctgccaattaggtgacggtggcctccccttaggtggtcaccagaattgctgggagagcctttctttaccaggcaactgagatttggattccctagtctagggtaggatgtgggcatctgccttatccaaaagctctaaaggtgaacttggtggctaagactctctcacttggagcagtgctgctgttaattgctcccttaatgactccaagaagttcaggggaatacatttaacaagcccaatcctactccactctactctgatcactcttacctcacccttagcagggtcagaggaaagcaaaagaggcttgcatgggttctagcctttgctcctgtcagggaaagtagaagacaccagtgggaaggagcaagctagaggggaagaggtaaacttgaccagggggatttcagctgtaactgaaagtcatttctgaccctgcatcaggctcctctgcatgggcatttcctgggcatgtgcctttaacaactcaatgtacactaaagaatacctgacatttggtaactccttgctgtaagaggacagagggtggctgagaatagttaccatttatttagcacttacctatgctaccaattatgcttaaatgcttcatcatctcactccatccttgcacaatcctcataatcaaataggtgaacagtaatattcacccactatatgataatattaattcattatattatattaatataatgaataataattgttattattttgttgctgttcttattcccactttaaagatggttcactttggtgaaaccaaaacacagagttcaaatgacttgctcccagccttcagcaggtaggtaacagaaccaggattcgaatctgggtctggatggctccatataccatgttctcaatcacagttctcaaggttggaaaagttgcccagaaggcaaaggattcaaaaagggatcaagagccgggcacgctggctcatgtttgtaatcccaccgttttgggaggcccaggcgggtggatcacttgagaccaggagtttgagaccagcctggccaacatggcaaaactctgtctctactaacaatacaaaaattagctgagtgtgatggcacacgcctgtaattccagctacttgggaagctgagacaccagaatcgcttgaacctgggaggcggaggttgcagtgagctgagatcatgccactacactccagcctgggtgaaagagagactttgtctcaaaaacaaaacaaacaaacaacaacaacaaaaaaaaggtggtggggtaggggagggacagagaatcaataatgcaaagaacaaactttgcctactttctgttttccccaacttaaaactgacaaatgaaagtagtttggctaggcacagtggcctcctccagaaatcccagctatgtgaggggctaaagcaagaggatcacttgagtccaggagttcgaggctgcagtgagctatgattgtgccacagcattccagcctgggcgacacagtgagacttcatctctaaaattaatcttaaaataaaattaagaagtactttgcaaaacacatgtggggctgtttgcagccactaggttatggttaatcaggatattgctgaagtctctcttggtgaaggctttctttacttagcaatcaaacctcttaaatgggtgtcacaacttttttcttgtgagcaatttttagagttaatgaaggagaatgtttcttaaacaaggttatacacactccctgcagtataccatatttgtaaatatatttattttagttctgaatattacaataactttaggctctaactaaatatgcatgtgttgcacatttggtcttcatgtataacaataagtatgagagagtttagagatcttactgatttgtacatgtgttatttttctatttcttcatttcaaacatatttcctttgcctttccctgcctactttcaggatggatgatggccggctcttagactaccttatgaatcatgatgaactgatggaggaaaaagtagctttctatatccgagacatcatggaggctctgcagtaccttcacaactgcagggttgcacatttggacataaaggtaataagaagtggcaacctgctgggcgcagtggctcacgcctgaaatcccagcactttgggaggccaaggtgggcggatcacaaggtcaggagatcgagaccatcctggctgacacggtgaaaccccgtctctactaaaaatacaaaaaatacaaaaaaattagccaggagtggtggtgggcacctgtagtcccagcaacttggaaggctgaggcaggagaatggcatgaacctgggaggcggagcttgcagtgagccgagatcgcgccactgcactgtagcctgggcgacagagcgagactcccttcaaaaaaaagaagtggcaaccttgcagggaataccttaaatggccaagtccaacttaccagtcattactcataaggaatataaattcaaattcattttatttacttagagtagaatattataacttttttttatttgagacagagtctgactctgttgccgaggctgaagtgcagtggtgcgatctcggctcgctgcaacctccgcctcccaggtaccagcgattctcctgccttagcctcccaagtagctgggattacaggcgctcaccaccatgcccagctaatttttgtatttttagtagagacagggtttcatcatgttggccaggctggtcttgaactcctgacctcaagtgatctgcccgccttggcctcccaaagtgctgggattacaggcgtgagccaacacatccatcccattatgactatttttttttttttttttgagatggagtctcgctctgtcacccaggctggagtacagtggcatgatctcagctcactgcaacctctacctcccaggttcaagcaattctctgcctcagcctcttgagtagctgggattacaggcgcccaccaccatgcctggctaatttttttgtatttttagtagagatggggtttcaacatcttggctaggatggtctcgaactcctgaccttgcgatccacccgccttggccacccaaagtgctgggattataggtgtgagccaccgtgcccggcctccccattatgactattaaagagaatctgggctgtcacacaatttaagtgtatcatccatgaattaatgagaatatgccagagccacaatgacatctggtgtgagagaaggtagggaagttctacctacctaatctaacttcatagaagtaagccaacaaacgtcaccttctcttccatgcttctcaaaaagaagcccctgttcaccaaaatgagtaatttattatttccttgattcaatgcagaagcagtgtagttaagaaaacatgattttcaatgtcaaacaacttctctgaattaccacccaaactcaaagtgtagtaagctcaaaatgatagtttgaagtatcctatgcagtttccgtagtgcatagggaattttctgtacaccataggctttatcaaagaatagcataactgtgtttgaattaatgaggtattttgagtagtcaaaatagaggcctaaacttcccttcttttctccctgcttccttggatctctgcagcctgaaaacctgctcattgacctacggattccagtgcctcgagtgaagctcattgacttggaggatgctgtccagatctcgggtcacttccacattcaccacctgctggggaaccctgagtttgctgccccagaagtcattcaaggcatccccgtctccctggggacagacatctggagcatcggggttctgacatatgtcatgctgagtggggtctcccccttcttggatgagagcaaagaggagacatgtatcaacgtatgcagggtggatttcagcttcccccatgaatacttctgtggtgtgagcaatgctgccagagatttcatcaatgtgatcttacaggaagattttcggaggcggcccacagcagccacatgcttgcagcatccatggctgcagccccataatggcagctactctaagatccccctggacacctcccgcctagcatgcttcatagaacgtcgcaagcaccagaatgatgtgcggcctattcccaatgtcaagagctacattgtcaaccgggtgaaccaagggacgtagccatctcccagcccctatggtttcacatagacgtgcagtgtgaaccaaagcaagactgaatgtgactgtaaataattctgttcatcatttcactccgtgcagttctctgaattgagagatgtacctcttaaacctcgtcagtggttattcagggtctgagcagcagtaaaagtcaccctaaatcaaggggcttttcagaaggtcattctgaagaaataaagaggcaaagggtcacagaagtgttcagaagaagggcaaagataagaacaatattagctgttacgaaattttaactgtatcttccaaaatgagtggttaactgggcaaaccttaagctcacaagagtataaaagatctctggctttgctgaaattttaagcaagaagttctatttaatggagatgtcatgtatatcaactattctggtttagataacttagatatagtttcttaataggatagatacccacatacagtataatatatcccattcaggtttcagagttttctaatatagagatatatatattaaatcaatcacaagtaattttgagtgctccagttaagacagtaatttatttaccgaatcattacattgttttgactaagcacaattagatgacaagtttttttagagcattttatagatcttgtatagaaatcttttaccagaacctgtgcattaagagaaagcaatgttgcccttttgaatgagaaaattttttctgtcaatcgcaggttatttgattaagataggttctttctgtatatgaaacgctccccgcaaattcactggcagctcagaattattctggaaagaaagcctgccaggaaataaattcaaatacagtatgagctgcggggatatttttgtgtctacaccaggtttgaaataagtaaacaaatacaagaggttcatataaaagggcaaatgaaaacctttcctacagttcctatgaacaacgtaccaacactttctgatttcttctacagctgtagaataccatctttcagaaagttggctggctttatttctaactccttattgaagctaaggggtgcttactaaaaggaggcagccatataggccttttaaaggcctggttctaagtcctttttaaagccatggaacaaaacctgatacatcaccctaacagagcattaagttgtaactgagattgcaatacctgtcaccatgcagccgctgatagttctctgaactaaaaggactaattgtactttgaggccaatgctgctttctggtgtatattctccatacaagattattattaactgctctttttccctctggtggaaaaaaaattaaacctgggcatttcatgggttttctttctttatttttgttcatttgttttggagggagggagcttgttttttgtgtttgtacatgatccacccttagttttctagaatgtgtgttgaaaattgcgattatacaagtaagattttaaaaatgtaactcaagtgtttgttcaaatcaggtttaatggtgttgcttctctcctataatgggatagagaaaattaaaatcacgtagtacagaagtgcaagaagagaatttatgaaggatgaatagaactacaaacctatctaaatgaaaaagaaatggtggaaactaagcctgaactttaacatataaaaaacacttattcccacagagaaaatgtaaaattaaaaatcatcatctttttttttccattggtttcaaagacaacttcctcattcgccctccacctcatcccatccaagattatagattgataaattaatggaaagtataagcaataagactagatagcacttagtatttttgggattaaccaaatatatggaaaccgactccgactgtatttgtttcttaattttcaaatggccctgggtcataaagcctcactccctcagaggtctctcgactaacccctatagtcttcatttggacctttatgtatttacaaacactctatgatacaatacataaaaatttaaaacatacattaaacatggttactaaaatttttcaaaatgtaaaacatatttagtaaaaaaattttagtaaacatgttttcattgtgtttaaaaaatttaaaacatatttactaaaaatccttttagtaaacagtttactaaaaccctttcaataaacatgtcttcattatggtatacagcataaaagaggaaagcctgagccgggcgcggcggctcacgcctgtgatcccagcactttgggaggccgaggcgggtggatcacaaggtcagcagttcgagaccagcctgactaacatggtgaaaccctgtctccactaaaaatacaaaaaaatcatctgggcgtagtggcgggcactcgtaatcccagcgacttgggaggctgaggcaggagaatcgcttgaaaccggaaggcggaggttgccgtgagccgagattgcaccactgcactctagcctgggcaataagagcaaaattctgtctcgaaaaaaaaggaaagcctggcccatagggtttgtcatgggacaaactgtaggctctgaggattcccaatatccataaagtccagcttggcaagttctgttctgtccactgtggatgacctgaatcaagatccccctgctgagccattctgagtttttataacaagttgagtttctgcttgagaaggccagggcccagaacaatggtgtgcagaccacggcaggtgggggacaaggagggtatttttgaaattatgttatgggggcagttgacagaatgttagacagaccccaagctttcatatcagcttttacaacagagttgggaggatccagatgtggggttgcatggaattcccccaagtacacatatttgggaagtgagaagacaggaaaggagggacctagaaatgaaaagtaggatgattttgttaactggagccaaggtacaatcattagactagaatgaacttaatagaggccccaagagaaagggggtatattttatatagtttgataacggagggaaactaacagggaggctccctgtctgcaaagctcctggtccctcccaacagagataagagagtagtcttggttcaagagttctccacagcaagttggaaataacaaggaatcccagatgatgatgatcctggggaatgtactttaggttgctctgagggcaaccgtgcttagggaaaaaggatcaggggccactcttgttcctgttttggcggagagatttattacttggtagtaaagaagagaggagagaagagaaaatggtccatttctatcattatgatggtagttcacagtgggagtgaactttcagctgaaatgggaaaaacaaacaatggtcaaggtcacaagtttcttgcttggcttttattcattgcatagggttttgagctttttgttttgttttgttttgtaagggtgggatacagaaagaatgaaaagatcagggacaacccataataacttttaagaagtattaatataatgatttcctacatcttttacatttgtttcaaattaaatagatatatatccacttacagctgaatgtggtaaaatttttaagaaaaaaatggtaatgttggagatatccttcaggtctctctcagccataaacaatgtaagggggagtagaggaagcagaggagaaagctagcttcactgctttgtggtccacaaagcctttataaatagtagtgcctttcagaggggaggatgggagataaagaagttcattgcatttagatgtactgatattgcagcattttttctttactttaaaatatcttgtaaatgaaaacatctgaatataggggtgggaccaggaatgtttgagtttcaatctcagctattcctgattcatcttttcttacagaaagtctttgtttttccttccccaaatgtccccattggtaaaatgggagttgggggatggggaaggagggaggacattaatcttacaggaatgttgagaaataaccttggtggggacatctataaaatactttgatttttttaagtgctacacactgccagtgctaagaattttattgatagtaactttgaacattccaggttttcaatattcacgtctttagataccaattataaactcatgagattaaattctgtaaattgttttcagttggaagtatcaggtgctctttgtctaaatgttatttggtcttagcctataatttcgatcatttaagagcttgtctaccgaaaagggttaggagagctgatgaagtcttatgtccataagttgttttctccagtatttcttatggcagatgcgaagagtaaaatgcccttgaaagcaactgctaccttccttctcaagctttatgctctggaaaaaaggacagagaagaacccaacaaccactttcttcacttgggagggcagaagtgagaagaaaatatcttctcataccacaatttatttttcacagcctcacaggaatctaagagacaaattaaatgcacaggcaaattaaatgcatagaaatgaattggactgctcatttttggaggacaaaccttgaatctttttttttttttttaggtggttaggtcttttaggagttgcatatttgctatcccataacctccatgattagagcccacgagttaggcattacttttttcttgcctctgtggaagagcatggcaatttagatttgtgagaatatgagggagcaaatatgatataaactaaattttgcattaactaaaactttgtcccatgcatttaatacaggaggaaattattttgtacgtaagaggtctttgtagtagggcaaagttcaaactcaccatgtccttattcagtatggtcaatgaattgtgctggatgagtttcgaggaatgtagaccttcttcctttctctcctgggtcgcacctctgtggagtctgggttagacaaatgcaatatgtgacctttcagtgaatttatttataaaactgcaccttgatttttcctcactatttaaagcctagggatgatttgatgatgaatgattaaacccatggtgggcttagagacgacagagctcacacacgctccatcaagaaaaggaaagctactatgttaatatttattttctaaaaatattaaggctctcagttgtttcattaattctaaagggttaaaaagggctgaaatttgtttatagcactaaatgtttttaataggaaatttactcacataaaaaatttaagcagaagtagtagaatacagattatcataaaacatattttctatgaaaggcatttcttcctcatcttcaataaatatgaagaagttagaggagaggaaaaagcaatcactctaagacaacttttcgtctttgagggacattatgataagcctgaaattaatacgcacaggctattgcatttttctgtgagaaatgtgcccctttgctgtgagattctaaaatgtgttcagatttagtttttattcaaatgatcaagataacgcattagttagataactgctatttcagatagtgaggttagctgagaaaaggaagcatggtagaagaaatgcaaataacaattcttggaatgccaactcctgaggcttagtttaaccaagctaatttgttggcccagggatggccatcatatgagtttccatcaatacctgacttccatcaacaactgaatccatgttctggagtattacagagactgttactatgacctcaaagactgtggctacgaatctgaagttaacaagacatacatcttctcttactaacttaagccatatctgtcaactctatgtttgatttttctgaccctggtgcttttacttctgtttctgccaaacttcagcctactctatggggaaggtgagtaaaactagtagttagaacaaatatgaagactgaaaaaaactaaacatactcttcataatgagatcctgttcagagaacagtagtgatcaaagtgcaaactgttggaaaatatggatatatgtacatctgtacatgtatatagtgtataatatgtatgtatatgttattgctcatatgcagaaatctatccatttgcagacagcccaggtgggtcaatgtttctaatggaaaaccatttagggccattcaaaaccattagggctaatttgtggagacgaattctactcattctggaattaatttgctgtcttttgacatccacaaagccaaactaacaaagtgtgaaacataaaggggccatcatttagtttattctgtttatctggacttataactatctttacatttgaactattaatagttgatttgcaaactgtattggcatctcttggttttgagtgacccctgcccccctcaagtcttttgagaatttggagtgggcttcactggccattcagacaaagggccttattcataagtggacaggtttccccatagggaccatcgcacatatacatataagtacatacttccatcaggcttgtaacaattgatttaaaatcactccacagtattgataaatagctctatattttcaaggtgcagaagaattccacagccttaattatttcagtgtcttgctggtctgccttaagtgtatcttctgggtttttggttattttattatttttaaatttttctgctgttgttcattttgtatgcacacaatgtcgttttgtaaaggtaggttgtaaatattttatttgtaagtcaaaatcactcatgtgtaatgttgtaaagtgatgacctgctgtcttgttactgctacagtaaatgttataagttatggatgaaacttcaaaatgtacatctcacatgttatgcattcctataaatatactatactaaagatactatatggttgtctcttttttcctaattaaacctttgttcaaagaaaagagtaatttttttctttctccaaatatatgaaagacttagaaaaggtaaaaatatcacaggattattacaacatgtttggcccaggattttagagagaaagcaacaattttgtgccctagagtattctaaggcatttacccaaaaatgccaaggaaacctcagagccaggtgtggtggctagcacctgtaaatcctaacactttgaaaggccaaagtggaaggatctcttgagcccaggagtttgacaccagcctggacaaaataaggagacacccacgtccccccaaccccccacatattaaaaattgttttaaaaatattaactgagtgtgttggtgcatgcctgtgatcccatctacttgggaggctgaggtggaagcatcatctgaacccgggaggtagaagctacagtgagctgtgattatgctacctcactctagcctgggcaacaaagtgagaccagaccctatctcaaaaaaaaaaaaaaaaaaaaaaaaaaaaaaaaaaaaaagcctcgggttgttgttaatttcatactggtatttcaggtgataatgttgttagactgtctggagggtattttgggctggatctcacaagtttatacattctggtgtggactccagcaatttgggttagcctatacagatatgatcaggctttgaaagtttaaatgtgccacccacgtgcaaatgaggctgattcatggtatactgtcaattagccagagtgttaaagtgttttgattagcttattttgccaagaaaacaaaaacatgttttaacatttggcttctatttcattaagattttattgcatttatttgtaatgagaaacacttgtcaaaagcatgggctcttcacattggctcatcagcacaatctcctgagaaaatatagataataaagaatattagaaatgaaatcagaatcaggtttatgagttaaaatcataagccccttatgggctttttttttatctagaatttgtatgtattttagcacctatatagcttatgaagcccatttgtaattaatatttcatttaatcccaacaaattcttatgaagtaagttattttacttggattagagaaaactgagtcacagaatctaggtgattgttcaaggtcactgagacattcactggaagataactttttttttttttttggcacagggtctcactctgtcactcaggctggactgcagtggcatgatcacagttcactgtggcctcaacctcccaggctcaagtgatattcctgcctcagcctccccagtagctgggaccacaagtgtgtgccatgatgtctggctaattttttttattttttgaagagacagagtctcatcatgttacccaggctggtctcaaactcctgggcttcccatctctgcctcccaaagtgctgggattgcaggcatgagccactgacctggccctagaacataacttaaaataaatgtgtatgtgtgtgtttcagtgtctctgtgtgtgtatagtgtaggtcaaacaataataaataattaaataacagtacctcagcctatatttttttgaaggggagtggttcagaggaatcaccaatatagttatggaatattagcaaaagccctaatacaaatgataatcagaaccccacaagctcagtctaaaatagatatcagagtagaatacagaagggattcagtaagcaatatagagctaggtccatgaaaaggctcagattgaactactgcatgaaattttacattcatggaaactctttagggtaaatacctaaaatagtaagactaaatattggttaaagccaagatcctttacccagcctaagtaaatgaaatggagaacacaaaatgaattggtacaatctatgttcctctgcttttttttttgttgttgttgttgtttgtttgtttgtttgttgttgttgagacagagtctctgttgcccaggctggagtgtagtggcatgatcttggctcactgcaacctccaccccctcggggttcaagcaattctcctgcctcagcctcccaagtagctgggactataggcatgtgctactatgcccggctaatttttgtattttttggtagagacggggtttcatcatgttgactgggctggtctcgaactctcaacctcaggtgatccacttccctcggcctcccaaagtactgggattacaggcatgagccaccacactcagctctaccaactttttatcaagtgtttttgagtgaactatcttattgaatcttcatagtgatttttggagaaagttaatattattatcttcattctttttttttttttttgagcgcagtctggctctttcgcccagcctggagtgcagtgatgcgatctcggctcactgcaagctttgcctcccgggttcacaccattctcctgcctcagcctcccgagtagctgggactacaggcgcctaccaccatgcccagctaatttttttgtatttttagtagagacggggtttcaccatgttagccaagatggtcttgatctcctgacctcgtgatccgcccgcctcagcctcccaaagtgctgggattacaggcgtgagccaccgcgcccggcttcttcattctatttttgagaaaattgagactcatatagctcaaaatgcattgccaaagatcactcagccagtaagtagaatgggactaaaatccaaatgttttggtttgaaacttcatgttctttgtagtgcactatacagctatgccttatctgttcctcttttttaaaaaagtatttgttatagttgacacatgatatcgtacacatttattgggtacatagtgctatttcaatacacacaatgtacagtgatcaaatcagagtaattcatatattcctcaccttaaatatttatcctttctttgtgttgggaacattcaaacgcccctcttctagctattttaaaatatatagtaaattattattgactacagtcaccctacagtgcaatggaacactaggacttattcctcctatctagctgtaatttgtgtcctttaaccaccccctacccttcccagcctctagtgattactattttattctctagctccatgagatcaacttttttagcttctgcatatgagcgagaacatttggtatttatcttcctgttcctggcttgtttcactaacataatgtccttcaggttcatccaccttgctgcaaatgacaaggtttcattctttatgtgaatttaagggttattttccttaagctagaataaagtattgccttatatacacaatggagaagggatttatttgtacagattatttattgattatttctttaagggatttatttgtaaagaccaaatatgtttggattttcagattgtctagcaatattatcctcctggataaccctgataccaatcaattaaccgtcttctaactctcctccttccctcccttaccttttctacacctattacctaagcatttgaggtacgccaaaggaaataaaaaagtactcctccaggaagcagagtacagacaaaagaggtaatgaatactgtaatgatctaagtgctatatattcctatgtgcaaactgctatggaactgtcacgtactagatgctatgaagttaataaaagaattgagtaaaggtccctgtctttgataacttatattctatttggagaaacatggggggtaaatcttggctaataactagcaaatataacatgttaggccaaggagtagagataattaagagaactagtcgagaaggcattggctattaaaaaatggacaggatttatgcaaactctcatgaaaggtgggacttcatgatcctacagtcaatctagctgttctgggctttgaaccccagcgaccccatccagaagaaaccaggagaagcacaaactggcgctaggttcgctaccatccacctgacccttgagcccggggaaacccacgggtgcagcaagccgggaaagctgcagacgaggcaggcggaagaggcgggacttcgcgggtgacgtcatcggggcgccggaggcccggggcgcctgggaatttgaagcaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggtgctggcctaggaagggaaaggacagggcttggtggcgggaaggaggacaaggaaatggaagagggtgacaggagttgggccgtgagtgagagcaaaagagccaagcaggcagaccgaccctactcttggtttggggagtaagcatgagaagcacagaggccaggggttgggctcctcgagagtcgtctgttctttcacccacacgcttagacacgtgttttgcaaaagtcgggaaacccagtttggaacgctttctggcactgaagcacacttgaatgaattctgtatatttaactctttaagaaaattagacttgcggccgggcgtggtgcctcatgagagtaataccagcactttgggatgcctaagtgggcagatcacctgagccccaggagttcgagaccagcctgggcaacatgacgagaccccgtctctacaaaaaattagctgggtgtggtggcgcacgcctgggacgctgaggtgggaggatcacctgagcctgggaggtcaaggctgcaatgagctgtcattgcgccactgcactccagcctgggcgacaa

SEQ ID NO: 295 - DNA, 233324 bp, Homo sapiens
caacccttaaaaaagcaaattcagaaaatagagagaacccttcaaattcagaaagctcatggtgaccacatggcttcctctagaaataattctgtatctggactatcagtcaaatcaaaaaataataccaaacaaaagcttcctgtgaaaagccactcagaatgtggaatcatagaaaaagcaacgtcaccaaaagaactgggctgtgacaggcaatccgaagagcaaatgaagaattctgttcagactcccgttgaaaactccaccaacagtcagcaccaggtcaaagaagctttacctgtgtcactcccccagattccttgtctgtcttcctttaaaatccatcagccatacacgttgacttttgctgaattggtagaggattatgaacattatattaaagaggggttagagaaacctgtggaaatcatcaggcactacacaggccctggggatcagactgtgaatcctcaaaatggttttgtgagaaataaagttattgaacagagagtccctgtgttggcaagtagtagccaatctggagactctgagagtgacagtgattcttacagctcaagaacctcttcccagagcaaaggaaataagtcatacttggaaggctcttctgataatcagctgaaagactctgaatctacgcctgtggatgatcgtatttctttggaacaaccaccaaatggaagtgacacccccaatccagagaaatatcaagaatcacctggaatccagatgaagacaagacttaaagagggggctagccagagagctaagcagagccggagaaacctacccaggcggtcttccttcagattgcagactgaagcccaggaagatgattggtatgactgtcatagggaaatacgtctgagtttttctgatacctatcaggattatgaggagtactggagagcttactacagggcatggcaagaatattatgctgccgcttctcattcatattattggaatgctcagagacatccaagttggatggcagcttatcacatgaataccatttatctacaagaaatgatgcatagtaaccagtgattataggatatacctgagaccatcaggaactgtcaacaaatgatacctttggatatccatcctcctcgacttatagtacagtggtgtatagtggcatttctgataaacttgaaaagacttgagtctttccactgggacacatccatttttcagattgttttgatttaggccaggtatattatcttcatttttaagagtttctttaagaaacttcatcagattgttgaaagataatttttgggacatagagctgaaagtttcagggtgccattttctataagatcttcccaaaagaaacatttaaaaagatgacatataccaccacttacttaaaaacaataaaagcaatagatttgattagtaatattattgctgtggagttctttacaaagggcttaggctgcatttccttctatagaggtgcattcttgtagaaatttgtagcatggtagatcagaaaatcctcttaggttttaggcaggaaggaatatttaaacattgctttagattttcctaaaggtatttgatttgatctgttagcttccagtaaaaatatttgtttttagtaaaaacaaatttaaatatatttacatgtttgttgtttatcttttgaatgtcttttgaggctgtgaaagctgtccacatttttgctgtgtattaaatagctgtgggtcatcagttgctgtcttacttgtgttgctcagatagaggagcagctcttaatcttttttggttcttggatccttttatgaatcagctgatagctatagattgacttcaggaaatttctcattccataagcacagaattgtgagtgtaatttcaaggggttcatagaccctctgaagttcatctatacagtccagattaacaagtgacctgctctgctggtaggctaggggaagttctagctcttagttttaagtattttgtggaagctggaattgattctcttcagacacttcttagtacatcctaattttgtgtcttctagaaaattttccccagtttttacctctaatgttaggatccaagaggagcttggatctgagctgatgcatctgtaaattacgatttagaaaaatataattggaaattacatattctttgcttttttcctctggaaatccttttatgattaagcttttggttcccaagcctttctgtgaactggattttttatgagagaaccacttgtgtagagagatgtgtattcactttttaaaaggaaagctcttctttcctgtgtacatacttgtctaggtagtataaacactttccccagggctgtcagcaaacacccacagccattgtcatttattgtccaacacctacataacacaattctaaaatcctacttaacttggattcctgtcatttggattgggcaatattaggcttttcttacatgtgtcagtatgtgaattaattaataatgtagatagcaaatccataattaggtccagtatgtcattaagaagtagagattttaattacacatttaaataagatcctgtcattgatatataattgaatttactttttccatcctttcccccacaatacagccaagttcagtttgtcattgctgggggattttaattagggtactgcctcatcttaattagagacgaggttacccattagtcttcagagtaattggattctctattttgtgcttgcttttttttccccacaaaaataagctggaggtaagcatatgtataacatacaaaaatactaattgcttcaatttccataagcatttaccaggaaaatggcagctgccaccttctcaactaacaggtagctatagttgtggatgtggaagggatcttccacatactgctatttgtgtgtgactcacctttgtgtggaaaaaaattttttttttgattgtcagtctaggtgcatctttccatcatctgttaggaaccatagagaggtttacagtagattcacttgagaaggctctgtggtggtgtgaaaaaggtacttgtcctggttgatactgctactacctactttttaaccttgtaccagtcatttaacctctcatggtccagttttcccatcaataaaatgaaagttggactagaagatttttaggatcccttctagttctatgattatatgacatatgctgaagaaaaaatagtttctagttcaggaaaaggataatcaaatttataaatacagaaagcctttataaattcaagtaatttggacgaaggctgatgtgaattggttaaatgtctgaatttgtgaatacttgtaaatcattaacactgcaactattcacgttaagctgtaacttgaattaggctagcaatattaacatgtagcgagatatttgagaaacctgctactttgaataattctgacttagaatatgaattattttggatgactaaaggtaatattttctaaagtagcttaggtattacagtaatacttattaaccttttaaaatgtggtttaaaggcaaagttcagcccctgaatactaaaaataattgaacatacagtacttgcggatcactctgtatgagacaaagggagtagtatgaagttttatgtttttttcccccttaaatgaaatctacattagtcttttaaaaatatgtatttttgataaccctagctgacagaactccatcgcaaggttattgacttattttggcagaatgtgtttattattttgtacctctgtacacaagcacgtatgtctcacttgacattcagtgcgtcttaatgaaaaagaacacaaattgctcaatgcatatctggtttccagttatttctacccgaagattatttggtctgtgggtctgcagtgacacctagtgggtgataaggatgtgagcatcaatgattaaaatgaatttcacagctaatttctaaggtctttgggcatcatgtatttgttttagtgttccatttctattactgttttcatcaattggatctagttgtggggaaattaaaaggattctcctcattgccaacggtgaaacagactgccggttggtcttatcacctaagtcagaattgttaagtttggaacagatttccaagataactaatccaatccccattttttgttgtttgtttttttagagatgagggtcttattatgttccctaggctggacttgaactcctgggctcaagggatcctcctaccttagcctcccaagtaactggaactacaggcacatgccactatgctctaattctccatttttaacaggaggaaactaactgaagccaagagggagttactgatgggaagtcacaattcagtgctagaacctaaacttgaatctccaccatctgattcccaagctttctacaataccccacagaacatttaattctgagttttctttttaatttgagaacttggtactcagtaaaaccagtactgatacataaagtcagattttctttcaataatatggggtcagtgttcaaaatagagccgttgatagataaaatcgaatgctttacctgttagcgaacatccacaaatacagcatacaagcaggcaagaaccatcagcgatatcatagaggagttgtttatgtttacattgagggatggagtgggaagattactctaggcctttaataacccttctaagattctgtgagttttctctagcaaggtagaaagccaatctgtgttcaaattattctattttctagcatataccagcacctttgggaggaaaggagaatcagtattcaaagaaacagtcattttagggtttgtggcacataatttgtttaatccagattggatacatcaggtacagcagtggcacacgactcaatactgtaaatgatatacatgttttaacatatgcactacagtttcaaaagaagacgacaggaaactcaagggtgttttttttttttcatagaaagttttcatgttttatcttcctgcagttttgtacagtatatttcttctttgccattgtgatgttgataagcaaagcccatttattatacgaaaatagaaaagaacacacttgatgtatctcacgatgacattaatggggggaagggtgtgacctctaaggaaaacattacattggaatgtctgattatcaaaaatataccatccctcccacctcccaggtttgtaaaatagtccattggtccaaggagccccccaggacttgggtcagtgccgtacactggttagagtgacatcatccagtgtagttgagtaacctgctaagataaatgtcattcccacacttgagaaaaaacacagaacattctgaatagaaaacaagacttaaaaggaacccctttaaagctgtttcattttctgatagccactttctcttagttttaatgatgctcttcatggtgctgtttgggctccgagggtcatgggtcataacaatgtttttccttcatctagtcattttaaagctttgcaaataatgagatttcattaggaaatcagaaagagaaaataaaagtttgtcatggttaccatgccaagtagtgtagaaaggaaatgaatattgccttaagttcacagcattgggatatttttgccttatagttacctggtaattgaagtgggagactggaaaactggaattctttagtaacctcgaaatctagtgttagctcaattttcaaccacttcctctgcaaaacttaaggaaaaactcttaagtacataatgtcccaatgtacattttccttgtctacaatctaataagtgatatcctgaactgtaggaatcatattttgaaaactggataaaatcatcagcatatccacaagttgacatttttgttaattatagatcggcattaactgtcaactttaagttctgttcaaattctgtgtgattgtaaactaatgtgttcaactgtcactgagaatatctattggtcttttgaaagggagtctatgcagttagtcctgagcttggcactagttatgaaaataggagatgaaggagaaatagtacagagtttgtttccagagatcttggttcacggtggttctgaattgaatacttccctcccccacgtcaccaccctggaaatccaggtatgaaaaatataagcaagcctcagagcagtgcaatataatgtggaggaaaaatcctaggacaagatgtcttaagtcctggattgcaataatggttctgccactaacttgtcatgtgaacttggataagtcgttcagtttctttccacatgttttcccctctctgaatcaaggatttagctactttacctactaccatcacagactgtcataagaaccacaaggagtataaaaggtatgcttcaaaatgtcactgtcctagtcttctcttcattgagaagagaaaatatttgactaaaaaaaattgactcttcacttgttcactgatttctgacaaaattgatagtccatagatgtttctacccagagaatggtggtttccaaagtatggtttgtattggtacagtcaggtgatttccaagggctgtgtccaagtagtattgacatatacgtattgacatataagactatgtctccaattacagtatggattctttgatggatcttctccaaagcatcactgctctcagaggcagtgggtgtggtagaaaatgcattagactaatagccaaaagactcgtgttctggtctcagatctgtcattaaataactgcatgaccttgaacaagtcatttaatttctctgggtctcagttttctatactgtaaaatgaattagatattcttaaatcttttctagttctgatatgctcttaatactacattttctaggttcacattcatttgacatttgaatgtaactgttaggttggttggttggtttgtttttccctccccctcttaatgctgagtgggactgaatggaataggtggttttgggaatattttattatgtcaaagtggttcatgaactatgaaagctcaagggtcatggctattggcccccagaaaatcctgatatcctggtttttcagtcactggccaatgagttagacttatgaaaccaattcagcatactttggaccttgtgttttcttacagtaccctttagcagtgtcatctggctgtgttctgtagtgtagatgagccattttccaaacgttgacattttttggaccagaagtgagctggatcttttctctggctaaggctacagtggaggatggaggaaaaggggatggtctaatggtcttttaggaagtggcatgacgtgggctctgaacgtgaagtggaaggaacacaaaacattctgttgattaggaccaataaaaaaacatgggaaattgcttgggacatgatatttaacatttattaatttttgtgggaaccagtaaaatgttcccttggtgccctatcaaacagatcctttgttgaatctgtcactattctaaccctgtaatgatctgttcttaaattcatcacaggaagtttgtatgtgtgtgcaaccagttctaatttacctcctttttttttttcttttcttttttttttttttgagacggagtcttgctgtgtcacctgggctggagtgcagtggtgcaatcacggctcactgcaacctctgcctcctgggtttaagcaatcctccccctcagccttccaagtagctgggattacaggggtccaccaccatgcctggctaatttttgtatttttagtagagatggggtttcaccatgttggccaagttggtcttcaactcctgacttcaggtgatctgttcacctcggcttcccaaagtgctgggattacagatgtgagccaccgcgcccagccctatttacctctttatctcttaccccagtcagatcttatgaagcataactaagatacttagacactcataattttgctctagtactcattttttttaagagaaaaattcttttctagtcctttgcccgccctctaagtgaagtttagcttggtcttctaatgagatgtgtatatgaagtgaattgatttaagtatgtattctctgatgtgtttaggttggttgtgtgtatacacatgtactctgtagttgtaaagcttttctgccttcttagtctgtaagctcagagggcaagaaccactccattcccacattaggggacccagagaaagaactcagcccatggtcaatgaggataagcataaagagataaagacagaaagaaggctccctctcctctgccttctgcccacattctggttaggtgccacctcgaaaccttttgaacctacagggtcaatcgagctggggtcatagggaagcccacgaagggtgtttttaggttcctggctagtaaaactcatttagatggctgtggtggggagagaaattcttggcctacaattaaacagctaaccactaagctgtaggatggataggcagctcccgaggagctcatgtatttcagagcccaggctacagagactgcagcaaggtggctgggtgttgggaagggcaggaaaggacttgtcactaaccctgaggcccacctactctgctacaagcagtgaacaatggttaggaggattccagaaatgctgcccccagctccaccagggtgcaagctagttgaatagatatgttgtccaggtgttcaagaaataatcttcactcctttgcttgcacagaggtgatgaggcttctcccccatttcagcatcttcagggagatcaggccgaagcctcttcagacatcaaggcatctttcatagcaggtaagaatcatctagaatctcttacttgcttttgctttgaagcatttttcttgaggcacacaggcttacccttccacagcctctgtgtgggagttgcctctggtttgatataagtcagaggaatcttggtccccgtaccactgccctctctggagaaaactactcccggggcctcttggaagggctctggatgggctttatggtgggtcttgaaggaagggtccatagcaaggtgccctaatgaccggctgaggctgcgagccctgggtccttccgttctcccctcactggcacataccagagttgaccgcgtctcaggtgttggcgatttgccttttcaagattccagtgtgataaatctgttcattccctttctttcccagaaactgaaactgcaaacacgagtggttccaaccccaagggaagtacctctgttctgtgaggtagacttcccttacccctaaactctcccaatttttgcttcactctttcctcctctgcagttgcattcacacagatagaactcccaggcacaagtctgttgtgcgtggcagtgatgaagaaggctttactgatgtgtttcaggatcattgggatccaggtagagacagatggctggacacagaaacagctaggggtaagcagagaggtacagagacaagggagacagggacagacaaagggtaaggattgccgtgtggtcacttggcagctctgcacaggtcagctgggcagtgggggcccaggctcagttgacctcacccacctgggggaatggagagagaactcagcaataactgacttcttagcctaaaagcttttgctataaaaggagaaaaaaaaatccctcacaaaatgcattgttttggttcaaaggtgttgggtccatggagaaaaacatttcacaaaaatccgttggtgtttttgttttccaccttttcccatgaataaatattatccattaagagccttgaaaaaggtgcttaaatacacagtgttatattttcttcctgttttgcttgtgacaacttggcctctttgctgctcttggtcttgtattttcctcactggggtctccagaaacgactgttatttggtctgagtctgaggctcctccatccaggccctgtcctggcacatagcctatatcccccggcctatccccgacccccccaccctccctcccttcctctggccccagtgagatgcagtatcacagggctatgtccacgctagcagcgtgaacctcaggtgcccctttgctacctctttttccttccaggcacaagtctcagtgctaggggtacaatggggcaggcagaaatagtggggaaaggggggagggagtggtctcagtgaccacccaccaacatgccagtccccttcattccccactacccactctggccctctgtccagtggttttacaaggcggagaccttgacaacattgctggctatggaaggaatgttcgtgttggggcctgggctggcagggggtggccgactttccccctctggggttagcgctgggggagtggggatgctgatgatggctgtggtgatctgggatgttttgcagtttggtctcagtccgtcgtctgctttcaaattaaggctggagcgactgggatagaaaagagtgagttgatgatggttcctgctggccagcgtcccaaagcttccttgaccccctacatttcttgctcgtggtaactaggaggatattttgttgtgcctctatctctgccttttgtaatcaacttgtaattatccattctaattattattcccaaactaccagaaattaccaagttgtatatagtaggctttgaattgcagaatgtacatcacccccaccagtgattgtatatctatcatttgtggcatttggcatttgcattccctgaattctctgcaacgcatttggaggtagtgggaagtggcctaaatataagcagagggggagggaaaagtcagtctctgggattcaaatcagcctaggataagccatgagtaacacagatacgaaaactgtttcttgagaaaatggttggtccattccttgtaccagatcaggtcatttttgtgtatctagagacacattattttatatgtatatatataattatttttaaagtttttttttttccctgttacctattttcagcctaaactgctatagtacctactccaacagcatatgaagggcctttgggtttccttgcaaggaaaggaggaaggtagaggggctcatgcattagataaggggagcggctagaggatcctcaaggttctcctaatgctgcaattgtctaattctgtgaatgggatgattcgagcctttgcgggtgatgggatggaagccacccacctggttgtgagggagggctgctcactgccctggatgtggatcgtgctgagctcttgcatgctgcgcaggcgagtagctggcaggttagaattgggcaggtgtgtggtcttcttactacgacgggagcagcaggtggtagtgaggcctgggtggctggacagtgagggacttcttgtggatgggtagttctgcattgaactctccatgcagttctgctcaaacatctgctcatcaataaactcgtggttctgcgggaggcagaaggagaagaagtaggaaaaggaggtagggaggagagaggtaagcccctatactctgtatggctgcctgtctctgttctggaccttgaaggaagggctcccagctgcccggatcacagataagcattcaggaggggtgatgtcccatgggcatccaatgaggacagaaagagaatcatattggcagccctggccatcagttcaaagggtagggactgcagttgtgaaatcatgatgtgacatatacttcacctacagctttgagctgaagggacatagaggacacagaggaattcaatggcatcatcacagctagaggcaaagactttactttccaggctttgtacaagatctgccagaggtggcagataaggagtcactgactgtgggaagtgggtatgctaggttgtctttcctggatttaataggtaagggtatgacaaaaacttttaaacatgggggtcattcacagaattgggagagcactgatcctgaaggccagtgggcaaactgtcacggatagggtttcttttaattatttttttccccacctgattatgggatatgagtccttaatatacctggaggcacaggattccctaggtcaagtgtaagcatgggaagggattgctaactgtctcctgactggaggccattgggatggggtatagctgaacccaggataactaaaaaatggctgtttggccaagttgactacaaatctatggcattgatggtctggctaaggctgccagagtgaggagaaagtctgaagagaagtggcatgaaaacagagttcagggaaagaccagcctggcggcaaataccaggagtccccacggagctgggatgtggcacagacagatgtggcacttggagactaacaggataccagcactggtgccatgttccaccaccccttccacgcccctggggagttccaaagagggaactagaaagacagttgggtggttcagcgcaagaaactggaagcctgagctggtgctgggtgtgacagcagaggtaggaggagccccagaagaatcagcagcacatgcacagaaccaggccggggggtaaaaaggggagaatccacagactcagaattatcagagagaaaaacatcaattgaatttttaaaaagttataccttgatggtggaggttcgtacagataacaggggatcatccacaagataggacaacccctacaggacaacatgccaacagaagataaaaacaccattgattgtacattccagcattcccaagccagttttgacattcaatctcttgatcccggcattccaccctttgagtcaaacattccacccctcattcccagcattctgcccccttcctcccaacattccaccctttagccccaacaggaccctgctcaaccccaacattcattccttctatcccaacattctgcctctcctgtcctgacattccaccccttaagtccaacattcctcccctaaaatccagcattccagagctttaatcccaatatctcacccccacaatccaacattctttccctcaaattcagcattccatcccttcaatgccagcattccatccctcaattctaaaatctcatttctttaatgccaacattccagcccttcaaacccaaatattttcacccatatcctttcaatttacacattccacccagcacatgcaacttggaaagggcagttgggtccgggcctatccctttggcaagctcagagtctttgagagaaagtctatacatgaatatatgtttttgatgataaatcctgtaactagggtttgcagagcaccttcccattttggaagtaattattgggttcaactgtcatccacagggtccacatttggctcagatagagtcatcgaagccaggcatggtggtctgtacctgtagttccaactacttgggaggctgaggtgggaggatcacttgaggccaggagttttaagaccagcctgggcaacatagcaagatcctgtccctgcagccccacacccccctccccaccaaaaaaaaaggagtcatctaacatttattctctctacatctgggaggccaggatatggaacatctagaattaggaagttccttccttagggtactgagccctgactatagactctttggggaggaggttctggaaaggagcaggaaggctttcactttgtttctccttggcttttctactctgacctctcttccctgtctactattcctagcagtttctgccaagggtccagggttggccccactgcccttcctttcagtctgatggttaggcacaagcatcattccacactccagctgtggcaccctaaaccatggctctgttttaacaatcagcctgttagcatctggactccctgagaaccacagggtgactgggcaggggtgggggtgggggggcggtacttctgaatcctagttggagaaatacatgcactacctccttcacacgctgtctgcaggaggatgtagggagccaaggggcccacaggctgcatcaacccagccccagaggtgggacagaaatcaacactcttctctactctcctacacaaattcagcccaagctttgaagggtgatgcctgtcagaactgagaaactgataggcagacccctaagtcctcaataatcaagaaatgggctgtggagacgagtgtaggagtgtgtgggaggctgggggaatggcctcctcaatgctcctgcaggacagagctggtctcccaccctggtgaccttgccccactcctcagggtcttccacctgagggccagtagatcccatcactaccttttggatctgaaggggacagactttgacttctggcccagagtgaagatgtgagtacagccttagaaaagggtcagggtcagcgatgaaaaggaggtggcaaagggctgggactcacagtggttttttccaggcagtgcagcaggtgatgatgctggctctcgatgagtgaggtggtcttgcccatgtgctcctcttctggggtgccctagtaaaaaaagaagagagattgagtaaaaagctggtggctcttcccctctccagctccttcatttctccactaaaggtcaaagggcaatagaataatcaaatttttttttatttgaccaaatttcagggtcagcattgaatatgctaacctttgggctcaggggcccttggtctaaacctggtttagaggtagtggtgataatcctatggaagtggtgtgtgaatggggggctgctacctggggaaagtttggaaacgtgtcctccttggggttcatactggggctctggtgagagtgctggtgtcccgggaaagagaaaacaagcccatctacccctttatgttccctagcccaggtcctctaggcacctaccgtcagctccagcgcctcgttgaggagcccgttgcgcttgctgtgcaggtatgcattcgaactgcctgttttggccacacggatcctggcaaggcgggccttctgtgattggcagagataataaaagaatgaggcagaccatgatacaaaaagacagcaaggctggtgaagctgtgaggctggcttcccaggtgacacctgatgaaggggatgaggctgtttctctccaacctcatgcatctccagttgtgtacccactttgtatagcttggttgggtcagaattcccaggagtctccactcatctctccagcccgggtataatcctggcaggagaaatatcactcatccaagctctcttctcccaaaggtttcatgacctttatctactcagtattgcaaaatgccatgtgctattcagttgtgctcctcagttttcttatctctaactaaattgcaaactccttagaggagtgtatgtgatagctgccctgattctcctctagggtccagtacaattttctgcatatagtaggtccccaagtattagttaattatgagaaaagcaaggagtgggcctatgtgctcttcaatgcttcttaactcctctgcaatttttttctttgcacgtattactaaggaaatatatgttttatatatttttcttgatactttctctttctcttccactaaaatgtaaattccttgagggcaggagtttttgccttgtttactgatgtacccccagtaaacagtaggttctcgatttttaaagttaataaacacatttacaattgtatatctgtctttgggagtagattcatgcatgtatatggtttttttatttttttgagacggagtctcgctgtcacccaggctggtgtgcagtagcgtgatctcggctcactgcaacctctgcctcctgggttcaagcaattctcctgcctcagcctcctgagtagctgggattacaggcacccaccaacacactcagctaattttgtatttttagtagagatggggtttcaccatgtatcaccatgttgataccatgcaggagggctgcatggtatcaagctcatctctcctgcttgcacagggagaagctgaacacattacatatgctggctgcccttctccttcctaatgactgtaatcattgtcactatgacagtagcacagccaaagagagaggactaaggaatgagactgagagagggagaagggactgggtagaggtttcttgctagtttaaaaaaatgcagcttgaggtttgggctctgtaaatctatttacagccccaggtgcttgctactggaagcagaacagcccacaaggatagcagacccatcctggagtagaaggtccctcctcctggctctgagcaagtccacatgtgacttcagcatggaccctaagcaggaaaagagtcctagggaaattgtggcaatttccacttcttgtcaccctctccccaagtgtcctgctgggctggttcatctgctaaaaggaggccacagtctcaggggttcaggtggacaacagaagcacaaaggatgtatatctcttgcttcctgggaagtatctccttgcagaaacaattcaactcccttcccaggcttctaaatgtggggaaggggccaggacttgagcctgaaagatcttcctttaagtctgaggaagactgctcctcttgatgaaggagagaataaaaagggggacctgggagagaaaggatgatggcaaatcagccctatcattcctcctctctacaagcagagaacattgactagggggccaggacagttttactccatgggaatcctgctccagccctccccttggctagatatttacattcaagcaagttcctcatcatttgaggatgtggctgcaattgctttaggtgagtgctgggtgttgagagtttcatatggaaatccaattgtgtcaagcttattatagtcttatataatttgattgcaccacttggagccagaccgttcttgtatctggggtccgtcttcattagtttctagagatgaaagattctcctgttcttctttgtggcacttcttttaatcatatcttaccctgggctctattaaagcaacagattgtcatatcaaatgtactagatcatttaatctcttcccacacaggacaaagaggtttgcaatggatttacataaccatacccagaatatgaaatttggtggggctctatggcttggttttgagctcttgggggctggggcttgtggcttatacctatttttatctctaacatccaacacagggtttcacactgcacaggtgctcaagcaaagtttatgatggccgaggaaggaagaagatcctatgtgagttggctggaaggccatgcttatactgccactgtaatgggctcaatccttgagtggattggtcaacttcaccctcttccatggccttaagaacaatgtgagagttaaaagagagcttggagatcatccagaccaattcaaagacaaaaaaaaaaaaaaaaaaaaaggaggatgtgagggaagtgacttatccagggaaaggcagtggacgatcaagacttcagctcaggacctccaactttcagaccaaatgatgcttccagaacattctcctcctccttccctgaatttccaccatcagacaagtttcaaaatttgagcaaagcccaggagattgcattttcaacaaatgtggagactccagggttggaggagaggggatctggaaggagaatgctgctaccctaggtacagttgcaggtaccatctatgttcaagccaatacttctatcaatccttgggaggcctctcacaattaagcactttcttcctgtctggctgatgggtgccttttaaccatgagtatttctatcttttgctgttggagaggcagaaggaagagaaagagaaagaaatggaaaggccaaaacatgggaaattgcattctgggacatttatttcagagaaattaaaacttatgctcacataaaaacctctacatgattgtgcacagtagctttatttgtaatagtccaaaactgaaatcatccctggtgtttctcatcaggcaaataaacaaactggtacatctgtaccatggatactactcagcagaatggattacttatacagcaacttggatgaaaatccaggaatcatatagaatggaaaaagccaatacccaaaggttacctattgcatgaattcatttatataacatttttgaaattaaaacatttataaatgatggaaaaataaatggttgccaggggttagggacagggcagggctagggcagaaggtggggttatgaaagggcaacccacgggatccttgtgatgttgaaactgttcagtctcttgaccgtggcagtggatgcattaacttatcacacacacacacacacacacacacacacacacacacacaccagtccaagtaaaactggagatatctgaataagattggtaggttgtacaatgtccatatcctggtggtgatatatagtactattgttttgtaaaatgttaccactaggggaaactggtagacaaactttacaagagattgctctgtgttatttcttacaactgcgtgagcatctataattatctcaataaaacatttcattaaaaaaaagaatatgggtatgcaccagaactggagatgggaacgaaatgccccaatccagatgttcctctctacctgtccactgccagacccttatctccagttcacttggctcagaggacacagtatctaaggcaaatagtaatagactaatcttagtaataatcccaagcaaaccagtcatgggaagaggatgacgatatagctactccagctcccaattatgtggtctgggctgagaactatcattagtttccttcccatcccatctctccactttccaccaaatcctctggacctacttgccttgacccatggtgacagactcaatgctggagcagccagcattttttttccctcttataggaagcccaaggtgacagacacagagctgagcagccttgaggagaaacagtatccaggcaaggtgaaaacactgtaaatatttactctgatttcaaggggagagagaagagggagagggaaagggtcagggtgggagggagacccatctttagcagcgagaggaaggaagaagcctgagttgctcctagattttaatcacacaggatgagctttataatgtcctaggggagagctgggagcacgcctgtaatcccagctactctggaagctgaggtgggaggattcctggacctcaggagtttgactccatcctgggcaacatagtgagaccccatctctaaaataataataataataaatcaattcccaggtgaagtaaaggtagctgtaggagccactgagaacacagctggaatgggctgtcactggtgtgtgcacagccgtgggctagtgtgtgagctgaggattcctgtgaacctcacctgctctgccagaagcctgtgtcagctctagccccttgggggcagggccactagaggatccctggcccttcagggtctctggttcctgaatgtgggaaggagatcccagtttctgtataacaaatttaggccctattcaaatttgctgcctgacttgaacagggaaagaggtaagatttccatttctgggatgactgtcagggaacaggaggtagggaaaccctgaccttgggtgaagaggtaggagataggtgtgtatgggacacaaaggatgacggacagagccagaagataaatcttaaggtggcaacttaacagaccaggtcaggataaataaaagcagaggcagaggggacagcagggcaaggagccaaccataaaggcacacagaaggtgataggctggaggtgggaaccaattggattcactacacaattatatgtaaattgttatgtaataattattatacattttggagctagctttcgtaacctttatagctttgtgatggtcggcatacacagatctgttctgaaattctggatttcttcctccataacgacattaacttccctttgagcctttacacccaaggcaagccctgctacctggaggttatccctgcaagcagaaggccagtagcagggattctgtagcaaggaaagaatctggctgcaatgcatagggccgaccacatagtacgtgctcagtaaatgtttgtggaataatggataaaagaataaagtaaggagacaaaaccccaagcctccaaaagccagtctttcaacagttctcctcctgtccgttgtcctcagaaaggctctggccataacccctgggggctgagatgctgctgaaggggcaccacagttcagcccagatctgaagacaatgaaaaacaccgctttcccacttccccaacacagatatccctcttctgagaggaaacctggggaaagtcactacccaggaacctcactggctagatgccttaaaaatgcaagtgaacaagagttggctgagttgatgagttgttctagaaacaagattgagggctagctggaaaaagaggcttctttctgagcaccaaagccttcagacatttttcctcattgcatgggcaaatgaccgtattttaccctctcctgccattttcagcagtgtgtattgaacataatctaaatctttccccaggactgatggttagtctcctgatcaccaactgcagttgacttcagtgcctttgccctatgatatcttggaaattcctaaagcctgttgtgccatttgtccctgaactcaacggcctcaggatgctctcctttcacagtatttatttttcttttcaacaaatttatttttgccactgggttttgtataggcttttataggatattaaaaagagattatgtttcctagtaagctcttggctgggagagggaggagtgcggggatggctgagtggcagtggctgagggagtggaggtggagccaggagccaaggaaattgccaaaaaatgtccaaagggggataatcagcttacagataattgagggttcagtgccttttggaactgactggggctggaattcaggagactggtgagcaggaagggactgaagctaccttaccttgcaaagccagaggccatctgtgcagtgatcctgtgaggagctctagtcctggctccctgactggtgctcccccgcatcctttacactgcccccgcttccctgcgtctgaggcttaccttttgtgccctgcgtttatcagctctctgattctggtggtaaatccggctaaagttggaaacaatcacagggactggcagggcaatgaccaggacgccactcaaggagcagatggagccgaagatcttccctgcaatcgtcttaggcaccatgtctccgtatctgagagagggagagaaacagggtgtaagggagagagggccatttgggaaacaaggcaggcttccctgccaatcattcacctgtttattcattcattcattcagcaattgcttagagtatctactatgtgccaggtactgtgacatggacctgggggtgaacaagagagacaagatccttatgtgcagggagccaacatcctaacaagactgtaaacaattaagtgaatacataaaaatatcatgtctttgttggttctacaaagagactagagagaggtgctgcatcaggtggtgggagtgtggtcaggaaaggcctctctgaggagctaacatttaagctgagagctgaatgtaaaggagccagccatgtaaaacacctggggacaagtgtgtgtggtagaggaaacagcaagtacagaggccttgaagtagcaggaaggagtttggcctgatctaggaattgtcaaagggtcagcaggactggacaccacaagaggagggtaaggcaggcaggggccagatcatgcagcgtctgacgggccatggggaggaatatgggtttatcccattcagtgaggcgccatgaggagttttaagcaaaagagtaacagaatctcatttatgatgataacaacaaataacaaactcacctattcatgtagatttataatttacaaagcacttctacatatttacctcacataagccccatgaaccctgtgaactttgtattcttatccccattgtacagatgcaggaactgaggctgagataattacatggactgctctcatttgctcagctgggattaaaagccactcttcttgcttttgtctattttccagtagccatagcatctcagaggaggaccatgagctctgaagctcagccccttaaagctgtgaagccactttggaactgtgctggctcctctcagagcttggagaaactcttttaagtacttcacaccctagcagctgccctctggaaccaggttggcctggatcctactcagtcttcggcatgcaggccagagcctctgtccctccaatcaataagatgctttccacagtggttaagtgtttagtctcctctttattgagataattgaaaggccttattaagcaaagagctgtgattactccttcggctaaagccagaaacaccatctcccctgcctctgtgccctctgggtgtctggagcagaaacaagcttaggatgaccaggaattgtttctgctaaaatagactcaaagtcatctgtcctgaggaaaccacggggcttgggtttccagagaagatgtggaaggggatggggcaagctatttcagaagtatgaacacccaagaacttggtggaggacatggcagaggtagacaggtattcggtgaatgaatgaatgaatgatctcacttaagcctctcaattccctgtgaagtaggctcctgttttgagactgtcttccttctccttcagtgttcatgccctttgccctggctcaagatttcctggacgtgcactagcattaaggcctgtgctagagccttctagatctttgcagctagggttgtctcctctgccgtggtactcaggagaggcctccagggaagtggttgagaacatggattctgaatttagataatgtgggttcaagactcaccctgctccataaaataaccatatgatcttgggggaatgttactctgggccttagtttcgttgtctgtaaaatgaagataataacagtaacctagatcataatcctattgtgacatatacagctccacaaacaatagatactattacttttagctaggcattctgaaaaccacagtctctgttgatgggaaactctaaaaacacagttggttgtcccaagttcaaatagccccattgatgaagaaaaaggggctgcctctgagatatatcaccttagctgggattttcagatgacacaactgaaagggggcctgtgggcacagggctgtggatgaaaataaagcatggcaggagtgcagaagaacaatgccaggaaggctgcatttcagagtgaccaaggctgatgaggaatgctaaggacaacagaaagattgcttcatccatatgaagaaagagggagaagggaagccatgcctcctgctggggcagatggtctgctagtgacagatgacagtgagaaagccgaacaatccactcccaggcgtcctctgccttctccaccgggaataaggagctgcatcttggagaggctggaacaaatgccaaaaagaaggatccagagcttaaagtaggagacgggagagcaggcaagtgtccagctgaattcagtaaatttacatcacaggcccacatgaatcccacccgggagacaggaggaatgtgcagatggggttgcagaaccactgccctggatctttgagaaatcatggtgcagcagaaaattaccaagagactagagatggaaaacggctgtattgaatttttaaagaaggcaaaaggaggtctgagaaaccacagaccaataggcttggtatctgtaaattgtgccatcaaattgctggcagaatttgagagcagattattaagtagacagcttgtgaatacttggaaaataagctgtattggttcactaggcacacatcttgccaaattaaccttatttcttgttttgacagtgaggttaactggttggtagatcaggagactgctccagacctattgcatcatgattttaacaagatgtgttcttgtcccagttctttatacccttgacaagctggaggagtgtggtgtggatagcagtgtggttagcagggtttgcacaaccatctccagtcttctggcacttctcaaagattaccaactatggtcctatgccagcaaaggaagttcatggttttcatgttaaaatgtctcctttaatgaaaaagtaaataagtaaatgaaataaagaatggatctcaagttaggtctccagtggtatgttccggaatttttcaacaacttataaaagccagagggaggcagcatggcctaataattaagagaggacactggagtccaacctgggtttgaaccctagcttacattagttaccaactagttaagtgaccctggggcatttatttaacctgagcctctatcacttataaaatgggttttatatccccagggttgttgcgataattaatgagataattcaaaagaaacacttaattcagtgtttgaataactgtaaattgtctagaattagccagtgtagtgggcacctattttgtctgctgacaccccaataggaactgtgtccctctttcccatgatgatgtaaactgtccagataagctgccatatttcccatgccccaatgcccacttgccacagctggtgagttcaaaatagggcatctcacccaagctgaaccaatgacttcctttcctggatttattttttaaaagctttactgagacacaatttacataccataaaatccaaccatttaaattatgcatttcaatggtttttaatgtatttagagagttgcgctcacatcaccgcagtttaattttagagcacttcataacccctaaaagaaatgtgtacccattagcagtcagtgatcattccacaccccacctctcagacttaggcaaccacgaatctactttccgtctctatagatgtccccgttttggacaattcatgtgaatggaaccatatatgtggcttctcatgtctgacttctttcactgactgtgttttcaaggttcacccatgttgtagaatgtatcagtactccattcctttttatggctgaataacattccactgtctgggtagaccacattttgttaattcactcatcagttgatgacatttgggttgttcccacatttgagttattctgaataatgctgctatgaacatttgtgtacaagtttttgtgtggacacgttttcatttctctaggagtcatacggtaactatgttgaatagtttgaggaactgccaaaatgttttccagagtggcggtgccattttacattcccaccagcaatgaatgaggggtccaatttctccttatctgagacaacacttgttattgtccgtctttttatagctatcctggtgggtgttatctcattgtggttttgatttggatttttctgatggctgatgatgttgaacatcttttccccttccttggacttttacgttagggaccagatcagtctctttcaaagaagccgatgctgcaacaagcaaagctctggagctgttggcagccatgctgtctgccatggggaaaagcgggattgcagtcggggaggaagaaggctggcactagcaggagatgcgtgatggaaaagacagtgatggagctggagttcctgttctaattcttaccgaggaccagctgtacccccgactttcctgtcgcttagctgttccatccttcctttgactctgctcactaacaaattactgttttcgtttaaccttttttcatttagatcctgtggtagcgatggtgatgaggctgctactggtgattgtttgaaagtaagttcctcacatttctaaatgacagagctactatgaattgaggtctttaggagtcaaaaggattttaacaggttgtaattatgggtgaaaccaaccagattaattttaacaaagataaatgagaacaccagcatttttattcaaataatcaatgacgtatagctgatgggaaggacctggtttaaaaagagtctctgttaaaaatcaccggggaatttaacttcaacatcatccaccagtataaagaggctgttaaaaacctaatgccatccttggctggattgatgggagtgcagtgtctggaaaaagggagtgggtgtcgtactctgctcctagatgcagaccatttctaggctgctgtgtcgagttccaggcactatatagtctataggacactgattaactggatcatgtctagagaagggaggctgggatggtgaactgtctggaattcctctcaaggaaatcaaaggaatggggacgtttggcccgaagaagaggagttggggaatggaagaatggaaaggaacaatgtaccagagcctgtgctaggaacttatctgcattagtgggtctcacagtaacccaccctatcaggtagggttaacccacgttagggatgaggagggaaagtccagagaggacaggaacttgttcaaggtcactcaggtagtcagaggcagaacaactggggttagagcagagatgttttcatgcctctgctctttccgtcatatcctgctcctcccagggtcagggaaggacagaaggggaagtgagggtggggctagagagaggatggctgtggaaaagggctgtgaggagtcagcgggagcttagccccttctctccacctccgctcagtagcagcagcacagcacagtggttaaaagcgtggtctctgagtgtcaggctacccagggcaaatcctggctctgccacttgttagctgggtgaccttggccatgatacttaaatcctctgtcttcagtttcctggcattgatcaattaatagtacctacgtcacagggttgttgtgagggattgcatgagttactttttgtgaaagctcaacctggcatataggaagagctttatttataagtgtttattaaataaacccagggtccagaccaccatactttctaaactggacttctgcaaaagtctcttaaccagaattaattctcacttctacttttgttccctttatatatataaaattatatatattataattatagatatgtaattatatattattttatatataaaataataccaatttttgagctcaagtgatcctcccacctcagcctcctgagtagcaaggactgcacgtggttgccaccatgcccagctgatttactttttgtagaggtgggtttcactatgttgcccaggctggtctagaactcctgccctcaagtgatccttctattttggcctctcaaagcactgggattgcaggtgtgagcaatcacacccagccagaagcatattctttttttttttttttttgagacagagtctcgctctgttttccaggctggagtgcagtggtgcgatctcggctcactgcaacctctgcctcctgggttcatgccattctcctgcctcagcctcccaagtagctgggactacaggtgtccatcaccacgcctggctaattttttgtatttttttagtagagatggggtttcactgtgttagtcaggatggtctcgatctcttgacctcgtgatctgcccgcctcagcctcccaaagtgctgggattacaggcgtgagccaccgcgcccggccagaagcatattcttaaaatgcaaatcaaagcatgtcatttcccctgctcaaagcacttcaataaatgtttgttgaatgtatgagttaatgagtaaattaactcaatgttgttgcaaagactacatgcctattacacagtaaacactcattaaatggcagctaattatgagtgtaatgaccgtggtgtgcagggccctttatcccatggtccctcctggggcccacctgggcagaagactgaagtaggggagctaatggtgattctctgagtcctaatggcatttatggcctattttctctgtggaattttgaagaaagaaagggtaagaaaagaaaaagcagaaacagtcatggcttagaaaaaaaaaatttaaacccaaagcgttatttcctttttgtcttcctctgctcatgcaaataacgactctcctcttctctctaccctggctttgtgggtagggatagtaagggacgagaaagcccttcctggaggtgacatcccaggtacaggtgagctgtggtgcccagcccagagttaggactcacactcaaaccctatctggggccagtgtggaggcagctgtcgccctgagcaggtggggctcagggactctgctttggttgctctctctctcccagcacatcctcagtaatccacagtaatgtctggactgaggcaaaagcaaggaagcttaacctcctaatatggaaggctaattaatttgtattagggcttagggataattaaactttttatctgaacttaagctgcacaaaccacctgacttgtacaattaattgctcccttcatttcttcctccaggtgccaagagataagtgcaagccaagctcccccatccagttttgcctgcctctcaggtgggggcacggctgcctgtgtggtggggagtccattctttactggagaccagggcactggccggttagggcccagctgctgggagctcaaccagggagacacatcctcaatgagtttctgcaaggatgatgtctcagcctcactgccacacccactgctgcacctatcttctccactgggatgcccctgaacttggcttcctagagcctcagtgttggggatggggatggggcacagaagctgtcctgttgggtgggaccagggtgaggagagttcttagagcagactgggccaccatagtgtgttccagggactcagacctctgtggcttcctccttgtccgggggcaaaagacaacagtagaccatcatggaagacaccaaaaataccagccagggctgagttcatcctgtgacaaacacctgtgcagcctcttttcatgtccaaatcccctcccatgagtagacactattattatccccattttgcagatgaggaaactgaggcacagagtggtaagtaatacgcccaaggtcacttggctagccagctgcagaactggggcacagaccaggtccctttgattccaaagtcaaagcatagctcctagttatctggcccaaagctatggtttctggggagccaacatggaaggcagcagtcctggtagagagcaagggaggagaacacttcagaggcgaccagatctagggcatcagcctagccacaattctacaaaaacactttagccctatgttgtcaagtctcaaggtgggagacttgggaaatgaaatgaaaccccatatcacctctcctttctaccacatgcaccccctacccccaacacacacttctgctcgtgtctctgcagctgggcactctccttggctcacctgcaaagtgagccccagcagtgagccaggaaccaaaaagataggatggcttttaggaatcttgaagttcctctgaagacaccacctaggggtggacccagacgggacagatgaggctcagagcaaggtaatctaataataatcacagtggcaattcagtaataatttatttttatttagcataagtatgggccatttaattatcataaacttacaaggtactattagccccatttttgagattaggaaactgaagctcagagaagttaagtaacgtgctcaagatcatcggctcattcaagccagtgctccacatcaggcttgtctgacttcagagcgttctgctttctcgctggaggaggagaggaatgagctgaagacctggctaatccacatgagaaagaacagcctctttgtgacagaacgatttataatcctttgggtatttatccagtaatgggattactgggtcgaatggtatttctgtttttaggtctttgaggaattgccacactgtcttccacaatggttgaactaatttacactcccaccaacagtgtataagtgttcctttttctccacaacctcaccagcatctattattttctgactttttaataatagccattctaactggtgtgagctggtatctcactgagattttgatttatatttctcaaatgatcaatgatgttgaactttttttcctatgattgttggccgcatgtatttcttttgaaaagtgtctgttcatgtcctttgcccactttttaatggggttattcgcttttttgcttgttgacttgtttaagttccttatagatgctagatattaaacctttgtcggattgcatagtttgcaaacatttttttcccattctgtaggttgtctgttcactctgtcggcagtttcttttgctgtgtagaagctctttagtgtaattagatcccatttgtcaatttttgctttcgttgcaattactttcggcatctttgtcatgaaatctttgcttgttcctatgtccggagtggtattgcctaggttgtcttccatatcataaagacacatgcatgtgaatgttcattgcagcactattcacaatagcaaagacatggaatcaacctaaatgcctatcaatggtagaccagaccaaaaaaaaaatgtggcacatatacatcatggaatactatacagccatagaaaagaataagaccatgtcctctgcaggaacatggatggagctggaggccattttccttagcaaactaagtcaggaagagagaaccaaatactgcctgttctcacttttaagtgggaactaaatgatgagaacacatggacacatagaggggaacagcacacactgggaactattggagggtggaggagggagaggatcaggaaaaataactaatgagtactaggcttaatacctgggtgacacaagtttacaaacctgcacttgtacccctgaacttaaagttaaataaaaaacaaaagaacagccttgagacaatggagaaactttcaaagtggcatgaacctagaaaccctgctgggaggttctctgggagatgtttcctaagctctgccagcagagagtcctgcgaaaaggggtgggcgacccttccagatcattgctgtggtttgctgtggcttgtagagtcacagccagtcacagcggcaggctcctggccaagatcactttactactgttggcctgtggcaataatcttgtcttgccacctcaatggctgtcctgggtgacagagctgttcttctaaaccagtggttctcaaactttagtgtgcatcagaattgcctggaaggctcgataaaacatagattgctgggccccaatctcagatttctgatcctgtagctctggagtgagatgtgagaatctgcattctaagttcctaggcatcactgatgttggtgatctggggactactgctttaaatcatcctctttccataggtcacagatctgtagactcatagcatgtcagcggaaaggggtcatagcaaccagcttcagaccagtcatgcgtacatgaggaaacagacaaagtcagacatcgggtgggagatcctgcctgttcatccagagggattccctgcgcactgtctactccacctacccatagcccctcgcactggccagtactttcccccccatcctcctggattgatgaactcatcaaacatctgctgggtgtttgttaggactgggaatacaaagctaaatagataggtatgtcctctgccctcaaggagcttatgatgtttatagggaagacagacaaataaatcctgatgatggtccaatgtcacaacactacaagaaggatgtatgcagggtcctgtgtgagcacaaaggaggggcctctaaatcaaactggagggtggtcagaggatctcttggaggcagaagcactggctgacttctgagctgtgaaggaagaactatgagaaattactggctggagtaaagggtaggtgggagatgaggctggaggggtagtcacatgaagattcttctgggttaatccaggaatttgaacttcttcctgaaatcagcagatttccagtgaaggattttaaatgataggaaaaaatattcatctttgaaagatcaccttgaaagcagtgtggtggatgtattggatggggatgaaagtagagacagggaaaccagttagcaggctactgcatcagtccaggcaggaaaggcctgagccaaggcaatgacactggggatgggaaagagaggacagataggtacttattgtacctattcgtccttttctgttgggcttagtaactgactcactgtgagggtgcaggggagaatcttggggtgaggctcaggcttgggaagtggggcagccccttccatctctagcgaagctcccacccttcccttctttctattgtcacatgcttctgccacactgtatgcatctgtgctcccatatgcactgggctcctccatgactccaagcttctaaccaggcctttctctcaactgggaatggccctctctctctctctttgctaggtaactcagactcatctttccagatgctgttcaaatgtcacctccctgggctttccctgacttccccaggcagagtattacctattcctgtctttccaccttggttggagcacttactcctttatgccctgacatacctccccaaaatgtctatttcccctattgaaataagagcaatctgaggacagggctttctatctctggatccctggtgcctgacatgctgcacgatgccaagtagggactcaattgttcatgagtgaatgagaaggaaagcaatccccctggtgtgtgttccatggactggactggcttctgggatggacttcatgaatcaaactgcaagctccaggagaagagaggctgtatccttggtacctagaaccatgcctggcacaggatgggcactcaagacatctgttgaatgagtgaatgaattatgaaaagattatcggtggaactgctgactcggcatactggatcatcagagggcctttctgctgcaaaacacttttatcctgaataaagtctactttttgatgcattgtatgattcacttgaagtaggggaatctatctcacctccaataaaaaggaacaaatctaaggccacatcacagctgggaggagtcagcagtaagcagagggaggaacatttgctttgaggtatacaccaaccgtaaccaggtgatccctgatttgtcactgggagatggaaccttgggctaaaagcaaacagagagagctttaagttgggcctcgaaatgggctgaagtcatcccaagatggtagtactacctgacttatgagcaaaccatatttaaatcctgtccagaggtaaacattcttaacctagggcttcaggattcccatagattaagatcaagtaaaataaatcataaaaagcaagcaaccaagagtgagtcaaccaaacaaacaagcaatagatttagaccctccccaaacacttcaggtactagaattgatagatacggaacagtcatgtatgaaatgttttctaaaaataaagcataaaatcacaaagattagcaagcaacagaacactatcaggaatcacaatgcagatgtgaaaaagaaacaaatggagtttctagaagtgaaagagttaaatgttaacattattactgagtataatgccttaaaccaactggttattcttattgggcatcttctaaagtggatgtcctcttcccaacctaattcttgggaaccctcctgttgtcacttggcccaagaagttcttgtacctgagtctattcctattaagacaagaaggagggcaataaagaccagagagctgcctgcaccagccctgtcaccaaaagaggtgatcactgtagcccatcgcagagcgcaatgaagtctggttcttgtagagacataattcctttagcctgcacagctcctaggaaaaacacactgacatggatgaatacagagagtgtgagcagactgcaaaccagtgttaaaacgagacggagatggaagagcaaatgctagccagccacctgtgggataaaaaccaggaaaggagatgtcatcaacttcactaccggtctcctgtcaataggaagatactaaaatgaaaattgggcccccccgcctggccagccgccccgtccgggaggtgaggggcgcctctgcccggccgcccctactgggaagtgaggagcccctctgcccggccaccaccccgtctgggaggtgtgcccaacagctcattgagaacgggccaggatgataatggcggctttgtggaatagaaaggcaggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaaaaaaaaaaaaaaaagaaaattgggatatggttatttgtggtgatgcttcctaaatgtccagtcagttgttccctgccctatggatgcattggctcagagtgtggtctacaaggacatttgtactttggaggggaaaagtagaagggctgaagctcaagaggctgtgaagccacttgccccctgcctagtgatgagccagcccctcagctctggagagagcacacgccctgacctggggcatccctggttggggctgggagccatgctggcaggtagaaagcccaagcccaattatgagaggcatgcttttacagagacttggccttgctcagtccattcttcccaatctcagatcccaggaaacttctaatttatctctccaggccttgagagtcagggttcacaagaaagagacatgaggagcagcacatgtgtctggtcaagcggtggagcccttgtccctcaggcctgtaccctgtttctctttctccgtatgttcacacaaaagccttctccccggggctgcttctcagccttctgccaccctaggctagcacacattcctcagaaagggatgagctgcctcaactgcacagtagagcaactgccatgactagccctggttagtgccaaagtgggcgtgtaaggcagaagggagggctggatgctgggagaaagcgggaaggtgggaagggctccatgcagtctgtgcagcacaggcagcattggccagagtcagacacctttatgccctgacgtagctcccaaaaatagcacagctagaggtggtgaagcgtcaaagtggaagtccacagaggtgacagggagctaggacacagaagctgggctggtcaaccagacaaactcttatggccagagtcttccctgaggttcagtcctgcctctcctcgcacacccctgattctgccttctgtggctccagctgggacgtggttgaggtagtgacaggtgggaggtagaagtaggcaagaggcaaaacggtagcggtagtgaccagaggagtcttagccccaggccaggccagattcagtgcttagcggtttggccaattgacccaatatatggccaccaggtgtcccccactcttcagagcactctgctctccactgctcatagggtaaatccaggttgctccaactgcgctttgcaaatctgatctggcattccccacgctgtgctgccctccatcttgggcatcctctcttccctttttcacccatcctcatcctccgagaaccagaagttatccctcttccattaagtctcagactcttacaggtcttgaaggattgtacagggtggcaggacctacacccacgtggcacaggaatcctctccacggcggcctttcagcctactggtgaacttgccaggcacaggctttggagccagacagacctgtgcagaagtccttgctctcccactacccagctgagagacctcaagcaggcacaacttcctgggcctcagttgactcatctgaacaatggaatagcaataaactacctcacagggttgttataaaaatcaagtctgtaaaagcatttcatgatctgtgcagtggcagacagtgcttagttcttctgcatgaaacaacttgggccatggttgggctgctcacatcatcggctttcctgtaacttgcacctgtgagtgccacttctgccattgggaactccagagtacatctgtccctctgtcaacaccacagccttcctccaagctctgaaagcaccgcctgctcctcatctcatttggctgcactgccagtggctgtttcacacttgcctgcccccgctctggcaggccctaagctgggtacaagacaatgtcatgcaaagaacgtaggccttggagtcagaagtccctggcctgcaagtctgcatcttcctctctctagttgtgtgacttcggggcagcgacttagatctctaagctttagatccttcagctgtaaaattgagaataatgtctccctacagggaatggttaatatgcactcacagaccccacagtgcagcactgacaagatgcttgtttcatgtctctctacccaccagatggtaagctgcatgagagcaggcccggtgcagtactaggcacatagtaggaatgtcacattgagcctgtagcaggactaaatgggtccccaacttaactatggcctctaacctcatgttgggtacttaaaatcctgctcagggcctagggacaattgaatgtttcaactgagctgtggaaaaccctgaagagccctttcacatcttgcaagcttccagctctgggctccatgcttctgggtttggtttgacccagctcagtaaatttgactgagcatcaaacattctcctgaagtatttcttctgctttggaaggcagaaatggagctgcgtgctgtacactggctcacctgactccctgaggctgtgtggggtgaggaggctcctcctgcagtcctcagcaggggcctggtctggacacctgcctgcgaaggacaggagccagggccccttcggcctctatctttaagtctctggttctttgagcctttgccttttttctctctgtttcctgccctctagttccaggtgagatgccctctggtgtgacaccctagcaccctagccttacccgcccccaccccatgtgagctggtgacagtggaggcctcgtttgcctgggacacctctgcctctccacagcctcgcacagcacctgccatgctgtagggttccattacatgttttataagtacatggatgcttctctgattctctttcagtctctgcctctctcagatccccatgtcttagctgttccagccagccttgtctgtgctgagatatgctaggatcagttttggggtgattagaggtggtccttagggctgctggttgtgtgtgtgtttgtgtaaaattcctcacagacaccaagcccccacatggacacatcactttctcctcaccccgtcagagaaaccctctgatattcaccatcacacatacactcacaccaggtcggagatggtgctccatcatctgctccatgcatactgaagtatttatgggtgaaaggacacgtatgtggacttttctttaaaatactctgggaaaaaatgaaaggcaagtgagaaataggatgtgcagtgtgctgaagccaggtgggtgggtgcatgggctttcattcaccaccctctccggttttgtatacatttgaaattttccataattaaaaagttagaaaaaaaaacttcgttaaaagaagaaccatcgactccaactcccttctgaggccactactcattttgcgcatgtgacaaacagtcctgcaaaatccctcctgccttctttaacttttctttatgtggggctcatcttgccaactagattcttgcttcttgagggcagggctgtgtcttatgctactttacatcctttttataatagcgcttatagaagggcaggcatcaatggccactagaccgagctgcccagcccttccccttggaccgaggccttctttcacatgcctcatgtccttggcattgactccttttccgtcccccaacccctgctgctgcccagctcctccctggcttccgccaaggtgacagggtaatgctatggccagggactctgctgtttccttggcaatcagagcctttctttagccctggcagcatgctctccttgttggtcaatatttagtttaatttaggttctaatcaggcaggaaagaggcaggtggtcttaggggttgctgcagggctagcagggacccatctgtcagccttccccacaccctgttgcgactgcacgcattttatgtttgctctgaaccctccctttacaacatttctgctctctgcccttcaattaaccttctgtgttttgggtctgacctagctgcagtgtgcagggaagggaacatgctgaggtcacttgcagggctccgcaaggcttcctcagcagccctgcctgtagcctctgtgggaaatctagctgacccccagggaagaggctggagtgaaggtgccctgctccactgctggggagagcatgagaagtcacaatggatgaatgcttactatgtgccaggcactggtcccagtattttgtgactgttagtttatttaattctccaaacaaccccagatagggagatgggttctataattatccccattttgcatattaggagactaaggcttgaagaggttaaataataattgccaaatcatagcgttaattaacagtacagctgaagttggtgcccgggcggtctgcctcaggcgcctaggcccttgactgctgcccttcagtgagggcggatgctgcatgcaggacagacagcacaggaggcgccaccgccttccccacctccctgtcccatgctcccctgagggcccgtgtgagtggctgacagcacgggtgaagcacagggagatcctcccagctgcagggtggcgggtggatcacataaagggcaggggacttcttggctacaaagcagagccaggtggcatggaggaaagggcggcctaagctgacaggcagggtttatttatttcctttctctttgtcacagggcccctttaaaatgactcaacagactattagtctcaatggaatatcaaccccaacagggggaaaaaaaaaggtaagaaaatcctcaagaaaagaacacatacatctcagcccagtccaccagacagggcaacgtggggacactgttgggaggaactcttccagtctggccagagatccaccgccacaacctggatgccacaacctgggtgggcacctgggccagccttgtcccctcacccttgcctcagtctggctgcactttccagtctgccctctctgtctcccagttggtaggttccttcctgagcccctcacagtcagactgacacataccctgtgcatttcaatggcctcctgtgtggacagtatgaaaattaatcttagaaatgttatcaagtccaaaaggaaattcctaggggaatgtaagtcaacctcttttaaagagcatggctaagcagagaccttaaactttagggaaaaaccaaactccttgagaacaagagtcaagcgaggagcggggggacatggagagctggagtctgccgctggcccatgtggctaggggagcgcctaaggagaattcaatgagccacctgtgtggacggtgtgaaaattccccgcggctgcagagcagggcagcaacctgcatgtgggggacaagtaattacagaaggacagaatgaaaacagaggctcagaggtctgggaccaaggtatcctggagcagctgctgggttactttctggtggcaggacggggacaggagggcaggaagaggagagaaaagaacatgaggtgagccagaggaacactgtggttcccctcaggccaaatccgaaatcctgtctggccttccccaggggccttttcaccaagcgacatctcacggctcccaccaggcaccctctgctctgaggagcacccctgctacgacactgactcccagatgctgggtcctcacctgcctcctgtgtgctgcagctccaggggacatctgtctcccaaagaacggggtcactcaaaggggggcacatctttttcaacagaggccttctacactagtggggagtgtctgcacagcctggcctgctgtttcccctggggacactcctgttgatgcggaagccctgcttatcgtggacatgctcgtggccctcacggcccggccctcccattctcctctgaactctcacccatgtactttaaatggcttttatgctcctcttttccattcccaagcatggcataatgggaacgctatgggctttgggctcagaaaaatcgtggtcctcaacctggggaccatttgattgggttaaaatttttaaccattgttttctcatctgtaaatgggaatatttatatttactcatctcacatggttattgtgaggaaaatgagagaagggatatccacttccagtaatgtaaaactaagcagtttgaataaacccttctgctgaggataatttaaaatgctggatgaaatataacaaacattttcttaaaaacatcaaagacataacgaagtaataaggaatcatgggccataatctctgaggaagtgagaactcaaagaggtgagcccagtattcaaccccacccttgcctttaaaaaaagttaatccagaagcaatagtgacaacaatgagctgtggtttttgcagcttccccacccagctctaagataggaagcctaaataaataccctacacttcactcaaagttggggtcctgaagtgctttaccttcagggtgaagacgaattgagagtaaatatcccctctatggacttgcagccttgaatttggattaaggaatttgggttaaggaggtcctggactggtaacattcccaggtgactagcacagtaaattaaaatcctctctggaggaagaatactgattctaaaccacagattatccttcaaataattttcaaatacactgaccagcacagagtcaaagataaagcatataagggaagaagacaccatgagtaagaaccagaagaaaatgatgataaaaagagacccccaaagaagtgacatatagtcatgcatgtcataatgacattttggtcagtgatgaactgcatatatgatggcagtcctataaaattgtggtatcgtatttttactgtaccttttctatgtttagataggttgagatacacaaatacttaccattgtgttacagttgtctgcagtattcagtacgataacatgctatggccaggagtggtggctcacgcctgtaatcccagcactttgggaggccaaggcgggtggatcatgaggtcaggggtctgagaccagcctggccaacatggtgaaaccccatctctacaaaaaatacaaaaaatagctgtgtgtggtggcgggggcctgtaatcccagctacttgggagcctgaggcaggagaatcacttgaacctgggaagcagacgttgcagtgagcctagactgcgccattacattccaacctgggcgacagagcaagactccgtctcaaaaaaataaaataagataacatgctatacaggtttgtagcttaggagcaataggctaaaccacatagtctggagtgtagtaggctatatcatctaggcttgtgcaagtacactgtatgatgtttgcatgaggataaaattgcctaacaatgcatttctcagaacttatgtccattgttaagtgatgcatggctgtattggaagtatcagacacagaccaccatattaacaattcaagaaaatataataaaggcaagcttgaacattttcttaagaaatgggaactaaaaagtgacctagaaatgttgaaaaaacccaaatacaaattctagaactaaaaagcacagctaaaattaagtaagcaacgaatgggtttattaaatgctaaataaacacagctgaagagaaaattagtgcactgtagattagaaggaattatccagaatgtagcacacagaaacaaacaggaaagtccatgcaccttgtctaacgcctgggatagagaagtaggaactcaataaatgttactttcatccttttcctctttcaagtcttaaaaaaaacactgctctttcagaaaaccttttctgattcacttggcctgacgtctgccactccatttctctgaattttctcagcatctttgtaatcggtttgttcatactgacaggtactcacttatttcctgagatcaatgaatgcgagagttaaagcctcccccaaaactaatgccatgggtcaaaggtttcctggtccacaaactcattcctcctctgtgccatgatgatgtacaaatgcaagggcttgcttatgagaggtattgctccgaggaaaaggagttagttgaattccaaaatatggtctgcttcttgacccttttccttggtcaatgctgtgtcaagacaactgcagactaaaggtcacaataaatacctcagtgttcatggtaaacagggagcatgcacaagccctctcaggccttgctctcctctgttattagagcttctcatctcagctcattctggaaattctgatgcacaaagttggtgaggggaagtggctagagatggacatcaataggaccaacaaaatccccagctccaagaggagactgccaactctgcaaaaagcattaaatacttgtgctctgcagcgcctgtttaaggacttggagaaccaagatgtgccttgccaaagaggcctcttgtatgttgactttaagtgtctgcccttcattctcaagcaccatggagcaagagggaggggacaccctgaatgaccccatcctccacccctaatctggatcatctcagacccctggccagaccagggccagtgacctgtctccctttaaataggcctgaagtgtaagggagaaggattggaattagctctgggagagaaagaagagagaagctttggaagcctggctgctgggctgtgttgagatggaggagctatgggtgggccctgggccgctgttgaaggtagaggtggaaaccagggaagtagctttgtgcaggcagaaagcagaagctgtggtagttgtgttttgattagtaagagcccaaggggatacagaacccaatgtcctggccttaccggttctgtttcaacagcggaagattatttttctttcttttttttttttgagacagagtctcgctctgtcccccaggctggagttcagtggcgcgatcttggctcactgcaagctccgcctcccaggttcatgccattctcctgcctcagccttccgagtacctgggactacaggcgcccaccaccacacccggctaattttttgtatttttagtagaaacggggtttcaccatgttagccaggatggtctcaatctcctgacctcatgatctacctgcctcggcctcccaaagtgctgggattacaggcatgagccaccgcgcccagccagaagattatttttctagacttggaaaaattgtcacatttcccgtgtgtgtgtgtgtgtgtgtgtgtatgcgtgtgtgtgcacgcctgcaaatgcttgcatgcatgcaccaacccactcatttgatcaaaggttaaaacaatattaaatgatagtcgttacatgtcagacactgggctgagtgctggggattcaaaaatgaccaagacagggtccccaacctgctctgggggtgttcatcagctccagggagatgaaatttctcttgatggctcctctctgtgcccatcctgctctagaagcctcttcattcactgattggtatttggaccaaccaaatggtttttcctagccccctcctgggctctaaaggcagcaccagaaatttcaagcaagaagctgcttcctggtccagcatcacccaatgtggacaggatattactgagataaaagatgcatgaccagctccagctcttgtctgccatttctgcccaggatcatggaacaggagatgaccaaggggtcagtgtgtgaggggcctcctgaatctatttgtggctctatcttgaataaactgggtgagcgactgtggctcttctcacttctggcttttatgtcccttcttctgatttgggactaggttaggtgccctggtccagtgactagtctcttccagtccttggtcctgtagaatgggcctttccctacctggaagagggcagctctcatgctgggaccgaataccttgagaggagagcctcttggttgcactgtgacccaggacagggcacagaggaagaagccccattctggtgctccatccctccagtttgcccaaaggttgcacccaaaggccgatgctgggcacagactggcaccttctaactttctctccaagctcccatcctggctggagagacagcaggtgtctgagaactattccttctcttctcagtgagaatctatagccaattagctgagcccagggaggtggaaaatgtctctttccagccctggagctaacagcgaatccagtctttcttgtagacgtctctgtgaagggcgagaacggagtaacctccaggactccaaggagctggtttcaggctgtcagctcgaggctttaataacacaaaaggcaaaggaacactccactaagtagcataaaataagtgcaaaacttggctatattttttttccagagtctgtctgggttttttatgtgggtgtgtgcaaagagcaggaactctccctggggtccaacaaattgggtctttgctgtgaggggctgtggcagctgtaaaaggagccaagccaataattgggctaaaataattggtctcaggatgtgactccctctagcctctgcctgtcacccctccagcttcagggcctcaggaaggctgacacacacacccggctgctgtggcatcttcctgacaccaggtcaatgttccatttcattagatcttatctgtataaaactgatgatcaggggagaggggtctgaacagtgtaatgggggaaggtcctggttctatcactatcctgatgtgtgagtcttggcaggtcatcttcctctctgtgctttactttcctcatctgctcagacagaggaagaagagaggatcagtgcttactgagtggggcaacagtgtggcaggtcctggactaggtgttttgtatacattgtctctgtgtcctgtgttatggtgaaaatcagatggaaaaagagaggtcaaggaatttagacaaaaccagaaaatactacaccaagatgaaagttgatgtatttttactgcttgctacccacactcaggaaatcctgacaatgcttggctcaagaaatacgcagaaaagctgtgaggggtctgtccctcccttacctgggtgtgggctcagctgtggggactggctaaggggtgggcgatgaaaggacagggtgagtcgatctttaaggtttgggtatttctgagtccctgggtgaatcccacttactgaattcccaaggcaaatgcgctcttcggatcgtccacccctaggccatggactctctgcctctcctcttttcctgtagcacccatagtcagagttggctacataagacaaagccttcattatttttaaaaaatcaattggctccattatggtatgactaaaattctattttcaacttcccctggagagacgttacttactgggaataggtaagtatcattagcatttttctttgagagtttggggcctggagaatttaggctcagacatttctatttctttttccccacctgcctgtttccttggcccgggtcagaaatgacttcaagagttagggacagcgcagagtggtgatgaaggaccagtgagagcattccttgcagtgccacgccaggcacgtcagccttctggagggtcagtgttctcgtctggaaatgggggatgatgttaatcttgcatcacaggaccatagtgatgactggaggggtgatgcttgtggggtgtcgggcacggtgcctggtagatgctcagtgagcagcagccatttctgtgaaaggaagggcctggacagctgatcttcaccgacagtgatgacaaagagggaaggccaactccccggctccactggtgggtctggaggagctggttttcacaccctcagggccagctgcccagctgattttgcctgtggcctctgtgtgccacaccctgcatggggaattaggggaaatgcaaaaatgatggtggggtccctgggcacccaatgctaccaaacatagagcagtggtagggcttaaggctgagggccacagtgtgaaggagccatcagattgcaatgtggcttccctccaggggaagcaggggcagagttccttgcacaaagtagacaatcataaaaaataagggcagtgcgcatgtcatgagtgcttactgcatgccaagcaccgtgctaagcactttcttcacgtggaccttttacatttttaatctgtacgagggcccaatgtagtaggttctcttatcatccccattttacagatgatgaaactaggcctcatttgcttaataacctctctggaatcactcagctcataaacagtagaagtgggcctcaaacccagtcctgcttcacatgagtatctgagctaaagcccttgccccactcattgtggctatagggcacagggagccgggcacaggctggcagaagaagccagaggccagtccctgctgcacacactactgctgtcccatccctcggatttctcttgcttggttctggcagcatccaggaagatgttctcccagcatcctgtgcccctcactcccaccaagatacagtctgccatctagaactgctagaggcaggagcagccagttcaggctccaaagtcaagtagtgggcaggagtggggtgctcccacgagagtgaggtaaccacaggctcctgggaatccaactatagcccctatctccccaggtgagacaagcaggtgaggagtttgcctggaggccagtggacacaagtgccctccatgtgggagtgggggtatgggaaggggtcatagtgaggtcacaggggcccccagatcactcttggaaccctagcaagctcagggagcttggaaccctagcaaggatcagaagccagcaatttctgattccagcctgatcagactccagtccctcaaattaatgcacgatccaatttaatttccctttagaaaattacatatttttaaaaaatacatgaagagtcagaaaagagtcatggcaacgaggaggctgagcaccagagctgaagccaagtctcttctccctcagcaggggcctgtctggtcttctaggtcagagcctcctgaccctcttcacatcatagcacatgtggaagatgataatattcgcccaggacactggagtcaacagaggctgccatctgtaatgagaggcaagcagctgaaggctctagctgtcttaggctcgcctagccacagccgggccaaggggtccgtgccccacacacctgtaccaggtgcggaggctctgctctgggaatcttccctagccagatgctggctccctaggtaggtcaaagggtgctggacaggttcagctggcactgactagaacctgctaggagccaggcaggcctcactggtggctgcccttaattcccacaacaatcctgtggcagctgggattcctttcccattatatagatgaggaaactgagcttcaaaggcattcagtgatttgcccaaggcaacaatcatagtattcaatgagctcctattcattgtcaggcactgtgctaagtgctttatacacaacatctccctctgctgggggccgtgccccaccaacgtgctggcagtctccctgagctttttacacaatttgctgaatgcatcagtcactgatcaaatgaagaggagttatgatgtgctgggccccaggaaaggtcttcaggtgcaaatataaataacggaaatggtcttgccagcaggaagcccacaatccaagacagatctgtgactgtctgacatgaatagatgtttattcacatatgctacgtgccgggcattgcgtcagacaccgggtccagaaaggtgaaacactgatcgtggtgcttatcctaggagcaggctcgtggaggagcccaacaaataaacggagaaatcacaaggcagcacggggagctctgtaacatgcacagcaacctagcatggggcctggaggaggcggctgccaatcttggggacatctgtgaaagcactgtggattctacgccgtgagaagaggaaacagcgtatattgagaatccactataagtaacacacctgtgaacaagacctgggtgtatcctgaggcctgaactgtgtcgacataacttagcacgagctctgcgtataccttgctgggtgctcggtagatacatgcactgccagggattaactgagcgatgagtaactgatgtgcctctgtcatcttattttcttattcagattaatctggttttaacaaatgcttaaagcagagaccttattaccaaagaaacccctattgctggtataaagatctgctttaggagcctgaaagttattgccagaaaactgatactgacataagttccctgtttcttcagatgtctggcttgtgcaggggacacaggcccagcagcccagctgcccagatcccatcccgacggctatctccacagcccacagctctgctgttctaggcacgtgcttatctattttatccaccagagtccctaggatgtgtctgctcagccatattaaggaggcccacccagtgccctaatatttttatcaaatggcagaatacctggctatatttgtaccttgactcatgtggtacctttgttacaaagaacacaaagcaatgggcccttgctctgtttaggctgctcctgcctcagagaggaacaaccggctctctctctttggcagaggaggccgatgaggcccagggaaacaaggtggtctgtctgaatcctcagagccttggtggtagaacctggactagaatctatggggcatccaggcaaactgagtcctgacttctgtgtgccatctcagctctcggagggctgagaccaatccctttgcctctttgtaagtttcattgcaattagcacagtgatgttcccctctcttcttttcctttctctccttctttcctcttctccttcttcatcagtcacttcccttcatgtgacagagtctctccttgaccaaactctggtcaggcttctctgaatcctcttcccaactaggcctccatggttggacttccatgtctgtctttggattgccttattttagtaagaatcctgctaaatgggtatctgatcagccttggtatctgctggcttcctcatcccctgccatcccccagttgatatctagttgccctggcctgactttagcaagactcctgttaggttggtttagccagaatcccccttacctgtgatgttttctcttagtaattttccaaccaccaacacctctgaccctgctccttggctataaattcgcacttcttgttacattgagaactgagcccagttctatattgaagtctcttttcccccgttgcaatagtcccgaataacatatatttttactgctttagctattatctagttgtggttttctttgacatatcatacctgcagtccataagcactgctccttagagaggctaagatagaaagaaggtaagcaggaatttctgggccttcctggatgttccccccccacacaaaaattcctccttggaaagctgcccagcccctacctccactgccagcagtgactcctaggaccccggggaggaaataaggggaaaagggaggcagggtggggccaacctgagcgctaatgctgtgcccggcagcaagagcttcatatgaatcatctcgtttaatccttgcaacagtcaacgaggtaggtgctattgatacttccatgttacagatgaagaaacaaaggcatagggcatttctgtgacttagcccaggcccaaagctcggccgggtgtggccaggaggcaaacccctaccacatggcctcttgggaaggggtggggtccgagcactggagcctctcactccctaaggaggcctggccacatctctccaggagctggaaatgtcagacttcaaagggtcaccccagacctggtaggctgtcaagtccacagagaagagaagcctgagtggagtgaactgactcagactcccttgtttcctccaggaaagctttgcgtgcattcgcacggagcttccttcattcattccacaaacatctgcagaacctgaagaataaacctggttctttcctagtgactggagaacagagcagaggattgtgtggctctcaaggagtggctgtccaatgagtcttcactgatgcccaaacatacctgccttcacaccccgaactgggaaagatgggggaattcctactgtgggtgggcgcttctactgtgtcttcattcctcatgtaatgttctccacaattctaggtcataggtattattgccaactgttttacaggtggagaaacaaaaacctaaagagaaagggaagtcatttgtctcaactcatacaactattaacttggtaaccctggacttgagtctgaatgattaaggagcttatatttttctcttttcacctcccttgctcccacaagaaagtgaaataactacatgccacatcccaactacatgcactcacacctactgacacacacttggaagcaactgagctctgagacgcgcctgtgtctggtgcagtccacaagcacagggtgcatctgcctacacacctggatgtgcacatacatgcacacatcaatgtttttaaaaattcaatattttgggggtacaggtggtttttggttacatggatgagtagtttagtggtgaattctgagactttagtcaccaaagcagtgtacactgtaccaaatatgcagtctcgatgttttttcccttaacttttgaatgttgtgaacacatggaaaaatatctaatttcactagttactaaaaaaaaaaaaaatgaagtggggtagcaagaaagtgctgtcattttagctcatcaaaataccaaaaattagggagaaaataaatgagaaaatagtcctggtggggatgcattgagatgggcacttttgtacactgctgattggtacaactctttgggaaagtgacttggcaatattcatcaagaggtttaaaaatgtccaagaccaaaagtggcccaataatttcacctgagtgtcactcagtagtaaatgcataacaatgtttaacatagcattgtttattatagcacagacccgacaccgacccaaatgacttacactggggggttagctaattaaattctgtcaaggaaaaatgactgaaaaaagacaaacagtaacatgacaatgttaacagtggttgggtttgagtgatcagactatggttaatttgttcctagcaccctacccatcttctttcttcggttttctgcatttttcttgaaaaagatcatgcctcacatttctaacaaagctaaactttatggaaaaagttgggagcagatcaccacactgcatgagtgatagaaagctgagtatatggatacagaatttagtgttgtaatcaagcgaaacccacaacagaaatgatctattgcgtcaatatgtgcaaagcagccactgtgcacatgtgattggacttaaatagtgaagagcatgctcataagaagctgtaattagtttgccttttataccacaaaatcagtgtttagtttctctctttgttgttagttcttcagcatctgtcaactgcatcagggctgacaggttagcctaataccaggtgtgagctgttcccataggcacacgcgcgtgcacacacacacacacacacacacacacacacacacacagaattatgaggcagctgtcttgccagccaggcttcagggctgggcatatgaacctccctcctgggctggtggttctaggcagtgaagctgctacaaaagatgcagttggtgtggggaggggatttggagcaaggatggcctctgggcaggagggaaggaggaccagggctgggaggactgaagaggatctgcctgcgccagggcccgaggcttccaccccagcaggagttcttgagaacagattcccaccagctttggccaaatgtacagtgaagtacaaagtgactaacatcacacgtcagaggccaaaggcagatgggagtcagatggaatgagctggagagtgccccttggctaaaaggccaaggggaggccagggagaaacaacctcacgttgtgccagcgaggggttttcacctgtctgcgagccttctctgcttcttctttattgatccatccatgatgcaacttccaggcttttctgcattcccttagagaccaggcaatgaatcccaggggaacagatggagtgcgggaactgttgacattttccaaacttcctgagtgggggtgacacccgtctattgtcccctgagtttcccttctttgctccatgccctgggtggctagaccaaggagactcctcactttctcctctgtgtcagaagggccgcccgggcctcccctctcagtcttgccctggctcaagctggctgacaggagtgcaagccacaggtgctgtcccaggggagatcctggggctggtccctgaggcatagcatccagagaggccctaaacattacacttttgtcccgcaaagaagagacccaagaaaagaaagaggccctgccttatcttttctctcatccctgaggagagaagtagcttttgtatgcatttgttttattttattattaatttattaatttatttagagatagggtcttgctccgttgcccgggctggagtgcagtggcaccatcacagtcatttggatttgaacccacccaggccttcttgcttttaggagagctcacacttccccatgtgtgaccacaagtgtgcacacacagcctctcactcacacactcacatgtgtacacacacaaatactctactgcagggggaagaggcctctccccagcctgggagtgtgggactgcttcagcttttgcatttgtgtgcttggattctacctggatagtagaagtgaaaagttacagcaggtcttcttccctctgaagaaccacggagaagaaaggtacagcatcactggaattcagattagagatgtgaagccaaaaaaaaaaaaaattccccaaacccaaccgggaaagaaagctcattaatgtctctcttcccctcctcattaagcaagagctcgctcataaatattcacagaattctaaagtaagatcgaggtgaaagttaacttaatgcggaacaattaagactgctcacagctcaccagcagcctgactgggctctggcctccccaaagcccagagatctgggaggctcttggtcttccagaggggcggaagaggagcaggggttgggacagaggtttgagcagaagatccccctctgcacctgcaagacgccctgtgaaagcagctcacaggcctgcttgtgtctcctcaggctgggaagtgttagccatacgagggtcttgaaggtctcccagcacctgtcactggcttgccccatcttacaatgaggcgactgtaatcacggagggtatatgacttgtccaaggtgaccggccaagccatgactgagtccaaggatgctttccaccacccaccttccgtctttaaccaggaccaggaaagctttccttgggcttcaggccctgatccctccctgccccggaggttgcagaattccctgatcctgcacactgcagccagattaatattctgaaatgcaggcttaattgcgtcactccttccaaaaaacattcattggctcatccactgcctatgaattaaatgccaactcctcatgctctgtggtccaaatgctcctttacaaccctaattaccattacttgttatgcatttcccaatgttccagccaaatggaactccagctcttctccaaacatgctctaaactctcctgcctccaaggcttgtttatgtagccctcacttcctggaattcccccctgctggttctacctgtcaaaatcctgtccatctttccaagttcaaatgtcatttcaaatgtctattccattaagtaatcttattccttacaatctgatggagtcttgctctagggtattttgcttgaacctcttctatgctacatcatcttcttgtgccttgtcattcaattaataataatagttgtaaaaatatttgtacttactgccaacatgcgcctgttgccttgaatatattataccttgcaatgtagatattgctattccattttacagtggagtgcactgaggttctcagaggttaaaaagcccaactctatttggctctaaagtttttgcttcttctccttctccaggattgttttcattcttacttttggaagctccctggattgaattgtgtcttccaaaaagatgtatgtaagtcctaacccctagaagctaagaaggtgacctcatttgaaataggctctttgtggatgtaatcaagttaagaggaggagatactgaatgagggttggccctaacccaattactgatgtctttataagaaaagaaaaagctggacacagacacaggggggtgacggccatgtgaagacagaggcagaggctggagtgaggcatctacaagtcaaggaatggtaaggaatgccagcaacgaccagaagagaggcaggggcagattctccctgagaaccttccaagaccaaccaaccctgcctacaccttaaccttggacttccagcctccagaactgtgagacaataaatttctgttgttctaagctagctagtttgtgatacattgttatggcagccctaagacacgagtatgctcttcaaggacaggatctgtttttacccttctcattatccttctaagagatccgtgtgctgtcttcagatgattaggtgctcagtaaatgcctgtggaatgcaccacagattttcacgccccatctgcagaggtcctaggggcaaggaatgtagtaaatattttatggatgggtgttaaaggcccagcgaggtcatttaccttacagttagctggcagcagagctggttccaggacaggagtcctgggtctcaacagctagacagcgtggcacctggaaatgcagctggtgtgattttgtcttctgatgtgagtcagccagctcagaggccttgagtgcacagcgggtatctttggcaccattaactgaagccattagaaatgtgctgggtctatggtggtgctggacagaggactcagagatgcctggtttcccgcctgctcaggaagccctgggtggccagctctggtcctgggtcacagggttgctctgggatttggcttttctaagaggtaagctgaaggctgtggggctcaggacacattctggaaacacccagtggtgagcttctcctcaccacccccaactggaggcccagttagtgtcttctcctcctccagtacgaacagccagatgtgtctcaccctgggctcttgtcatctctgccagcaggcatggcctcctgcaggggccagggggacagtccctgggaccctgagcatcctgcagcccctctgctgtttggaagtgggtggtggggatggctggctctgagggtgtgtgtgtgtgctgatgttacagaagatgcggggttcatctcctgcagtgtctaccctgtcccccagaactgtgagtaatgggggctctttccaggcaattataagcaatactctgactgggatttccccttaaggattggtctctccatgcccttgacaatgagccatggattatatttctaacctcctctgtatgtgggggctcaagcagtctttcttttttttttttgagtgttaaaaaccatattctttttattctaaagatttatgtgattttcacattttaatatctctaaaattatgtcataactgaaattaaaatatgtttgtcgtgtaagcaattttttaactgtagtaagatatatataacataaaatgtatattttatctatgtgtgatttttaggcgtactgtttggtgacattgtttaaactgttgcgcaaccatcgccaccatccatctccagagctcttttcatcttcccaaactgaaactccataccctctcttcttgccccgccggtaaccataattccactttctctctctatgaatttgactactctaaatacttcatataagtagactcatacagtatttgtcctttgtgtctggcttatttttcttaccacagtgtcttcaaggttcatctatgttgtagcatgtgtcagaatttccttcctttttaggctgaataatattccactgtaaggatagaccacagtttgcttgtccattaatccacggatgaacactgggttgttcccaccttttggctactgtgaataatgctgctatgagtatgggcatatgaatacctgttggagtcctgccttcaattctttcaattcttttgggtgtgtataccaccagaagtggaattgctggatcatatggtaagcttatgtttaattttttgaaacagtcctctttttataatcagaaatagatagggctacaggaaatggagaaggcaaaaacaaacaaacaaaaacaacctagcgtcttttgagaagaactcgtgctaagaactttatgtcatcttgtctaaactctgtaacaagactatgaacaagatatcatttccatatgatgggaaattcaagacacagcccctgcccaaggtcacacggtttataagtgtggaggcacaaactgaacccagacagacggcgggggacccacggggtggctatgggcggaatcacagaagcaaggatcctactcttccttggctgtctacttcttccccattactgctgaggggcctgctgggaagatggtgagattctgaggaatgtcctggggggcagggcagggtgtggggtggggagaggtgttccacaaatcgtgaggttcttggaggaatctctaattctaagcaggcagtggcatgtgtgtgccatcttttgagtcttttcttatctaaatttcatagtttttttttcaacggtttctcacagtgacagtggccaaagccctcacgggccctcctgttctccctccatggaacctactctggtccctgacataacatagcctgacacatccatcacagctctgcagatcaggcctgatggttctgagacactcagggattgagttcctttaaagactgagctgctctctatctttgctcctattttgagctttagttctttttttaatgatgctggttttacactgtccaatctgaagagcattcttcttgatgggaaaagcaaaagaaaaataggagctgaataacacatttcattgtggggtgcattatgtggggtccattatgccctgcaaagcatctttgtgactaccactcatttggtcctcatggcaaccctcagagctaagtagggcagtgctattacctgttcagtgagggtgaatgacttgcacaaggtccctcagctagttagcagcccaggcagaactgaggtgtaaatccatatccagaaacactttgggggaaattctgactacataagcacaaataactataatcaggaagcatctaaaacactaatatggttgcactagagactctgaaaagctcacatttgaagacaaaagcaaaagaaaaaatctgctttagttgtaaacagacaatgcccagcactgaggagtagtgtggtccccagggaaggatgcagaagatgctggatttttaggaaaagctgaggcttggggaaaatgcagaggcaaactaaaaacatttttagttatgctaatagcatgatcccatgccttctccaactccaaaaaaaaaaaaaaaaagctcaaacaagaaataacaaagacagcaaagaacaagatagtactaggtctgctttttgaaggaaagtggagaaatactgacagctccacgtggagagcagaagagcttggggaaagggccggtagttgaagcagggagaccaggcttggtctggtgttgaccagttggttgacttgcagcaaatcaccctccctccctgaccctttatgtcccagatgcccaaagttctggactagttcagtgtttaccaaactactttaattcttcttctgccctggtgattctgccatacccacacaccacttgcattactgaattctagccagatgctgttgtctgcttaaggaactgagcctgaagcctgctcctacttggttagaaagggagatgagcaagggttaaagaggtgttgaaaccggcccaactgttccatcaaactgatgtttactgttttttggataaacatagaaatggaccctcttgatcttaaagctcgaaacttacatttatcttatttgagtcccatcctcagaaaaccgaccctcaggcctcccagagagtatcagggatctgaaactcaccagatcactgcatccagacatgagatgccagacccctcatccatggcgattcctgttttccaacccctcttccttacccctccttaaatcctgtttttccacacatagttacatttctttcctgctgttatatataaatccctaacttcagttggttgaggagatggatttgagactgatctcccattctccttggttgcagccctgaataaagccttcttccctggcagcacttgttgtctcagtgattggctttctgtgtggcaagcagcaggacccagaccaaacccctgacatttcagtaacagtgttaaagatatcctagcatcaaattaagacttctctttggtatcactagaaagattgaaagaaaattcaagaagaaaaacttaaaaataataattccatgtccatacaccacctaaactgcttcagcattatttggagtcattctgagcccaccagtgatccagggtccacactttgggaagtggtggactaggctggtgatcaccgatatcagtgatgtctatgacactgttagtattttttgacccatatgtccgaggtccaggattcttcctactttgtggcacaatggcccatcagctcaggttgttcttaaatgccgcacatacttcccaggcagcacactaatctctgccatgttcacacagtacaagttcctcatgttgattgtagctctgcccataagccagatccacttgaagctttaaggatccctgacactggaccacaggaatgcacttgtctgttggatttgtcttccatggtgtgagctctcttcctattctttctacatctccagtattacaataaagtttattttttccataataaaagtaatgcacaatcattgtaagaaatctgatcaccaagcaaaaatgcagaaagaattaaacaaatcatccatgcttccaccacccaaagataccatcattgtattttgttttcttctagtcttgtttttcttttaaatcatacttacatattgtgtgtataattttgtctcctgctttttcccacactaccatctgaaataataataagcattattctacatggatgcattctgattctttctaatttttgcttatacaaatattattaataacagtatttctaaagtagcactatttcctcgggagagatccaagaagtgactctcctgagtgccatatcccacgtgcagtgtttgaatgagactattttgctgcaccctcaccagcattgggtagggtactcactaaaaatcaaaatcaaagtctttgctaatttgcaagccaaaaatagctatctagttgtttgaattttcattgtgattactagtaagattgaagattttccatctgttggaaagctagctttatttcttctttagcgaattgtttattacatccttgattcacttttctattttgccttaggggtttcattactgatttgcacgagctctttatatattaaagatattaacaatttatccaatatttgctgtaaatatagtttttggcttttaaaatctaggttcattagaggtttcccaggtagccacattgatttctttagatgtctcatttttcttccttgttggaagtatatgtgaatttcttgttctaatttcatttttagagtctctcactccttgtgagatgttttcttttagagtgtgcagccatggaccataaaaccttgactttcaactttcaggtctaggacacgtgtctgctctcatgccacgtgctcttcctttgtatgtgcacacacccaccatcatctgccatgaacatacaaagacatgcaggtctcaggccctcaggtttggctcagggctcttaatctttctacgtttaatgcttatttgggtcaagaggtcactcacaggtggtttactatgtcaacgagttcatggtttctgaatgtttcctaaggctgaagagttcattcagggtttcaataggacagtggcgcctcagagcaaaatccctactactgggagatgtgaagtttctattataataataataatagtcatgataataacagctaatgtttaatgatcacctgaaatatgctgatctttgttctaagtgcttcacattaattacctggtttaatctccaacaaccctatgaggctggtactacaggttgagtatcccttatccaaaaggcttgggaccagaagtgttttggattttggacttctttagattttggaatattcacattaaacttatggttgagcatccctaatcccaaatccaatactccactgagcattttctttgtgcatcatgtcagcaatcaaaaagtttcagattttgaagtgtttcagatttggaattttgggattaggaatacttagcctgtatgattatttccagtttttggatgggaaaactaaggcacagagtggttaagtagtttgcctaagtgtacagcaaagctggaagacatgcatatgtagtgtatgttgctatgagaacagatgtgtacgcagatgacggttggaattgcccatgagtgaaagcagagacaggaaatacaagtgccaagaggagaggtaaggcagctggtgcagcctaggggtggagcccaagtaagcacacccatgtcctgtgacccccagcacttggtcccttgactttcagtgggttcacgatgcaggaacacatcttgcacaggaatccgagatattgccaggggtcccaggacactaagcagacagaattttgttacctgcctccatcgcaagttaagcactggaattccaatgagggccaggagcagataataatcacagtggcagcagctaacttatattgagcagtaagtacatgccaagcgctggactaagaactttacatgtaaagatcttgtaacaatcctatgaggctggtactgttattacaaccatgttatatatgaggaaactgagtcttagagaggttacacatctccaactggcaagcctgtgcaattccaaagtctgtatattatcttcactttgctctctgccctcctgggtgaggaatgttgatatgatggagctcttctctccctcctgctccaggataccctgatgaccagccagggctgagcagaggaagaagaaatggggctccaagggatgcagcagggggccctgctatcttttttctagagccctgggatagagaataagagaaaagagtgaggcccctggtctcactctgagcgctgttcctgaatgccattagtggatttgcttcccattaatgaaaactggtacttgctaagaattcttggaagagggagagcagacagctgccttttgtttatgggcttctggaagcagcatttctgagcccaaggcttgccgctctgccccaagcagcagcactgacggggcatatctggagtgggaagcaactccctgtgatgacagctccatctatgttcgctgggctcagggctgtgtttggtgtgggcagcaagtcttacaaagcttttgcctttcctcacagagcttggtattcacacaatttacccgtgtctttgtgaacaaggataggatctaacctttacttccgtctacctgtggccatctcaaaataattgtctcattttatgggcttctgtctgggtttgtagctgttacttctcttgattgaatagataaaaaagagtatgtttatactattcaactgcatctcccattagtcaccagtgcaaaccctttgccctagttaggccagattcctcactgtccccacaaacaacaggtgttatcactgctacctggacaaacccttctggctggaaggctcagaggcatttcactcaagaaggctcagtaatccccagccccaggaccatcctgagtaggacctatcttcactgttaccccaggtgagctctgggatctgctatgcaccatatgcctggtgtgctggggtatggagagaccccccatcctgccaccagctctgctcagctctctgtccttttactcggatccactgctttgctctttgctgttgccaccgtccattagccaccccagccactgctgcatgaggcccctggaaccaaggtactgcttcctatttgcttgagttttaccatgctcacagcccactgtggtcttgcttataccccagactggattcccattgacctagatgctgggtagactagctggggagggtcactttcctagttctggtcctggctttctgcctttctcagtaaacccatctggttgaggtcttagcattcattcaggagccacccgcgaaacaaatgctacaaagacaattcaatctattttcttctgtcatgtgagtttcactgtagtaagagagaaagtcatgtgagcaaatggttgcgctgcagtgttatgagtgttaaacagagtcatggtcacgaaattggaaactaaagaggacgaacaattatgtctcaggctgtgtggttgtgcggttgcagggatatggggcgacctaaaatgaaaggggatgctagagcaggtcttgaagaatgagtaggaatttcttaggtggatgtttctgatgagagtggtagggacaattcaaatgggccttccagacagaagaaatgggctggaagagtgaagcagcagtttgggggtgtggcagacaaggtgagagagctggtagatcatgaggccatggtaggtgggagctgagcaggagacagcatccaggctgaacctcaggtttctagctctaatagatgcaaggttgttggtgtcattaattaagttggagaatggtcttcagggatgggggaaagactacaaatctgatttcagatacgctgactttgaggaagagtggcaggaataagtgtccccggtctcactctgagcactgttcctgaatgccattatccactcacctcctgaatggttgacagctctcacaatccaatccctcgtcccgccctccattctgaaggtcagacctatataacccagcacctcactggacatctccacccaaatgaccccatcctctcaggctcttcaaactcaacgtgttgttgctaacaaaatggattatcccccccaaatgcttctcctgttgggtgcccaaatcacagtagacccgactgcctgaggtggaagctgggcatcacctttgatttctcccaggtagcactggtggctgcatccttagtgttgcgttgaccctctcatgttctcgcctactccatttctactgccattctgttcactatcgactcttcggtggctattgttccaactgcctgaactcttctcccctccatctaattatcctccggtccatctttctacgtcagcagcgtggatctatagatctatattcatttattatctgcttccccacaatgtgagctctatgagaacagaaacctctgttcactgttattcccagtgcccagcacacaataggagctcaatacatatcaattaacaaacaaatgaatgaatctaaaaatgcaaatctgatcccatcactccctgcttgactcttctgtggctcctcatagccttccagataaaggcctgtttcttcatgcagcataaaaggcttgctcagatctgggcccagtgcggttcctcagaccttgcactcattcatgactttgtatcttggcctatattccaggtaggagaccctccttgcaatccctggagcatatcttaagccagtggtttttcccgcctgaccaggctaggacccaagtgagacaaggcagggcccttgagtgcaaaatttaaggaggccctcactctcagggacaaccctacccttgcaggacctcaagagtgggtggctccttaggttttcagccctgagtctgcgccctgctgtgtaaggctggttttctttatatactacaaacaaaaccacagatatcaacagattgaatgcagatgcagatgtgagaatccagctgtcttctaattcattaaagagattttcaaaaatataaaacaatgccactcttccaggttttttaaattttggaaatatattttccataaaatgtattttaatgtgtaatgggatatgttattttaaaatgaattaataaacaagtatttaaaaacatttaaaaattcacagtgctaaatttctaaccctacatattccacagaaataaaaggtcattgggattcttggtaatttttctgaaaccagaaagttgaagaactgctttgttaaactagacaatgtggaaaacattgcttataataagcactggttgcatgaattttgtgactaaacaggacttcagagaagttagggtggatgcctcaggcagcaccctcctggcctggaaggttttccacacttgctttcctctgacaccggctgtgctgactccccctttcatctgtagggaaagagaaaattgatgaaggtaagactcttcctttcacaggctcaaaactcttgtcctgaatgcctttaccttttgtcatttttgctcttcctgtacttttcctgtgataatggtttggatttgtgtcttcacccaaatctcatgttgaattgtaatccccaatgtcagaggagggatctggtgggaggtgattggatcctgggggcagatttctcatgatagtgagtgagttctcaggagatctggttgtttaaaagtgtgtagcacctcccccaacctcttcctcctgctcccaccatgtaagaagagcctgcttcccctggctgtacgtttcctgaggcctccccagccatgctccctggacagcctgcagaaccatgagccaattaagcctcttttctttataaattacccagtctcaggtatttctttatagcagagtgagaaggttctaatacgtcctaccttcccattctatttttcccttcaaggtaacaactcaggtctcacctactccaggaagtcttcactaactgcccaatttaaatgttctcaaatgtggatccacagatctatactgagctggccccacgagaatcacctggagagtccataaaatgcccagcctctccaagtccaacacatcttcagagatacactgatttacaggattcagagatacatatttttaaaaactctctaggagatccttgaggccaggaatgggaactgctgagtctgtaagttttccctttgacagactataatctcccagagcacagggattagaatgcctccttctttcatatctccagaacaatgggcacagggctccaggcatggttatggaagcccactgaactgggatcctcaatggggggaatatactgctttaatcataactctagctggaacagcctctctacttgcctcccatcccattacccacaccacaggtctccccttactcaggaagtatctaggaaatcaaaggcacagactcagcacactgtacattcacccacattgggtctacaccttcccaggctaaggatcaagaagccaatgacaaggcctctttaaaaggtggggtgcatgtggtcccaagcatgtgcatgtaagagtgcctagacacaatggtgaagaacctatggtttgtaactccgagagaagcctgggacgttgggtgacaatgtggaccagatctggcagttcttcttttgttctttttctggagactttctaagttccagaaaggtttccagggagggttttgtcgaccaaagccatctgtaataaacattactataattctccaatcatctatcatttttacccatatatttccccattatctcactccctttcctttttttctgaaaacatctctctgatgccccttccctaaagcatgtagcagccagaacgatttccaagacagtgcagggaaagctgagcccctggtcctgctggttacctagactcagaactgctccatctgaaaactcagtttcgattcagacagagtttctgtgtgtccccgctccccaccccgcccagaatgcagtggcagaatgataaatgtgatgccgaagataacgaggctgaagggaggtgtagttctaacggaataaatacctctttggtaaatcttcccatcaagatgtctttataactaaaagcagccgctctgttccctatggttgctgtgaagactgatgggcttctgtatttctccaggagccatctctcctccctcctccagctcaccaccagcaaacagacatcatactgggtccaggaggtaattaaagtttcaggggcaggtgggaagcaagaggggcgagagccaagaaagcagcaggaccatacactggcagtgttgccaaactggccttggtccctggttcctggtgacagctgagcatctgcattcacttgtttttacggagattgagaagaactggaggcttttctttttgccagttttgacatctctgtgctttgcacattaacaggctcaccacttgacactatgtctgatccatccactgctctgcagaggtgtcaagcaaacttgctagagatactaagggcccaattatggtgcccagtttatacttggatcttgacagatgctggaaaccttttagaatctgggatgattagtgcagaccttcccttgcttgcaagcagcctggaaccttgcactcgttttatcggtatccaatatatccttattgaatggcctttcccaatgaagcccataggggcagtcaaaggctcaatgacaaggagcctgaggcccagaaagaaaggtaacttgcttgaaattatacttcaagctggtaacaagtcctcagtttcttaggaatcatgctcaaaataagaaattcaggcaggtcagggcaagagcagcaagccagccagaatttgttggatgaggaaaagagaacaaattaaagagaacgctgtccaaatgttggtggtgctgatttctggcacaattactctgccttctgctgcccatatacgaaggccagaagtctaaaacagactctctcaatatcacctaattaatcaatttcttaatctccgggggtatctcctcacatagatagctgagaaatagtgtgtagatagatattcaaggaaggtggtggtgggcagtggtggttaaaaacctttaaaaagaacaaactaatctgatcaaagaaactgaaaaagaaagaataagggaaacccaacaagaagtgggcctgaaggggacttatttcaggagggagaaggactgtccagggcctggattcagggcccagggcacacaggccaggagtagatggaagatcagttatccaatcaggtatgaaaatccttgataagctgggaagtaaaactctgagtcacttgagatggccacttgaagaggcctaatgccatttatctactctgtcattttacaagggatcagaccaaggatttgaccagtgaagggggttacagatctgcatctagctctctccctgttccaactcaccttggagttggaaaagagggtaaagtccagggaataaaagtagctatagatgcccactaggatttggagagaattttcttgtaagggggagatgtctttaaacaccaaagcagaagccaaatctgatcctgggacttagactcatatttactgccctttctgctgagaagagcttgaaaaacaaaacacaagagcttgaaaaaccaaccccaagacttgctaaacttaaggattttctccccattctccatatttgtctcagttccttctggctaagctccaatccttagtgtctgctctctgtacttactgagaacacagaaacatatataatctgaaacttggaaaggagtttagagatcttctaattcaatctttcattcaaagtggaactcctcaacaccagtcttgacaagaggtcacccaggctttgaacttttgcaataatgaagaactaattacttttccatgcaatcagactatcagagacaccaactgtgaaaaagtctgcctcagaattaagcccaaatctttaactcccatacctgggtcctcattttgccttctgaagaaacacagaaatttattacatctttttataagggatgatcctgcagatagttgaagacaaccagcaagcccctcttcaactttcccagtaggacatgggccaggccctccatcagccaggatgcccagctgtggacatgcttcagtctgtcaatatccttcttaaaatgtgggccctgttatgagtgcagagaagccaacccattgcatccaatgggttcagaccaacttggaagaacaggaggcaacctggatccctggggcttggagggtgctcagtgcctctaagagttaagctgagagctgtttctcagagaaacgccaggcagatcatcctccaaagcaacctacagagattgaggcagcgctgggggccagggatctgggagggagtcagccacatctagctgagggtctaattcctgacctttggaagctctgcattcagatctttgtgctggcccctgcggggagcctccgtggcttgacaatgggtgggtaggcggttggagggcagggagaggatcatttttagttgttgattttaccaacagatattcagaaaatcagtatttgtgtcattttatgtaaatccagatccatctgtcagaggtgtttgaaccagagcaagtccatctttaacaggggttgcgtaaaataaggctgagacctactggactgcattcccagggggttaggcattctaagtcacagaataagataggaggttggcacaagaaacaggtcacaaagaccctgctgataaaacaggatgcggtaaagaagctggccaaaaccaagatggcaatgaaagtgacctctggtcatcctcactgctcattatattctaattataatcattagcatactaaaagacactcccaccaatgccatgacagttaagaaatgccatggcaacatccggaagttaccttatatagtctaagaagggtaggaacccttagttctgggacatccctgcccttttcccagaaaacttatgaataatccaccacttgtttagcatataatcaagatataactacaagcatatttagtcgagcagtccatgctgctgctctgcctatggaggagccattcttttattcctttactttcttaataaacttgctttcactttataggctcacctcaaattctttctcgtgtgaagtctaagaaccctctcttggggtctggatcagaacccctttctggtaacacatctgtgatcatctagtgtacctgcaggctctgtaaaattttttgattaccttgctgttgcttttttctccaaaggcatgtggtaacatcttcagaaatctctagggaatgaaaatttgggcataatgcatggctttatgtcctgaaggatgttgaagttcacatgggtggatcctggacaagagacttttggtcatctgaggtttgtgacaagtcaacatgaatcctgaagaaccaagtcatgggtactgtctctgccacatccctgtctggaactgggcactgccagtttgggccgcctgccttcttggggctccccatgtttccttgtaagccacagtccctgcgggcagcttggcaatgactccccgtctctcgcaccagcccgatcgcactccctcccagtaatctgattttctctgggctccgactttacaaagaatcttctcaactggcaagattttgatagaaagtgtttgttaaagagtctgggatgggttatgattctcagtctgtactctgttggactctgttagttgctctcttagttgcttccctgcaccttctaggtttgtttcctgtgagggtgggctttttctcttctgacctccagaagcctccaagggcagtgaccatctcacctgacagaccctgtgggtagcggtattaggatcaccaccatttcctcatagcttccagaggggcagattataaggagcttgctgagtgctaacctgttcatgcaaatagacccccagcgacccctgagccattttatggctcagaaacaggttgacagatgttgggtaaatttcccaagatcccacctctgagtctaaggcctgtggattctctccagtctggccttgacttctctatgagttcaggattccaaactccatccccggtacccttcacttgtccctggtggctttccagtttaaataaagtaagcatttctagtaagagtgtcttgtacttttccccaccccctgtgaattgacacaaaaggaaatcaacatttaagttagttttaataccaacatatgtttattaaccacagtgtctttcattcagtgcatttccatatgtattaagtcattttatcctctcagtcaccctataaaactgaccaaaaagtgtccttatctgtattttgaagataaaggagcaaagatccagacaggcttagggacatacttagggtctcagtgaattaatgaccaagactgtcactcccctgctagccctcactctgccctctgatgtaacagttcccaggcccagtcttttctctgcagtatcatcatgagcccctcaacattcccacacctgatgctactctctgagataccagatatccttctgatatgaggcctactctaaaaaacaagaagatctctgctgctcaaagagatccaatttttgagtagttattatgtgccaggggccctgctctgtcccatggctctatgaggtagctatcattattagcccaatttataaatgaggaaactaagcatgagaatagtttagtgacttgactgggctcgtaaagctagtatgtgacagagcctggatttggaccaggaagttttggctcagagttgagactcccacgtggtctaggcagtacagagtcccacttagttgcctgatttagactcccaagggccgtcgatgaagcataggatcacacgggtgtattcacagccatgttgcccagcaccgtggattgagactgtggtcaactaaaagccctagatgtctttcccataagctgtgtctaatttagatgccccccctcgaaaaacactaacatactaccctcgcccctctagattgtcagtttatcagactttctttgattttgatgacactgagagtgttgaagagtactggtcagatattttgtagaatgttccccaattggaatttgtctgatatttttttcataatgagactgggtgttttggggggagaccacagaggtgccgttctcatcatgtcataccgagggcacatatgatccacataacgcgtcactgtcgaggtcaaccttgctcacctgggctgaggtcattttgccaggcttctccactgtcaagtcagcttaaagttacactacacccctcctttccgtgatgtactgtttggaaggaagtcactacctgcagcccacactacggagtagggagtggtactccagctccttgagggtgggacatctatataaaatacttggaattcttctagatgtctctacactttattcagggtaaacctatcactccaggtggtggaggtcatcttgaatcctgctgctgtatgcaactggtaatttaatttaattttcccaggtatgtgctatggatgcctccattaacatggcttctatcttttactgttacttataaaaaacacaacagacatcccagcgcgttgggaggccaaggcgggcggatcacgaggtcaggagttcgagaccagcctggccgacatagtgaaaccccgtctctactaaaaatacaaaaaattagccgggcatggtggcaggcgcctgtaatcccagctactcgggaggctgaggcaggagaatggcttgaacctgggaggcggaggttgcagtgagccgagatcgcaccactgcactccagcctgggcgacagagcgagagtccgtctcaaaaaaacaaaaacaaaagcaaaaacaacaacaacaacaacaacaacatcaacaaaagcacacacaacagatgaggccaaagacagagacctcttcacaaatcaccttttaagatgttctgttgacacttgggaaaaagggctggcacttttggaggacagttttgaagtcaaatggttgtactattgtccagatcacatctctgtattttactcacaatgtgatagggaataacttcattaatgttttcctgaaatcacgctatatgccaattctattccccttgggttctaaaaaaaaaataccctactaggaaaaggaaatcatttaaattttgcatgatttgtttttagtgagcccctgctggctcctgggtatctatctctttcccaagtgcacacaaacaatctatttactgctctatctttttagagtttcatcggtttgacatcaggctgatcaacccagaacgagaatcttgctttttgaaaaagctgtttccagtctttgagcatgtcctttgttccatgtgctttctcaacaattcccagcaacatttcagctattgtatctgcccattctttcagtcctgagacaccaagtatttgggtctggagtcttgacctcattcaaaatttgttccctttggtgaaaaagatggaagcaaacaagaagcaggtgcttttattttcctcactcttctccagaggcccagttctccacacaggtaggtatgttgtattccttcctgcccttcagcattatcctaattcccttttgttagatctttcttttggacaaagctaacattatgtcatttccccaaggagcagtcctttaccttgttcattttcctgcttcaggcattacttaaaaataacaaaaccactaaaagctaacctttatttaagggtttgatagtcagaaaaggagaggaagagcattacacgcagggaataatgatactaatgatggctaatatgtattgaaccaaatgtgccggcactaggccaagcacttaccatgcattatctcatttattttttacaataaccctttgagaatggatatcatctccattttacagataaggagacagaggcttggtgaggttaaagaacttgcccaaagtcacaaagctgagattcaaccaggtaggtctgattctgaatccttactgttaacagtaacaaccacagaaatacaaaagtgcccttttttggctggaattctttgtttaaaaaatggtttattctgggtgccttagtccattcgagctgctataacaaaataccataaactgggtggattataaacaacaaacatttctttctcacagttctgcagcctggaaagtccaagtttaaggtgccagcagatgtggtgtccagcgagggcctgatcgtcagagatggccgtccttgctgcatcctcacatggtggaaggtggtgaacaagctcccctgggcattttttttagaaggaaggaaactaatcccattcatgagacgtctgcagttatgacctaatcacttcctagaggccccacctcttaataactatagcattggaaattcggttccaacatatgaactttttggggacacaacactggcctcagacctccagacacagttcttgcagagtactgtgccccctggtgctgctcctctggtatggagccctctcatcttctgacgggccccgcaccttttccaggtgggaactccctgcaagcattctttgcgtcttcattggttcctctatgttaggtcattttaacattaagtctccaaccccctctaaaattatacacaaaacattgtataggtgtgtctttttttttttaatgggggaagtgtttagagttttcattagattctcaaagtgatttattttctgctcccctccactgccccattcagaaatttgtaagtcattgtttttgatgtatcttttcttaggtgggcacggtttgtgactgtaatatagacatttcacttttataatctccctgtcccacctaagctgtattcccctttggctcttctggctgtggaactgaacttcctgctccattgtgctctgtagactctccctttataaagcctcaggcttatgtctgaagatgcccggtgtcccctccccaggctatcagtcatgctcggatgacgtggctgctcctctagcttcccatccctgctctttttggtcactgcacaaataatgcagcaactacaatggccaggcactgttctaggcagaggggacaccacagtgaagaaaacagtcaagtcctcatcctttggagaccagcagtcttcatatcaatgattcattcttttctgtggatcacaatgaagtctagactcagttcccctatttgtctgttccaccttttaagggataaaattattagtgggtcaagtaaaaaatttatcagctcttctgcttttagcagaatacttgcagtcatctaattagtcagaggccctatcacaattcctttctgtcctgtgctgttgggacatcgtcatctgggaggcagtgtgtggcatacccttcttccaatcctctcacatgggcggcttcctctggctcacagattcagacaagcatgcacctttcaggcacgtagtgtttctctttctctgcgcagttagaacttccctcgctgtacatttcaggcctgcgttccatccaacagagaggaggacccatgagcttatgttaacttgtttgaccactctctctttctcagtaggtaaatatcagaaaacgaattgttcctgactcttcacccactagttcctgaggcttgctgggcaactcttctggaaaatttcttctttctctagaatcagcatgctcaatttaatcgctatgcaactcagagcaagttaaattctctgaggtgtcttaaattctctgaggtgtcttcatttatgtaacaaggataatactacttatcttttggggttgatgtgaagagtaaatgagacaactgtaagcagctaaattgcctgttgcagaaaatgaggccaccacataagggcacaggccatatcagttccctggctcctgctctgccaggcctgtcttcctttagtgtgtttggccttttctaggcatttccgtttcctctgcttacattcactttaatgtctcatttcagtgtctgcttgtttgaggctgtttaggagagaagaaagaatttagaaggatggtcaggttggcagaaggctatgcccaagcggccctgggagtacaggcctgggggggtcaggggatggctcttcactgagatatgtcatttccaaccatttctgcttctcagaccctgcctctaggccagggcccattgggactttgtagcataaaaacatgtcctggagagagggaaggcagctgggaagcagggcacctgggaggcaatatgggcatcactgtgggtccccagtgtcaaccagaaaggggcccaggtgttttggattcaggactgctcttgataaacacggcattcgcaggggacagggactcacagaactccaggcagaagggctgatggtgagggtgggtcagtgctgggctccacataggccccagctgtccaggccccccaacccaccctgagcgggccatgctgcccagatgcctgcctgccctttaattcagtcattccattttagcatccctgtggggagcagtcatgagggaaggtgggacctcccaaaatgtcagggtcctagagtgagaaagcagtgccactctccctggagaggtccagtgaggctctgactggagaggaaatgccactgagagaagtccaggctgggaaagatgcagtgggggctgggagggctggaaaaaccatctcagctgaggctgggatgactagtgagcaggggtggaaaatgatgccaaggagctttcactctggacagtgaccaacgggagctccacggagtagctaattaatgctgtggctctgccagcgtgagtggcccccacctccatctgtaggactgtctctgtatggcaggtgcctttccaactcagttgtgtatatgatctgagaatatgtggcagatagaatgaaccaagaggcactgtcagagaagagaaaaagttggggaggtgggtaccacaaacccagggattcttttcagaaaggagaaatcccagctctccccacctcttctgctttgggtccttggatcacggcagtctttgtgatcagttatgagacagagaacaagagtataaacggcatcttgagggcaaagattatgctatgtttatttttggcatggttagcatctttacaggcatgagttccaccctttgctgaatgaatgaataaatgatgcttgttattacattgtctggattgagctcaactgggagcttctgcattgctttcattgtctttctccctctgagttatagattttttcctagacctgagctcaagttgagctcagaaaaatgctagctgggttctgtggagtggatgagagaatcagaacagtctccggagtttggggtttccatagcaaggctcttggagctcctgcaagggacacagccctgtgcacagactgaccactgtggttctgatagactccagtcccaccagaggccctaccacgtggatttcctggaagctgtgcacatggagagggctgcattcccttggcttttccccatgagtggcaagagaaggcaaaggctgcccagtccctccagatggcatgggccccaagctccctgtttctagaaagtggggcaggcctcaggggcccacaaggagagctaaaaacaaagcctgactgtttctgcttctttggagagtgtccaggtggcctctgggaatgggtgagtggggtgtccactcttgcctgggtggacatcttgctttgttttgacttcaggagccagtgaagccccttctgccctgcatttcagggttctctgatgcaggcattggtgccaggctggaaagaagatagtgataaggacaaaataagcccattgagagaatagaactagggttgcaaaaacataggctcctcaaatttgaaccttgtgtttccccttacacggtgttactgctgctcctttggcgacattttgcaatgttatttagagatactgaaaacccaagtgctggcagatgatgtagcaatcattttatgttggcataaaatggggtctgggaatggagcttggtgggtaggcaggttttatgttctctgggactttggctcacgctgagagtgacagtaaacatggcttcttcccctttctccaccttccaattccccatatggccccagaagagaagtggcctgtacgcagcagagcaggggctcaatgaacacctcttggagagaggaagaggtgaggtgcacagcaggaaacgcaggttcaggtggatgtgtctctcaggatgggagcaaggcactctctcactcactcaaccactcaacattttaaaacgacctgtgacacgtggaatgccagtgggggaagaacatgagatgaaagcaaattggacaccagctctgccttcaagttcatcatgtccctgcagacctctccaggacagaagctcacttttccaggaggtggggaggccccctctttgataagcaatgccacttcagaattattccttttattattcctatttccattttttaaaggatccagcttctttgatggatatacaaagaaggtacacacgtctatcctctttttggtctctgtcatttttcagctttctggtcgctgagaaccttggcatctgctgtcatcctactctgagccctgccatcatcccagctggccccaggatccacggggaccactctaacaacagctgtctgcccaggtccctgactatcctctggaaacactttcttcattctccacacagcttttacaaatgttcatccctttcctcaagcctcctcactcccatcccttcacttgagacagaagatcttgcctctgatgttccacagaaaatggtggccacccacctctccatgtttggcatacacacagcacacagttacctgtgtcccctctcatccttctctctctccctccatgtcactggagaaggcagcgttcctcctgtcagagctaatcctgctggtacacccagcatcttggtcccttctgcctcctcaaggactttgttccagcaattgtgccttcatcagacatcttcttcaacctctccatctctactattctctcccaagctcaacgcttgtgctccttcaagacaaacacacctctcttgaccctgcatactgctgttattgttcccctttccttcatagcccaggttcttcagtgcagtccacgtgcattctctcggcttccttactttccattcacactgtaagccctgccatctacagtgaaatgtgttcaccaaggtcactgatggcctctgatgctaaatccagtgggcgctcttcagtctgaagagcaaagtttttggcagcctctttgcagcatctaacacttgaaaactgcccctcctgttgcaattcaattctcctggcttctgggaaacaattctctcctggtttttctcctgcctttctgagcacacctcacatttctcataggctcctccacctgcaatttaaaggctccccacagtgctctcttctcctactccatccactcccagctacatgcagatgatgtcaagattggaatcttaacctggatcttccttggatgccagacttggcatgtccagctacctatccagtagctccactcacttctgacacctcaaatgcagcatatcccaaatggagctttactgtctctccccatcaccctcccgcccccaataccccagggtctcctcctgttctcaagattcccttccagttatttaagtcagagaccaaggagtcatccctgacttgttgctgtgagccacgtgtggttccaattgtcttatattaactctatggaatactcacaacagccctgtgaggtgcttctattattatatcttattcatagacaaacagagtgagacacagagagattaaataacttactcaagggcacagaactagtaagtggccagcctgggatttgaacctagtgagcctggtgctagacttcatgctctttcttacccactaaccccactgcctcttggtaacaattctgtggattctccttcctgaataatgccttcaacattgctgtccccctgcaccaccatatcctaaaggtctggttggcttcagcctagtctctctagaatccattcccagtgagtccccatatccttccagatacaatcagaggcctcagtgggtttgcaaagctctgtttttctacttctctggccctgctccttgcctttccctgttacctaccagcacactagcattgtggtgaccatataatttatcatcctaactgggattgtctgtgagtgaatgagggactatttataattaagcttggtcaataagtgtaaaccaggacagtcccacacaaactaggatatatggccaccctaactatcatccacttatactgaaatatttgctgttctccaaacactccgtgttctttcacttctgggccactgaacacacagttccctctgccagaaaaagcccatttatcctctttcgggagctcttccctgatgttactttccccgggttatgtaagatacctttcctctgtacacccatgacactctctgctgctgctgctgctgctgctgctgctgctgctgataaaagaatggcagccaatgttacctgggggtggggtgcaggacagaacagcacagtagttgagcctatggacaatggagctagacagcttggggctgaatctcagcttcctatgtacccaggttaagtcacttggcctcttcatgcttccccttcctcataaggttctcacgaggattatacgggacagtctacaggacatctgcctgggacatagtcagcatctactgagcattcacaatgaccttttacagagcacttgctatgtgccaggcattgtcagcacctcacagacatgacctcatgtactgtttgtcacaacagttttgtgaagcaggggttgtcatcttcatttgacaatggggggaaactgagtcttagagaagctattgccctaggtaatgaagcagccctgggcagttctggattcaggtttgaacgcaggcctctaactcacagcacggtagtacctgtgttctcctactgggtctccctcactggactgtgagccacccgagggcagagacggcaccttttgcttccatattctcagctcaagcccagtgcctggcccagtcttggcaaatatctacaggcacttataacctacaaagaggggaaggcatgctcatgcctgaccaaaataaaaccccatgacgaggagtgctgtcagggaggcagggcaaactggccagagaaaccgagaggcgggaagatgctctccagcaggcgaaggaggggcagcagggccatcttccttcccatagtattggggttttcatatcacagagacaggccaaagagacacctctgtatcacctttcctcctagaaattaggttacaaaagtatattgattgaggaggagggagggaggaaaagcgtgtgagtgtgtgtgagtgtgtgtgtgtgttttgctgcaacgtgggctcgcctatgcctcttatccaagataaaaatggccaaaagaaaataaacttccttcaaccatttccatgttattttctggaataaacacgtcaggcagggcagcccagaatgccatgggccttagatgagcatttacagtaattcaacaacagtgaagccgtgcgtgcccgcgtgcatatgtgcaggcgtgatctacgtggggctgggtgtatcagtccccattcctgagggcaagcagcagcaaattaacaaaaaatattcccaccaggcctcacactgccaaagagtaaatataattatccttaatcaatacaggcccttcagcacgaggtaatggctgtcctgggcttaattgtttgcagcagctggagagggaggatggcgggaacagaatgctccagcttccctctggcagggcagggagtcctggaactgcaggcaggatcccaggacagcgaaggggaaagtcagaggaaaagttcgacagggagaaggtcacatcatttgccccaggttgacagagctgttggtggaatcacacagcccctccctgagctcccatgacagcacctgcctaggcctcgcctctcccacggcctcccctcaggccactgtgcagtcaaggcagggctaagcagctcctttgctgccacctcaccttcttgagacattgcctgtgtttcatgaggacctgtgtgtcctaggcactgagggagctgacagactggagcatatgccttgtctcgagcagctcgctcatggcccactcctcagccacgcgatcgcctggaagtccctgatactaagggagtgcagtcacggggaagggagctggatcttgggcatgacaaaggctgtctgagactcagcacctgagatcagaactcatgtctgtgtagtctgctctatagagtgctgagttcctgaccctgggaccccagaggggtatggttgtgggtgggcacctacagaccattttctgcattcgagaaagtccaatggaaatgtcacacagccagggctttgggactaaccgctcctttcctgatgactaactcctttcctgtccccctcccctaggtgctgatctccaccctgaagtgactctcaggtatctgtctatatagctgcaaacaaataggctcacagatactcaagccaaacctgaaggcctcagaaaccgtggactccattccctaggcactgcacaagcccaggagggctgcactcacagagccacacaggcttggttacaggcggcatggtgcgtggcccctggggctggcccacccagcagaagtcctgactttgcctcctcttggctccgagaccttgggagaattatttcacctctccaagcttccattcttgcctgtaggatgtggatagtaagacctgacgttgtagggcgtggagatgacgtgaggtgggcacaggccagagtagaaggatgccagggacgcgggatgtgctgtccacagggagcgctggctgcctcatccacaggggctgggggcacctctcttccttgctcttcccttttcccctgtcttccagtctccaggctgatctccatccttcccccagttctctcctgcccctccctctcctttcctcctctctgattcctctccttctcccccgccgctccctgtagctccctcctcctcgaggcacaggcgtgggaggtttgggcagctcacttgtgctctgcttgttgtctattcctggccaggtgcaggtggccctcagagactggtggtgtattgattgggcctgaacactgtctagacacagcaaactacccaaagtgggtgctgctacaataccaccaaaaactcctcagtgactctcgactcttaatttccccttttcctggtgagcagaagacagaggctgtgacctggccagccatcagctgtgccacagcacccagaaacagcactcagcctccgggaagcagcaagcaggggctaagcccaggggatctggctcagggtccctacccagcctaccccatcttcctctctgccccctggggtgggtctcttgctcccaaggactcaaggaatcccacctctgtgaaaggaacacctgtggcttcaggcctggcccagtgcccctgagtccctctacccctgtgggtattgtaggagcagtcctagaccaagctctgggtacaatcccatttctagatgggggaagccgaggagtccaggtagcagctcggcttcaaggccactggtacaactgtgcaggtcctggctgagaaggggctgaaatctgcatggctatatctgtcggggtggagggaagcaccttttctaatttgcacaaagatgccatttagcttgtccaggcctggctcaacctagtgtctttttgcttatctgttctcctgaaaactccgtggccctgtcccctgccggcactgatttcctctgtggcttggctccttctctgatccctttatgcattctttctgggatgtgacttcctgtatgatgctccagccctcctgtgacaggattctggatctgagacccagcctcctccccgtgggccctccatatcttccatcggatctccctgcctgattcagctctcgactttctgagagcagaggagagagcctaccttcttgcctaggtaacccaccagagagcccataactcatcagacatctcaccgcgctccttcctgctgcatcttaccacctttaactctgtccttttctctgcagagctggagaatatctgattctcctctaaccaatccctgcccaaaaatgtcatttttcctggtctagtcctaacaggccctgcatagaatttcaaatctcctggcaccctcagttggcctgttccctgctccttgattagagaagcccaaattgcctgagtgctaagaatagcatcatcatcagtgactaaacaacccgactgacagcacccccaccccagtgtgcttggggacacagctcctgagcctctaccccctcgggaatccttggaggctgctgtgccatctggggacccctcacagctgacccataggcctccttccccttgaaatgtccccacagtggaccctcctttccttgtgaacaatatagggatatttgatgaaggggtctcatcacaatcactctgggagcctaacatgtacagaccctgggtcatagcctgggcgcactgaactggaacctccaggacagaggcatgaagctgtgtgtgaagatagcccgcaggggattctgacatggctggtccggccactggccactggggaccactgcaccaggactttctcgtgtttgtcttcaactcacaagaagcccaagcagtggcccttgagcattctcagccagggactgggagagtgaccagtgacattgttggcggcagaaaaaggctggccccatgttcaaacacccacatgacacagacacatagggcacaaaccacaactgcgaagatggaactgagcatgtctctcacatgagaaaccccgtgtggggtttactctctgtaacaggaccctggcacttaggtttctcctcaatgttggtctccttgtgtatctctcatccatgttattgttgagctcctgtactgtgcagctgtttaggtccctataatgtccttagaatcattcccactgacctaataacccccacccctgctactttttatctgacaactcctaatcatccttcaaaacccaacttggacataaccattcctaggaagtcttccttgagctgctattttatccactccacataagtaattgtttctttctctcttacctttaaaaggctcttcttgtgatggacatattccactgacttataatgattttgtttgtccgtctttcctctagatcagggcagtaactgtgtctaagcaccttcatatcatctaacacatgtggtaggtgcttgataaatgcttgctgagtcaatgagcgcagtgtgagtcttcccctctagaatgcagtttccttgagtccttaaggactgttcatcttctaaaagccagcacagtgcttaacccagctcacatacctctgtggaataaatgaaatgtcattgcctcccttctgccccaaaactcatctgtactcaatgaaaatctcaacaatctcatcacaactcctcctggcaaatttagtcactcccttctctgtgttcaaacctctgtaaacatgcctgcattacagtctttaccccattgtattgcaaacatttgtttacttatctgtcttcctcactagacgtgagctcctcagggaccaagcctgttcctcattcttcttgtattccccaacgcagcacctagcagggaatctggcacaatgcgaacactcagtgcctgtgtgtggggtgaatcaccaccatgaggcggccgtggctatggaacaaagagtggctcacagctcaacagggaccctggattctccaggagagactcctcagagccactgcccacttgctgagggcagtaaggtgcaaaggatgtttaccacgacagccagcaacttggtttggctccctatagcctcctcttgtctctgcctctaagctcccaggagtacctgacccatcaatctctacagctgccactgtctggataatcaactatttgtggaggtcacaaaatacgtgggtcacaggctcaggtttctcccctggaggatggatggagcttttctttgtcctcttctcatcctagtcacctgcgttgcccaatattaatcaggtgcctactatgtctaagtccctattccaggtgctgaaagcacttttctggaaagtctgagtggtcagtggttgtcatgacttggaggaaggttggcagggagaagatggagtgggggctggaaaagcaaagcaagcccaggaacaagaaattacaaatgccttcaaggcagcctgcagccctcagccctctgtggggcctgctcagcaacatgcctagcaggtggggagtcctttttgtgggccggcagggactaagcctgagctgtgcatgctggcaacaggcgtcatctacataagcctggcccagacagcttccagcctggtgctgggctctgtctccggcaccttcttttaaggggtaatcattttaataaatagggattgtgggcctcttgcctgagagtgaaactgaaatcgaatccataatccagacagaggggagtgcagctgcactgggttaattacgcacacaccaagcatatggcagcgcacctccagaccaacaggcggagagcattctctgggatgcaattagttcctgtgcatgcataaaaaatgagccagcacctccaaaagaaaaataaaattgctgaagtcataacctcaatccagtgtaattacaatcactgagtcgtaccacttaggtttaagcaacattcattcatccgctctcaggcaggtgggcttgcctagtggtggttttcttcagctccgctctgcccgtgcttcctccacttccccgacccctgctctcccacagcaccctttccctccccaagtcctgagcaccacattgtttaaccctggtcctccacggtgatgtgataagtagagcatgattcttagagtcatagtaacagcatgcatgcagggagcctggcactttacatgaattatccactgatcctcacggcaatgctatgagataggtaatgatactaaccccactttccaggtggagaaatcgaggcttagaaaatgcagtgggttgtgcaaggctgtgcagacagggtgagcccattgtgcttggtggacttggaaatggaacaactgggctggaatttccagcatcacaacttgaggcaagtcatttcatcttttttgagtcatttttatctcccctctctgggaaagtgtgacaataaaactaactttcagggtcgttctggtgtgaggattaaatgaaatcttgtatgtgaaagtggcaagcaggcagcagaccttcaattgaggtctggtgagctacaatgcatagtgattgggaacccagctctagaaccagaacaatctggggggaatctcctttgcttctcccaacctcccctcacttccttcacatttttgctcaaatgtcaccttgtcaggcaacctcccctgattaccctaatttgaatcacaaagcccaccccggcactccatagcctcattctttgctttgtgttgttcataacactcattatcttttcacacacggtccatgatgctttctttcctcattcctgtgtccccacccctgttccctactagagtgtaagctccatgcgggcagtgaggttcatctgctttgttcactgctgtcttcccagcactaaggataatgcccagcacctagtaggtgctcaataacggtttattgaatgaataaatgattaacctcagtttcatcatctgtaaaacaccacctttttgagtttttgtgaggattgcatgagatggcttctagaatgcataatacagtgcttggcatttggtacttgctccaaacacgatagttatgagagatgaggctgtttattctctgttcaccagcgtagctccagtgctcaggagagtggttcatataaggtagatgtttgctaaatatctgctgagtggattattgtttgaaggttttttgagcctgaaaaagtacagaaggcctgtcagaacatggggcccctcatgctcctgctctaaaaaatggcctgtggcccacagagggtcctagctgagaatgttgtactgctcagagcatggccgctcaccaaagcaggcacctggcagctgactctagttggaaaccttcttgaccagggggtagagatgccagataaaatatagtatgtccagttaaatatgaacttcagataatgtaatatttgggacatatttaaactaaaaagtttcattgttctgtgttttaatttgtgaaatctggcacccaagctggaggatgtattttcaaggcactctgagaagatggaggcatcagggagaccccctgggctacgaccatctcttctcctctgctgtggctagaggggcttagcctagatagggactttggggagctcagaggcagaaaggcagaaaccaagacctgtgggaggtgagtcggttgtccagtggaggggtcagaggggcaaggaaaggcaggcgtcgggtgagacactgacccttgccactgggcagaggctggttctctgaggagtggctgtgaaagggcagcagtacaaagtgtttctttgtgacacacacacatcctgctcttagttgctgctactaaaatatctcccacatttgcaaattgcttcatccatcagtctcagggtggatgtctcctctgtttgagagatgaggggactaaggcctcgagttaccaaaagcactgcctgtgtttccccactggttagctgctgagctggagcctcctggcctcctggtgccgggctactctttgaaaaggggtgaaacaaggcctcgctgtctagtcagtgccattagggaacttcaaagcacctggagaatctcactcacatttcctggggaccttctacatccccggcatcctgtcacagagtaaggtacctgccactctgtggcttcgtcagtcctgccgcttaagggctcacctgactgtgccctgtctccatcctggtctggccagctgctctcaccaccccctggggtccacttcatgaaactgagatccttaggcccatgggggaggttaagctgaggtcaaacccagactgaaacctcacaaccagagctccccttttgtgttctggagctccaaggcctgggctgcttctcaatcctgcagtgccccagaatgtccagttgggcagcctccagtcccatatattcccctcatggggacaagcctgccagcctccctcctgagtatgagttcccagtgtccgttatccgaaagctaactcatccccctcatcttccaaggtcagggaggcgtgttccagcaagtgcaacccagggtgactctgatcaccagcttgtaattacttttcacaccttggttacatcatgatggtccttgagctgagtctttgtcttatgctaatgaccacataccagcctggcctgagaaggctgtggaggggatcttccgatagcaaggaggctgctggatctctggccaaactgctgaaatttgggaagctttggggtacatatccttggggcataggtcagagtcagcatcctgttctctatatgggtctaggaggaccatatctctcaccttagaccttttccataaccccctgctgcacacctccaccccaggcaggtggcacactcaaatcagggtatgggagaaggtttataaaggggctgcctacagagatgtgggcagggtctacagaaaccacgagggatggctccactcaaaggaaagtaaagtggcactgtcaccatctaggctaactggatgaggggagggagtgggaccaaagcctaggagaagagaatcatagaaacggccccctcaagaggagctatggccttcaactatggggcagagccagtcccagatgacctgcagggaggcagccaagggagtaccccaacctcaccctcttttctccctccaggctcttgccaggacccccactggccaaacccagccagaagccaggatggagaaggatggcgagcagacctggacggagaccctccctgatgaatacccaagggactgcctccgcactctgcacctgccttgcaggggagagaagaggtaggatagcaggggtgttttcactgtccacagtaagtttggtgagggcatggatgtggggtggggagatgttttcagaagtttcagaacacacaatttggtctcagaagccttgagaccttgcactgtgtgtggccctggtcaagttgcttgccctctttggtccctgctcttctccctatagcagcattgctaattccacacagggcgactgtgatcattacagaggataacatgagtggaagctctctgcgtgctgtgcacagggcacttagtagatgtgcaataagcacaacctgaatctagaatggcagctggtggtcgcctggtagcctcggcctcccctccaaacccgggcttcctgcctgctgtctctctcagcctccctcaggccagacccccccttgcacatggtggatcctgagcctctgcccgacttggggtcagcgccaggaagcctgctgccagccccacctgccaaaggtgactgctggctagcactggcctgtcccagcatctggcagagcttacttatgagcactggttccaagccccaagtgactgcattgctaggtgtcaaggtgtgcaaaggagctgggggccagactggatggaggagggagggggacccagggaaagggacctaccttgtgagatcctgtcccctgtcctctgggcaagcagctaagcagggcaggaagagggggagggcctcttctgcctgagagaaaccagcagctgcctgtctaccttgttaactggagcacaattaaagcagttaggagtcgaggacgtctcatgtttattcatgtacctttgacacactgtctttctgtgtcggtcacagtccctgtgggtgctttgtggccactcctcctcctctaaccttctctgcctccacccagttcctggacactcgtcatgcgccttctcattgatttcatttacaaatagtaagtgaacatctgtaaaacgccttgcagtttacaaagcacttttcatattcgttactttgggtaagcctcacagcagccctgtatggtttctaggatcatcatcgcggtgttacagatgctctgggctccacagtccctgagagaaggtgcagccctgggcgtggggtcacagcgcgtgctgaggaggacagagatgtctgcaccattctgcttctgtgcagagggcacggggctggttttgctgacccaggtagcggggacaggacgaagtgttcctgtgggctgatggagtgagtgttgtcctcctcctctcctggctgagctccgaaggcttcttttgccagcatatgcagtacagccgggagaagtaaatacccgtcgcttatggggggtgttggcaaccctcagtcagaagaacagtgtggtgattgttgcctcctcagcaaatctatgcctctgacaaccgcttggcccagccctccaggggactccagctgtcttctcctctctgttcctgttaggggtacccagagtactcctaggcttgccccctttctcggtggaaggtcctccccagcgccaggtgaactcactggtccacaggtgctgcctctgggaggcatcctctgatccccctatctaaagagccccctccttgactctccatcttctaatagaatttttcttaatagtacatttaaccttagtaatatatgaatttcactttttttgcaatctagaatgaatgaatgatactagaccttaagaaagcttcaactcatgtttatgaacacctactgtgtaccaggcacatttacttgggttattaaaaaatttttctgattctcgcaataatgctgtgagatggtctgcagtgcccccattaggacaggaaactgatactcagaagagtgacgtgacttactggaggttgtcggctgccggttctacatctcagcgaaaggcaccttcaaacatgtggctgcccaagttagtgaactgagagtcacgtaggcctccttctcacccgtgcccaccaaaggcacacatggaaacaatcatccagtcttgtaaaccccactattagagtttttcttaactccatcaaatcccttctcccttgccatttccctgggcaaacccaccagcatctcttagggactgccttactttgacgcttcaaagtgtccagttctctcctctgtaaaaggtgagtaagttcaacctatcctgagccaaagtccctccaaaggcctatgagatagggtgacttgacatcatggttttgggggctgcattatgatttttgtggatcctttgctttcatggtcccatttctccataaaaactttttaaaaattagacttttaaatagcatgggaatgaagacaaatataatccagactaaattcattattatcatgttgattttttcttctgattaaaaaaaaagttaaaacattgtcatgggcccctaaaagtgttgtgggccctaagcacagtctctcctgtgcctgatggatgggtcagttctgttatccacaggtcagttttagcactgaaagtcccccatcccaggacaaccctcagtcccaggcaaaatggagtggttggtcactctcctacaaggccttccatgatctgactccccactgcctctctaacctcaatgcctactcttttcccttggccagttctgctctagacactcccctgcccccaggctggtcctggatcaaatgaggacactcctgcctcagggcctttgcacttatcctcccctctgcctggcataaacgcttggctaactttattcagatctttggtcaaatgtcaacttgtcatttgggaccttctgggaccagcagcacaatagctctctcactggtctccatttctccctcctactcatgtccagtttttttctccacacagcagccagagtgacctttcaaaaaagcaaatttgatcatgtctgtctcctatttaaaatgtttctcagttcccactgtttttagaagattgaaactctctagcatgacctacaaggccctgatgagctgatgctatgtgtcaggctcctgctgggaagccactggctgggagttgcaatgctgacccttttgaagttcttcttctcccaaggtcctctgagtgcacagagaagctctttgggccatcttggtctcagcattacctcctctgagaagagaagagacctcagtgagccagggaagggctgggactggcatcgcgggaaaggagaggttggatgggatgacttcacaaagccctgcaagtgtggtactttactctctccctgaacccagctagaaccactgaagagaccctgaaggacaccggggcccagaaggcaaaaggagtcactactggcaggaatttggttggacatgtttgccttctttcaactctaggcattgtttgagtctggacagtactttacagaagccacagtaagcaggatgtataggatacagccaggaagtacttccttgtgcctaccctacatcttgcatgctacaacttcactcctcagtggaaatggagagatggatgatcctccctccacatgccatttgtttccatgaaagctgagccctattaaaacaacaaaaatgaatatcgatcaagcttgtatcatatggcaaccactgtcctaagttctttacatgcataaagtcatttattcctcacaatagcccaaggaggtgggtagtatttgatgagatgagggtttggagaccctgtctcctgcaccctactgatgatgccagggtggcgggaggtgtgagagagcctttccctgacctttaacgctttttgggaaggaatcttctgcatgctgcaggaaatggccctaaagacaatcaggaacgatcctgaggtcataacttcattggtgctattctgatatagctacagctgaagttgacacaagtttcaccgtcttagatactaccaacaatagttacggcaggcacttcaaaatattcggtagataaattagtttactgagcatgtacttagtgccagtgctctaaaaggtaagttgcacacgttatctcatttaagccacacaaaacccctaagaagtagctattgttaatctcatttagcagataaggaaatacggctcagagagaataagcagtttaaccaaggccacacaactaataaacgcagaagctgggatctgtcctcagatctgtttgacttgcttctaacagcttaggtgcttgattgatacttgttaggtggctaacaaaaactgggttgctgacagctctgtctaggatagaagaccaacattgtgcatccaggcccctggggaagaggtgttcaggagagggagaggaatttggagcatggttacagcttctcagtcccccacccccccaacttgggatttagttctatccatgctgctaatgcatgacccacacttccaagctccctctcagccctatctatccttgagctgcaactgtgaaatcatagtgacagttccagtttagttcccaggatgagcctgcgattatgtctgcctcagcagggaggtgacccctgttctgtccttgcccatgacaagtgagctctcctctctcattcaggtggctactaaaacactgcctcctccatttagtcctcccgggttgaccagatgttggatgtcagctaatgtgggttcttccatccagagagaaaaagctttgagcccaagtcttagccagcatctgtccctgtcttactggattattgataggacacctcagtaaacacttagctcccagcaaggaagtcctcctgtgtgtcccaagggaagtcccctttcaaacaggagctgtctggcagagcccctctcaccatctcccatttccaaagggcttcatggggtctggcagagctcctctcaccatctcccatttccaaagggcttcatggggtcaactcaccagttctcaggtggtgactagttgaggttgccttttgaaaaccaaaagggcagaaaggaggaaggggggcggggcgtggggaaagaggtagatggcgtagataacaatggggtaggggcttcctttagagaaagggaaagtttcccaggagaggccctgtccaggcaagggtccctcgatgacccataataacctgagtttacaccctgggttccaaccaagatgtgctctaacttcaggctgagagattgaggcacatagaggtactttatgtgtagatttagggatccttctaaacttcaactgtgcaaatccctttcctttccctcccccagcccagtctcaggaacttagaatggcaaggtttttgaaatcactttaaaaggcttttcattttgtagataagaaaactggggtcataagacttgtcccaggcccactgcaggaccttgttcctgtgtttacggagggaagcgggtggcaggagggggcccaccggcagtggaagagaacatgtcaccctctcctatctccttattcctctccttccccactccctgaggcagcattcccagcctggcagagcaggggtggaggtgcagggagggctctgcagggaagaggggcctgcagggccagggcagacaccagtgacaagagcaatttatttcccaggcacagattagatggcaactgagaaattcttccttatgccatctatcagcggaccgcctccagcagcctctgtggggtcaggaaatttgtcttgactgcactgctcagccactttatttgggctcctgtggtctgagttatgcgagggacccccaaataagtagaaggaatccaaccccacatcatccacagagctactgcctcacaaactgcagctgcctgctcctaccctgggctaaacagactccctaaaggagatgatgcatttccttatggcctgtaggaacgagggcttttatagtgcagggcgctggctggggagggagcagcccctagagactctgcccagacagatatctggggtcattgagattttcttagcctgctttgacaagagggcattggctgaaagtacagtattagctgaaggggttggcaaactttttccaaaaaggaccaaatagtaaatatttcaggcttgcaggccataggcctctgtcacaactacttaactctgccactgtactgcaagggcaacaacagacaattcaaaaataaatgggcatagccatgtttcaatagaactttacaaaaacaaagtgaatggccatgggccgaatgctaatgcccccaaccctttcactaaaaaataagttttgcaatgaaaaactgtaaactatgcaatggggccactggagtatacccttaattctaatatggtgagtctgtaaattatatcgtcaagtctaagaaagcaagggatctgctctcttgtggatctgtggccattagttctcacaataccctttaatcagtgtaggaaagaaccgtgtaggagttcaaagtataggctctgatgcaatattgtttggatttaatccttactctaccagttactagttggatgaccttaacctcccttacctcagttcccttctctgtagagtagggacaataacaatttactctcacagggttgttttgaaactgaatcagctattataggtaaagcatttggaacagtgtctggcatgtgatcagtctgcacacctatctgttgccagaccttagttaaccttcactaaatcctgaccaggggctggttgatcttgggtgatgtaagaggtggaggtgtgaggacactttgtccctaccagatgggcaatacgtgaccgttcccatctaggcaccttggcactggacatttgaggtttctctttttgcctctgcccattttgattagaatagaaagcggactaatgatagcaacaagaagaagaaagagaaaagacaaggaaaatacatttattgaattgttacaatgggctgggcagggctaggtgccttacatattttgtttcattaaatctatgcaacaaacctgcaaggcaggcattactatcctcatctttagacaaagaaattaagtctcagaaaggttgtgtgacatgttcaaggtcacccagactgactaattaaaagttcattctttcatcatatttctttttcaccaactatgtgccagacattgactaacctatttgtctaggaaacagtaaaaaaaaaaaaacagcttatgttctcgatgatagagatgaaaatttaaatcaatctttaaggtggggttgcaaaggaaagttatgagaagcaggaagccctcagcaaggaagagacacttaatctgaatcttgaagaatgaatgggagtcttctgggacgacaagggagaaaaggtattccaagaagtaacatcacatgcaaacacacagaggcattcaataacattgtgcttttgaaaacagccaccgatttgctctggcagagttgcaagggcaatcagaggggcaatgaagtaggagaggcagaggtcacaggggacttagggaggctctggtggctcatgatgaagagtttgaacttgatcctgcatacaatggggaggcacttaaagggttttaagcaggatagcaacataattaaattgtgttttagaaatttaaaaacggaggctggactagaaggtgaatgcagcaggatgcagggagaccagctgaaagacaactgagtaatccaggggagaaatgatgaggggggttaactaaaaagtagcagtgggaataaaaaatgggagactggtctaagagatactgaggaagtggggaggctagacttgatgatgattgaaatgaggagtgaggtgggaaggaaagaatggaatctgggctgacttggagcttgccttggatgatgagataaatgggggcagctttgatatggggagcagaggaggaggagcaggggtttacataatgatcacaatttccattttggtcatgttgagggtggctggtgtggggctagatgtggtggaggggtgggcgtgtggaaggcaggatggggaagaagagaagaaggacacatattcttctctcagtcccacatggcactcactgataagagctgggaaatagcacattcatcaggccccaagagccaactttgtgggaacagtggagggtactcccaagattgctgttggtggggcagcctcaacattcagctctaggggagggtcccaggggaaatctcaggtaagaatttcccttcagtaagaacttactttgctgtgaacaacttgcaaattcattcatttctcgctcactctctctttttttgtatttcagtaaaatgtaattcttgataattatgctgagttctagttatctggcttcttaagggctgtagtgccattaacacagatgagcaaacaaaggatgtccttgcatgcaggctttctttcatgtagcttgaaaatatttgcctagctgtcctcatctgctccagaccccaatcatcccttgctgctgctgcacttttgctccactaaggacagttcctgggaccacagaaggcatctcaggaggaactcctgactcagcaaggtcaagcagcttcccaaactatgcccttcagatggcctcacttcagtccccagccttggcctcatagatgggcagagcagaaggaaagaacagagatttcccaaggagtaagacagtagtgtgcatgtttgtgtgtatacgttagggttggggggaagggaagggagagaaaggcatagaaggagacaaatatggtcagagagcaacagagagaatgctcacatacgagagaggcacaagcaagacacaggaaacaggaaacagacacagggtggtgggggtgggcagcaggcatgttcgaggaacagccagacattcggcaacccaatcttcatcttggtctgaaagtgtccttggccatggtgctgaatgctaaggccccactatcaggtagaggtgggtgaaccatgctgtgactttaagctgttatattcacctagttccttattattaatagttattgagtagccactgtatgccagatatactgctacttgctttcacacatagtcttatttaatcacacaataacttcctaacacaagaattcacagaacggccacaggtcttgccttcggctattgaagccaaactacagtagggggtaggtactgatacagtattttactttttgaggaccttcacagaaaggcagggataaggggagagagctggttgctggttacatttaaatgattcccaaagaggtcagggctacacagggagtgagccagcactcatcacagtggatcttgtcagggacatgtcccaccagaatatggcccgtatgtgctaacaggggtcagggtcctgggaagttttttgtgtttctataaattattatcttcaaaagacatagaaataatgtctctgaaagaggatccttcatagtagagattctagcaactccaacccattccagttatattgctattgttcaaaacagctctggaatcctttttttggggtttccttaaagacatttatgttttatttattaatttttgtgacaaggtcttactctgttgtccaggctggagtgcagtggtgtgatcatggctccctgcagcctctacgtcctggattcaactgatccacctgcctcagccttctgagtagctgagactacaggtatgcaccatcatgcccagctaatttttgtatttttttgtagagatggggtttcaccatgttgcctaggctggtcttaaactcctgggctcaagtgatctgcccaccttggcttcccaaagtgctgggattacaggtgtgagccaccatgcctggcccaaacacatttatgttttcaattgaaaaaatttttctttttgggggcgcagattaatttttaaataaaatatttttcactattttattttttagttctaatttttttagtagattattttttaagagcagttttaggtttgtagcaaaattgaatgaataccattttatttttctaggtttgtttcattgattttctttctttctctctttctttttttctttccttcttttcttctttctttctttcttttcttttctttttttttttttttttgacaaggtctggctctgttgtgcaggctggatggagcgcagtggggcgatctaggttcactccaacctcgacctcccaggctcaagccaacctcccacctcagccttctgagtagctgggaccataggagtgcgccaccatgcccagtcaatttttgtattttttgtagagacagagttttgccatgttgcccatgctggtcttgaatccctgagcccaagcaatctacctgccttggcctcccaaattgctgggattataggcatgagccactgtgcctgacctgtttgtttctttaaacacacacacacacacacacacacacacacacacacacacacacggctgagaagctgagtagtgttattttgggtcacaaacgaggtgtgacctgtagtcctggttactcaggaggctgaggcagtaggatcgcttgaggtcaggagtttgagaccaacttgggcaacatagtgagacccccaactctgagaaaaacaaaacaaaacaaagtatgactctaatgtattaaagctgactttcctctttgatttctaaatcaggtctaatggcaatttctagagggatattctacaactaatcaccagtgccagcaccattggattaaatatgcagcttcccaaggaagccatttgaagggcactgtgatcttttaaatgcacatcatgaaaaaatcctatgtaggctaataaaaatattttttattgcttttaagtcctcgctctgccagttagtcacctgtgtgatcttggataagttacctaacttctctgggcctctgttccttcatctgtagaaaggagacagcagtagtcgctaatgagttgataccagtaaaatgtgcttagaacaatgcccaccccacagtaagcccttaattgatggtcccaccatataagctcttgcccgtcattttctaggcacatcctagggtagaaaacccagtgagttgaggcctattaggtaccttggcatgcctgatgcctggcatcaggtaggtgctcaatgtgtgtttgtggatgcaaatagaactaaacatagcccctttagaagctgaagggcttgcatcaggatttactgaaaacaggaatctctcttggattgatttctataatcaacatgttttagatattttctgaatatgcagagcaccccaatcctgggttataaccaaggtgaggctgactttggaagggaaacccgccttaggatgcttttagagcatccctttccctatgggaacacctgtatttccatgcagtggggtgttggaaggctggggtctgtgctctcaacaggagctcttttggtcacactggggagcagttcttgctaaagtgttgatttatgagtcttcttccctctctcctagggtagtatgcacatctaagagggagaagctttaaaaactctacagattttccaaggaaagcatggcaggcaccttgatagaggtgaagagtagaatttttgattatttggaaggaacttggaagaaacccttctgagcacagtgaaaatcctagcaatgtataagacatagtgtcttcataggtaagagcacaggctatgggggcagacagacctggtttccaattctggtcttacatacacaaacaaggtgacatggaggaagtcgctctaagccacagagcctcattggtcagatgggaataatcctaacatctacctcattaggctgttagaagatttcaatgaaagaggcccataaagcacttagcagagtgcctggcaaactaaacataataagtggttgctattacagtagtccccacttatctgcagtttcagttacttgtggtcaaccatggtctgaaaatattaaatgacaaaaatccagaaatagacaattcataagttttaagtcgtgggctgctctgagtggtgtgatgaaacctcatgctgtcctgctcatgctgtctggctccaacctgcccgggatgagaaccttcctccagcacatccgctgtccacgctacctgccagttagtcatttagcagccatctggttatcagataactgctgcatttcccagtgctcgtgtttaggtaactcttattttacttaataaaggccccaaaacacccaaaacacaagagtacagtgcctagtttataaattaaaatttatcataggtatgtatgcataggaaaatcatagtatatgtagggctcagtactacccgtggtctcaggtggcctctgggggtcttggaatgtatcccccatgggcatgggggggactaccatatttttgtaagcagctgactataataatagctaccatttattaagcatttactatatgccaacattttgttatactgcttcatgcatagattttatctaaactccataataacactttgaattatcatttctattttataattgaagagaccgaggcctgggaatttaactgtttcttttttttgagacagggccttgctttgtcacccaggctggagtgcagtggcaaaatcatggctcactgcaaccttgaactcctgggctcacgtgatcctcccatcttagccttctctgtctcccgagtagccggattacaggcatgtgccaccacatccagttaactttttatttttggtagagatggggtctcactatgttgcctaggctaacgtaactggtttcatcccagagtcatacaaatagtaagtgatgagtcaggatttgagcctgggattccttgactccaaggcctgtccccttaagctccacaccatacttccttccacacgctgcccatcctgcccacgggccctctcactgcaggaagtcaagtaccagcagtacttggctaaaatcagaatgcttctttctccctttccttctccttattataatgtttcctctcaaaaagtttgctttatcgatttcagactttttaaaaaatgagctcatgagacagggctatacaagctgtcagaattatcagacagaaacagagctcctagaggctcctcctgccacctctaggaccccccaggaatcctagatatgagcttcctcctcaccttcatccaaatttgtccatcagcctgagctctttctgtcacagcatcacttcaccttcttccatccccagtgccactatgggatcttgaatgagttggggttatggccacattgcatatactggcccacatattcttccagggattggcctaactggacaataaatagggacagtcacagggtattcaaagctccaagccacccattgcccaatgtgctcagttgggaaggaagagagaattgagaccaacacagagaacatgcactatgttctctcattgccagaccctgtgctagtcagttccatgtgtatcacctcatttaataacactgcaaggagtattattagcctgctttcacagatgaggaagggatttgtaaagacactaaattaactgctcacaaataaacttttacaatttcccagaagaccacgggtctttactgtgaagattaacatgcagccagtaagtggtggatccaggtttgggattcatacctggtaaagtccgtactctgtgtgtgtgaagctgttttccaaaagaatgaacacacacacacacacgtacagacacacatgtcacatgctgaaataaagtgtttgtatcaaataaatatcaaggacaactgtagtatgtgtgttttttgagggagtggaatgggaagcagagattaattgagacacatactggcagactaataataggtaaaatttatcaagcacttgcttgtatcatttaagcctcacaatggccctatgaagtaagcataattgttactcctattttaaagatgaaaaaactgaagcacagagaagataagcaacttgcccaagcttacagacccagcaaatgatggtgccagttacttgcctactgccacagctccaactaaattctctcttctgagctggaactctgtggattgccttgataactggctttctatcaggctttgctaatagcaggcattagggggcaattgcagtgcagaaggaagggaggtggggacttctcattctgatgctggacatcagagtcactgtgtcacagacggagacttagcttgaactaagaggacagatgatcactttgacactgaaggaaattactgggaataacaaaggcttatggcttcaattagagggtcagctgatgccagtgccattttgaagataagagcatcagggatccaaggagggcactgcttggagagctatcagctagggtgccttgttaagagagctttgatctgtgcagagggagcatcaagtccaagatctggagtagcagccatataagccaataaatatgatgctacagggtctcttgttgaagatggtacatgggattgcactcagtgaaagaaaaaaaagacacaaaaagaagaaagaggtacctccatccaatcacctatccatccattcaatctaacaaacatctattgaggtactatcctgtgcaaagcatatgtgggatggaagacagacagagtcagacatagatcctgtcctgaaggaatataacatccccctagtagggatataacagtagggatataacgggaatataacatccacacatagggggatgtcacaaagagacatacttatctgcatgtgcagtgagagatctgaagaggaaagggcgggctctagctggatcaactctgtgactgcatggagaaagcagcaattgaaatgtggaggaatgggggcatatgtgaggcacattgagatatcagagggttgtggtgaagggtttgtgaagagaaggaatgggaggtgagatgagaaagatagctgagactatactgtgaatggccttgagttgcaacttggttctgtaagtagagagtaactgaatgttttcaagcaggatatgaaataatgatttttttagagtattctagaagcacagtgggaaatgaactgtggtaggaacgtcaggttaagaagccattatgattatcaaggcaatgaaggaatgatgaaggagtgaatcatggatgaggcagagaaaacacagacaaggaaatggagttcagagccagctggtaacacaattggtaggtcctagagagaggcaaggaggagtcagcttgtgtgacaggaaggacaacggtgtcactaagagaaatagggagcatgaaaggaagaacaaagttaaaggggtaaagctataaactcactggacacattgagtttaatggattgtaaggaatgaaggtggagacacaaagatagaaaagcaggacagtatggagttaaggagagaagttagggataggaagttaatttgggtaccacctgccttcatcaaggttggcagatgaagctttgaaattggatatggtttccaaaggagagtgttgagaaagagcaaaaaagagtcaaggatgatccttggataaaacctaaatttataaggtggaggaaaggaggaacaaaaggagtaatgaccagaatggcaggaagacagcaggaggagagagcaggtgaagagaggtccaaggaaagaagggtaaagtgttaggaagtggggagaactgagcatcaaatgctgcaggggccaaggagatcaggagcaaggaaaggccactggatttggggcctgagaaatggtcagtaccgtcaagagcaagttccgtggagcagcgaaggccaaaggtagattaaaaagagccagaaataataataacaaagatactaaaaataaaaccttatatgtgatgcttactaagtgcaagacacattgtaaacacttcacatgtactaattcatttgatcttcacaataaccctttaaggtgggcactattattatccccactttacaggtaagaggacagaggatggggcaccaaagaaaagacaagaccgtagatttccaaggtgtgctccacagacccttagtcctgcaagaagcagaagcaccacagaaaagtgctctgaggttaagtaaatttggcatttcccttctaggaatgcacattattagtatctttaaagacagagaagccctacactgaagaaccttgtttaattttgttaaatccaatgttttctaaatttatttgacctgtgaacctttttatcattaacattctatggaacaatgttctacaaggcacactttgggaaatgctggtatagaaggctctcataaagtcatggacagaagcattaggatcagatacatgaggaggctgaagggatactactgcgtcttttttggggagaaagagtgtttttttatggaaggagagcaaaattttagggtgggctaaagaaagtgacagagaaaatgggaaacaaggaatcttagtgccagacaataaatgaacaacacatttatagaggttggagccgggattcctgaaaaagaggccgtgagagagaaaattatgatcaattccacttcaggccctttaagttggcctgtccactcccatgtacccagtgagaacactcatcagttttacaaaggcagatgtctccgtggctttagggagcattcctcattcattcaacaactccaggatggacactcactctgggccaggtacaatgttaggcattgctctcactctgatgctgtctcttctcaacttcagctcttggttttgcaacctggattttatttttgcctctgatcctttgacttgaagctatgtctgggcttcccagagtctgaagatcagtttccccagtggcatctggctaatgcctcttttggtcccagtgtccgaagaagcttcaggtgagaatgctgatccagtcctggcctgggccacctacccgacattgttcccttgtgcagtatccctgcctgtcctgcctcgaaatgtctctgccctcttccaggagctgtgtgcattgtgtgtggagggtggtggtacaaaggatgaagcactcagacaagaacagaccctgccctcaggagacagaaatctagccaggacaaacgtggcaccagccctccttaggactgcttgcctagcagcatattaacaaggcatgtaatggtgtggcatgtggtatggaggcacctgtggcatgataggtggtgggaattactgggtgaaatcttctgaaggagagagtcttacaccagtagccctacttggggtgagaaggattgtgggcagaagtctagcttaggaactctactttatgaataagagagtgatgttttggaccagaaatgctgcttgctccacctgggaagacaggctaagtgtctgttatgtgcagctgcagacctagcccagggccccgatcaggcattgggcatttggctagagaggatctctctctcaagcagatgcttattatagacttgttctgagcactcaacatgccttctccctcccagctgctaaatgtccatttccaagttattgaaattcactgggaagtatggttaatatgcaaatatagattagcccccttgccactgatgcagagctgcctgtttggcagcctgtggtactcaagattcataaaatatctggcacaagcaggggagaacggagaatgattggacggggttggggatgggggtaggtttaattcttgggctactaatgaatctgattgcagccaacactcgattatacccaggtggattacacactgggcgagtcatctgtagaaatgttaaatcctgtgaggttttacccattgctccacatactcagaaagcttccaagcagcctgacccagccattaattgctgcgcactcacagatgggcagctcatttccatactggttgaagcaaaacataattggtaaggcaaacatactgtcagaaatatacaatatctatgtatcccactacacattggaagtcaaacaacactgagctttgtgattttccactgttttaaacgaatcaccccactgctccccctcttgcatggaccgctgaggagttgcaacccatggggctgttttaacaaacatctgagaacatacacattcaaatacgctgttctttcaaaatagacaccttgggactgagttgctgccttgcttgagaacttccagaagttcttttctttgttgtttggaattgcctttggagcgttttgtctgctctttaaagtgcctgtggtctaccaagagggcagatctccatctcgggagagcaggattgatttttggtgacaggagaaagaactgtggagccaagtgtagtgagtcaagtgcaatcttatacttcttactcataaagatttattttcctactattttttcttcccaaggaagtcatctaagatgaactctgcatttgtgatcattgcctgagcaaggaggtgaactcgtcaatgcttccctgaacaaaataagcaagataaaaccaaccccctatcccccaacaatgacacacacgccttttcttctgctgagtacacagctctcagcctggcacccactgactgccacatggatacaaacaacgtctcactagaccccagggcctttcctttgtggagctgctaaaaaactgcttcaaacatctcgctccaggctagcttccctgcaacccaactaactcctcacctacctccagggccactgatcagcctgcaatagggaaggcaaactcacatgaattcaatgccctaggtagtcaggaggatgaaatcatggcaacagtctccagctaatgaatcaaatgtcccgaggagacgctttggttccagaggggccatggtggctccagggacctggggctggacactttttcaaaggaggagggttgaagctgttctaggagttggcagtgactggaatgcatgaatcctccaagaggatctctcaggggagatcaagcctcctagttggatctaagactttttttgatgtattggttaaataataaatcaaatgtttttgtttgtagttagagggctgtgtcaggtgagaggaagcagacagtgttgggatgactatatacttggtaattctgggacttaccgactaggagacagcctagatctattttcaggtcttgatgaaggcagtgagctgtccccaagaccctccttaatttccctaaatcaatatttttcccttaaaataactaggttgtaggtgctgctttggggactggccatttctatacaaaccaaagagtgaggtttccaagaatgaaagttcagaaagctgggtccccaaggggaccctgaggatcagggagaattctctaggaaagccacagctcctctgtgttccttcccgggatcagcacctctgaggacatcagtccctggagattttccctggcacaggggagaattaattcttgtgttgcctctcttagcttctcctccccctgggacactctacaaccagctccaataattttgtcttcatttccctggactcggggcctccagattcagagaaactagaattccattctttccgctaaggaaaaccattagacctgcacttagcaaccaccaggatggtatttttagctctctggcagaagtgtaatgtacaaaatgtaataatctcagctttgaagttcctcacagccccattcaacatgaaattgtggctgatggatggttatggaggcagcagagaaacagggccaatgtgcttgtctgctgttttccttctctggtcagagtgtaggtaccggagaggcagcaaagatcagaaacacacaggtcttaggaaatccactactcaactcgcagggaaactagcccccaaatgtccatttcctccttaggtcacgtttatataatagctcaagggctaaatccactctgctgaaactttggagtgaaccagttgcctattccccttctcccaacttagtctgtgcatttgggcaagtcccttcacctgtctgcctcagtttccacatctgcaaaatgatccttttcggtttagaattctacattctataattccaaatactgtctggaattgatacaagacaaaccctgtgatgggaggcccagtgcgactcagtggcgtgcatttgccgagtgcctatgaagcactcagcactgcaaggtggctgttctggcccagcccagtgagtggctaattcacctccgaggccctcttcggatcaattttaattcccacaatgcatccccaccccatctgacacctctgcttccaggctgcctaccctgacttcagccagtgggcggccaggaattgtgactggattttaacttcagcccaagcaagataaaaccaggcaagttcaatctgctcccaaacactcatgggacctattctgaggccaaagaaaagtgacttttgaattagttactattttcagacaacataggggtaggcaaagagacagattttgttctctgtcttctgcccagcctctccccaaggcagagaaggcaagaagaggggggaagaggagcaaagggaaatgtataggcttaagggagaaggaggggctggagctttggctcctgcccagaagtggcagatcatcacaagccccttaatgatgatgcaaccagttccctggtgcttcctccagcatcaagcctggctcccagggaccttcggcatcgttctctctccgggtaggatggctccacatctggatggactgattgggatcctgctccagagccccatcattgactcacttagccatccaaacacatttagaaaagtgcctagtatgtgccaggctctgtgctaaatgctctgggagatgcaaagaagtattagaattctgtcctcaagaaatggatgtctcagagataccatctattctagagaaagaggtttcctggtcaattttagccaaaaatctcatttatttaagtgaattcatactgagcactcccgtgaagtgccaggcactgtgccaggggcttgcgagttgtccttgtctgaagcgtcaatgatctacagtggaattgggatgaggttcctctatgtcttaaatttgcctctatccaaaaatgcttgaagctccatcacactggtttcctcagcactttcagttcatgtgcacctatgtgcacactagaaggtggcagggggtgccctggggatggggaggcaagggcagggcaccttaagttgcctgtaggaggggactagagggaccactcacttcctacatggccatatcagtgaggaaggcccaggagagactatgaggccagggaagagaggagtgtggagggaaaggggaattatgaggatggaactgaaagggttctatctcgtgccacaagggtcaacagccattgctcctattttccatgctgggagagaggcgtcataatggaggatctcatatattattcccacatccacctggccgctggtggttggttgccagcctcctgatatgtagcaggggcagagggatagagtccttgaccttcctcttgaaataagttcatcccctcttgaagtaagtttggctgctaatgggagccagccttggactgtacatttgtggtggatattcaactagcagaaaaccaaatcatcacatctcaagaagcaaaaggaggaggctgatgggcaagaataatggccaacatttaccggggccctactatgtgcaattcatatatattaactcatctaatcatcacaagaaccaccccatggagttggtgtgttattattctcatttttccaaatgaggaagttgtggcactgaaaggttaggcaacttgcccaaggtcacacagctaacaggtgggggatgatgtgtgcctgggacaaaagcccccatcagagccctagtgctgtcttgcctctgggttagtggaatgggaagtctgtacttatttcctctggcttgatgccactgccaactttcagactaacaggcagagaagcatgtacgtgaaacctcttcctgtctctttgccgaatcctatttcccagagtgtgaaatgcgcttccctcctgccagccacaatatggcctgattatgcctaataagacacgggcttctagtcagcacgagctcagctgctgagtacaggggagacatggggactctgcttccaccccagcctcctcctgtccagggcacctgctgtggcgcccgcccaaggcaacagatgacacagggcccatttgtggccccttctccccacccctggctcctctgctccattccccctggtggggtgaggtctggggaggaaaagaaggggtaaggagtgaagagaggcaccctcgttgtcaagtgttggtgctttaacccacacagctggctgctgaagccgacagatgtgggaggccaagggaaagggcgacctcattagtggagctaagaggatgctgtaagcactctccctatactcctgccccctggaacagcagttgaggggtaaggggtagagaatgcagagttagctgtaccaggcaagggcactgtgatgattaattttatgtgttgacttggctaggtcaaggccacagggtgcccaggtatttgttcaagcatgactctgggtgtgtctgtgaggggggtttcctgatgagatcaacattcgattcagcagactgagtaaagcagatggccctccctaatgtgggcaggcctcatccattctgttaaaggcctgaataggacaaaaaacactgaccctcctgcaaagaagagaaaattcttcctgcctgactgctttgagctgggatattggtcttttcttgccttcggactctaacagaaacatcagctctccttaggtcttgagcctgctggcttctgtactggaactacacaccaactctcctgggtctccagcttgccactgcagatcttgggactactccgcctccatcatcatgcgagccaactctgaataataactctctttctctctctctacatcctattggttctgtttccctgcagaaccctgactaatacaagtaccataaatatttattggtagggacctggcttggaggttggtaggttgggtttttgcatgtaaccggtggttctgagtcaaagtgtttacattcttgcctctcagcttccagggacgactcaaatggcccctgaaatacagccttgaccaggaaactcagcatgaaggcacttctctggccaaatatttctagatatggcctgtttttcaaagcttgaaattaaagtccatgctcagagctcttcattctttccaagctctgcatgtgctatggggctgaaaagagcagagagcagcttactggagtgtctagatgcaagagagtctggggaaaaacaatggctgaattcaagggggctgtctttgccagttttctgcctccaagaaggaggagcttccctcgtgacatgtagtctctgcagttcctcaaggtttccaaggagggtaccactatgagtgtctcacttatctattccagtgttggctcatccagaaaatttcaaatccttgaattccaaggaaagtcaatgtttctgtaatgcagacttgagtaggtgcatccaggacaggctggtgcggtagtgtggtggcggtggggtgctcagtgatggtgtctgggttcaatcccagctctaacacttactacctatgagagcttgggagagttacttaagctccttgtaccttcatttcctcatttgaaaaaatgggatgattatagtggtaactaccctcctagggttgctgtgaggattgaatgaaattatacatgtatatgtagtgaatggttaacctatagtagcgctatatacactttagccattagcagatgtttttaagttagtggaatagtttacccttctttgtatttcccactaacgctagaacctgcctggtattctaagaattatatatctaataataatatagggagatcctaaacgttctgatttcagacctgacccattgccaggaacagcagtggattcctgagacatggtcttggtcctcaaggacttagaaattatcttacaaagccctgtctactctcactgggttataaactgacaactgctgctggaggaggtacaactgagaacagggtggggcgccatggagagtttagccagccagggtggaatctacccgcagcacctttgggatgtgaggtgagacccctgtggcctcaggctaacttagctgatgtctcaggtggatggaaggtgcccatctcctccaggacatggactgggagagaggcactccaaatggcaacaaataaagtttgaggtttcctactgggacttctttggtagtaccatataaatacggtttaggagcacaatgtcttaagtaataaaggagaaggaggaaaaaataatccagagagaaatcaacttatggctcatttaaaccttattgaaatttctaccgtggaaacatttaaatatcatagttactgcagtgtgccttcgctcctgctattccctggtgaatgtttcgttgcacatttggttggggagcagaataataaagctgcttggaaattgctttcccactgctaggtaattacaacaggtttttattccaaatgtaaagaatgaaccgttttttttaataaaggaagctctcggtccgtcccagccccctccacttgctagcctcggtctgccttggcccttggctcccacatcctctgtcacacttcccaacacgacctcctctgtttcctgcctttcctctgagacgcagctggaagcagctctcccatctcagctgctggctctgtctcccagcctggaagccttgcatgtcactgtttagagaaaggggcggcccccctccaggtctctgttgaggacattacatatttggcttgactccatccaggccatcaaacacactcctgtctcccgttcctacccagagagatgcatttccccacctccatctttttttaatcccaagcaagcaattcgggattaactcgacatttgtcagctctgtctgagcacaggcgtgagctcctcggctctctcccaccagacagagcaaagaaaaagtgccttttgtgctttcagatgcacacttgagcttggcagccaagtgtgcacctgcccaaggccgggtgggcacaagtcccaacagctgcccgcacagggctttgctctctcatctggcctctcaggtttaactctgagcgggcttcccctgtcaccagacacatttgtttctttcctaacccctgttgcttctggctactgcgtgtggaaaaatgaatcctctttgtgctatgtcacctccaatgtctctaggagggagaagtcactcagcagccacctctcatgacatcatgggagtccggggcagcccctggggcagggcaaagggcaggggcatggaagtcagttcattctgcagctgtgtggctctgagcactcccttcccctctctgggcctcagttcccctctctgtaaaataaggcagactagatgtctttgcatccctttaaactatagtaccccacaactgtacatttcagtgatacccattttggtccattatctgctgttttgccttatccattcccatatgtccttccctgagaataggtctacagggctggagccagacaagagcaccgtgcttggctcagagtcacatggttctgagggggcccctgttaatgatcaggtttattcctgggaacggaacaccatgggaccctggtgaactgaagaaataggaatggagacccagcagctgtagagggaggcaggtgggtggcctctccgggacagactggctgctggctgttggagtgagtgcctgtacccagtttctagctctgacccttccctctctgagctctggttttctctgtctgtttaatgaggtgttttcccatgccccaacttaggaggatcaatgagaaggtgaaaatatttttctttgggaagaaaaagaagccagaggtccaatggggaaatcgaggcatggggcactcctcatagtctagaagtaccgactacaaatatgctcgagtggggcagggcctctggcgtccggtttggatgcccagcagggcccagtggcacttcttgacatcggtgttagagaaagatgacctgctgctggtcttccctgccccaagcccagaacctctgaggaagagaacactgtgcagattccaaggccaagaagtggcctagaggggaagttctgtggtctagtcctgctttgggggtgtgtgtgaaggtgacagtgtgcaacggagtctcagggtgtgagtgaaggctggggcccaggccctgaggtgcactgaggctggcttctgaggtgtggccggctcagtgcagggggcgagggtgtgggggatgggaggagagcagcggctgtgctgggggcggacaaagggagaagacaaagattattttaaacctgtattaatcactgctccaaacagggactgggggtgggagccgcagctgtcatagagaggctgggtgagggtggtggaagagagtccagcagggaggggctggaactcttcctttccaccccaggacctcggcccagcccagctgtgagcctggggccttgctgaatctctgtggcttgcttggagtccagagcaaataaatggtaaaaactaaactgtggccccattttctgggccaacttgtcttcctacttccaggcaccttcctcgagagccttccctccactgttgccaagagttagcctaaaacagtttggatcaagtcatgtctctcaaaagatagtaataatggcttcccattgcccaaacaactggccacctccttggcctggcagacaaggccgttgacaactggtccatctgaaccttccagccccaactcccgtgggcataacagcgattgtcctctaagcacttgccacgtgccaggcactgagccaatgctttcatccgtgacttcactgaatactcatatccaccttgtaggttactttctacaaatgaagaaatggaggcttagataacttaagcaagatctgtctgatacacaagcttacattcttaacttcctggagaattacacaaacattcatcattccctgctttgctcagctcttatctcacccgtcttctctttcgtttttgcccttatgaacatcctcctcattcttcagggctcagctcaaatgccgcctatttaaagaagcctccctggttggaattcaaccatggactcgataagcatttaatattcactgccatttagataggtcctattatctccattttatagataagaaaacagaggcttagagaaacaaagctaagtatctgtgtttacacagacactacactgagtgacggaggagggattcaaggccaggtctcctgatggccccaaattcagcattcttcaaaacactttcaaccatgtcaatgactctccctttatgcatccacagtcctttgtttgagcctttattcagtgcttatcagattctgcacgtctgatattggtgctaggatatgagagtactcaataatagccacaatattgacttactacatgtgcaaggcattgcagatgctgaatttttcccccaactatgaggtgggtattgctttctccattcttaaagatgagaaactgattctttgaggcattaggtatgttctgcttaatgctgcctcaccatctccgtgggattccgatgcagatctgtctcaagttcatgcttttcccattacacaggctgcctcttgtaggctcttcaacaggtgggtccatgatttatttgttccggaatgaataagaccctagtagcatcttgggtagagtagagaatatggagatgggccatttttggctaggaggactggtcggccactatagtctccttggggatcctggggctctgagctctgtgaacaccaacaactccttctttaaagtttcaactcaattctcttggactcagtcttctacacaggtataggtgggagtgtttctccctccatttgtcaaggtttttcagctgttacactagggacactgatacctgcctaagtgggaaatggccacattgaaagagggaaggagagctgccctgctgtgcctgttcccttgttactgacatttccccaggacttcctaactttctgtgggttctgtgccattcctgactggggtgggggacaatggagggagaggagccagacccgaagtcatcgccagggatgtgagcaattctaggaaacaggagagaaagcactagagaggagaccacgctgagagatctccttggagcagggcacccctggacaaactgattcccatgagaggagcagtcccccaaatctggggactctccccatgagactggagagttttaattcaatcagaagatgttttcattcaatcagaggattttcccttgccaaaaaagaattgcatgttaatgtaactgttgaaaagtggtagtttttagaaccagcatggattcattaagactaggtgacaccaaattcatcttttaacttaaaaaaattttttggtaaggttctaaagcagggtttctctatcttggcactattgacattgggcctgataattctttgttgggggtgagtatggcgatgggggcggtcctgtgcattgtgaaatgttcagcagcaccctggcctctacccactagatgccagtagcatctcaccactcagtcaaatgtgacaaccaaaaatgtctccagacatggccgaatgtcccctatggtaaaaatcttccctagttgagaaccattgttctagtctgataaatcaggaagcttctctacacctagttctgtagtgagatatttgatagatttggatttgacattatctttgtgactaaggaggaggaaggtgggctgagaatgagcctagttagttgtcccagtaaccagcaggacactgtgtacccgcatgctgatttatgacgggcatcagcctgggcacgtccacgttcacaaacctccagcctctactaacagaactcttatcaacaactcgaataaagacaatgatggcatgcttatcataggtacaaatgtcataagactggtagacatgaaactatgtcagatgaaatactaaggattcacaaggattccagactttgttagtgaaaacaacaagcttcagggcagtgtgcactacacattcccatttgtgtaaaaagtgagtcaaatataaaaatgaattttgatacttgcttagagctgcataagggagccccagaagggtgcatgagaaactaagaacaacattgtcattacttatgtggagggaaggccaactgggcagatgagaaacaagtgtggtacgggaacgtttccatttaccctgttacattttgtgattttttttttttttagacagagtttcactcttgtcacccaggctggagtagagtggcgtgattttggctcactgcaacctccgccttctggtttcaagcgattctcctgcctcagcctcctgagtagctgggattacaggcgcctgccaccatgcccagctaatttttatatttttagtagagatggggtttcaccatgttggccaggctggtctcgaactcctgacctcgtgatccacctgcctcggcctcctaaagtgctgggattacaggcgtgagccaccgtacccagctgcatgtttcgatcgctagacatgatagtgtgttatctactcaagtaatgtaattaaaaacagaactcaacctatagtgtggctgaaatcaaatgcaatgcaattgaacagatgcaaataaatcctgtattagtttaaaaagttaatttggcaatgatgagtataatatcaggcttgagaggttcatgtgaaaatcaggtaggaggttttagatggtcacaggccattaagtcaaacaacaagcagacccaccaacatacacaatgaaagcctggactgtttatggtatctggatcaagggaaatggcccattgtactctgggcaggtcagaccaaattcagccttaccttcatttctgtctgctatatttttggaaaggcattgacaagtgtgtacaaagaacagtgacctagatggcaaaggcctggaaaccatgaaaaatatggggaagaggtgatgaaacttgggacatttaaattggaaaagatttagaaggatatgaaacctgtcttcaaacatttgaaggcttgtcctgtgcgaggagggttaggggctttttgtatagctctagactgcagaaccaggccctcttcaatttattgggaggccaatttcagtttagaaccatgcaaaggctgctttgtgagataataataaaatagcaacacttactgagcacttacaaagcatcaggccctgtgataagcactttctctgcattatttccctgacttttcacaacatcctggccaaggcacttacttcattgtcattttaaccaaaaggagaaaggaggcttacagaggttaagcaaacatgcctgaggtgacatggccagtagacggtggatttgtgtgaccccaacacatatatgcttgaccactaagcctccttcctgaaggcagtgagcactgtattgtggccagtattaacagaggggtaaacactgcctggtcaccatgctctgaggaaattcttggagcaggtgggagaagcctgtttcatgcttaccacactgtagtcctctaagaaaataagccctgtgtgtgtgactctgccagggaaaggagtgaggcatacggagagagagaggcaagcaggctcctgctcacagctatctaggggctaaagtggagtttttggtggaggtggtggtctgtaaagaagtcaaagaggtgagtgccgaggagaaacgctgccccagtgctgaagagttgtctgttctgtccacggaggcttgtggcagcacttacaagtcattgggtattatgcttcctgactcacaaagcccctttgaagacatatctcatttaagtaatcataccttgtgagaaaatacaactctggcagggtgcgggtggagagggatggggagaagtttctccagagacagaagggggagaaccacaaaagtaagagaacaatttggtggtggtcataccagagaaggacaaagaggggaaggtgagagaggagagaaaaaatatctaaggcttctcaacctcctctggggcccagctgggccagctcagctgcctcaaggacttaacaatatttccaaactaaacaagctccaaaaggcaaatgacccccggtcactgcctggttcctctatcacacagtagcaggggtaaacatttaccgagtggagaaaggaagagccagcaggtaagccacatttaaagcaggctgaatcagagcagataaaccaaggggccagcatatagctttatcaagttatctgatgtgctggctggaaaagagaaagacctgcggcacttaaatatgagagggaatcacttcaaagcatccaggaatgggaaattcatgctcagtgggaaggacctgggagaaggacttgtcatttggagagggctctcccagggaacccatgtacacaggagactcagaaaattaacatgatatcttgaacaataatcttacaccttagacccaactacagggacagccctggaaaaggagaaaagtcccaggtcctggcaaaggctgtgagccagcccacaagccaacacagtggacctagcacaaggtacccctggctgggtgtaccagagtgatgggcagagcaaggtccagagagggcagaggagctgggagggcagggattggaggcaggctctgctcagaccagctggagccctaactgtggggtgggagggaagagggatgggacttacgcagtggatgcctggcaggggcagcagagcattgccctccaagggccagaggccaagagaagaagctggaggtggtggggattgtggtaattacaagagagggagagaaatgggagggaaaggaagatggcaagaggctgtcaaaaagagctgcaaaggaggatgagggcaaagattacagagagacagaggcagatgacacacagagggtggcagaagagaacaaagacagtgaggccgggtatggtggctcacgcctgtgatcccagcactttgggaggccaaggcgggtggatcacctgaggtcaggcgttcccagcctggccaacatggagaaacccagtctctactaaaaacacaaaaattagcagggcacggtggtgggcgcctgtaatcccagctactcgggaggctgaggaaggagaatcgcttgaacccaggaggcagaggttgcagtgagccaagatcacaccactgcactccagcctggatgacagagtgacactccatctcaaaaaaaaaaaaaaaaaagaaataaagaaaacaaagacagtgacatgaagacccaggtacagagaaacccaaagacagacagaaacctctgcaggggctaccgagagaaggaacaatggagaaggagcagcacagagaggcaagcatgcattaagaaagggaagagaagaaagaaccctgggctttggtgaggagaggctgcagaggagaggaaggaagcccctcctgctgtctgaagtccctttggagcttatcctcttggcactcaccgggagcagctttgctaatgagggacttttctctggttgtgtgtgcgagggcagcaggaggaggggcaggggttggttcatcactgggacttctttagatcagggttttgtgtttatcttgatgtaatgagttcgtttgggtaaatggaggcgatgtggctgcagggctggggttcactgtattgttttcagcaacctgctgctcttccccggaccagccacaaaccacagacataaccaccataagtgaacagaggcctgccccaaaaattcaggggacagacaccgcagccttgccaatgggtctgccccatggactgagtgacggcccctggccctgctaaagcagggaggagaccaagatgggaccctggcacctgctagtcccactgcctgcaatgccttcacccagataatcactcaataggcatttatggagcactggctctgtcctagatgcttagaatatcactgcacaaaacaaagatatctgttcctgtagagatcaggaagttgagcttctagtaaaggaaggttctagtaaaggaagattcacttaaataggtaaaccacaccatctgtgggaaggtaagaaatcttttttttttaaatcattttaggagaattttttgccaaagttaaggatgcacccaggagacaggtctatgcctgtctctgtgattttgagggctccaaatgtaaaggtgaaggggcaggatattgagaagcacacagttttcacataaacaaaaggagcagaggaaaaatgtagggaatctgcattttacataagataacacagacaaaatggggtaggggaacaataagctggaaggtaagaaatcttatggaggaaaacaacagagcagaagacggggagcaggaggcctggggaagtcagggtagcttccttcaggggtgacatctgagggggacagccctgaggatctctgagatgtgtgaatttcaggcagtgggaacagccaatgaaaatgtcctgaggtggaagcattcctggaacattgagggacaacaaacagaatggctggtcgggagggactaggagcaagagtcgcattcaatgactccagagtggccatggaaaccagaacatggaagactctgaaggacactgaagaattcagctttgcctctggatgaaatggggaggaattgtagggtcctgggcagaggaaaatatgctctgccttaagtttgcaaagggtcatgttggcagttgggatgagtagataaggagtcaggaatgcaagtgaagaccagctaggaggacattacagtaagctgaagatggagatggtgagaggggtcagtttctgagtgtgctctcagggaagagccagcaagatgtcttgagaggttggatatgggcgtgagattaacagaggcgtcaaagctgactctaaggcttttggcttcagcacctggaaggatggagttctccatcaatgaagatatatgggtggagcagctttgggccaggcagctggcaagagaaaatcagaagttcagtattgagcccattgagtttgagatgtttattagacacctaagtgtagaggcaaagaactcagatgggtatgtaactctgcagttggggaaagagatcagcaatggaaatataaataccagagtcttagcatgcagagtttttaaaggtgggagactagaagagatggccagggagtgagtgtaaatggagaaaaggaccaagaacccaatcctgggctctcctgcccaggaaggagaagagaagccagcaagagactgataaatagtgaacagcaaggtgggtagacctggagagtgtggtgtcctagaagcctggagaaaaaatcagagtgtggttttatggagaagagaataaccaactggctcaaccatctcttacctgagagtcatcaggtaagatgagaggtgagaagtgaccatgggatttagcaacatggaggtcacagtgatctggacaagaagtgtttcgggagagtggtgcaggtgaaaccctgagtggggtgggtttgagggggcgtggcactgacaggctgcatggcagagtgactgagaccacaggtctgggcaccagcctgccaggggtcagaaaccagctctccacttactagccatgtgactgtaggcaagttgtttaacctttctttgccctatttcctaaatctgaggccacctacttcatagggttgttagaaggataaaatcacttggtgtttgtaaagggttgggcacatgggcagcacaataaatgcttatcaggttacaaagaaaaaaggaagagaatgggcaagagatgaatcagaccattcttttgaggtggttttgctgcaaagagaaggaaaaaaatggtgagagtctgtttgcagggaagtagggtaaaaaggaaggtattttaagaaggaataaataacagaatgtctgagtgccagcctgaatggtccatcagagaggagacttcaaggatgcagaaggcttgctggagtggtgtcatgcaagaggcacagtacctacggcacaaatgcacagacggtatgtgccctccctcagctcccgaagggcatccccaccaacaccctctcagggagaccggcacttattaacttgttaaacactgttctcagctgtccccatctccctctctgctttaccgttctccatcacatgggttaccagcaaacttaatcatgtcttgtgttgtctgtcccacaactagtatgtagattcactaaatgcagaaatttttgtctgccttgttgacagttgtatctccagatctcaataaatatttgctgagtaaatgaataaattggtatctgtacttagtttcttgccattcggggaagaaaagtcctcttcttcatttattctacacatactttctgaccatctactatgttccaggaactgtattagatcctggagacttgaagatgaatcagacaccatccttgcccttatttagcctgtgtgtgtgtggtgtgcgtgtgtgtctgtgtgtgtgtctgtgtgtgtgtgtgtgtgtgttggaggagagcaaaaaataaaaagcaattccaaaactgtgtcgtcagtcttacaagagagggctgttcagggtcttgcagacttgggaataagggacagggaaaagcttcctagagaaggggcagctggaacctgaagaacaaaaccagaactgacgacgacggatgaggcaggtgtttcaggtggcagagcaacacaggctgaggcctggcggggaaagggagcatccaaagctcgcctcagtgcttgtgcatgaagcctgcctggtcactcagccccctagactctctctttctctctctctgctccaaccctaacatctcatgttgtatcatttattgggcattgccctggacaatgcagtgagccagctctccaatgtgtgagtcttgagacctcaggcaagtggttttccttctcagggaaggggctctggtgcccatagcaacaattcatgtgtaataagagctcaagagtcatttgcttacaaaataattcttgagtgcctacaacttgagtgccaggctgttttctgggcaaaagggaggcagctgtgaacaagacagaccaggctatgtttcctggaactatagtacattctatgagggaaggttatgcaataaataaatgaacacatacatgaaagataatatagtgccacgcagagaataacaatgggtaatgtgatcggatggagtggggctcccctagactggtaatcagaaaaggtctctgacagttaattgattgattaattaattcatgtctctgacatttaagctgagactgaatgataactatctactgaaccaattaatgaacaaaagagaagtaggaaggaagactttctgaaaaccacattcccgggaggtatagaattcaaacagggagcccaagggctgagacgacacaccaaagtatcctctaagatataagaagacttcctggagaaggtgagttttgctcaccttggacttgcaaacgtgattagacaacttggctttttgcttaagcgatgacctgaagagaaggctctgtgtcaacagatgcttattgagcagatgctctgggctgagctggctgaggacaggaagatggtgacagaagaccatccccaccctctgaaggctcacagtccagaagtgggagatagacaggtaaacaaacaattacaataaacagtgatgtagctgatgaaggctatggcagcccggcaagtacagagtactaagtgggaagttgtgaactctggctgggcagacagctgagagagggaatgtggggtctgggacacttgacggagaaggtgacatttgaactggggcctgaaggatgactaggagtttgctgggaaccagggtgggggcagggagaaggccctcaggaggtgttcagggagtgcagaatatggaggaagtcttggaagaatgatggccttggtaggagactcgggactattgagtgccaggcacaggctgtggaagtgtggctggagaaggtggggaatatttttgaaaattccttaactctttaaggaattcacatgtaaatgaggtcatttctatagtacaggcaaggctagaaaactcaacactacttacctgcccctatgcggtgcttcaccctctgttaggtgctccctgggggccagcccttctcttaggaagccaagtgactccttgacctatcagaggtgaacaacccagggcccaagtgacaggagtcatggtgagaaggggtcaggtttgagatggccttgaaggtaaagccagcattggtctttgacccaggcaactgggttaatggtattgacactgacatggggataaggtcagatttggggagataagaaccaagagcttcatctggacacagtaggtttgagttccctgcagtttgagggagaggggaggacagaagagaagaaggtccatgcccccatcactcagacactgcacttggccttctcctggggctctccggtcccctctgctccccacaatccaacctccacacatcagccagagtgagcttttaaagcatgaacaagatcaaatcagccaactgcctcacagtctctagtggctttccactgcacctaaaatacaggctaaatcttccccagcctatgaacgagggcgctgtggtgtggttgagggctcttctcaactccacgtgcctctgccttaccccacttgttcactctgctccagcctcacggcctccctccttctctcaaacacgccaggctcattcccattatgaggctttggctgtgttctatgttcctctccccctagaatgctcttttcctgggcctttgtggagctaacttcttagcatcaggccctcagtcactttctcagagaggcctttcctcataaccctggtttaaagttgtctttctctcccaccctaccctgttccatctccttcatagcactttgcttgaagtcatcttagtcatctgtacatttatgtgttttttatccccccactatcaccagcatgtaagagcaggaacttggtcttatttttggctctaccccagatcctagcacagtacttggcacttagtaaatagtttgactctcttcccgggaatgaaggatggcaggcgtgatgactagcaggctgcgctgcaccacggcaatgtgggaagctcctagctgggactggcggaggctgcaaatggcagggtcatcaggccagcagccatctggtcccaagtgtgtagagaaggggagatgctctggctacggggactgtgcctgcaaggaaggcctctgccctgtgcctgcctgacctttctacagatttctttctcctaaacacatacccaaagagattcctcctcagctgaagtcagagcagcagcagaaggaggaggaggaggaagaggaagagcaggaagaggaaagaggagaagggagaagaggaggaagaaagtagaggcaggagaagaaagaggggaaaagagggaagggagaggactcagggggagggaaggggaggaggaaatgagggatgagagggagatgtggagagggagaggaagcatgagggaggaaaaagaagggaggacagggtgagaggaaaaggaggggaaggaagaggaaggggaggagggagaagtggggagggagaaggagaaggaaggagggggaaggagggagaccaagagcaaggagggggaggaggcagggtgaggacggagagggaggagggaaggatgattctacctcagctgtgggaccaggctgtagaccagactgcctgggggtttctctgcttttaccaaatctgagggtcagggggaggcctttgggcaaaaacgtcatgcattttacatggccttggcctcacagagcaaagtgcacaccaaatggggaggtgggggaaggggtaataaaaattaaattaaagaaattttttaaagttggaagaacaaattatttggagacgaagcaaaaatatctgtgacatagcgagcactgttttaatgacagcccgtgtgggaggacagtttagtcatatttttcattttctcgtccccggggagctgcatcccagtgatcaggccctgatagcaaactggcatgttccctagatcagtcaccttccaggcttattcagcagcaggatgagtcagggggctgcggagtaaccccttctccatatgctcagaatgcgctagcgcgcctgccgtggggagtggagggggccagggggctggatgcggaacaggcctcgggcccagtgggtgggcaggaagcttcagcggaaacgctgccagctcttcccggggccagccggctggtgtgtcctagcctcctgcaaactcctgggggtaagagtatgacgagtcctgtatctggggccacatcaagtgtggaaaaggatttcttcgaagaaagcttgattcactgccaggaggaagaagttcaggaagcagttctgccatcccctcaggcatgagcacttccaggactaagataaaaataatgaggataattttaaatgactgccaggatgcgagagctgactgcgggcaacatgctccacgcgcgttcattcacttctcttcataacagccccgggaggcaggtgtgaccagccccacggtgctgagggaagcagaggctcggaagcggagggacctccccgagaacacggtgaatacgcgtcagagcaaacccggaacccgggcctattggctttgagtctgtccacggacggcatgacgtggtggttgagcacctgcttctcttctgagttggaggtggtgagaacacaggaggggactgaccccctattcctggctcttcacccagaagatctcagctcgctgtcattactattttatttttaataccatttgattaataccacatgacatgttctctggaaatcaggagggagcaggtgtggttcttcctgttttacaagtggggaccctgaagcccagagagaggaggcaagtggacatggtgctgacagaaactacgcagtgccatctggacccaacagaactgggctggaggctacctgtcagctgtctagtagagagctcattatttgaaatgtctacctgtatcttcctcatctgtaaaatgggaatgttgagatccactcagcggacagcaataggttcaaatgagcaaaaggaggtgtgtttaaaatgctgtacaaactctacagtgtcaggccaagctggaaggtggcatcccctttatgggcatcatcatcaagtcctagttaacagcatgggctctcagactgcctgggtccaaatactggctccttcacttatgagctgtggaaccttagacaagttacttaacctctctgtgcctcagttccaccatcataagtaccttccctatgggttgttacaggggttacacacataccacatgtgtaagtgatagagttctggcacataggaggggcttagtcactattattatgaccaccatcactgccccactcctgcaaactgcaaactccttaaggcaggctggggtctgtcttgtccgctgttgtattcccagggcttagcacacggggcaggcgaggagcaggtgctcagcccacatggggcaagttggggaacggacaccagcccccgccttcctacagcgctggccctgcccatgaactgcaggactttcctaagtcctcatccacgtttagtgtttgtaggatttcctggggttgctgtgacagtccaacagtcccagggcggcctgcctctctgcaccctggtggtcctcacagcctagagaagggaatcttccccaccctctatggtttgccctctttgcaatctgctcaccccagaaaaatatggactcagcccttggcagggcacctggacctcagtcccagatgtcctttcagacattgcatctggttttgtggcttcctccttgccgcctccggaggtgcttttgcctgtgtggggcagtcaggcacacaggcctcatctgtgcgtgctggacagctcggtgtgtggcgccctgtgaacgtgcgtggggcacaggagcggagtgtgtctagctgggtatgtgggtttctgcctatgtggggccaggtagggcagggcatgcaggtctgagggcagtggactgaggcgttgaaggcacatgggctcacttgtaagtctggggtacagaaagaagctagatcatccacgtgtggctgaggggagcttgggtgcaggtgcagaagctggcttgcaggtttatgtgtacatatgtcacatggggagagggcaggagtgagtccccacaatcagctcttaagacagaaattcacttcgtattttatttagaacctgaagaatagacaaacacaggccaggcataaaggagaaaatactttttatttccaaatatgccttaggccaccaaatactttgggacaccagcggtttcttacctccaagtaccaccttccttccataaacacggtctctctccctctccagcctcattggtccttgggcaattcctacaagagcaccccacaaaactggactgcttaggtttgcatctcagcttaacattttacctatgaccctacgcatggtccttgtcctctggcttggtttcctcaactgtaaaacagggaccacaacagtattcttcagggggttgaggattaaatagatcaatccacctggaatgcttagagagtgaaggactctattcattttagctcttaccttagcctttctttaccatgattctacctctgggtgggaaacaaaagtgaattttaaaatgcccatcacctgctttgagaaggtcttcttgaatctgcccaccagggttacctcctccatctgctcccccgtggctcagcacctgtacctccacatgcctggcacatgtgcagtactcaaaaagaccttatcattctgatcatcgcttgacattgactgcaccaggttacaattggtggtgcacgtggccatctccctggggagactacaagcttcctgagggccagaactgttcatttgccccttggtccctggggtctggcacaaggagactttcagtaagcaataagtgaaatgaaaactcaaatatagcagccccatgggcagtaaagtcatgtgtttactgttatttactgagtgtgtgcttcaactgtacacaaagcacaggccttgccctcctgaagctgagtccaagggaaagggcgaaacggagacagaaagaggggaaacagcagagaccacagagtgtggggtccagacagcttccactgaggctaagagggcagggggcagagttgggggtagaggacacagtcctatgaccacagctgcctctggccctcagctgcaggaccacagaccagcctaacatggcaaccccatttcctctcctatttaggtaccaagcattgctggggctcagcaccatcttactgttctttttcccatcatcaattatagtggctgtcccactagtgccaggaacagggtggcataatcctatcccatcctcctactagctgtggcaggagtactctctaaatctcccaaagctagagatctgggttccatccttactccacagtgcttcttgctgaagatctgctcacagtgcagccccacagtgactacaagggtcactatcaaacctctgttctgtctcctccctgctttctggctcaatacctagcttatcactgttccagcaggtgactccacagagccctgatagtaacactgatcccccaggggcttctcatgaggattcaataaaacaatgaaggtaaagcacccaggtctagttcatgggaagccctctgcaaacaccagtccctctcccttccatctttgcttcttttccttctgctcaatgagcatcaatttgaaaatggctttatgttctgcttcttggcctgaggcagggaccggggtcagggaggcaaggtggccctggccttctgcctcttgctgtaggtgatggaagtgatatgtctgcagaaaggcctcctaagatcaaaacccaatggcaatttctgtgatttcgcactccctccaccagttacagggggtctgccacagtgaggagactggatttcattagttgtactctagaccaccccttaaaagtcagacctgggaagttgtttttaatttccttatagattgtgtgtgagcactcaggtacacatgtgagtgtgtgggtgtgtgtcagcatagggcagttgcaaaggaaggcagggaacagagctggacactcctaggtgagctgtttggccacctgggtatatgtgtgtgtggcacttaggtgtgggtgagccccagcaactaagaaggaggagtgtgatactcacaagcagattcctgtacatgctccttatgagtcctcgggggaaccacacatccatgcaatgcctcccaggactctctgcaacatgacccagagcagggaatgatcacgggcactgatcggggcattacaaagcagtgaggaggcaggggtagtagaatcaacttggcgccacacaggagtgcagtgttagatactgtgtcttgcctgggacctgtaagcatggtgctgggggactatcttagccattacatatatacagacatatggatatgcagggctgctgggcacctcacccttgccttctccacatctctcccaagagacccctgcccggagggagagacccttctctccctctgacccttcccacttcaagactctttacctccctctggaaagccccagtgatgctgtatctgagactacggtgcagaagcatttccccggacctgccttccaaacctccaggagacagcatttcaggtactagtgacaagtgtgcttacctgccaaacattcatttgcataaggcactggtttagattctaaaggaaccaaacagcagcctccaccctgcaaactagccactaacttgagtttgcagaggggcagcacttccctgacactgtgaaaacaattagatgaatgcagtgttgccacttaggagctttgtgactaccgcaaattactgagattcctggagtctatttcctcatctgtaaaatgaggaaaataaaactgtgtttatcttgtatactgccatatgcccagtgcctggtaaacagtgaatgctaaaaaaaaaaaatactgattgaggccaggcgcagtggctcatgcctgtaatccagcattttgggaggccgaggtgggcggatcacctgaggtcaggaattcgagaccagcctggccaacatggtgaaaccccgtctctactaaaaatacaaaaattagccgggtgtggtggcatgcgcctgtaatcccagctacttgggaggctgaggcaggagaatcgcttgaacctgggaggcagaggttgcagtgagccgagatcacaccattgcactccagcctgggcgacaagagtgaaactccatctaaaaaaacaaaagaaacaaacaaacaaaaactggttgaatgaataaatgaatacagaaggattgttattgggattgagttgagggaagtaaagaatttatcacagcaatgtcacatattatgaattgagtataaggtagttattattgttagctattatccaggagcaaaatcttatcattcagtcagattggttcccagagctaatataaaagcaggtaattaaggataaatagtgacatgccccaaagaatctagcagctgcccctggagtccaaagggtgatgtgttatattgcattccatttaatttaacaagtttatattgagcccatcttatgtgcccagaattggtgagatcccatgcaagctacaaaagaattaagtcaggctaccttcctaaaggagttactttctacttggagaggcaagatcaacacttattagcataaaagctttccagctggagccagagactcagcctgcattctaagggccggggcaaaactttcatttgtttcttcaacaaatattcatagtgcactggctgtgcagtggcaggcccctagctaggcactggggacccggagatatatgatgaattcaatgagctgctcccagactaaagaatgagacctcatgaaaatgggtcaggacaataaatgctgaagcagagcccagagcgccacctctgtaggcggtggggaggctcattcccagtacttttgatgaagaggcttaggaagaatgctttctttttttctgagagatgtgggtcccaaagccccagcctgacctctcctgcctggaggctggagaaccaggttgtccacaggcacctcattttgaccccaccctgaaagcataatctctcaccacggtccccaccccaaggttcccaggaatcttggagcatcagctctgaccagaggggaacttagaaatcatctgaatgaaaagtggagcctcattttgcagctgagactgaggccaggagaagttgaggaccccaaactactccattaggcagcaacaaagctgagtaagatcccacgtgctcagcggtttacttactaaagcacaaaaatgcttgaggattcagaatctcccagagccccctccggcctcactcaggtgcagcaggtgaatgaagagaggtgtatccttgctcccagcacctggccagtgggtccgagataggaacggggctcaaatgaccagtgagggggcagccaatcccaaagtgggtccaggcctctggggagctaatacgtgggacactttgtactgcaagtcagagaatccagtgtgcagggattaaaggggtaacggagcaggtgaggaggacgtgacttaacaacacacctacatccagtggcaactgaatgagcctggagcaacagacagcaatttggtggaaggaaaggcaccctgggacaaaggtgagtgcggatgagggacacagggagtgtggctaagagaggcccccaacaccatgctcacaggtcctgggtaggacacagtgtctaacaccacactcctatgtggagccaacttgattctactagccctgcttcctcacttctttgtaatgggaggggtttgtgaatgcacctgtctcatgtgcccactgctcgttagtgttaaaaactagtggtccacaggtctggggccaggagatcctttggattccaatctgaactttgccagctactttccagtgttgtgcccctgggcaaatttaacctttctgatcctttgttttctcatctgcaaaatagggatagcaatatctaccttgaggttgttgtgaggcataaatgtgatgcacttggtgtcaagtacctaatactgtgcctggaatatactaggtactcagtaaataatatgattagtaccttcatatatccccctgcccattctgaacacttgtgagagtagcagagtgctttgctcatagtaggtgctcaatatatatttttaaagatccgtatttacatatatacagacatgtggatatacagtcaacatacatgtgtaagtgtttacacacatacatataggctgtaggagctcaaaaacagattctgaaggccagaagggattctttcatccaatatgctttggggcagaaccgggctgtccagagaaagaggtggaactctttctctctgactccagtctgggacatatactcagcctggctcactgttccctgagagtctggtgaccatcagaccagagggagcagaaggaaagtaccagcttcagtacctcgctgctttctccagccttccttggtgcctacttactatctccaggctaaagttagagcaggaaaggctgagcaggtgggaggcggaggaaggtcatgtgacattcaacacggatgtagtgggggagggaagattttccaaatgtccctgctagcatccagcctagccacctggagacagcacccactcagtatgtcctgggccaactgtggccaagcctccgaaagcctcttctctgctcaggctcagagtgatgctgcagagtgaagctttcaggggagaagccattgatttctgatctctgaatctgctcattaagcagcagggtgacttgcatctactgccatatttgagcacaatttgaacaatgagaattatcttgcactgaagccctcacctggcattggtgacatctctgaaagaatgccaggctggctgcatactccccacactgactggctgggagggggcctgaggccagagtcaggtggtcatctgccttcagtcacagtcccccagacccatgggctgctcctccctgcctctcagccagttcataggatgctgatttgcatgagtctctccatgtctgtccttaggtctctctttcatgcctgtgttctgggagcttaggagccttgggaggccagaaccttgatcctttttcctggtctttcttatcttacaatgtccagactgagggagctcagtccaggccactggatgggccacagcttgggtagcagaagtgagcggaaggacaagcaattacctggtgaattcaggcaaataaacaatttgttggccttctggctcccctggtgtgctgaatccctttcatgtctttttggaggttggttttttgttttttttttttttgtccattaacctcaatttccagcaacctgagagttcccactgcacccctcccagatggtggagtcccgccaaagggacattactctaggacccggggcaaaggctcagttgccctgggctctgcctctggtctaagggactaagctgactgctaaacaacccagaggaccccctattttgatgatcctgtcacccttcccagcacccactgggccaacctccctccactgtccccaaggcctatgggtggggttgggggttggtgggtggctggaggaaccctttaggggcagctttcctagctgctataaatcagcttagctttgctgttctcttccctcttgctttactttttgcctgtgttcttttaaccctctctatgggcaaaacacagccccacgtgagtgtgcctaattgaggaatgttaagccttcccatgctgagctggaagtcagcctctttcaaagctgtccactgggatgtacccagtgcaggagctaaatatagaaagggctccctcctcccccagcctccctcatcctctgtgggcacgggcacaggcgagaatcgatgctacgcttggtggcgacggcaagctgcgtgacagccgcccctgcttagagacccttatctgcacctgccgccgattggctctgatagagccctgacatactggggacaggaagtcaccatggcgacctcacacagtggagcggggaggggacaggggcttgactctgtggaggtagactcaggatgcacttgggccaccaccctcgggggctcccagctggccaagcagggatcacgtccctctgccttggccactccaggccacctgcagagggggcagccctgtcagtgatggagggggagacagcctgtgttattcacgccggaagtccatggcattctcagagagctcttccccgtacctccccagaacactgagaatggatgaatcagtcccggctcatcagagcctttcatgctaaaccagcccaaatgactgatttagaaactgcgtggtcttgttctttgagtggatttctgaggcacactccagagcaggcccaggtcttcattatctccatgcacaccctttgattaagcatctgtgaccacacagcactgtgtgctgtacccaaggaggcaacagaacaggagacactgatgggagacacgcacccagaacacccaggcagcagggaaataataaaaacaatattgctgtaccagcactcagctgatcaccacagccctgtgaggaactgctagaattctaactgaatatgagagtagagaggctcggtgctttcacaaggatccctggtaaggggcaaagtggatgcactcaagttttccagctctggtaccgggtaaggacatctggtgtttaccaaacactggaccatgcgtctgcagcaacagaactccctgggggacaatcttaaatgcagatttgtgggtctcgctctgacctggagattctgcttccagaggtggaggctggtgttgatcagtcttcaggtgactatggcgtgcagcccttctgggagtcgcgtataaaaccatcaatgcttccttcaggagccttggtgagcacatggtccagtgagtctcagccccagcagggcatcagaatcacctgggcagtttaaaggaacagtaatgcctgggccccacccaggccctttcaagtagaatccttcatgctggggcctggggacgcctgaccttagaaagctccatgggagattctaatgtgcagctggaacactggaccatgtgcctgcagcattggcccctgtattttacagatgaggaccctgcatctctgtgagagggagtgagttggatgagctgtcagcagtctcgtaactacctgggtggagaactaggagaacccaatgttttgactttcatttcaaagctctctctacttctaagctctgtgtcctgggggctgtgagccccagagtagccactggagtcccattctcaagggtggtgtagggtgggaagagtatactaattttcctttcctagactcattagtttggagaaagagctatcaggctgtgaaagaaggtagagatagacacatagagcctgatgctttaaagtgcatgtggtgtgcagagaccctcagtctctggggtcagcatttgtgactatgaacacgcccgaacatctgcaccacctcctctgcctgggaaacagcacagcgtcttacctggcaacatccagcccatgttgtaaggacccactgtccatgtaaagttccccactgtccagaccattccagaagaggagcttccatcctttctgacctcctgccatttcgtgtcagcatcagttatttggcagttgtcatttacttgtgatatgtgacacctagaatcactatttatttttctaaataaaacaaaatgtaactcttttcctgtcttatcaagccaaataagcaacttgatttttaaattttgccctaggctggacctggttctctctcaggacactgcttctttcaccttgcttttcctctctaccctgggctcagagatatcccctcgatcccaacttttggggttgggggatcaggttgtgctgatcattcattctttccttattccagatctctctgtgcacaaagcgtccactccttaatccagtctgaccacagccatcaagatggatccaaagaaaactagggaaacagctgcccactgcttcccaagcttcccatgctctcctgacttccatactccaacatctctgaagcctttctcatccccacacaccacacctttcttccctctaaagtcttgcattcactgtccctgcagattaaaacacccactcccctcttctggctaacatttcctgtccttcaggattggtccagaatttgctcagtgggatgacatctctgtcctcatttcccccctactgtcccccaatcctgggctcctgttccctcgtgttcagccagctgtcacagcacctgccacacttcatggggcacaagtgtgcaatagagattgatgaactgatctccatgagagaacagacttgttgctggggtgtgctcagggagtcccagatgttgtcttcagatgcagaagagttaaaaggcaatgttttctttatgtgtgtacaaaataacaaaggggaagactctcagaccatatcctattggtattcacatcttgtgtgttgcccttgtgtgtgggctggacttgttgacttgcttctacctattatggcagaaatgacatggcgttcatcttggtggcctctgtctctcagatcaactgcccttgtatcggctgtcagctgtcatgacaagaggtaggccacatggtgaggaatggagaccaacccacaaccatgtgagtcaagcctttaagtgactgcagctctggctgacatcctgactacaatcacgtgagggttcttaagccagaggcacccaactaagccatgtctggattcttaacccacagaaactgtaagatgatgaatgtttgtcatttttaggtagctaagttttgggggaattttgttatatagcaatagatagctgattaatatttgtcctttgtattcctcctatgtgcacacatgctgtgagcatagcacctaatagggcttagaacagaccagtggactggaaaggaaagctgtctggagactctgtgctaggaagcagagccctgatgaagacaagctcaaatgccagctcttctaccagctttttaaccattctaatactcactggattctgcctctctgcagtgtctccagaacacactgcctgtcttagtagttcattgtctttctacttgaaattcattcattcatttactcaattaatatttgtagagtgcctcctagggactaaggactattccccactgcagaggagcctgcagctcccaatgccgacataacagctttacttgcgttgttcctcttcccttggtttccctgaaaacactctgagggttttaagagtcactctcctcctttctccccttggatagatcaagatttgactgacatttatttagcacctatcatatgtctggaaagcagctgggcacttttccatgcattagcttatttaatcctcacaaatgcttgcttgtgaggcaaatataattcccatttactagtgagtaaatcaaagctcagagaggcaaaataacttgcttcagttgcacagtaaaaataacagcaaacccttttggaatgttctgaacaaactcatttagtcctcctccagcccagactgaggcaaataaatgttaggtaacttgcccaagtttacacttgtaagctagtaggtggcagggccaggaacaaaacctagggctctgactttagaattcttattcgtaacaacactaagggttgtagcaggactaaaattcagagttaggtctttggactggagtccccagtctgtcacccctgctcagagatgctctttcccacctcctgcccagaccccctccctccacccaacttctctcccgtgttccagtgatgttccaatttgatgatgaatttgcttctcttgagtatttccttgacttaattcaacactttttttgtctcaaaaatgaagaaatcagaactcttctcctatcatagaaaggtcacccattcccttccccaactttgtggaggtcttgctattggggagacgtgtgtgaaagggagaaggaggggggcagacaagaaaggaataaataaaactaaagcagcaaggaacttcccatctcggtggctaagttctgtttcaaaatgagtccaaaactctggtctcatgccttttttttttttttttaaagactgtgacagtaggagaataatgtgagctggcaagtaataaacagtttctataggcatcaggtgggaacttaaaattcagaaggcagactcctcaattctgaattaacttcctttcttcctgggcacaagagggtctatgtttctctcatcttctccctggccccacacacactctttcatgcagtcaacattcctgccccacaataggtgtgattgcatcccattatgttgtcatggcaatatccattgccatctggggggtggggaggtggcagtggaaacaaatgagtggccaatcaggctttccaggaacgtctcatcatgacacactgctctctgccaactgccagagctgagcggaataaagatgagtgtgtgaggaccctattgagggggcacaatgatagtaccctgcctaatctcggccaagggatcgagagtcagagggacattttgtccatgtgaatgtctctttgctgagtgacaggttattgatcagcatgagatgggagaaccaaacagcaaacggtaacacagaaagcaaaaggcccttcaaggtggtaattgttacgtgatacatatgaaggatatatgggagttagttcttttcggtgccgagaagggccaaagattatagaacctagtgtcaccatggtcattgcttcttccttccccccattccagaaacagaaaaggaaaagtcctgttgtcaagacctccaaggacaagaaccagtgaagcctggtaacaaacacattatgctttgaagatctgccagttaacagctgtgtggtctctctccgattaacatctctcagcccttttttcacctttatgagatggggattataataccacatcccttgtagggccattgtgaggattgaatgagctaatgcatgcccacgtgcccacctcatggtaagaacttcagagatattagccattactattccaactgatcacacacactcagtgccaccaaggatgatgccactgcagtgtctccctatctccctaccttaggtttcacgttttggcgagcaaatgcagcaggaataaattttcagtggcctgggagccacagctatagccttttgccataagaaactcccaaactctctctctctctttctctttctcgcgctaggtgggagcaagccattgcctccccctcagaggacccagtggagagaaggttgacagcttggcattctctttggaatggctgttgacttcgcactgccatccacagaagagctccataaccccacccaagggcacggaatggcctttccttaaaggtgaagcacaacatcattctcaagtgcctttgcaaatgtatgtgaacagtctttcaaggctcatatcaagaagtctccagttcacactcctgtcccaatatccagtgcccgacattgagcccctggggctttctgatcaagagtggggaggacaaccagccagagtgggcagctgaggtcacctggagtaattaatcctaaagtttactggtgcctgttctgctggggagcaggaatccaattacccacagtgacagcagcttagtccctggggagatactcatctgcagggcggccaacaacctgtccacctgaaatcttcccgagaagcaacaccaacctccacccccttcactttctccgcacaccctagccaggcacagacctcagctaaccaggacattgcccaggccacactgcctgggttgtggtacaaaggagtgaattctgggagattggaccaggacagcttctagaggtctcctaacaagaacccatttctcctgtagaacgaagaccagaactggtcatttacccaggccgagccagacctatatgatacatcaaaagcagaacagaaagaaagggaatgagagaatccaaatgagtttatttgtccattaaataaatatgcaaaattatgcagatgtggaaatgggcatacaatttttaatcaattgctctggcatcatcgtgaatagacctatggttctggatgaggggaccgctaagagataattctggcccccttgccatcagcatcccaaagaatgtacattaggaagcagggaggtggtctatgccagatgacctttttgctctttttatgtggccctgactctgactaagatgggttcctacttctagaatttcttccctggacaagagtgaaaaagtggccaagtcttttgcatggctaccaccagggaaaggaatttgacttttgtaatgcaaatttacttcctggcttgaaagtacatgattaaaatgatatgtttcagtgtgggagccagacagcagatttggtattagaaggcagcagctgctgcttacacacaggggtgtctgcaaggtacacggaggagtaggtaaaaaagtatttgttggggcctggagaccctaggacttgctaatcagaatggaccattcaggtgcacttatataaacctaaacacaacaagggtgtagtataacaaaagctgagtaccttcaaattggtcattcattcattcaacaacgtttattgagtaccaaatccatgtaccagctgctgtatatagttatatagcagtgaacaacacagacttagtgaagactgttgaccagggctcaaatttggactacaccactcaagaataatgtcatattgggcacgctgcttaatctctctgtgccccagtttcctctaaaataaggataatgcaagtacatattgccacctctgctttcagccatgataaaaagaactggatttacctttctgtcttaaacaactagaaagtcatacaaaatatatgaaacaaatattttcaaacattggacaaaaggcgatacaggactatgatccttgagagaggtgaatcaaatgagagacccctacaatttctctaccctactgcctgcatcggatttccaggctgcagcacagggaaggggagccaaaacagagcccagaattcttggagttcaagacgactgaggcagctagagtgtgcaggcacaatgccagaaacagctttggctatctgaaaggggatccacttaaagagctttgccaaaatactgattttcacatacaaggaatgaaactccataaggctggagaaagaaccatcgcaaagcactaagccaaatgatttccagaactgggaagagttcatgttcccaggtgagaatgaacaggtttcatgatacagttgtgtgctgcatagcaatgttttggccaatgccagatggcgtatatgatggtggtctcataagattataaaagagatgaaaaattcctatcacctagtgacatagtgacatcatagtcatcttaacactgtagtgcaatgcattactcacatgtttgtggtgatgctggtataaacaaacccactgtgctgccagtcctatgaaagcatagcacatataattatgtacagcacataatacttgataataagtgaccatgttactggtttatgtatttaccagttactgttattttacagtgtcctcctatgtagaaaaaaaagaaagttaactgtaaaacagcctcaaggaggtccttcagaaggtattcatgaagaaggcattgttatcatggaggaggatggctccatgcatgttattgccccagatgaccttccagtgggacaagatgtagaggtggaaaacagtaatattggtaatcctaacctgatgcaggcctaggctaatgtgtgtgtttgtgtcttagtttttaaaaaagtttaaacagtaaaaaaaccccaaaacccccttttttaaaatagaaaaacttatatagagtacggatgtaaataaatattttttataacggtacaacgtatttgtgttttaagctattactggaagagtcaaaaagttacaaaaattaaaaagtttctaaagtaaaaaagttacagtcagctaagtttaatttattattgaagaagaaacaattttgtagtatagcctaagtgtacaatgtttataaagtccatactagtgtacagtaatgtctcaggccttcatattcactcacccctcacacagcctcacccagagcaacttccagttctgcaagcatcatacctgataagtgccctaatactggtataccattttttatttttatactgtatttttactgtaccttttctatgtttagatacacaaacaattaccattgtgttacaattgcctacagtattctatacagtaatatgctgtacaggtttgtagcctagaggcaataggctataccatatagcctaggtatgtagtaggttataccatctaggttagtgtaagtacactctatcatgtctgttcaactaaattgcccaacaatccatttctcagactgtatccccattgtttagtgatgcacgattgtatacaaagcaacaggtagggtcctcagaaaggcatcacattcacagtgaggctaaattagccctaaacaaaaggcagtgccagacttaccctaagagatcttaaagcaagccctaaaataatcaaactgattccaattaacttaactctataccagaacaaagtccaacaccctttaaaggaatacaaaaagaaaagaaatcagtggctaaggtagtaaaattaactatgtctggcatctaataaaatagggctgtgtgtattgactcatgcttgtaatcccagcactttggctgaaatgggaggatcacttgagcccaggagttggagaccaacctgggcaacatagggggacctcatctctaaaataagctgggtgtagtggtgtgtacctctgatccgagcgactcaggaggctgaagtgagaggactatttaagcctgggaggtcaaggctgcagcaaaccatgatagtgccactgcactctaccctgggcaacagagcaagaccctgtctcaaaacaaaaaacaagaaacaaaaacaaaccccacaagttatgcaaaaaagaaaaaagataactaataagcaggagaaaatcaatcattagaaaatgactcagaaatgccagagataatggaattagcatacaagaatggtaaaactactatagccaatatactatatgctcatgaatttacaggaaaacatgaacatggtaaggattaaaaaaggaagatagaaaagtgaccccaataaaacttaaataaaagacaaaatacaataactgaaataaaaatataataaatgagattaacagatacatcaaaaggatcagtgaatttgaagaacagaaatagaaaatattcaaaataaagcaaagaaggaaaaaagattaaaaaaaaaaaaaacccatagcatcggtgacctgtaggaaagtaacaagtcatctaacatatatgtaactggggtccccaaaaagaagagaaacacagaagaaatattttaaagagatggtcaaaagccttcagaatttggtgcaacctataaactcactgatccaagaaatgcattgaattcccagtcaacacaaaccataccaaggcacattataaccaaattgctgaaaacaagtgataaaatcttaaaagcagccagtggaaaaaggacattacacacagaggaaagacaaagtggcagactcttgtcataaattatgcaaaccagaagacaacaatggccttaagtactgaaaaggaaaaaaacctgccaacccagaattctacatcaagcaaaaatatcaatcagagatgaaagcagaataaatactttttcagatcaaagctgagataagtcatcactagcagatttgcctgtaagaaattttaaaggaagttctccaggaaaaaggaaaatgatactagatataaatctggatctacacaaaggaataaaaaacactgggaatagtagatatgtgggtaaattgaaataaattttgtactcatttttgaagtctctttaaaagtgttaactgtttagaacaaaaattttcactgtattgttggatttataaaatatagaggtaaaatatatgacaattatatcacaaaggacaagaggtacaaaattgaatatataagttttttatagtatacatgaagtggtatattattagaaggcagattttgatatgctaaaatgtatattttaaatcatagagcaaccactaaaaaaaaatacatatggataataagccagcagcggagataaagtgagatcataaaaatattcagttaatacaaagtaaggcagagaggaaaacataaacaaattacatatgagacaatctgaaaataaacagcaagatagtagacttaaactcaatcatatcaataattacattaagtatacctaatctaaaaacttcaattaaaaagcagagataatcacattggattttttttttaaaaagcaagacctaactatgtgctatcggcaagaaacacactttaaatatgaagacacaagtatgttaaaaggaaaagaacaaaaaaagatataccaagaaaagactgatcaaaacaaaactggaggccgggtgcagtggctcatgcctgtaatcccagcactttgggaggccgaggtgggaggatcacgaggtcaggagatcgagcccatcctggctaacatggtgaaaccccgtctctactaagaaatacaaaaaatcagctgggcgtggtggtgggcgcctgtagtcccagctactcgggaggctgaggcaggagaatggcgtgaacccaggaggcggagcttgcagtgagccgagatcacgccactgcactccagcctgggtgacaaagtgagactctgtctcaaaaaaaaaaaaacaaaaaaaaaaactggagtgactatatcagacaaagtagcctttagaacaaggaatattaccaggactaacagggattttataatgataaagggataaattaaaaaaaaaaacaaaaccctaaatgtatatgtatttgttgatagacctcaaaatacatgaagcaaaagttgatataaagaaaggagaaatagacaaaaccacacctatagttgaaaatttaagcattcttgtctctgtaattgatagaaaaagtaggctaaaaatcaggaggggtgtaaaagacttgaacaatcccatcaacctcctcgatctaactgacattactagaacactcgaaccaacaacagcacaatccacattgtcttcaggtgcatataaatcactggctaagataagaccgtattctagactataaagtcttaatatattgtgatagaatgaaatcatatagcctttaatttgaccatactagaattaaactagagataaaaaataaaaagatacctggaaaatcctcaaatattagaagattaaataaggcacttcttaaaaacccataagtcaaatttaaaaatcacaagggaaattagaaaatattttgaactgaaaaaaatgacaatataccaaagtcaatggtatgtagtagctaaaagtgcttagaaataaatttatagcattaaatgtttatactggaaaataaacaagtctcaaatcaatgatctaagcttctacttctaccttaagaaaccaggaaaagaagaaaactaaatctaaagtatgcagaagggaaagaataatgagcagaagtcaatgaacagaaaggcaaagagaaatccaataaaaccaaaagctcttttctaaaaaagatgaataaaattaaaaaaatgccagactaatcaagagaaaagacaagatcaccaatacaagacatgaaagatggaacatcactacagctttcacacacatcaaaaagataataagagaatattataaacaacttcatgccagtaagtgtgaaaatttagacaaattggagaaattatttgaaagacaccagctaccaaactaccaacactcactcaagaagaaatagataactggaatagccctatatctattaaataaattgtatttctagttaaatctttccacaaataaaatttcaggtacagatggcttcactgataaattctactaaacatttagggaagaaataatactaattctatataaattcttcagtgtaattgatcatacaatagactaaaaaagaacgcccatatgatcatctcaaaagatgtataaaaagcttttaacaaaatgtgatacctatttatgactggaaaaaatcctacagctaacatcatacttaacagtgaagactcgatatttattttctcccttggactgataacaaggcaagaatgcctgctttgatcatttctatttaccatttcattcaacattgtattgaaaatcctagctggtacaataaggcaagaaaaaaattaaaaaggatgcaaactggaaataagtaaaactgcaggctccatgctcatccgtgtaaaagtaccccacttcctagggaaggcgtaatgactgaattacaaggactgcactgcaagtatgtggagtgcttagaatagtccctggaacctcaaaagtgctcagtaaatgctcactattattgttaattcaaatgattacagaacggaactgagattatataatggggatctatccattgatggaggtggttgtgagaaaaatgcctacttgcctccgaagcaccagacgctcatgcccatgtaggaatcggggagggccattggaagacggggaaaaatgagcccttacattggtacttctccatcaaaggccattaggactccaaatctcatataatcctttaatgaccgtgggaagggacagggcaggtagaattatcttcatcctaaggatgggcgaactgaggtaaagagccatagacctgtgcaataccaggagtagtcctgaggtctccatcccagaccactgcaccttccactacaccattcttcctttccacaggacaggtctcaaaacagggtgcttccctgcttctgcagacggaattgaataggcacatttatgagaaggatggtccagaacacaagtgcaccttgataaacaatggtagtctacgaggcactggggatccaggatcctgaggatttgcctctttgcttttgtgaggttgtcctaccctgcatatttggccgaggtttacacaatgaggctcctagaagactaaaacttaaaatacccaaatccaattgtggcacataataagtgctcagtaaatgtttacttagaaactcgaatctgactggagcccagggaagatgcaagtggcttagatttaatgaaataagtgtgcacaagaaaaccactttgtaaactgtaaaacaatgtacaaacactgacgtcaatgctagcagttgtgtgaaaagacaatgagatctaaaaaggaagacctgagcaaactgtcttttgggtgagtgtaggagcagagctcggaagagacctggaaacttgaaaaatagagtttacaaagcatgtagtaaattaattgataggcatagggcttggggagagaagcaggcttctctagcatctcttaaggacttttcagtaccgtgctacatgctagagagacagagatgaaaagacacagtcccaccactaaccagctcatagccttgtggggagcaacaggcacatagagaccctccatagctatagtgagtgctgggatggtggtaagtccatggtgctttgggggcacagaggatttggggaaggggagaggggagttgctagtaagaccagaaaagagtggtgatagaaagcagttttaatatgaaactgaggggctgaatggagcccaaataaaaaacaaaaacagcttaatttcctttgttgcccaaaggaagtatgggaagtacttttccaggctggaggcagggaatgatgagccaggaagtacaactagggatgatgaagcaggcttttgagtcatgagattatttttctgtgcatgggttataccctcaagattttgccacctaatgaatgttaagatgatttttacatcttaaatgactgtgtgtagaagcccctgtagaggggaggcagctgaggaagggtgaagaggggagctgtccaagtgatggcagaagaaagatgacaaaatcacatgagaggacctggtgctgagctgtgctagccccagagcctgagctcagggcatcatttcacccccggggtgccttcattcattaattcattcagcaaaaatgtcttgagtacctactatgtgccaagcactgttctagatgcagggaatggagcagtaaacaagggagaatccttgccctcaatatactggcattctagattggggagacagacagtaaacaagtgtacaagtaaatgaacaagataaatataggtaacgataggtgctatgaatgaagtaagagagggtaatgggaccaaagggaggctgatggtgggcacacagctgaggtgggtggcaactctaggtatggggttcagggaaggcctctccaagggtgtgacctttgcctgggacctgaatgataagagcaagccctatgatgatgtggaggaagcagaagaaacagctggtgccacagtcctgaggcaaattcaaggactgtaaagaaggccagaggagataaagccctgagggcaagggggcatggtatgagatgggttaggagaggaggcagggtctcatcggataaggtctggaaggctctgggattttattctaagtacctcaatttgtcccttaccaaagtggtccccaattcagattgaatgatgtccccgaagcaggctgggcaaatttacacatgaacaaatacaaaaatctcacaacaaagttctttcagtcaaacccgtgctggagtcccctcagcaacactcttaccacaggataacctcacctaaagctggaacccagtccctcctgagatggcatcttgggactgttaggattcaaaccgatttgaaacaggtgccactcatttctccaggctctaagcagcatgtgaatgaatgacactgcccttgaaggggccagcctggatggagggagatggggaatgtttcaaggttctcattaggagctcaggttgctgctataacatctccctctcgtctctacttcttactcctccttaggaacagggaatgaaggacagctttgcccccaggccactggaccaatgaccacctgatgccctagggaacgtaagggagtgggagagaaccccacctggcccctccagctggtagacaaaatggaggcctccagttcctgccaatgttccatctggggaaggtcatgcagaccctgcactcacaatcaactgggcagaagcaaacccttggggagggcagggcatgcagctgcatgggcgccatctgcacgtgagtcctgacctgggggaggagaggtcgtcttcctacagcccgacctcacacattccttcagcatctctgggaaataatcacactccccacactgaagaaacacagtcaacagattctggtttcctagatacgccagtggcttctaaaaatagccaggcaatgacaaagcaaattggcatatggactgcaaataattccagtaccagcttgcttggcagcactcaagcctcccagtgctgggtgcttcctcctcttccctcccgtttctgaaacagtctcttgctgctgaaaaccccaggccaaatgtgagcgaaggggcagctgcagcccctgtgggggtccagcccagggctggtgcactctgctgggctgaagccactccaggctcctcctacttccctcctcatccactccacatgctctgcgggtccccactcacgctgaaggtccactgccagtcaagccaccggtagctctgtgtgtgccccaacactcccaagcaaccaacctcttcctttgtgtaaccaagatggggctgccttgaccttctcactccaggactcctcttctggggataggccactgtccacggtacctcttactttgactcaatccctcccctggccccagcagggagtctttgcaaagtatcctctttatctgcctttcttcattctctaaaccctgtgtatggttgtgtgcaatgtgccaggctttgtggtgggcagcatacccagcagtgggaattccagggggaagaagacaggtctgtggctggaaagagtaaggaaaactaacatggttgaactcctacacttagccagccactctgctaagtgagcctcacaagttgtctcatttatttctcattcaatctctatagtgccctatgatgtagagattcttattgtcttcttaactctgtaaaccaattgaggaaagcagctcctaggagttgagtaacttgtgcaaggctacagctgaaaaatgtgtagctggaatttgcttttacagccgtacagcataagggccctcgaatctcttccatgaagccagagcagctccctcaagcagcttattcttcaatggagcttgggtcaaggccaggcggttaacagaccccatctcagagaatacaagagtcttttggaaggaccatttacagaggtagaggcaggattatggggaccagcaagagatgctgaggcacccagggactagcaatggcaggaagctgtgtctacctcaggcctgaaagggcaggggagggagtagggatgaggggctgcccagcagcagcgccaatcatgagaaagtggggagaaaatacctcatgcctctctcttcccacctttaggtctcccacaggctgaactcaactggatgccaggcacaagggaggactggggatgcagtacaagtctgccaactgttccaagtaatgttttatctttgcagtgtcaccaaccacctgatttctcccaggcctttgttaggaggaatcactacgtattttcatggttaatttttttcattgcatgaaaaaaaagctgaaaggggtaccctggccttgccttttctaaaactgttaggaagatcaacaggataaaccaggggtctgagctcctggggagataatgtggatgcctaaatattagctatcccagtggtagggataacaagaaaatgcttatgggtaagcaatgatttaaaaaattttaacgctactgcaacagccacggtgttctcttctcaaggcagctaaaaaactcactctgcagacatttctgtctccaactatttgttgccttgaagcctaagaatgcttccaggcagccctaacttgtccaagacgaacacaagagaggcgatgccattatgaacccatggccacaggcagcatctttaattcatgagcagggcggcattggcaggagaaaaggaagggagacattaagaggaactgccttgaggctctgccttggactcaaggtaaaactgagattttagcccattccagcacagctaagtggttttcaatttgtgtttgaggaagggtgatacagctgcggtcaggacaggaggggttcttcccacacaccagaccaccaggtgctaagagcactgtggaagatgcaccagcagttattcctgtacttttattcattcattcaacaaatgtttacggagtacagtacagcatttaagagtgagctcttctgagtcagaaagtctaggttcaaatcttgctccatactagctgtgtgacttcaggaaagtttgcttatcctctctgtgcctgtttcctctcttttaagtggggataatattaacagcatttatatcataggttgttaggaagattaattcagttaatacatgtaagggctctgaacagtacctggcatataggaagcatggtggaaccttgctagatccactttggctatgcagtgagatttggatttgagttctgcatctagcaattagcagctgtgtgatttcaggcaagttacttgacctttctgagctagagttgcctcatctgtaggagaataagtctctgttttatatggtagttgtaagaattcaatgagatggcaatgtatagtattcaataaatattgactgtctcttctgttttgataatggccctgccttaaggctaatgtctgggggtaaaccaggcacacacattcagatctgatcatccctgcaggctttgaatgactactggaacaccagtgaggaggcctggttccaccctgtcctcattagctgtgtgaccatgtgcaaattgcctgacctctcaatctcagtttcccaaccagcaaaatgaaggggttggaatatatggcctctaaggcctcttacagcttggggcacattctcccagaccctctggacttctgcccagacctagtcttgagaaccagtgtgggacagtggagaggacacggctcatcagaatagatatgggttgcatcctaggtacctgatggcctagcacagcatcagacacgaccagaggtggtttcctgcctgcttcccttgccagcacagtcattactatctgattcctcaatgcagggctgaggctgaaaagctgagatgtgccccaagattgccctatacccttcttcctgtgccccatcttcccaaagtgacttcctctggttctccaacaagctcagggaatctatcccactgaagcttccaggctcaggaccctgacaggtagttgtgcctaacctgaaagtttatagaagcatccaacctgggcagctgggctggtgagagggagtgtgtgtgaccttttcacttttgtctccaggattttaatctccggtgttataacacctgggtcaacatcttggaaatttatttctgtactgccagctaaggaagctgcacatatttctgtctcaatgaaaaaaccaacagggccctgctacctcgtctgaagctctaagctcctcagcagaggtgcagcgcaggggcttcgtgcacagggtgctaatggtcagttgacttagggccaccacactggtaggtaaatgactcctccttaccttactcctcctcctgaaggcagtggggtgggcagaaatgctgcttcaagcaccaccatgcagagggggctgggcagagggcatgggagtgtctgaccactggacaaatgacatggcttaggacttcaatcatgcaggaattcaggagttgttcctccaatgtgcccacgggccaggaccaccagcacaaccctaactaggactcgcagtcacaagcagatggctcatggcagcacaggccacagagagttgtgcattgcactctactgccctccaactattcattcatatccactccacattcatcaagcacctgcgtgccaggcactgagtgtgagacctcagaagcaaaggtgaacaacatgagcagcctctctctgaagagtttctagcctggaaggggaaattatggacacacgaacaaataattatgataatgtgcactaaatgctgtaatacagctataaagtggtctctgagcaataaatatgatgctcagggaccacaggagattctggagaacattacaccctatagaacactgttgagagaagcagagatggagcttcatcaggcctgcacaggtcatccaaaagcatttctagctcacaccttagtcagtgaagtttttatttgttaacatgtgtaggagaccaagccacaggctgcaagcttgggctcaggggttgtccaatggaacagcagggcagagccatcccagcacaatggccaaaggtccctcatacttagaaaatgcctccctaccaggactttgtcagcctgaagggccagggcaagggtgcccttggatggtcttagtttaggaggagcagaggtcagggctgccgtagctcagggctatttcaggacacttaagacataacagactggcttgtcttccctccagacactggctgccttgcatctgactctttaatttccctggagaggaaaacatattgcttctggctatgaccctgagagggacaagagcatcctcctttctgattgctgtctcctacctgggagggaagccagaccctgcatgtgtatccactctgtaagtgaacacttctgagacagggatctgtggagccagcccaggagtcttcaaatgaaggcctttgctgctctcatctccaccttgtgggcaacccgacctatccagggactagcactaaaagtttgggtgatgcttcagacctcacctcaaatgcccctttgacctctgtggtcagctgactgccagggtaccagggaggacaaagaagaagctggctggcctcactccccacacctaggctgcccatggcccttgttgctggcgcaggctgccctggcattcagcaaccccagaatgtgtgtccatgttgtgccaggtactatgagatgtattgaacaagagcatttgctgtacgtgggttaactcatttcattttcacaagactgtttctgctgtacatatgagcactaaggggttatgggacttgctcaaggtcacccaagctagcaagtggctgggctaggatttgaaccctacgaatatgattttagagcccaagttcttacctactgcatcattctcacttgaattcctcatttaactttggaagcatcacagtgtccttttaaaatagcagttttagtggttaacagagcaggttctggagtcagacacaaggagacctgggttctaactgtgtgattttggaaaggtcacttaatctctctggggctcggtttcttcatctgtaaaatggaacaagaacacctgccttcaaggaggtaaagatggaataatgtactcagcacactgaagctctcatgggcagttagttatgtactttcttctcttgtcacaagtccagtgtttgtgacaagagaagagtgcctgcccatgtggtttatcaggccctcctattgaaagctggggtgtggtggttaatgggtctggctctgatgtaactcgaaaaaagaccaaccccccaacatgagattaaaggatgggcttccagggactgtgcacaggggctaggcatccttcccccgacaccatcctctttcccagccttagtatcctccccctccccactgatcacaaaaatgccttatttgcccaattattatacatactaatcatttccatttatatgcctagcttaccatttattcctaattattgtgcagttcagaaacaattatgcataccattaaggatgttatcagggtaactttgcagtgaattttacttaacttcaatactaaatggtttgtgtgtgattcactccacagtttgtggttcccgtggcataagagctccttcaactgagttgggggacattagttcccatggcataagatctccttaaactgagttgggggacattagggtaggccacactgcactgtgatggtacataagaacaactgtgggagtagcagcagcagtagtaatagctgcaattccttgagcgattatgtactggacacttcagcatttctatacatgatatcatttgaactccatagccaacctcttattaaagatgaggtgaggcacagtggttaagtaatgcatccaaggtcacccagatgggaactggcaggcctggggttcaaatccaggtatgtctgagtcctgagcctgacctccatcacctcacaggtgcctgtcccgtagaagggtgcaaggtgagccctggtggtggcagggaggggcttggaggccatccagtccattccccttgttctcacggtagaacactgaggctagagtggggaagtggcttgcccaggcctgcagggccaggtgaggacagaccgggataaagccctgcttctctcaatgcctggcttccccttcagcactttaggaggcagctgtactggggacagaggcagcatctctgaattcttgttcatcgctcggggctgacgcaggcagctgcgcgcacctcactgctagatcgtcagcctggtcaagaacagcagtttgctctaattcttgaaagctgacctgctttaggaagtgctccctttggaagatgcctggtctcttccccttctgtccttttttcttttttttctaaacatgcatctcctttcactccttcatttatcttccctcaaaaggcaactgctagcattaactgagtacttactaggggctgattatgctgctaagtgctttatgtctatttttccactgaatcctcacaatacttctgtgaggtaggaaccaccattatctccccatttgctagctaaggactctgaggcccagagacattaaatatgggccctgagtcacacagctgggaatgtcagagcacagatttagagccaacagatttaggaccaacgagatggggctgccccccagtgggggctatggggtgcccacaggctgaggaggctgtgaggagcagggctccctcttaccacagaagcctgcagactctgttctcactccaaggcctggtatctaggcctcagtgttcacacccataggtggaggagggcacatcattttctcatccacttttggagaccccttcctgaatgggcatgcctccctctttttggctataagccactgagttagagaacaggatggagaatgtgattgacagcccatgtcctcctgtgtagctgactgcattacaggtgaaagggcaagtcactacttcccacgtgtgcagagggagagaaccctggggtggactttccaggatgaaatgtgagtgacaatgcttatatgcatttctctctttcttctctttgccttctcttcctccctctttcctccttccttttccattcatccaacaagcattcactgagtcctcactccatgctgggcactgtgctaggcaccagagatgcaaagaacagccctgccctaggggacaagcactcatcagaaaagtgggccagaaatcacagtggtgttgtaaacatgacagcaggagggtgaggccaagccagggctcactcctcttccctctccacagcactcctcaggcatcccaggcctgctcctgccggcctgtctgctccccatgtctgggacgttcctcttcccagacacaggagtggctcactccctcagcattttgaggtcactgctcacctctcccagggcctcccctacccactgcctggacctaccaggcccctgccactctccatgctctagccctgctctagttttctccatagcgcacttaccaccactgactttttaatttttttttttagctaacgtatctctaggttattaactcccattagaatataagttccatgagggtaggaattttattctactttgctcactgctgtatcaccaaatgattagaacagtgtctgtcgcataggagctcgacaaatacttgttaaatgaatgagtggcatagaggtcatggtgcactagaaagtgaacgggccctggagtgaagctcacctactccccgggaagctcagcttctcggagtctcagctgatgggatacctgcttttaaagatctccaagtcccttcttaccttcccacaaaaaacgcagatcatggcccatgcctgctgttccacctcagtggaaagcagcgggaatgaagctcaagcaaagaccaggggtggggcctggctgtggagcccactcctaagtggcttcagacggcatcacgcaattggtgtggagacaaattcacccccgactgcatttgcatatgttgaggttaagatgaactttcactctctgggcacaacacacaagcagggagccccaaaactgagtgaacagtggcaggggcagccaggaacgaagaagctgctgtgaaggcaactcctgagttttcagaaagggaggcagtctagctcacaggagacctcagggtcctggtcccaggaccttgccacatagatctcacgcactccctacacagcccttcctgggagcagtgtcactgtgggatgtgacagaatcccacctcctgcccctgccttccagtgttcgggatgaaaaggccacacagcctgggatcagggaggaaatatctgctctgcagacatgactgtttcacagatgagataacaagcctgtgatggcatcaaggttaatagagcctcctgcaaacttggaatccaaacggctctggcagctgcattaaaacctgaacagtttttcctggggatttttctgattaatgcaaatttgttttgcttcgcaaattggaaatcagttgcaagcacctggtgtaataattccaagagggaactgagaaccctaaggagaaatcaggtattctcacaccaaccagcccacgcccagaccttgcctgccttgtcccacctctggtacctgggcaccaggtcaccacctcggttctctgctgcattctgccccccacaacccccactgctcagtaaactattctctattgagcaccactggctgactttacccaagtggtttccagatgctgggactcccagcctcccgcttccccagccatggagggtggtaggtacaatcagggaagtcattcaagccttctgtaagaagcctgccttggcatctcctggggggacatcattatcatcagtggcactatcgagtggcactgtttcatctttcagcaaaggaactgacagaaaacccggagatgcacctcctaatcgaaactgttccttttttaagttcttgtcccaactacccagttgcttctcacctctgagtaagcaccttctcccatagtaccagaaagtggagtgaactactgggggctcccagaaaaaagtgtgtgaagaggacgctgcagggatcccacgactgcctctcccatcctgcttgtgcctttctacctgtcaaagcagtgctcctggagctgcagagctgagtggacaggaacaccctttggctgcctgtcccctcccccagcagacgcacattgttcattcagctccaagataagttgggagggatggcagttatgaacgggccccatcatgctcccccttcctttgctacgcaatttaaaggcaggagacagagaaacgctctggaaatccaaattaaaatgtattcctgcagcaatcctgcacccaattaaagtaacccagggcccattgtcctttgctaaatttagaaaatgctcaggtgtgtctgatcctactctgcacagatatttttaatacagatttaatcatattttgggttaggagaagaagctaattaggtaggcagatttagaagggctgctggaatgcgggacaaagcgaggtgatttgatgcaattcactgttttcggtttttgttttttttttttctaagcagtaagttgtgttcaaagtcacagaaaattggcttgaaaactgaggtgacaaggaacaggagggcatccctgtgttagtagttgataaatcctggggctggagggaaccccaaaagggggtctcatatactgcacagagtgctgaactccagcacacccaaaggcagagggccttcgccgtttaatgtgacaccagaactggcgtcttcatccgtggctgggaaagcattcattcaggttctctctgcaggaaggcacaaggtgttcctcaatgaatgctggttggatggataactgaatcagtgtctgagcagtagaccaagaagccagccagcccctggacctgggtaaggggcttctggttcctgtccacctggccccagggcacttgcctgcctctggtccttgattcttggctaggtgccacccccaacccccttctcagtaaccatctccataaagcaccactggctgcacccaagtgtagaaaaaaaaaaaggcatcttggcttaaccctgtgctgaatcatcatgtaattgagtaaatgacttaaaagcccctctgagtctcagtttctcctccagcaacatggggattctggtttctatcttcattataaggatggcaaagatacagtgagacttaaccgtgacatgctggaaatgccaggaagggaggccactggagggcacacacccaggtagctcagttctgcaggtgaaaaaggttgcgatgctacaaggtcattctgttttaaaccaaactgtgtgctggggagaggtgggttctttatccagccccatcccacgacacccctgtctttgtgatgaaggaagctgatccacagcacatccagcacattgtctgctgaacaagttaggttacaaaggaaagcacagaagagtgtctacagtatactctgcctcgtatgagaaggagagggatgtaagaaagcacacaggcatcttgctcatctgtgcaaaagaatggaggaaagataaaccagaaacttaagagactggctatctacaagaggtaggtgggaaagaggtgagaaggaaggaggaatgggaactgggagaagagatgaggagggtgggacacttctgataataccttcttgtactgttttgattctgaaaagctcagtaacgtttcacatggccttcatacacccaaaataaacaaatgaaaccaacaggatgtggaaggagtctcccacccaccccctaaaaaacctgtagagttccccctgagagcagactctgtcttcctcaaggaaaaggtcccacagaaaggagagcccatagctttcctagtgtagtcgctgaaagcaaagattctagagcctgggttcaaatcctagcatatcatttacaggctgcgtgtgattttgaataagttgcttaacctctctgggtttccatttcctcatctgtaaaatggagtaagacggtaactacttcacatagccattatggggagcttgtaagtcagcacaaaacgaaggcttagggcagcatcggcatagtgctgcgtaagtgcttgctagcatgattatcattattttagggtttgatgttttgggcagttgcagagactcatcttctgtgccatgagataatagctcccttttcccactaggacatcccttaagattaggaatgggccagactgacatggaactttccagtggcggtctcaccatggtggcaaatgcccctgctccgagactgtattagtttcccattgcagctcttacaaatgcaaacgtagtgtcttcagcaccaccaacgtatacagttctggagataacaggtctgcaatgggcctccctgggttagcccttggcttgtggcccctctcctccatcttcaaagccagccgcagcaggccgagtccttctcagattgcaccactctgacctctcctcttgcctgcctcttccaccttaaagacccttgtgattacactgggcccacctggataacccaggaaactctccctttcttaaggtcagctgactagcaaccttaataccacctgctgccttaattaccctatgtcagaaaaggtaacatatccacgggagcaggggatgagagtttgggcaccactgggggctttatcctgcctcccacaagggccagctcttaaccagctccaccctcttcacttgtgctaagggctgggtctcttgggttttgttggtttgtttttaccattttttaagcttacaatgcagtggcattaagtgcattcacactgcagtgcagccatcaccactatccatcttcagaactttttcatcttcctccactgaaactctgtacccattaaacattaactccctattcctctgcactcagctcctggcagccaccattctactttctgactctaagaatctgactactctagatacctcatataaatggaatcatacagtttgtctttttgtgacttgtttatttcacccagcactgtcctcaaagttcacacatactatagcatgttggtttcttgttttgcaacaactccgtgctactgattctgctcatctacccaaaagctggccctgcaggaagtccccactagaaattgcattttaggctaaaagtttgccaacaggtggcctggagatttaaaaagaacagagtgtgatctgatatggtggtatgcattgctctggggtctcggagcactgggttccagtccagacccagccatctattagctgcttgactttcattcatcagcaaacatttatagagtactgacatggtttggctgtgcctccacccaaaatctcatcttaaattgtaatccccataatccccatgtgtcaagggtgggaccaggtggaagtaatcagattatgggggcggtttcccccatgctgctctcgtgatagtgagttctcatgagatctgatggttttgtaagcatctggcatttcccctattggcactcattctctttcctgccaccctgtcaagaggtgccttctgccatgactgtaagtttcctgaggcctccccagtcatgtggaactgtgagtcaattaagcctcttttctttataaattacccagtctctggtatttcttcatggcagcctgaggttggattaatacaagtaccaacaactcaccagtcactgtgcgaggcatatgaagcacagaaactgcttagcacagccccagtcacttagtaagtactttgtgagtgttagcttataaaggaggtcaggggcagagtccagagaaaaacttacccctaccattccacattgagtgtcctgttaggagcctcagtctgaatcctggcagaagagcattcacgaaattattgcagcatctcttaagatgtcaggggaggctgctctggggaggggcctctaaaggggctctaaatggagctggagaggcatccaagaagcaggaccaaatcaagagtggcatgcatgtgggaaagcaggcagggaggccaagctccacctttcaaagctgatgggttttcctgatcctcatcttaaatctcctccaggaagctttccataattaaacccacagaattctagtgactttcactagacatctcctccacatttccctacactgtctgtacttaatcaatttgcacttgtttatcagtcatggcacaaaagcacttcagtaatctggattaaagtacttgatctgtctacactgcccaagactttaaaaacaatcccaacccttccccaacctagataccgtgctataggcaggaggcacagatcaagcatctgttgacagaagcaaattgaaggagaaaaaatgacaactcctggacccatcccactagctaagtgcttactctctccctcccaaaggccctggggaaggtggtgcgggggctcagcaggtcagtttgtggcagccgagcttctccccgtgtggttctgggtaggtcactccaagtcgccaggttgctgtctcctcacctgtaaaagtgggaggtgggaggcagggttggggtggaggcttcagctgaaaggcctgcccaagagagcagactccctcccatcctccagacactccagacaccccagcccccagcccattccatctctggcctcatgacaagacatctgagtcaaaggcacagactcatcagacgtggggctcagcccaagcagttttcacatctctcaaaaactcttgcttgctaaggaatcagggcagctgatgaccaataggatcagagaaaccagagctaggagatgctggccacagcaagcacctcagccccagacatagaaggcccaggtgaaagcggttgtctaaattaatccacggggaatttgtaaattaatcccagaccagcgccccgccagactcgtgtatgttctggaaaagccattatcattcttagaaaaaggagtgtaaatctgccaccaagtaggcatgtgagtgtgtgcatgcatgtttggtatgtttgtgcatgtgtgtgcgtactctgaatctgggtgtggacagtgcaggcagtgaagcaaataatggggcagttgcatgcacagcttctggagtctgggtctgtatcctggtttggtcatctagcagttcggtgaatttgggcaagtgctataaactgcttatacctcagtttcctcacccataaaatggagatactaatagtatctaagtcatgtgagactgctgtgattattaaacaagttaatacagatagagcacttacattaatgcctggcatgtggttggcactcaacaactattagctattcttctgatttatttatctagatcagttgactgatggatgtcacctttgcttcttgactctaaactgagtaatcactggaggtcaccagacttaaagccaaatccatctatctatatggcatacttgaacatggggtatgtccataaacacaagtcttatggttttcattagattctcaaattcccaaggacgaactttattgaaatatcattcatagagtcactgccattgggaaccttttatatatttaataaccttataaaaaagtcttttgtatacctcatcaaccaaaccctttcaaactggtccagcccaacctacgtcatgctccctggcttgatggcagggagctttctgaattgattttagagcccactctcttggcttgtggattatttgtgcaaccacctgcttcccttactcccagataattgacttgcctgtttttactcatttacatggagagagagctacataaataaaatccttttaatttccttatttgattataattgcccagagaggaaaaacatgtcctttttcccctgggagatgcaaacctttagtattttggtgatacacttggcaatgattaataatgaaatattaaataattaaaatggcaacaataatgataatgatggagatggtgacagcctctatcttttgctgaacactcaagtgtgccaggaactgtactaagtccttccccgcattagctcctctaattttggcaccagaacagacctgtctctcctgcaaattgaggggcaaacttaccctgttcatgtttgtggaagaggggccgaggggccaagggtcctatagccctgactgcagatccagagagttcaagagcatcctcctggaatcccgacctcattccaactcatagggagcacagaacacccccaatccacttttcaattatacacacatacacacatgccccctatgtaatcatcccaacaaatgtgctgagggaaaataaactctgcaagactggtttataaaaatagcaaaactcatagcacaaacctgctctgtataattcatgcagaaaacatggaaatatcctgataaattgtgctttttgtagtttccatgaatttgctgattacacacagtcacattgcatgcacagactgcccctgtatgtatttcaataatactgcttgtatttcagtaaagagatggagagaccccaagtttgaagactggctgtgtccgtggggagcttgcaatctaccactggtgaggctggtcccagctcagacatttttagcttaataatatttaccaagtccctgcaacgtgccagcattggtgagcagagggctccccagggaggaataagggcctagtggagcaagcagaccctagaacagattaaaaatatgacaaagtaggtttgatcacagtgcagaaacagaggaccaggtgggcttcctgcaagagggtctgagtcttaaaggataaaggcacagtgaccagagaggaaggcgaaaatggcattctaggtagagggaacagtaagagcaaagggtgctgggcaccaggaaatggagggtggacagggttgcttggtatcatcaaggcatgcggcgggacaggcaagagttgaggctggtgtgggaagcagcagtcagaaaagaagagaaggccctggccaccctgccaagatcttggcttcactgtgtgggtgagaggccactgaaagtcctatcctaactactcagggaaacgtccctgctccctctgtgaagcactctcaggcctccttcctttccaccacagtgcttctaaatccaattggaattttatcattatccaagtgatttgggggcactgtctctccatctagacactgggcttttctgttcactgcatctccagtgcctagcacatttctggtacatatgagccactcaatgtttgttgaatgaaatggctaatgaatgatctttgcaactcatcatgagatggttggatgggggtgagactagagactgggaggccagttgcaaggctagtggaataattttgcctgatcaatgataagggtctcaggagagaatgcataaacatttaaaaggtacgaacagtaggcagacattgatggatctgggtgtggggagagggagttgtctgggtaagtcccaagctgggctgacatcctagagaggcaatgggccatttcctgagataaggaacaagggagaggagcaggttttgggggagggtaggagagggaaagcatgagtccatcatggacttggtgagctggagtctgagttcccagaggttccaagcattctcttcctggaaacagacacagtgacctctctggccaccccaggcaacccctccacaggcagcattaggattcatgctgatcctgctgtagactgaccagccccaggcgcttttccattccaccagccatgccccgagtcatcagactccctgggggaaggtgggtggaggcctggcccacagagcctgctggttgtagcagaggacgaaaagaatgtctgctgtagaaatgagattcaagcagatgcccccgacaggccaggggactgctccacactggggctcatgcctttcagaacgcttctggctcattgtaacaagtctattacagtgaggtgtaagacaggcaggcataaaacagtgtagccatcagagagggacgaggccagggcataaagtccaggaacttcctggccactcagtctccattcccaggaatggccaaggaaaaggggacaggcccttagctggaattcatggcctagaaatgggtctaccagcctctccatccattccctgggtaggcctgaacacacattctgggctggggagccaagatggagagctggccagaggcataatcgccctgctcctccacccagtctgttctgctcagttagcttttctaaagttaccacattgatcatgccactctcccactcaaccttcagtgaccccttgttgcctttggaaggaaggtgaagtctgaagcccagccttcaaagccacctctagtttaacctcaacctgacttctcgacatttcagctcacttctccccagaaggctatttcactgcagccaaacaggtatcctcactgacttaagccctcataaaaacagaatcattgactgttagtgatggaagaaaccctggaaatcatcaaacccagccttccattttacagacagtgacatccaggaccagggaggggaagtgacctgcctctggccgaggtctgagctgagtctagagtatgttggtttgttcatttgcccattcattctcatattcaacctgcattgagtgtccatttcctgccagacactattgtagttcatgtatgaacatgaaacctacccttagtcatttatttaacaaatgtttactaagcaccttctatgtgccaggctagagtcagaatgtaataggaaataaagcagtgaagtccctgctttcttggagagctggggagctagatcaccaataagaaaaactatgtcagatggtgataactgctatgaagaacaacacgggggaaggggatagagacagcggcagtggggatgcaaattttatctagggtgtgaaaggaatgcctcttccatcagtggacattgaatggaaacttgaaagaagtaaggttatctgaggaagagggtccagggagaggaagcagcaactgcaaaggccctgaggcaggaacgtgcttggctaaagagaagaacagcagggaggccgccaggactgcacagagcaagagagagagtaatgtcaataatcccagagagggagcagggatgtgccagccacagcaaggactctggcttttactcaaagtgaaaggaggcatcactgggtcctgagcagaggagggagccaagctaagacctcacacaaaggaaggaagggctaaacagggaacccctgcagctccaatgctgtacttataccccaactgcctaggtcattcctaatcattctttagattctggctgctcaatgtgtggttcccagaccagcagaactggcatcaccaggaaacttattagaagaatcacaggcctcactcagaccgtctgaatctgaatctgcacttagcaagatcctcagaaggtctgtggtagacgcattaacatttgagaagctctgtcctggatctcaggccaaacacgacttcctcaaggcatcctccaaaccctcaggccccacaaggtgatttatttatttttaattttttttagtatactttaagttttgggatacacgtgcagaacgtgcaggtctgttacataggtatacacatgtcatggtggtttgctgcacccatcaacctgtcatctatattaggtatttctcctaatgctagcccttctgtagttccccaccccccaacaggcccgggtgtgtgatgttccccttcctgtgcccatatgttctcattgttcaactcccacttatgagtgagaacattctgtgtttggttttctgttcccgtgtttgctgagaatgatggtttccagcttcatccatgtccctgcaaaggacatgaactcatccttttttatggctgcatagtattccatggtgtatatgtgccacattttctttatccagtctatcattgatgggcatttgggttggtgccaagtgtttgctattgtgaatagtgtcacaataaacatacgtgtgcatgtgttttgatagtaaaatgatttctaatcctttgggtatatacccagtaatgggattgctgggtcaaatggtatttctggttctagatccttgaggaatcgccacactgtcttccacaatggttgaactaatttaatttacactcccaccaacagtgtaaaagcattcctatttctccacatcctctccagcatctgttgtttcctgactttttaatgatcgccattctaactggcatgagatggtatctcattgtggttttggtttgcatttctctaatgcccagtgatgatgaactttctttcatatgtttgttggccgaataaatatcttcttttgagaagtgtctctttatatccttcgcctactttttgatggtttttttttttttttttttttttgtaagttccttgtagattctggatattagccctttgtcagacggacagattgcaaaattttctcccattctgtaggttgcctattctttctgatgatagttttttttttgctgtgcggaagctctttagtttaattagatcccatttgtcaattctggcttttgttgccattgtttttggtgttttggtcatggagtccttgcccatgcctatgtcctgaatggtattgcctaggttttcttctcgggtttttatgcttttaggtcttacgttcaagtctttaatccatcttgagttaatttttgtataaggtgtaaggaaggggtccggtttcagttttctgcatatggctagcctgttttcccaacaccatttattaaagagggaattctttccccattgcttgtttttgtcaggtttgtcaaagatcagatagttgtagatgtgtggcattctctctgaggcctctgctctgttccattggtctatgtatctgctttggtaccagtaccatgctgctttgcttactgtagcctcccacaaggtgatttattgtctcaacgcagttttgaatcctctttcataccatttaccacattgtcatgcaatcgttctccaacttgctgcacatgataatcatctggggagaagtaaaaagtgccaacggtccactgcacccctcaccgatgacatcagagcctctggtgtggagacccaggcattcacattttttaatctctccccctccaccttccaccccacatacacaccctggtgtttccaatgtacaaccaaagttttgaacacttgtggtaactgaatccttcatggttctctcctttgtgtaagtatcatgagagcagggactgtgtttgccttgtttactgctgttctttgctcccaaaacagagcctggcacaaagtagatgttcaataaatacttctcaaaggaaagcagcggggcaggaggggaagaagaaaggaagactgtcctgctctgacaaacttacctcagatgagtggcagctgctgctatgtcagggttaaaaatcagagcagggcctctgcagagctggtaaccaacttcacagaaaaaaaaaaccagacacattttctacttctcactgctaggcacccagaaaagccaacattgtggaagggtgtcggctctgtgtctctttgtgaggaggtaatctggtgccttctgctggtgggacccccttgcaggccccctcctacctccccacctgccccagtctctctgcaagcagcagggctgaacaggtcttcagggatatataatctgggagagcccaaaccctccgtccagctccccagagctggggggcttagctccatatctactggggtttttatcacagaaataaatcagggccttgttttaccctcgagtacacattacttttcctctctcactaaagcaaacttctctcccatcccttctggagaggttcatttaataatgtgtgaaatgaaatgtcaacaagaattagaacaaatggcatggtaatccccagcagatgacaggcagccagaggcagggctgctcctacagtcccaagcagggagccaacgagggggaccccgcagccctgaccctgggaaggggaacctctaggcatactgtctccccgcttgcaactgaaatatggtctttgaatttctgacagaagaacagaaactgcctttgacataggaaacagcttttctttgacatacaattagcaaggacaagtgttccctagggcggggcgcaagaggccccatcagtcagcccatcagaggccatgtggattgggggtcagggaatcagagccttgagctgctgccaataatcatccgatcaccttgccttgcacggggctgctgcttttcacaggctcctgcaatctatcagcttatcctgctccagggacttggagtataagagaaaaatacctctgcccttttgcccacctgaaccctggtgggcacaagccacgtccacataattcaataatggaaatagcacatgttcattgggcatgtactacgagccaggtcctgtactaaaaattgtatgtgcattattccttttaatctgctcatctattcattcaaacacatacttatggagtatctgcaatataccaggcacagttctaggcacagtagtgaatagccacaatcccccgtccctgtggggcttgcacttttgtgtggcgggggagcaagacagatggtaaaacaaataggaaaaacatctagtagagaatcaaatggggtggctgactggggcgctgtgccatagttcctgcccatgtcactgagtgcaggggtggtgggatgcccgagtccatgccaggcaggcacctcaaggttgctctgctttgctgagccaagggaacagccagtggggacaaaagtcaaatgttccaggcactgtccccacagttcctacaggtctctgaggcctgtgggccaagcccctcctgccctccggataaccaactcactacacccatcgctggcttctccaccttcctgtctcatgcctgccacctgggattgccgccccaagtcttggtcctggctctgttttcaggggaacccaaaccaagacacagggtgagatgtgttagggagaaaataaagcaggaaagggggtggagcttccattttaagtcaggaaggaactatagcatttccattttccagaggaggaaatgaggctctggctccatttaaatggctttctcaaggtcagctaggaagtgcagaacttggacttcccggccttctttctgacacaaaagtggaaatgttcttaagcaccatacacctggcctctctcctggatgaagaaccgaagctaaaacccatgaatgctgtgctggagggaatgcggagaagacaggaggaggcactcatggggacaacttctagcagaggtgagctgcgagcaggaaagggcaaactgtccgggagaaggggacacccaggagtgaagtgagtgttcagtgtggggaggctgcatctcaggctggatggacggggcggggtggcattctaatggagaaggaagtaataaaagctacaccccagtatgagttcagatgcagccagaggaccctggctgaatcctggccaagaagagcagctgcaaatagggcagaggggccctggcccccacctgtttccactcagctccttctccatggagcgcaccatgcccagcctcacccagcctgcagccccagcatctcctcagagcactgtttcactctcccctgcccactggactagaggcagttcaagctggaggaaacttaagacactggctcatggaatactctcatcttacaggggaggaggctgtggtccagagagggcgagtgacttgtccaaagtcacacagtaaggcagaagcagacctaaggctagaacctaagtctcctgatgtttcctcaggggctgggctagccgttgccctttctcctagaagaagggttctatttgcacagcgtgttgctgggtcatgcctcttgtgcatcacctggacagtcccgagcctagatgggaagaggctggtgagaacaggaggccatccagatgtgttcactgcactcagatgatgcatctgcctttacaaggtgctttctcacagtccttctgccccatgaagcaggcaggacaggcattattcaccccattttacagaggaagaaactgatgctgaggaagttgactcggcccaggagtggcatggccaggacccaaatccagaaactgcttcaagtttcgttttctttcccattactccaagctaaacccagccggggccgcacactgattaccttttatcagctgcagaaaagcctctgctttggcaagttttataaaggactaaatctgtcaggaaagcataaagacagcgccctcatccatcttcttgacaactatttattagacttattattatgtaaatataaaagaggaggggaaaactacattaaaaatccaatcaagtggctgcctctctaagggggtgagaaggggtggattgcaggggaggtagagggaagcccaggcccctctgtccctctgtcccttgtggagacccatagggaggcccggctgaggggagaggaaagagtggggcgcaggccacaagaagcccgctcagagctggcaatggctgtgctgctggcttacacacctgccattgtcattccactccgataaacgaaaggttaagatacaattacaaagccaaatggtgcccttgattgcaacagtgggacagcagcttagcaggacccccaaggaggcccttcccaaggagactccctctggaggctccgtctggcccaagactccctctgtcatttcccccagtagacctttgcgaggtgaagcccggccagccatgccctgggcacagggtgagtcccagctgcccctcctgggcatgctgcctggaccctggggcctcccagcaggctgtgtgggggcatgtgcatgctgccctgtaatggatctgttcacgtgtcatctccctgtcaccctctattgccctgatgttggctcactggtctttgtgtgtctcccgcagtgcctagcacatacaaggaactcagtaaatgttcttttttgaacacgtgaatatattccctgggggtgattacactccaaggggagggaaatgaaaacaaatatgggcatttcagccattaccattaccggaggcccaggttgaaccaggcgatgcagtgagcatgaactccctgtcttcaccgccgctcagccttggcacacatggtgctgtgctgccaattgtctgcctgcttctgtcactcaaccatgagccccatgatgatggggcaggggcctcagtgccagagctgtgcccaacacatagtaggtcctcaacagatatttgaggaaggaaggaggtcaagtggtagaggggaggtggtgggactgtcttgaaccacacagccccacccacggacacactggacacctgtggagagcagaagtcagcgagaaggagtaaaggcagccccagggcacccctcctcctgcagggcagatgatttgttgagcagaatgccaccacttgcctctgatgcccttgttcgaggtacaccagcacaaccccaggtggcaacttcatgtggctcggcatgcacaggaggggtttcatggaagacaaattcacactggattagtatagaagtttggaatgcatggtgcagccttcaacgtcaagggcaaatcccatgggcccttctatggctatctcccactaacggagcactgccagtttcagacactgtactgagagatttacatctatggcctacccccattaaccctcacaacaatcccacgaagcaggcactgtcactgcccattccacagatgaatgcactgaggctcacgggggagcttggcagctgctctcactggcccaggacagccatttgtgtggaaatgatcgattcaggctttggccgggtctcagccttgccccttcatcactttctcagagccctgaagttccagggctcttgcctcagcttctgtgctcaaaagtccccagcagctgggttttctgccaaacaagaaccttgagtagggtcctgggctgtcatcagtgttgcagggtgatgtttactaagaacttgccttcctttggtgtctgatgcccacaccaattagggtcctctgaggtcttggtgcactggccctgcagcctgtctccatgctgtatgagtggtgcaaggagcatgggctttggcgtcagatggactgggctctggtcctggctccaccgtgtcacttactagccctgtgacctcagacaagctttagttcctcatctgagaaaaggggagaacactaccaacatcactaggtgttgtgagtattaagtgtgtacataatgatgtacagcactcgacccagtgcttggcacatagtaggtacttgataaatggtagctgttattggtaataaattatcagctcagctgttatatgtaagtgcaacaaagtgttatcaaggctgtggtgggcccatgctcagagtacagtggacacacaaagcaggaggtgactcataatgtcctgtgtgcatagggagggttgggggaaagagtttggggaaggccaggaaaggctccataattcctagtctgagttggtgttcaagtcgtgggcaaggggaaaggcattccattcagaaatggaacaaaacactgagccactgtttctcgtagaccatgtgctgagcaaagggctgagagcatagtcagtgctccatgtggcagttgttgagtagacaagatgggagcaatgttgtctgagtccttcatgccctccttggcactgggaagggcagccggcctttcttgatgaccattcaaagcctccagccccagggcctgccaggatcactcccaagtctccagacccccctggcttagtgcattcctgtttccttattttctaacctcattggactgagaataccacattctccttttaatactcccccagagacttgcagattattattaaatactgaaaagtgagaagtctgaaggttgtgttcctcttcaggtttgcagggggtttatccatatcttgccagagctggtcttagttcccacaccacatatgggggccccactgggtaggcaaggccaaggagatagctgttcaaccagtgaatctgccaatcaataacaaatgcataagaaagaactgcatggatcaggaactctattaggctctgcagatacaatggcagactcaggattagtccctttttttgctctcttttggttcctatttgcatggaatatctttttccatcctttcacttccagtctgagtatcctttaaggtgaagtgagtctcttgtaggctgcatagaggtgggtcttgtttttttttaagccattcagctactctatgccatttgattagagaatttaatctatttacattcaaagtaattattgatagactggtaccattttattaattgtttctgatggcaggactagtccctttctccacagaaggtaattaggctatattccaggttaggtaattttgcccaattcctgtgttctggataaccagtcattcatttattaatttactcaacatgtgaatgattaccatgtgccaggcaccattccaggtgctagggatataacagtgagtaaaacaaggttcttgccctcatggagcttacataaatggggcaatacataaacagaacatttccacagcactttaaaatgtataatgtactttctcaaacatctcaattaattttcactttagtgatgtgaaaattgtatttgtgttattcccatctcatagaggaagaagttcagacttggagaggttaaattacttgccctaaatcacacagctagtaattggtgagactaggactcaaaccccagttttcaacacatgagaccatgtgttcttgaagcaatcctctgtcaggtgaatggtcaatcaaaacagctaaaacaagaaggcattttcattgtgggggcttttcttcatctgtctggggcttccaagagggatgctgaggtttggaagaactccaggtattctcataatggctaaaaaataacctatatcggtagaccagctgtttaagaattgtcagagggacctgtgaaatcctgggctgggatgataattgttgttcgattagttttttgtttatttgcttgtattactgtgtttggctttctaacccttgtcttgggtacgatgacacttctccagtggggactatgtgtgtatatatgtgaggagggtcaggtaagcagtcagggggaagtgaggagggacaggttgtacaggcctcacctccgaggagccctgttcagccaccactcattccttccatgaatacctagtgagttcctagtgtaccctggggtacaaggatggccaaggaaagtcctatctgtgtgctttggggaggctgccccatcatgcccacagggcaaatgggccccaccatgcccctatcctgtgcgtggcctccctctctgctctgcctctacagaaagatctatttcaagccacggggctggtgctggccatgggctcccctgccagagatgagtgctgttcccatctgtaaatgactccagctcctggaaaagcagccacagacaagtgcttagcagcaaatagatcactccccacagagcctgtgattcacagggcagaaagccagcctcctgaggtggcgtagggaggcggcagccctgggaggtgccagggaggtgctcaggactctggcccacacttaaggatagaatttatctcttcccttccccacagcatagggctgttctgccttctactttctctttcttctttcttctgttctcccacttttttccccctgggttggagagagttcctatcccatctgcacaggtcacttccccagagaggcttaaaaaccctcggaccaattagctggaagcctgtggccagggtcttttccctctgctgcaagcagacctgctgctcccctctggggagctggcccagtctagccctcctcactgccaggagggctgggcaagatcctcttatcacagctgtgagcagacaaccatgcacagcaggagagggagggacagggaagtggggaagatgagggagggataggcgagaagggaagggcttctggaaggtgagagaaggaggagcagcaagcagcaggcagagaagagagggcaagtccaaacaaagaagaacacaaacaatagaagggctggctatcaagaagatcttttctttgggggccaatgccatattccagcatgggcaggaaaccacaacaagcctttctgagcctcactctgagtgtctaggcttgtgggaggtgtagaagcatgacacgcagcctttgtcccacaggggcttgcaactgggctgaagggctggtgtgagtatcacatgtgcaagtccaactaaatggaaataaaatgcttttgtctgggaatagaaagtaggatgatagttctgactgtgtcactcacagcaaagtgagcctgggcctttggtggatctccgggtgccttggtttctcttttgtaaagtggagataatacggtacgtcctgctgacctaatgtggctatcaggacactcaaaggagactgcaggtgaaaatgcacttcaaattctaaaaccccgcggaggtgcaggaaaaagagcaacctagggctggatgctggcactggggccactcagaagacagccagagagaacaggagagccagagaagagccctgcaggcaagagcctctcagttgggctgggaaaagtaaacggtcagatttagaagggtaaggaaaaggtgagggggtagagagggagaagacaaacactacaaaagggcaggaagcaggagtatacttgttttatttgtaggacaattaaaaaatgaattttctgtttttgtttcattgcatttctctctctcccccttccccctcccaccctcatatttttagttgattccttctgcctagaacaggctcctatctttgtacccttccggttgatgaactttcattaatatttcaggtttaacatgtgattccttccaagaagcttttcttgattcccaaggatgggtgttttctaaatatttttactgtgactcaaaaaagaaatatattttacatcacacacataaacacacacacacactcaacatatagaatgaaaacaaaagtttttgttttattttgttttgtttttgagacagagcctcactctgttgctcaggctggagtgcagtggcccgatctcagctcactgcaacctccacctcccgggttcgagcagttcttctgcctcagcctcccaagtagctgggattacaggtgcatgccaccatacctggctcatttttgtattttcagtagagacggggcttcaccacgttggccaggctggtctcaaactcctcacctcaggtgatccacctgcctcagcctcccgaagtgctgggattacaggcatgagccactgtgcctggccaaaagttttttaaacatttccccttatgagtgtgatgcattctgtgatatttctactctgctctatttaatttttttgaaaatactggtcgtgacccactaagttaattttgtgacctactaatgggctggtaacccactgtttgacaacaccaccttccgcctgtccttgtggtagcacttttgccctgccccggattggatcaagtgcaagactttatccccctcactccctgaggaccggcacctgaccgtgctctcccctcgatccagcccgcagcactgtgcctggtgcccagcaggtgctataaaaattgttgaatagattaattattgaatggaggcatgtcctgctggagcacaggaatgcaaaataagaatgggattgaatggagagggccttgaaaggcaggcagatgaaggaaatcttaagagagaatgggagggcaggagggcagaaatcctaggcaggaaaggaggagggcctggtcagggcaccgtctaaggaagagcccttccttaaggcctttgaagggagaggtgacaaggttttatggcagagagctgtgggtttgccagagagtaagcgacaaagaggaccccaagtttctggcctggaggcaggatgccctgtgatagatgttttgtccagtcattgcagcttagtaaagaaatagtgggctgcacattgtggcttatgcctgtaatcccagcactttgggaggccaagttggtgggatcacctgaggtcaggagttcgagactagcctggctaacatggtgaaaccctgtctctactaaaaatacaaaattagctgggcgtggtggtgcatgcctgtaatcccagctacttgggaggccgaggcaggagaaccgcttgaatctgagagatggaggttgcggtgagccaagatcacgccattgcactccagcctggcaaacaagagcaaaaaaaaaaaaaaaaaaaaaaaaaaaagacctatagtaacaacagcctgcatttattgagcacctactatgtacaggtactatgccagaacatttgcatacatctaatcactgctggtaagtggcccagacaggattcaaatcagatcagtgtgagtccatggtccatacactttctcctgcaccaccttgcccatacctcagttctggctgccccctcctgttcatcagtttttatggatgacacagtctaaaagttcccaatttctttagaattgggaactgcttataatcaggagagtagatatatgtatgagaggggttggatgggtggagtaaagatggcatctgcgttgaccaccttaagtatgggaacaactaagggatgaagagcagggcactcattcattcattcaacaaatacttactgagcaccttctatgtgccaagtactggccaacatgttaagatacaatagagaataaaacagttccctgcccttgtggagttcacattctacagtaaggagggacagacaataaccaaaaagatacaaaatcatgccaggaaggaataagcgctaagaagaagctgggttggagtttggctattttagatagagtagtctgggaagagatcatttgaggaggtgaaatttgaactgagacctagggagaagttccaaaggaacatccaaggtgatagtgtgggaagacggagaagcaacagcagagggtctaagaaaaatcatttaagagcagtccctacagaaagacagcagggatttggtaggagaagagaatgtttcagggtccaggaacagcatgaaagccaggaggcataaacatccccactgaagtcattgataaaatgctgccaagctatggctgcaatcagccagggcacatctgcatccaagcctgggatggtggaatcttctgggaatgtggtttggtccattaacaggacacagttactgtcaaaagtctctgggagtcagccttagggggtcgggagtcacattaggcaagagctgctttcagcctggactagggaaagccactcctgcagcctcttaggaggtggctgcttgctgcatgtctgggagttcttgctttcaaaagagtcttcgccccactccctacccaacccttgcagggcagggctgacctggaagcctcttccacacaggcacaccctccttctgcctcacactctcccatgtagggtctaggaaaatgaaaaggaaaccctgaagctggtgcaggggaattttggggcctggggcaactttgacagagtgattcattttgtcccagctcatgtgtcaccatcttgcaacagcacttgcagcttctggcagctcaatacgggtaagaagtttctggggcttggctgccatttccctgccttccttctcccctcacaaccgaggtagctggaaaaagagggaacatccctcttggcttctcccattcacacatctagagcaaggaggaagctcactccttcccagagggagatgccgaaggatggacttccccaggtcatgcttactgctaaatatgagagaacccaaaactcccatgcttgcctccttcttgacatacacaggcccagtgcttcccaaccactcccattaggcttgaaaagccagcaaggggagggaaagagacaaggggatggaggagggtgtctctggttccctcttctcagctcttcctcttgcagaagaccttcccccaagccaattctcaatcagataaaaaggaaaataatataaacaacattttattgagcacttactatattctgggcattattctaaatgctttatatgaacaatttcactaaatcctcacaaaatcagatgaggtaccattatccccagtgtacaagtgagggaaccagagcagagagaggagaaccgacctactaaatgtcacaaagctggcataactagatgctggacttcattaatctcagtttcagatgaggctgtacatgaatagctaccacattctccagtgaggtgcaaggccaccacacaggatcccagctgtccacccacccggtccatcaatgaggttggagagaaaaataaaaagcttgttggagattggaagaggacctctgaagagagttactggtgtgctgtgagtgcttctcctttcaggtcaagccaagagtgaggggcgttaagaaaacctctcagagagttttatatgggctctctgcatttgggagacacagaaaaccagtgttgattcatgctcgcatgatctaaagggaaggcgatgtgtcacaggcagcttggatggcttcacaggttacttgcacatttccaggcaaagtgtttcttgtgaacctggtttggactacgcctgggaaacggcctgcctagaagacaagcggagaacctgcccaactgagaagggagttgagtgctcactcagggagagggcgtcacatgcatccaaggagctgtgtaggcttcctcatgattatgtggggcaaagttctccaaagaactctgaaagtgtccctcaagggagaaggagccagctttacatatattccaggcccagagagcttgggagcaggtcatgacactgtcactcaagtgataacttccatgccctgctctcctctccctgcctgcctcagttccaacccagggacgctttggttagcaatctaggagaaggaggaggctcattgagggcgttttccctcctgctccagatcactctctaccctttcctagccccaaaccctgggaagccgacctctatggacatcatcagcaggctccctgccctccacagggaggcaccatgggctaacaagccaggatggggggtggggggaagtgtactctccgcccttccctgccaggtcactgtgggttgctgtgtcccgctcccaaagatggaaggcccctcagatggcccatagagctcccttctcttagttctagtaacttctccttccccttgcacctgcagactgtggaattttctgctctcccaaaccatgccaacacctttgtaaatagtccttttatgaacctcccctcaactgtccagtttttgtgagccatctgcttcctgttgggacccttaatgacatagaggaaagggacgaggagctaactgtgcccgctaccccaccccatttccatctgtggtaggcagagccaggggataggagacacccaactcttaagtgaagtttaaagttatgattattaaactgaacatacagaactgagaccatttgtgtcatctaaaagtgacctgaaaagtcatgggacttgacccagatttcatctggggtgcagaattgcctcaacccaataaacttgcagcaacagtgggagctgaaagtgaagttgctttctgattataccaaagagttgtgcttgttccattctcccaactgccagagtgggattctggctggcatctgcctctagggcccatggtgtcatcactctgctgtacaatttcttatcaggactagtcaacgtaggagtgaaaacctctttaacctccaatgtccattgcaaatggagacctagacttctcctccagcagccttcattcagaattccgtctttctcctctgggactctaacctaaatccatgattcggggcatttcctttggtttctctagggaggaaactggtctatgtttttgaaccaatgcacttatatacaatatgatttgtgacataggtcctcctcctcactcactgctaatgccctcagttttgccttttatgtcaacctagatggagctgtctgtcttattgttgtccttaggatccggccaagattttcacaaatgatttgaatacctttgagtttcccaactccaggcctttctttgcacatactctttcctctgcctctatttctctacttccttcatctcctgtagttatctttcaagtccaaccctatatccctgcccggaacagtggcctgtaatctcaccactttgggaggccaaggcacgagaatcgcttaagcctaggagttgaagagcagcctgggcaacatagcaagaccctgtctccagaaaataaaaaattaaaaaattagccaggtgtggtggcacatgcctgtattccctgctacttaggaggctggggcgagaggactgctagagcccaggaggttggggctgcagtgagccatgactgcatcattgcactccagcctgggcaacggagcaagaccctgtctcaaacaacaacaacagcaacaacaaaaaccatctgcttcaagaagcctctcatggtgtccctgggagggtaaatcatcccctcctctgtgcttctgctggatggggggccacatttctgtttttgtgtcacgctgcattgtaatgatctgtttacatgtgcgtctccctcgctgggccctcactaggcagtgaacagcttgacacaaggttcattagtgcttaatgattttcatatcttcaatgtctggtataaggcctgacacatgagggtccaataaaggttttttagaataaattatgaatgactcaatgaaagaatgaattcttttagtttttgaatcatatggatgaaacagccaacattgcgttcaacaccctacatgaccagcactgtgctaggcacgaagtggggtcaccttaagcatgaggacgccatttctgccttcgagaaacaaacaatctggctgaggaggcagagggaactaataagtagtagttgtagcggcagtaacagcaactagcacttatggagtgcttgccacatgccaggcacagttccaagtggttaccatgtgataaccgactcattttaatccttgtaatcaccctatgaggaatgtgtttttattacctttaatttacagatgaggaaactgaagcttaaagtgaggaaggggcatgcccagtcctaacaagcataggacagattgcagatactagaggagttaggagaggagggagttgattgtgagctggagtccttggagaccgctttgaggggaggctgcacttgagctgaactgtgaatccccctcactctcactttgcctccctgacccctgtgcatctggagccctggggagaccactgcatgttggatgactttgtgagggcatcaacgtcatcagtgctcccgccagtcgcctccccagttccggagcccgagggggcaagagcccatggcagcagctgattaatttccactgacaagaggttgcatcttcggcaagcatggtattaaatagctccttttgatcataattaagtttctctcaggctgatgctataaatagccatgccctattgattggagggtctgggctgtgagctcagcaccctccgggagcctctccaagccgggcctgggctctcgagtcccacttttctttttctgatgtgcggcattcctaatttcaagggcaggtgcagctgaacaccaggcttgagttcagctcattttcccagccctcccccacttccacagctccttccagggttggctcaagaagtacttggcttccccagagaaaagcaggcgcagacctcaagaagctggaacaccgtctctcctgggttgcttcaggacctgagtctttccctctctctgcaaatgaggacagtagccctatccctccctacagcacctggacacctccttattataccagtagggaaactgaggcccagacaagtgaagatcttgtttaaaggtctctggagaagaaactaactcacaactagggttgtccgtgcctctttctcttccttaacaaaagtggaaccaatcttgttttgctgtactcagcgctatgtttaagacagaacgagaagaagggcctggggcctgcaagacccagggtcacaataaggggaggaaaacatctcaaacaaaacacattaattatgatccctctgaccaacacatttttatactggtggaaaagcaccaggtagaacactctgtctcccctctagatgcctttcagagtcacttcccagaaagccacaagattctttctccaggagtgcttcccaactcccactaaggaggccccaacagccactaagcacacacacagtgctgctactcagtccagtctgtgatttcttggtaactggttctgtttcatccggccccacccgaggaacgtgatgggccgggaacaaagcggtgtggcagagaggaagggtcttcccttaagttgccaggcttcatatgatcccgcttctgctaccaacaagggatgcttctgggaatgcagcttaacctctatgccttagttttcctcatctgtcaaatgagtaggtgaaacaaaatgacctttaaggttcttttctgttccaagttccacaatgatataagtttaaaaaaaaaaagagagatatgtgttcacatatgccaggaagagagcatggaagagcccaggctctgttttcatcttaaagcacttgggctccaaaaggagggcatctgcagagggctggacctggtgtcaggctcctgccctctactctttatggcaaaccatggctgtgggccagatctgtcccatctcttgtttttatcaataaaattggaacacagccatgccccctcatttacctattgtctatggctgcttttgtgctacaacagcagtgttgaatagctgagaatatatgacccacaaaacccaaaatatcgattctctgtccctttacaaaataagtttgttaaactctgccagggcatgttggtggggtaaaaagaggggggaaagcactctccagttgaggtgaaacttggggagatcctgggcagagctgactttctattctccactgtcctgcaactcagggtgtagcaggaatcactagtacttttccaggagacatggataatgaccctgagccctagggaccctgcccagtgacctagcagcctggagacaggctgtccccaaaccacctggcatacatacacaccatggggtggagtaggacagagaggtattttcttttcatcctgagtgtgtgataataaggatcctaatccaactcatgtaaagagcatccaacctgaccaggctgttctcgtccccgctggggttccatggctaatctgctccagaaaagctcccccaaaccctgcaggaccctgagctgcagccaaggtaggagagagcctcaggtccattcgcagtgctcagaagcagagtcattccctgggaagagtaggaaaagttggtcactgacaaacaaagcagaatggaggccctgtgagcttcacttagttctctgatgtatgaccagagcagaggtgctgctagggaactagggagcaggaagcggctagaaacaggaaaattaagtagaatcgaaattggtgaaataaaacacatcgccatttaacctccactcttcgtgctccccatagcttcccaagtttctccaggattgtgctgcttcggccttggatttctggggatgcttttgttgctcccctttattctaccgctctggagctggcaggccccctctgtctggcatctgtcctggcagacaacactgcactatagccctttgatctccaccccacagtgtccagcatccacctgcagggttgtggagggttttcattgccttctcttcctcaacatgaagcctgaactgggttctgagggtggtggtgggggaacaaaatctctcgattagtttttacacagaggctgccggaggccatatgccatgttctccagctctgccattatgcatcttgcttgtaattgctttagaatgacactcatcatgttctattttatcacccaatgacagatccatataggagaagggaaacacactctcgcacacacactcacagagtcagccagactgcataacagttaggcagagtaattgttctgaaattccaagagctggactgtgtccacttgcttaaatagagaatgtgttgcatgcacagttactgcttctgtgtatcaaagggattcggtcggtggtggacagcctggcccatgcttccagaagtgctttcccatgttcactcgctccctctaaccccccataaaccctcagctttctttgctatagttactcaaggatggtttattttcaggatggagagacaactataaacacagaagtaaacagaggctattccccagtatttaaacattccacctcaagcactctgaggcaaacagtcctcccttcccacccctctgggtcttctgttacttcccttgccccaggaagctcgccccatccaccacttcctaccctcatcagggagggtctctctccttcctaaaggtcaccagggttggaagcttccaggggctcctgtgaactaaactgtagacgctttaacttggctcttggagtcttcctagggccagcgagggcagtaaggtctatattctcttcctgccccctgctggggatggcagtaaacccaagacaccagtagctgtgggcaatgaccagaagcaacttctgtgtccctgctaggtgctctgtgacacactgtaggtacatggtagaactctagtagtgagcctcttcctcagaggctggaggtgcaaaaaatagttcacagtgaaatggtctcacagcctgatatggtttggccgtgtccccacccaaatctcatcttgaattgtagttcccgtaatccccatatgttgtgagagcgacctggtggaaggtaattgaatcatgggggtggtctcccccatgctattctcatgatagtgagtaagttctcactagatatgatggttttacaaggggcttccccctttgctcagcactcactcttctctctcctgccgccatgtggaaaaaaagaaaaaaaaaaaagcgtttgcttccccttccaccatgattgtaagtttcctgaggcctccccagccattcagaactgtgagtcaattaaacctcttttcttgtcttgagtgtgtctttattagcagcatgagaacggactaatacacagccctttcccaccttggaccaaagccctccatacccaatgttgggatctgtctcctctacccaagctgacttcacagcagaccccatgtaaatgcttcagggcctgaccagctatctagggcttggaatctgggcccccagtaaatatcaaaaagccaaagatcctttcttctgaaggatgctgatcctcagctgcttgataaagccgtatttagcacattcctccaaacagagaaacagggtacaccaaggggtggggaactatatgagctaaagaccagccagggctggtaccccttcctcccttccccacagcagtggtcaggcacggacagttcccaagagtgcaagaggacctctccagctccctcccctagcccagaaagtggccaggtacaaaaaaactggaagatactggggaaaacttgggccagaggtggggtagggggagaaatcccatgttaaccatacaggctgagacagggagggaggcttgactgaagtgtaaacagtgtaaaccctcagctggggttgggggaacactttctctccaaccccttctctattaggatgggaatgagcttaagtcctcagggatgaggggagagaacagaacaagctgtttccagagtgcttcccaccagccctcatggttttaattcttcatcaggagaccgagggaggcctggggccatggcagttggggaggtgagtgagtgactggggaaccccatccaaatgccagctttccactctagggaagacctctcttggtggtgccttgccatgtccctgccagagccatgaggagagggcctagataggggtagcctcgactctgtgctcttgtcccggagaagagaggtacagcacaggggtgaagctctctctgtccagggacccgggctacagcccagcctagtttgctcctccctggcttagcagccaggggctggcggccaggattctggctggccacagaggggcctgtccacctgcactcatcacatatgcagtgtgtgtcctcagctgttcctcagaaagcaaatataggcgccagcgaggccattgtgctctgagcagctctgtcaccccatcagacccggctggcacaatgtttcctggtctttgttgaatatgtccaatttcctgaccaactcatccctgataaataattgtttcctcgttccctccaggcagttccaagctagggaagggtggaggctggtgtgatggggacggtccattcttttgtctctttggcatctgaaagccagggttgacctctgcttagtgcaggggagcacaggctcctctgccaagccccatatcctacttggcagctgccagcttttgccaagctccttccctccttgcctcccttcccatctactgtctgaatacctcctcttccctttccctgtgccgaaggtgtgcatcgtgggatgggagcaggatggggatccagtaggacactgacctagggaactgggtattttaagggaggccagagggggggcatttgaaggtttcatggcatgaagggaagagcatccaccaggaaatagagtgatctgggttccagtgatgtgaccacagttgctgcctggctaatactggggctatcgcctcagctttctcatgtctgagacaagggggctcaactacatccctcgaccccaagtgagtgatgcccacagagccaagccttcaggcggctacagtcccacttctgttctccctgcagcttctgccctgagtttctctggcccgagttgctggcacgccatctggtattcctgggtgagccaagagttatttaccagtaacagctctgttcatctggccattgccacccaagcatgagggcaggagagctcatccaagccccagtgatggctaagactgggcacgcacatgtgccaggccctggtctaggcacattataaacgtcattatttttaatcatcacagcaatcctcatttgccagaaaaagaaagtgaggttcacaggtgggtttctgtttgatcacattgtaagaaagtggcagagctgcagatggaacccaggtctgcctgcctttggaacacatgctcttattaacccacactctccaggaggggtcttctttgagagggtctgacctgcccgggcagcacagggcgctgctgagactgcaatcatgatcttaggaatgaacacgtctgtggcttcttcccctttggcccgggggagctgcagaaggcctagggataggaggaagttagtgcaccagagaagaaaatccattctctgtccattcactaccttccccaaccccaaccaaaacagtgacatcatgccattacatcccactcttagggacttagagcccctgcctttgcatgggcttcactacctccgtagaaacaacttggacttttgatcaggcgaaagcctatgtggatgccctgcctgtccagaccttctttgtatttcccactatgaaattcagtccacatggttcatggttaggaccctgaggctggttgtgaaaatggccaccaactcttttcatccctttgtatttataccactgcgcaatgtgatgttgctgcttctcctcttattgaaaggtagaatctgtttatctactcttttaatctgggtttggccatgcaacttcctttggccattgggacattaacaactgtgacacaagcagaggcttcaacagagcttgtgtatgagggcttggcctgtcgtgcagctcttgggaaccctgtgaccaccaccatttgaaggatctgggatagcccactggatgatgtgagacaacagccatgtcacctctctttgttgccccaggagatcttgagcaggccaccagatatgtgattgaggccatcctagaccacccatccccagctgggtctccaatgaccagggatatcagctaagccagaccagaccaagagaactgccgagacaactcaaccccccaccatacagaatcatgagatgtaataaatgtttatgatttaagccactagattttcaggggtagattgttatacagtaaaagctaactgattcagagccccacaaaggaattgaagaaggagctagaaaataggtcctaaggagaatattgtgaacctgagagagtcagctgaaggcagtggttaaggggatcctagagccagaatgcctcagggtgaaacccttctctgtcattcagtacttacgtgacccttgacaagttacttaatctctctgttcctcagttttctcacctgtaaagtggggatgatagtaatgcctacttgataagggttgctgtgaaatggaattaaacacagagcactgagaacatgacctggtccaccgtatgaggattttcctgtcattattaccctaacagacagtcctgccaaggtcccaattgtcaaagagtttttacatggaggaagggggctgactagcagatctctagttccagtgagggctgatgtgaggaagtgaactgagcctaccgtcatgagggacaaagtcagacctcaggagagacttcctgacagcaagcattgctagacacaaagaaggtaatagtggaccttatggctacatggccttctggggacagaaacgcctaggcaggctgcactgcctctccatcaccacaccagcatgcacacaaggacttcttttttgaagggcttcctgcctaagcaaaacctcagcttctctcagaatcatcttacggccttccttgaggcaccatctcaggattcagagggaattagtcctccccaagaaagaagaagagaagtcatcctttatcccaatccttaatcctacctactagtcagggtctctgaattgctttctgattgtaactctattgtgattcggcagaaggagggaaacaggcacttacatgccattatggctgcccaggctcccagccagggccaggcagggaggggaaaggggccaacagtcttcctgggccacaatactgggctctgggacttgactgtctgccctggcttgacacactgctctggtcaaagcagatttttcactgaggatggcccagctgggacgctgagagcagtaggtggggaggggtgactcctgggcaggctgaagcccgggatgctaaagtacagcctcccaacctgcgggctgcagtacacaggtgggtgagaaggagttacaggcatgcagactgatagagattccctccctcccccggcccccacagctcctgaggcagctggtggggtggggtgggggcagcagagccctggtcagtaacctcctgcctcaagcagcctagccagccccagaggaacaaggtcaaaagcacagccaggtgaccacaatgggaagcacagctctaagggaaaacaccagcacacttggagcaggaaaggcagcactaactcagaggggctcctcttgcagcagaatcaaagtttatatttttgaaattctaggtgttactaggaggtagacacaagaatagaatggagaacagaactatttcctttgcaaagttgggaaaaggagggggtattgtcctacccaccagggagggactaagcaatgacgagagagggatcctgtgagctggggcactgagggctgcttccctcacctttctccccatttcccgatgtgtgcaatctttaactctgccaatgagcctgtcatccagttcatctggttcattttctgtgcatagtgaccacacctggcaagctcttcatcaccctaaagggcctgaacacatggtcagcaggccaggaatgtttgttgagcggataaaggaaatgggcaacagcagattcgaaacagcatctgcagtcaaaagctttgctgcacccccccaaactgcccccaaacactcattttttttgtaaacaggactgcaagtccaaggactgttgaatctctctggctcaggaaagatcccccagcaattctctctggattctccaggcacagagttgctttctgagtaaaaggggtgtggaggttgggtcagaggctcatctaaggaccagaagatccagctctggatcagaatgctgcctctggtgtgagagaagggtcacctctgaagaggtaatcttccaagaatggagggactctagatggcaggaagagggcaggatcctaaagttccctaagtcaacaatggcccaggttaccctgagaactccctcctccctccccgaccccttatggccagcaaaaccacacacacacacacacacacacacacacacacacacacacacacacacacgccaggagcatggtgtcaggttctgagtctctcctccaacttccactttttgcccagagtacttgccctttccagctctccaaaccagctttctcatgtgatttacaccctcctataagttctagctcttctgtgatttctctaagtggaacagattgatgatccccttgcagcccctatctggataggaaatgtccccaaattacatatgccattccaaatttgggcacaccctccctcatatcatttcatgaaatatacaaaccttgcacttgactcctgcttgttttgaagttttatccttcagtatgtttgatccacacatgtgcaggcgcctctccctgtctgaagtgagccagcatgaccatgacaaggcagcaatggaccggtatatgtccactgagcccctctgtgtgccaggcactctgctgggagctgggttccaggacaattgccccggctttggggagcaagagctgccaatgcaagcagggcttgtttaggaggctttcagatggtggtgactgggacctccctacaagactcactcacctggctcaccccaccaagctggccttccttggcaccaccctgctgctggctccccagtccttatcccctctgcacactggaaggaaagtcaagaagatgctcacatcctggagacagcccacacgcttaccctctctccagccctctgtgatcatttaatggttggtttcattcaaataactcaaggtaatataagccatgctgcccacacggatgctaacagcaatatatagattcccttgcattttgcagggaactcatgtaataaaatactgggggtggagaaggaaagggccatttacagaccaacaggataataggggaagaaaaacaagttggtgatgggagtgggaatggaggaaaccagccactagtggaggtatcagtagggctggggtggtaggagacagaagaaggggtgagagctctgcttacccccataacccacccattcatgctgcaaacgtccttggctgtttatcctagagggcctggtgaggtccctgagtggtggctcactggggaagcctccacccaccgacggacttcactcttccagggctgggcctgggtcaccctaagtctgtgccaggacagatgtatcacaggtcctcttgacacagagtcccctaatgacttccctgatctgagttatacctgccttccagaactgtttcataacagaaccttccaggttctcaaagctcttgtctttctgaggtatagagaaagtagatttgagttcaacacaaagaggaggttggtgatcactgaatctctctaccagtggaatgaactgcatcaaaaagggtaaactcatggggcatggttgctcatgcctgtaatcccagcactttgggaggccaaggtgggcggaacacctgagatcaggagtttgagaccagcctggccaacatggagaaaccccatcactactaaaaatacaaaaaaatttagccatggtagcgcatgcctgtaatcccagctacttgggaggctgaggcaggagaatcgcttgagcccaggaggcagagattgcagtgagccgagatcacgccattgcacttcagcttgggagacaagagtgagattccgtctcaaaaaaaaaaaaacaaaaacaaaaaaaaaaacaaaacaaaaacggggtcggggggtaaactccccatccctggaaatactcaggcagacctgttgccctctgctggggagggtgctgaagacagcccagctccaaagggaatagcaaactagaccctaaatctaggatgtgtggggcttaagtgtccgtctgagctcatcctttaaaaagcctcttggtcccagggttaatgtcttatgcttttccctctcctggcccaacgagaggcatccagggagctgaattcacagttccctgctctctccaagcacggcacctcagccctgtgtgggcgaggctgttgaccttgatctgcgtcctgccagctcaccgtcaagtaccctgttcacgcaccctggaggagtctgcaggcagggcctcccaggcctctctgcagacttgcatttctgatggctgctttagtcaaggactctttaacttctgcttctttggaggagaagaaatgggaatagaaggaccccagtgcgctaccttcttaggggctggttctccagggtaaggattatccaggctactgggctaatgaccagtttactttggaaaagtgagagatttaagccttgtgcagctggctagtagatgagaattcattcaatccaaccccctcaccattcagaagaggatactgaggactagagagaggaagtgacctgccctaggtcacacagcttgccaaagctggccccacacccacatctcctgactcccaatccagtggtcttgccagggtcctacagagccccactctagccaaaggattcaggcaacctatgtgggccagctcaggcataaagcacttaactcagagcagggacacagcagcctctgctcctcggatgagaagctgaccttacatggaaatattcagaaagacacacacaatgcgtgggggtgagaaggagggaggtgggcataatgcttcataatctctctgtaagccctgcccaaactctgagcatgccagctgggctgcagaatttttttattaatccacacaacacacttttgcttgcttgagacaagcttctgctgcagtgaggaaagaaaggagagaagggggatttggctcagaaggcaggggcacgagtcctcaggtacaaaaatctcaggaactcaaagcaatttttgcaggcagaagagaaatgggccacagaagaagggaaaaaagaaaaaaaaatctagggtcacataagctgtattgatcttcatctatcttgtgcaaaaatggcatgaaaaagaatgaggccaacagctacaacgtcagaagagccagcagaggagaaagtgaggatcacaacttatgaagaaagatccatacctggtgactgggggttcctcaggaaggctgtgaggcaatgcctgtcctgttacacccaggggtgacatctccaggaggatcttcctcccctacccccggccccatctctgttatctcctggaaccagaagtgtctgcaggtcaatgccaggacctactgcagaggggcatatggcagacgggggaacctgtgctctgtcatgggcttctgacaggctcccccacctggtccccagaaatgtgggaactggcttccagctctctgctggctgggctgtgatctctctagtggactaggaggggatcggctgaaaggctgagtgatacccaaagccactgtggagtgggtagggacgtcaccaactcccagtccaggacactagcaacaaggctccctggaaccagaatctctcaagagcaggagacggcatgagattttaaaagttattataaaagatatttacatagtatgcatatttaccctctcaggcttttttttttctttggaggggcaaaaacacgaagtttataatacatgaaagtttcccatttccttcttttttgttttccttccctttcgccagtatgtgcttcccctgctggtgaaccactgcctgcctgccacgggtgtccatatccctgttggccacacgagcctccatgcccaccctcgtgtgcctactgaccttgtctcccttgactctgaccttccctttgtccattcttcgtccattctgtgtccacccttcaccctcagaacctgtgccaacagagcccaagagtctttggtcctggtgtggtaggacattgggggcacatgtattttcctctcctatgctcaagtcagaggttgtggaaggagatttctccaccttccagggaaggcatttcaggctcccaaatgcctccagtggcaatcccagtggaaaatgataggcaagagcagacactggtcagctcactgccagtctgaatcccaaattctccactgatcagtggtaagctctgagcaggcttcctcagctacaaaacacagataatagtaatactgctctcatatggttattgggagagcaaaatacgtaaaaataattaataacattataaagactcaatagtattagctgttattattgctgtcattgttgttgttagggataatgacagtcatctcacatgtcagggtgaacctatttctactcattcaatcttcagtggagtggcaaacagctgtttctccaccttctggctaacaaccctaaagagactcaaacacagctattaaatcgtcatctctgttgtggggcagcctctctccatctcaaaaccaactgcggatgacactttcctggggggatgctggatggctgcccctgtgcactctcctgctgtgaccccttggctcactccacatgcaagctaatggccttcactgtctctcctcttaccagctttctctctttttttcatagcttttattccaatctttccttctctctctctctttttttttttggagatggagtttcactcttgtcgcccaggctggaatgcaatggcgcgatctcagctctctgcaacctctgcctcccaggttcaagagattctcctgcctcagcctgctgagtagctgggattacaggcgcctgtcaccactccaagctaatttttgtatttttagtagagacagggttttaccatgtcagccaggatggtctcgaatttctgacctcagttgatccactcacctcagcctcccaatccttctcattttaaacattcatttgttgatcatgtgttgctcttactaaaaggtctacttcagataatttgcctgttctgttcacagatacgtctttggcctccagcatgatgcctgttgcatggcagacccacaacatttgttgaataaacaatcaaatgaattaatgtatttaatttttccaccaaaatgatcttttaagggccagctgaaatgccacctcctccaagaagccttccctgatccttgcctcctccatcttctcctcacactttcctgtccttgactcacgcctctgacattgttgagcccagaaatgtatagccctgtgaacacaggcatttctcttactggactaaagctcctaatgaagccagtggactctaatgaagtcaaaggacctcagtctaaacccagtaatgctactaccatgtgggagcttgggcacaatgttttaatcttctcataatcttctcatatgtagaatgggaacctaacatccacctcgagggatttagtccccacctctttctctctttgcagcccctcatatcaactaggactgggtcatcttcatagtgtcagctccatgcatgtttgctgaattagtgaaccatcacttcccctagtttcttaccaagggcccaagacagatgtctcctagagggggcaggtcacaggatgctcccagtgataccagcgggtgcatctgacatttttctccaagggaaaggaaggagtaaatgagagaagtggtgtcttaagtgtctggaagttctgccaagagcttggcactgcaagaaccaggacagtgtcacccacgaaggtagtaccactctgaagtagcatcacccttggacaaggagaaatggtccttggtctgtggccatttagaccccatgtgccatccacatgccaatgtaagggtccctttattattattattattttagcaaagctcataaattctgctttcttgggtgggtactgtttgtttaataatcattgcaggaggcaaaaaaaaaaaaaaaaacaccacaaaacaaacaaacaaacaaaaacccttgttttactcagaaacccagtgtgaccttttggcttcagcagaaacacagtataaaagggaatttccacaggtgaagatgagagactgaatccaagcttcagcaaagctgttcatagacagcaccaaagttcctactgggggcaggtgccagagaagtagggcacaaggcaggaaatgctccccatgccctcttctcttccctcccttcatctttccctggccaatctcatctattttttctgcttcagctgatgattttggaaacggcctgtttatcctttctccctgctaagctccagacccatctttccacctgtctgccaaacacctcaaggacacccagggttaactgcaaacactacaggtccaaagctaagctcactggctctgtcttccctcttgacctcctgacaacctgttccttctctaaggaactccaacctccatacctctactcatgccaactccacacctctactcatccagtcttataattccagagttcttttgacttctcttccggggtgtcattccattccagtcctttctcttctgtttcattgcaactgtcttagtcaagccttctttatctcttacctggcttaatcttctggctgactttcctgtgtccaagggttcccttccacattcatccagaagacagctgccaaataaatcttcctgatcaatacacactggactacctttagtggttccctaatgcctatcaaatgaattccttagcctaatattttaggctctctgcatctctgtcaaatattttgttactgcttatctctagctattttcctatttgtatatcttttttttttttttttttttttgagacggagtctcgctctgttgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagcccccgcgcccggcccctatttgtatatcttaaacactagcaaaccagcatattagttaagcttcccaaacatcaagcccttttgcaatttattaggatttcccatttccacatatcaaaatcctattcaccattgttggtctagctaaaatctctttaccatgaagccaatcgttcattcatcaacaaatgtttattaagcatttattctgtactcctgatcttttcagcacatgccccattctctcttgtacactctcatggacatactccaattccccactatattgacaacttcttagggacaagcctcatgttttctttatttctctatcccccaaaatgcctactaatatgccttgcaaattcaactggatgttgaataatgtttgttgaattgaatcaagatttgtgctgtccatggttttgatatcatttagtttaattctcttagttttcttttctgcttaagtatgcgtgtccaggaagaagtaaaaataaactaatgatactcctcagcagctataagcctgtaattatggttaactcttggttatccatgccactgggaaaatagcactggaaaaattcccacatcaagaatcataaaaacattatttccatcagtctttgacatgcattgtttagtttttaagcagctgatttgcctttttaattgtttggctgatcagttaatatttgcatttacagtctttcaataactggctgggaaatagagatggaaggaaagatggaggactatgccactgggagaaatccagttcagagtgaaacatttactttgtacaacctcgaaggcaaggctctggacagctggaacatcataggcacttggagtgtgtcagcaaggccccatggtttggccatttcttttggatgactgcaaagggtagagatttcccagtctcctaaacagcccactctggtgtccagaatttgttttcatataaagaagataacaaagttctactgggactgataaggttctgggatggagggagggctatgtttccagtcctgttgggatcggaagttgctggctgtgccactggaaaccactgggtgcaaatcaaagaaaatgtggtttgcaattttgcagtgatagctagataatgtaggggggaagttccccttttccacttctgaagcaaacaaatatcacatgtggtagattcggcagctgcattagttggagaaaattgatgcacatttcttgtgtcagggagctgaatcccaaagaatggagccagcctcccagaaaatggtttctttatatagtttcatccatttattgtttgattggactttctgtatattaaattcaagctgttctgccactcatgggtattatgatgcgttggctcagtgggaaataatgagggtgataggatcttacagcatcacattacaaaggaggcgtccccagcctcatccatctctccatcaactagcttgtgtatgaggtggcacttatattaaaatgatttttctgattcagtttaatgacactcattcgagtcctgacacccagaataagattacatgagctaaatgcaatcttcctccatccagtcatggtcagcaaaggctcagctatcttccctctccagtccccatcttcccatacacccatcatttgcattgagctagttggagggaggtaagagtggggaaaagatgcctgtgttctggccggagaaaagcaggctggacagaggctggagtctgaacttgttctggaggttgtggcagctgagccttctggcaaaaaactttggatacccaaaagcattgtgggaactccttcctgcttgtcactagaagttggtttgaggtcaatactgtgcacttcttccaaataaatttctgggggtctggtccctgtttcccagattaaaaaaaaaaaaaacttggacatcactagaggatgaacacttaaggtatgagtatttggtagagtatcagcttcctggaagtggttggttgtgtgcagagccacctgcctgaggatagcgggtgggaggtgaggagactcagagctaaaagtctctgctcctctccctgatgggaaagagctcccagctacaatggagcatggacaagagccctgcaatggcctgggacaggagctccctcctgggtgggagaaacaaaaatactcaagtaattactgaggggcatttccctcctcctgaagatggaaatgctgccttttatttatactatcttgaggcagaataattgctgctcctcaggaggaatcccggttgtgtttaatgggtgtgtttaaagagggaaacccaaacaaaaccaaacagagagatacagagagagattgggattgattttgagggattccagaaaagatctgtgaaatgggcaccagcctagaaatccctttccaaaaattgcagcaatttgaattgctgaatcagaagacaaattcaaagtgatgctcccggtgtgaagcacccaaaaggctcaaatcctatggtgtgaattaatctttcccttctctgcagcctgaagccctctggcttcctctgctgcagctatcatagctgctgagttttagagtggcctctctgttttcgtgtctgtgtcaacactgtcctcctcatggcagggataactgtgcccagccacttgccaggtgctcagtaaatgttgcccgggttgaaaggaaagttccacccagatacagatgctgcctgcttactgtcagcatcaggcctactctgagatgctgatgctacaactcaggtgctctggctggtttgttacattctgaggtctcggctgcccctggccttgaagccatcctgcgaggccttgaggtttcttcttgtgaaatgcttctcccaggggtagagaagatcttcaggactgtgtcttctgagccagtcccctgttgtgggagctggtgaagcttggtgggagcaggaccaacaagcacttcctgagaaagcttcctggtgcctctacattcaaatacacgcagaattgcttacttctcccatctccactgccaccaccctcagtcccagccaccttgatttcttgcctggattattgtgttagcttctctcttacaaggtatttactatctggcagccagagcaatcctttaaaaatgcaagtcagtggctcaaaaccctccagtgacttcccatgccaagcagagcaaagaaaaagtccttgtggtggtcatgaggaccctacatgagctgcttcccctgttacctctctggcctcatctcctggtactctcctgtctcctgctcttgcagcttgaccatttggaccttcttactttttcaagaacagcacaccaaggtccctcctgcctgttggactttgcctgttggactttgcatctgctattccctctgcctggaatgctgctccccaggctatcctcattccttcaggtctctgctcgaatatctgagaggcccttcttgacatcctaacatgaaatagaaactatcccttgctctgcccaggcccccacactcagcactccatacttgtcatatccggctttaattttctctgcaacctgataaaatgtatttatttatttgctgttgggtgctgtccactagaatgtaacctccacaagatcagagactattttcttctctgctgtattcccagtgtctagtaggtactcaataaacatttgttgagtaaataactgaatggagaaaaacatcatgggtagaggggcttacctatggctccccttctcctcctccctggctccagagtctgcaggaaaaagcgtagccaagtagccaagagttggaggcaaacttcccttgcaagaaagccccaaccctcctaagcctaaaatcagaaccacagaatgccctgcctggcctccctatctccactctgtccacaaatatcatgtctgccatgactatatagctaacattttgatagcacattcatcggttctcatatcgccagaagatggttatcaaatgagaaaactaaagctgtgtaaacaaacgaacctgtttgagtgaacaaatacttattgagacacactatatatcaagctctgtgtaaggcatgaatcatgcatgatctctggaacagagagctcacatcctggcggaaagacacataaacagctgaagttaacaaaatgtgtcaatgacaaaacagagtaatgaaagggctacaagaggaggcaagagaagtgtacccagctcctggaggtgacgtggggctgagtttgaaggatgatgtgtatcagccagacacagaagcagagtgaagggtagtctctggagcaccagaaagagtgctcaagttcaaaggaagacaactgggtctcattcaattcatgttgcctgttccttacattggctgatgtgcaatcatagtgcctgtgtattctcagaggctgccatgctgcctggagtgtaggaagcactcaataagtgttgaacgaatgaaagattccttgttgagatgcagttctgcaccctctcttaagaatttcagcaccagagaactgtcaacaaagaaatgtcaacagagaaatgtcaacaaagaaaaggctttgaggtcgtttgttcccaataggtgtcctaagatccaagtcccctaggcaggggcccacccccaagtaggtggacactattagccagtgtcctggggccaaggtgcttgggcattgagaggagcactgatgggctccggaggcagtagataaaggtgcagataaaatttcaggtatttaagggttaacaaaagcagatctcagactggctccacttctggcactgtggggaggcttatcaagtaccccattctgtggtgtgcctgtattgatctcccaggcttagtctcctcgcctcttcgaacctcaggcaggccccttccaggattatgttttaaagtgaaatgcaaatcacctggaggcggcttcctgcttggaagaagtaaaaatcaattccgttttcattaaagtgatttttggacactgtcaaacgctctctcatctcagagcatggggtgacagataggctgccggtctcaattacataactgagacaaccagtagcagtgagccatctcatcgggatcggacactgctctgaacccttccctaggatacccaagagcagcctcatcaaaaccaggcctgggactggcctcccatggtccttgcggatgctcgcttgcaaggctttactctcacatgctctcctctttcccagtccctcctgagcttcccccatggactgtccgggacaatcatgatgccaaacaaagtcaaatgaagttaagaagggaaatctgctttgagagagtttacatcatataatacattctcaaagtagttaggttggtcttatttaatattgggagttctatgttatcccttccctctgttaactgagataattgaggatttattttatttatagcatcaattatgaggatggaaattaaacctcaaatggagcatttgggaactcagctgtcagggggctcaagggaaacctgggcaaagcataaagggtcttccccagtagtgcaggaggctgcatagaaaagccatcctcaagccctgacagcagctgggctgttattgttcttgtgtgcttaaggtattctgagatattaactaaacggtaataattggttccaggagatccctccctggaggacacctgagtaactcatcaacgaggtgctgggaaagcaggcagagagggcaaccagagcaggaagagtgaatgcctttactccacgtatcagctctctgtgcatcagtcggccctgctctgcagaagagctggagacattcccgctccagactggaaataggaactcagggaaggaccagggaagggagtgtctggagaaaggaagaggtagatatctgctgtgagctgttagaagcaactgaatgatggcaagatattggtccttggtattccatggccacttggactcaaatgccagtgtaaaggaaaaaatgggctttctggaatggttgaacaaggctacaactaaccatgaatgtggtcaggacagaaactagccatggaagagggaaaagtttccaaggtcacgtcagtgaaacctccagtaaagacaagaagatctccacagtactgcagggcagcccagggaatagatcatacaccaagtaaaggctgctcacctccctcctgggggaccagggctggggcagaatacacatatctgagggggctgcaggctgtgcaggctgaaatcttaggtctaccttctagagaggacaagtaggtctagaagggactgagaatagtatcaggtcaagcaaatggaagaggcactccattcacactggctcatccactaaaaagcattttgccaagtgcttgctatgtataatcaagcaacgagcctggtaatggtgtcaactgccaactcaggtcaaagtcaaagtagcctgacccagcaatgacctacactagctaggaaagagggaaagaaaaaggttgctttctcattacttatctgagtttaaggaagacactactaaaggtttcctttcttgcccatttggttctcctcccagaagctagacatttaaatgcatggggaaggtaaaacaaacttgttcattgtcagatgtggggtgagggaacccaccaggtccacgttcagggaaagcatgcttctccctagtgcaggcacctttcctttcaccctccagcagaatctatcagttccctcccaagaaagtaaaaatgagaccaagatactccactttgatgctggacttgccccttaatctacagggtgaatgacaaaagaagtcagcggtttccccagagcattaaaacatggattaatcaccattaacttctaagtcagtatttaaactgctcagaaggaaatgttttatttttaaaatctctgtgtgtctggtacagtgcctggcatatagtactcattgggctgatgctttcttgactggcaatatgactagaagagaatatcacaccctgaggccataataaaaaagtaataaccctgaaggtctgatttctacctaggggccctgatggcatgggaatgagtagtagggtgaaaggagaaagggcattggagcagccagattggtatttgaaaattagttctgctccttatcagctacgtgactatggaagtttatatagtctctctgagcctcagcttctgcatctttatagggtacagaattttttccaaccttgcagggctgttgtaaaaacttaaagagataatatatgcaaagttcttagtacactgctgacatatagtagacaatcatatgctgttatactactaataaaaagtaatgagtaggtggctatcaccatgcctgttttcctccacatggctatcctgaaggatctctctgatgtcatgagtcccatcaaggggcatctgagggcactgggcagtcagagccacatcaggagcttgactagaagtggaagtgaggtgtctggccatgggtgaggtccccttcaggaaggtgaagggatggctagggtcagcctaaaagggataaagacgacctcttgacagcacaagctctccagtccattttatctccaaaataccccactgtgccaaaaagcccacatctgccacctgagccaagagaaacaaggtcaaatgaccaaacattcttacccactctgggtgagcagccatttgaagagtgtgtgtgtgtgtgtgtgtgtgtgtgtgtgtgtgggttggagtgggaggaaggggcagggtggttctgtcagacagataagaagtaaagggaatgccccaatcaaatgtggccttcacaaatggatggtgacacccttgctcttccccttgctactccctccctcttgtgtgtggcagaatgacaaatgtaatcattttaaaaggtctcgtcacctgctcagtcattcccaataagcatacgcagcactatggaaaaaccaacactattgcctctgggttttggccaggaaaaaaaaaaatcaaatcaccaggacaccaccaaccacactgtcaaagacaaaataaaaagcttcatgaattctccatcagcaatataacgcttcctagcctaagcaaatatagacccagtatatgaattgtggagggattttgcattaggctccatggtttctaatagctgaggcagaaacccctaagaaatctatgtttccataaagccacctttattggctataatcctgctagggtgaagactgtaatctccttcctgagcccccttcctctgatggaaagcttcacatcccagcatcatgaatacatttctgtgacctcagctggagaggagacctcggagagacggaattaccatgacctcaccgagcacctgtccctccttctgatgatattgctgcttctgtgtctgaccacatgatccattcagaccatctcacagtcacccaggtcattcaatcactgactcagactaaaaagcaagactgatactgctttagaaagaaagaataaaccacgtgccttactgcgaaaaatccaggttcagagtcacttagagaaagtctgctcagagctactgaacgcttgagtgtctgtggcagcacaggagaaaagcataacaaatgggaaaatggcctgcaaaatatactacaaagaaaaaatgcagaaaggatccaaaaagagtgctcttggtgtcttctggtaatggacatctgaaccctccgaacttctcaacagtctcctccctccccaacaactgccctgaccttctccccacgctgccccatatgcgcaaatgcatatacaaatgcagacatcacctcaccccgagacttcacacgcacacaaggcatggctgaaaaaagaattggtgacttaattttcttagctctataaaacacatgccccgacctcaaaaagaaaactcaattcccagcaagctaccacccccaaacagatgactcatgggctttacccttcggatagagcaacttcccctgcccccaacacttgggtaagggactccctcctcctctacccatggtgacaccatccaaggtttcagaggtcatccagctgccctccaacctccgtcctggtttcatccaccagcgctgacttaccccagtgtggtcatggtgacaatggtgtaccaaaacgaggcagggatgcttgtgaacttgctggccgaggagcccttctcggcataaaacatcacagtggcaaagatgatgatggccatggtgagggagaagagaagaaagcccagttcggaggcacagctcttcagtgtgtagcccaggatccgcaggccctgggagtggcgggaaaacttgaagatcctgaagacgcggaagacccggagcgtgacgaaggcgccggacacgtcctcgttgttggtcatgaccagaccgatgtagtagggcatgatggccaccacgtcgatgatgctcatgacgctgcggatgaagcggtagcggctgggagccgcgaagagccgcaggaggtactccacggtgaagatcatgacgcacgccgtgtccaggcagaagaaggccaccgagtagcgctccccgcacggcagctccttgctgcccgggaccgtgccgcacggcaccgtctccaccacgttggtgatgaccgagacagcgatgaagaagccagtcacgtagtagaagaccagggccagcgtgctggtgtgggggttctcgaaggcccgccacatggtctggcggaagctgagcgagggcatggactcctggttgttctccgagtcgttgtcgtccatgagccgctcggcgttctccctcttgcggtccttgtactcctcgtagcagcagtccccgatgatctccgggaggatgccgtagaaggccagctcgtcgtcgtaggcagagatgcactcgtagcgcgggtagtgcagcttccccgtgcggtagaagttgagcacgcagcggaacacctcggggtcccggtcgaagaagtactccttggtgtcctcgttgaagaagaactccttctccgtgctgcccagcagggtgtccgggtagcgctccagcgtggtcctccaggtctggaacctccgcccactcacgttgaggacaatcagctcatcctgccgcttgttcttgtcggccggggccaggggcatggggcagttggccaccggcatccacccgatggccgcagcccgggcaaaaggcagccaggccgcaactccggccgccatggtgactccagctcttgggccggcagccgcgcggacgctaggcacaccagcttggagttagttcagcaaaccctgggagacaggaggggagagagagaagcggtgagtccatatcgactggcaggtaagaaatgggacacaggaaaggatcactggtgagtgaaacggccaaagtctccagggcagattaataaaactgaaatccccaccacagagaggggacttgattctttgccatccagacactgggagaacacctagctcctggagctcggcagggtgggatcgccagatgttgctgactgcctgacaaatcgtcaagctccaagagggctcaagagcatttggagggaaggcctctttagcaggaagatctggcaagacgtgggtaataatcagctctgaaaggttatggcgttattaccaatttaaattgggagagggtagatgagttctcattaaatgaatttaaaagtgggataaacatgctaatttttatttcactctttcacccactggggtaatcaggaacggggtgtagatgagtgagatcaggtaaacaattctttctactcctccctagtgaggaagaggctggggctgcccaagtccagaaaattctctgagatggcaggtgaccaccaggattggtgaggttctgtccccaactcccatggagaaggctctccctggcaaagtgctactctgagggacacttagcccctactccttgccctagcaacctagtatcaaatttttcccctcagaccctcagagccatgatggaaagacgtgggaagggttgtgaggctgggcagggtctctttccctgctctgtgaagggcgtcttggcttcttggttcacctgacttccatgcatcgtctctctccctccccagaagaagccgatccgcgctcactgccgtccctagattcctctcctcccatctccatctgcccaccatccataactccctcaggttatataacaacactccttcccataccagcctctctcacctggtccccactccaccctcagagatttttccagagccaggctaccctgtcccttcacctctctaaaccacactgcataagcacttccccattacctgtgtggacagagggagcaatggcacggagaattatatttggctttgggaagcagatttaccttcccaaatctggctttttaaagatgatagtgaaatcactctgcagtccccaaatgtataccatctgtgggaaggcatgtggtgacacggaaacacacgtaacagaaattggaaattgtttggggttgacacactcatctccactaatcctaaactgatcacacagaacaaatcctaacttggaattatttgggccctctggaattcagctgctgtgattctaagtttaaataaacgaggaagaggtgagtcttggaaaattttttctgttacacgaagacttgtaatgggagtcgatcttcatctctccctataaacctgcttcaccttctcctgactcccaactctttgagttttttcagatctctacctccctcaaactcctgagctgccactggacttttctgctcagatgcctctgaagtggacaggtttaaacagaacctgcctccttgtaaaaagctgctgttcgccttttcttcatgacgtccctaactgcagggctgtcaccttgaccatttttctctaaagagttgccaaataataggcaatagttcttactgccctcatgaaggcccaaactccctctggcctccttcccacgggccttcttgtctctcactctcacaccccacccggtttctcctattcccctgaaatccattctgctcagtgttatctccctaaagcaaggttctgattgtattttaccccacgacctacaaaataaagtccaaactccttggcctggcattccagaattcccacaaatagatcctagcttcatactccagcccaatggcccaggcacccatcctagtatccagcaataagaccaagacctgttcatggacagaccctggggaggtctgcctctggaccactcctccctctcatgagaatatccttcccctggacccctcctattagaatcctacctattcatcactctctctgtgatgcttcctcctctcctcactatgagattctcttcttcctttgggctcttgactcgttgtttgcccctcttccctagcacctatcaccccgcagctaggattacacacactttatatacatcttaattaatagtaatgactaacaattgagcacttacgctatgcaaggcattacactgtctcccatggattatctcatttaaccctcacagcaaccctaggaagaagagtctgttgtgtcccccatttcatagataaggaaagctaaagcttactgagacatagcagtctgacaaccccaaagtggcagaatagggattccatctcaggcagtctgctgagggctgatggtgtgccaggcacagtaccacacacttacatggagcgtctcaagagatcccaccgacaaccctgaggggtagacaccactgtaggccatgttttgcccacaaaagaaagatgaagcataaggagttgtaataattgtctaaaggatgtaataagtaggcggcgccattaaacccaggcagtctcaatgtggagttcaagagtacagccagaccacttcccaactttccctatcccacactaagctctttcgggcaaaggccgagatgcctccacttttgtatcacaacccaggaggcagcatagtgaactgcatcagtaggtgctcgagctgggacccctggttttatatgtgccattttttttcccatcaactttactctatgccttgctaatatatttcaggggttgccaagggtgagcgttctttctccagagtaaaatctgaagacagatctgaatcagaagaatccaattcaagtatctgcctctgactcactcagtcgagttttctaaagaagccaatctctgcctcagtttccccatctgcatgctaaaggaaattgtcacaggtcccttctctccctaataaagggaggttgagtcagatgctgcagaagacaataggaatgacaatgacatttcccgtaagcgtcactgctcagagaacagaaaaacagcacaggcctgatgagctgattactggaactgaggaactgaggaactgaggaaagaatggaggtcgttcatgcatggcagtgggtaatccacatgctactgatagaagagtcaggaacacatcctgcattgtatttctttctagaagaaatttacccttctaactatactttgtttaggattaggagacttagtagttcctcagcatgcacttagctaggatttatttctaaggggcaagggatgtttgagaagcaagctcacaagttcaactctgttccaattcagagttggttaacatttattgaacactgacaatgctctggacactgtctgagacacttttacacacaacatttaatttattcccactaaaatcctatgataaaggcttttctgcccaaaggttacaggtaaggagaaggaagctcagaagtctctttcaaagtggctaagttctgtgtatatgggagctgacaattttcaaacagaccattgatcacctcactgccaaatggctttcctgatctaggtgttgcccaatactgatgttcccaagagaagacagcaagatgcagagattcctttccctgtcttccccaggcagcaatgagcaagggctcatgaggccttgcaattccagtttcagtcccatcctcaatttgtgaaagcaagccatgatcaccctctgggcctcagagtcttcctctgtaaaatgagaagaattggacaggaacatgacaaaagaccctttggctcaaatgatccctgattccactggatccaggacatcaagtctatagcttaggtctcattgagacctcttaatgacaatcacccatgcaaagaaggaagtagagcatctgggcttactgctgtgaggatggagttagcctgagcctcaaggtagcaaagggagctctgggaattcctgctgaggctggtgctcagcacagggcacacaacctgtgtcacttggaaaccaggggcaatccaaggcctagttcacccacagaacccctggccaccttcctagagagtaaaggagaccaagctcccagactctgagccctggatctttgacccttaatatcctgttttatcccagaataaagctcagagaggcagaatcttgagggggttcaagaggcaaaaagtaagagatcactgaatcagaggcaccctgtggaaccctgtgtggccagacacacagttctgccccctgaaagggtgatgcccttcccctttcattctcctagtcctgctctaccctgattcccaagctttaatgccaggtacctgcccctgccaagctgagtcccatcaccttctcctctctaccctaagccaatctccaaggaccaccagtcctttacaaactgctttcagatgaataattgagagctcaggggaaggaaaaattaacccctccctatcttgggaccataaaagcttctggtcccacagccaaatgtttaccccatgcgtgaatccagggcaatcttcctaaagaaggccaagcaagcaccaggctgtctccagaggctcagcccctgtccccctggtaaaacataccaaaaaaggagcaattaccccattgttactttctctgtgtgtgggggttgggaggtgaaaggggaggacaagtgtcccaccagataccatatccaaggccacactggccatacccaccccacaacactgcaggaatgacccactcaagtaggccttctccacagctcatacagcagcattcaccccctgacaggagccaacaccttccggagctggcctgggtatgaattcctgcaacaggcacaacagtgcggccccatttccagccaatggcactgcacatgcctcaaatgccaaggttttactaggacgtggacgccttacaaatgaaaaatctgaagctatttttgtttttggcagaagagtttgacagtgggaaagatagggggtggggggaggctggaaaagaggcattcaaaacaggtaagctctgaaatgaaaaaggtgacaaatcctggcaaaggaaaacattttcccctgctgtaaaaagtcagttactccattaaacagcttctattttggaggtaaaaggccaaaagggggtggagtgaccagacagcttgtcctggggtttgacacctagctgagtacaggcataaggcagcaaaaaaagtcatgtcaccaaggtctgtccttcaatgacctcagtggagagcctctggaaacttactttccacaatctcacatcacatcccctagctcagaatggggctggtctgggggcagaggaaggtgcccatgacccggagggcttctcctgtgttcacaggattttggtaggcaaagcatgaaactgacaaggtgaaccaagctggggatccttgggggacaggcttgggacacacgcacagatcctcttctccaacggtgccactcctaggctagccagggcactttcctgaactctttttctccagcctcctcaagagcaaaagggaacaagctactaacctctttctctggggggtcccttgtatacttgcattttgttgcattcaagtagagacgaggaaaaaataaacacatcagttcccttcctgtgtgccaacaggtccacatggggaaatgtacacatgctttgtattgaattcgtggacacccaggagccctttctacagacagtaaacatacaggctccctcgaagtaaggtaaacaaggcatacatttgaccatcacgtacattcatgcaaaatacagcaacgcatgcctggtcttacaaacagatcgcattgtgcctaggaccccgagaaagttcagacgctctctcttaagaaatacggaccctttttcttgcagtgcgatttcaggtctggaacctcagcctgttgctgacatatcagggctgcccgggataaaagcagaacatctcggatcctattcaaatgtcaacactaagcaagcgcaggaatttagttgagtccaggtaactttgcccagtcccttcccgtcccccacctccagtgtaaacacctcgcagagtgagtctttcgatccctctccccggggccgcgacggcccttggcgtcacgtagagacctttcccagagctcgcggggtggaagtggcgtcgggcaggaccagatggactggcccccagcctctggtagacacaccgccggctcgccgagctggagaactttgcgaagcgccccaaaccgctccgggtttccactttcagccatttctctccttgtcccctcaccaagagcggggacggagcaagccttcgccacctgtctctggcacccgccgagggaagacaggccaatggaaagagggcagaggttcacaccccacccccgaaccccagcgcctggctgcccggaggtggctccacagcccgagggaaccgacgcccccgggccggctgtctgctcccccacggcacgggccccacccccaatccttccggcgccccagcgcccacccacccgggcgcgggagtgggagggtgccgcgtgggcagccggagcaacaggcgtgggagcagcgctcctcgcacttcctggctccagaaggctcggtcgcgtccctcttaccttccgcgaagccagcccgggccccgcgcccggcgccccgcgcgcgcgaggaagctgcggccgggagccggggccgcggaggcgccgagcgcccagcagcgcggggaagcgcccagcagccgccgctcgcgcggctcctcctcgccagcgcagtctcgctcgctgcctccctcgctcggtcggttcgtgcgtccgtccgtccgtggggccctccctcccccgccgccactgccgccgccactgccgccgccactgccgccgccgccgctgccgcagcctccgccgctccagccccggctcggcagcgcgtcccctccccgcctcgccgctccgctcgcgggctcgcgggctccctcgctctctcccttcccccgccgctgccggcgccgcgccgagcggagcccggccggccacgggctgcctctcccgaggtccctttcccgagggggggaggtggtgggggcgcggcgcaggcggggcggggaggagaggagagtccgggggaggcggcaaggctgcgccctcggctcccctccgatccccgcgggcccagcggccccaggccgggccggagagcgccgagccgccaggcagtggaggaagagaggaggaggacccggagtctcgccgcgggagggtgcccagggcgagggcgtgcgagggggagtgactccgcgcgcgagggtgtgtatgagtgtgagtgcgtgtgtgtgtgtctgtgtgtgtggagaggggcgcgcgcgtgagcggggggtggggagacgaggcagagcctagtgcgtctccccgggcgagtggaggaatcctagggtgtgcctggaggtggcggagtgtaccgacgcgggtgtgagcgcgtgtgccagcgagggtgggcacgggggtgagcgtggcaaggtgagctgggtttgggggtgggggaggagcagggagtacggcgtgagcgtaagttcgggggcgtgtgtggctggggacccacggagaggtggcagggagggccggcgtgtgcgcgcgtggggtatgtgtgcacctagctgtgtgtctatttctcgctgactgtccacagggcagcagcacctgcttgagaccaagcccggcgacctggcaaggtggggccccctaccgcgcaatctttgcggctggcccccggctctcagctccgagtgcagaggctgaagaggtacccgggggacacactgcctctaaccccacctatgagccgctctcctctcggaggacgaaggcaccatcagaaggtcgagattcgccctcctctcccgccacgtctacccactacctagaccgggagtctggacttgggagcgtgaactctcacccgagccggtccccttacaactggagcccgcccagcccctcagtccctccctgaagcccatgggtccccactgctccgtgcctcgtcgacccaggatggggagtgggaaggtcagcatgtgcccacagggccaggtgtccggcccagattcccaccctcagggcggcggcgcgcaaagggcgcagtccccgccgctgggcggacccgcggctccggctttcccggtgtctccagcctcggtgcccggaatcctggatctcggcctggcgctccggaagcgaggcagctccgtgccccagcagggacggggaacgcttggcttgagagatcacatttctgggtgtggagaggtgggtgccgaggcagagaaatgcaaagtgcgttgtgacctctggggtgttctagactgcgagggtgttctagaccctaggacaattgtagacccagggctggaaaaggacctccctgaatccggaacggggcttctggcttgtgagaacccctagccctcttccagatgaaggagtggaagtcggtaattgtggtctgggcccttgtggcccctggcaccttggagtccctcattcactcactcttactttttccggagcccccttcagtctgtcagtttgaaaggtacacaattggcccttcaggaggtgggcgtgggctccattagcgtttgccaggagtcccggagctgtgtgggatttgcatacagtaataatgattaacaacactgccactccctggcagacaggggaagaattcggggaaggccctggcgctgctcccacctccctcctccctttcctctggggaagggctaattttctggcaactgcactcctcagttgctctgacccctgggataaagtgcctcaggtcctgggtggtcactactcaggaggcaggggcactttccttcagtactccatcccatgttcaattcgggaaagtgaaacccatattttatttctgcccaggtttgaactcctgtacattctcactgttgtttagcatcttgggggcagctcaggggttgagtgcccccctcagtgtttggaggcttcaggagacagttgggcacatcatttctcctcagaaagtcaactaatgggacagttgtggcctcctgagactcgtaagctccgtttgaagaccagacactggtccagacacctgccccctcattcctcataagctcgtaactcattgcttaagtgtggtagctgtagactattctctcctttctgtcttaaccatctagggaaaataggaaagactgggatttctagtctaggccagtgtgggttttgtttaccagtccttcctacaaccaggtgatctgcaaaatgagagcaagcgatggggagaaaggaggccccttgattcgggcagctggagtagtcctgctgcccaggagatgctgtccctcccaccagtccccagtcatctattgcatctttccagcactgcctgtcctcaccttccccctctgcctctggtcccggcctggccgggattttcacttgcttttcccccatgacacggccgcttttcctttaactctcagcttctatttaaaaagctaatttgggagcttgtcgatgctcccaattcagacattttaaataggaactgaaagtcaggagctgccagggcactagatttcctcccgttgccaccagcacagctgaggcatttgttcagtcactcctctggccctggccgtgtgtgtctgtgtgtgtgagcacccgcgagctcagggtgtatttcaggctatcttttctatttaaagacggtgctcctatggatgactattctttctctgtgtgtgtgtcctttccaagctgtgcacacatgaggattcttctttagtctcatggctgtggccggtatttgcaaagcttgtcaccgtgtggactgtgagggtaattgggagcccagctcaaagtcggctgcttctttgctgacgtgccaggctagtgtgtctgcgtggctgtttcccagggctgctctgttcaggctctctctttgaagctatgcctcatatgcctgagaatgtccttaagggtcactcccaccctcactgcttatagctgtcccattttagcaatctgccccatgctggggcaagaattttgggggtgggctgtacctctgagggttacagcctttctacatttagggtgctatgtaccttagaagtaaaaagtacagactttgaggtgagactgcctgggtttgaacctgcgtctgctgttaattagctgtgtgatcatgtggaaggtacttaatccctctgtgccatgatttcttcctctctcaaatggcaataaataatactatctactttatagggttgtgaaaattaaatgaagtaacacagataaagtgcttagaatcgtgcctggaacatgggaagtacaatataattgttggttgttgttgttcaaggtaggagtggtgcaggcaggaggtgcaaagaaatctgtctgaggaggaagatagaactgccggattgtacacagagacacatatagtcactcacccacccatgcatgtaacaataaaaatggcaggccacagcccacaggcagtcaagttcaccttgctgagatagttaattctgtaagtcccagaaaagggagatttctgttgaaggaatagaggaagagtctagggatagagatgaggaaggggcttgaccatgtcagaagcccatgggacatttcttgggagccgattttatgctgaagagtaagtcccgggcccctcactatccatgtggtcccagcctcccttatttaaccactgaaagcaaggccttttgaaagtgagctccagcgagaaactcaggagggtggcacctcattctccccaaggctccccttgggtttggggtactctcactttcatactgccattgcgttccatcccttattcccacagctgggcatgtgagcttttattcagttgctattagagtttatttcacctcgatgggcccgcaggaagctgctagcaggaagaggagctctgaaggacaggaggctgtccaagggatgaaagcaacgttgcaaatgcttggcttagcatatcagctgtaagctgaggagccaccatatgttgggctccttgctagattttccataatcctgcactgtagatattaccatcattttattgatagagaacctgaaggtagctggtggagagggacactccagaaggatgtgaggctgcatagctggattggaactctgacctctcccttttgccgctatcccaggatccttggtttccccgcttctgaaagtagagtatcctcctcagtcagatagaggggctatcctaagaggacactcttgacctctcctgtatttggcctccataagttatgtgtggggttgacatagtttgaatatttgtcccctccaaatctcatgttaaaatgcaacccccaatgttggaggtgggcctagtgggaggtgttcaggttatgggggcatatccctcatgcatgtcttggtgccctccccatggtaatgagtgagttcctgctctattagttcacgtgagagctggttgttgtaatgtgtctggcacctccttcctctctctcttgctctcccttgccatgtgacacatctgcttccctttcccacccgccatgaataaaagcttcctgagacctcaccagaagcagatgctagtgccgtgtttgtacagcctgcagaaaccatgagccaaataaacctggactaatacgggggtggaggctcagtatgtccagggtggggatgcaccctatttttcttcagggtgatgtctgcctgaggaattccaaagcttaggggtggcttggctttctctagtttcccaaggtggggtaggaggtggtggtgtaaatgctgacgagctttgccccagtctcagaaggccagggctttgcctaccgggtatcagcccaggttgtccagcttccaggccaggaggcactgtccaacattggtggccccaatggctgaatgctcacaactatcagatgcttctagtccctttctgagggtggagaactcttgcttcctgcagcactaactccattttggaggccagtagtggcctggatggtcatctcattgatcaatatgcttagaccagttatggcaaatgagaagccatccaacttgctgggctccagtggagcttctgaaagtcagcccttccagtggaccttctgccagcctgacccctgctccaaccaaggcagctcctggggaaagcaaagtccaggtggagggttttctgctcatcaagacctcccttggagggagatgctagggaaggaagaggagggaagagaaggaggaaagcaaatatgagaaggagagataggtactgggagtttgggggaaatcctaatcatttgtttagtttcttgctagaaaatctggagaagggtgagtggaggctggggatataactcttaggtgcaatgacttgttttctgctggtggtttcttttgcttgtgtgctgatgtttcccaggtctctgtccttggccttctttgcttctctctctgcccttttccctggagagtttatgcaagtccatggtttcaagttcactcagatgcttatgatttcttcctgcactcttctgttcccagtaatgatccactgtgcatctccatctttgtacataggcacctctatgcttcatctcaccagtggccttaatccttctgcaatcaattgtttcccctaaaaaaccctcttcctatcatggtatatcctctactttctttccagccttaccttcttctacttactcacatcttcctttctagcatgtagatcttttcttcattacctgcaaaatctcatatcttcatgtctttgtacatgctgcaccctcttccagaaatgccttccaccacttcctatttcctttgtcttcctagcaaacttccactcagcctcaaaccttaaatacccaagaaaaaagtcatgtaagtgttggtaaagtcctcccccacatcccaggatgaactagtcgttccccactttggattttcacagtccttcctgcatacctcaaatatggttcttatgacctgtatggccttgttttctgcatagtggtatccctctctggacttcaagctgtttatggcaaggaccgttgtcagccatttctgaatcctagctcagtgctcgggacattgcagatgttcaatacatttgcattaataatttattttaactttaatttacgtggctcccttgattgtatgtaactgggaatatgtgattaatttgtcaactggttggtctccaggtcctatctgattgatcttaagcactagcatgaggacagaaagaagaatgagggtgttccattttcagctgatcctacatgaaaagagccccaaagccccactcctccagtagggaggaaaggaaagtcttttcgtatctacaaagtgagcctcagtcgatgctgcctgcagagaccttgccagtgttcttttcttgaaccagattggttttcagataactcttttctttcctttctggcagaatgtcaatcacatatccagaatatcacctccttgggcacagccagggcatggtccattgaaaatgttcctgattgctggaagctgacggctcaccataaaagccaaaatggggacctgtcaaaaatgttttagccaaactatggcttggctcaggaagatgccaagaccaaaggctgctgaactttaagtataaacttgcatgaaaagcacattgcaggtctgagacagtggaggcttagtggtgagaacatgagctctggatagacctggcttcaagtcttggctctgtcattcaccagctgtgtgaatttgggcaaaccacttttcttctctgatgctcagttccctcacctagcaaaatgggttataatgatggcatcaactcataaggttcatgaggactgagctagataatgcaaacaacatgtttcatatacaataataaataaaaatgttggctgttataatattgtcactgagtctacatgtatctgaaactagctcttttaaatcctgggtacagctttacaagcagtattgtgtagtttagacagatcacctgagttctttctatgtaattattgtttctactgaaccttggtaaatgtgtgaaatcacagaagtttgtccctagacactcccctcaccccactggctcctctctccattctgtgcaaccccatttctgcagccttgagcttcagcccatttctctccatttcctcctcattagcaagaactgataaaattatttgaactgatatgtaagtgaccatctcatccagagatatagtattcacattttagtaggtcagagccttaagccaaggcagtgaaatagagtggatggtacttcaagcattcatcaaagtaatggggaaagtttggggtcccaggagactcttcccaattccacagagtcctgcccattcataaaactggtactattgatgcattataagcaacaaggtggtccgtgtttgaattctgcagctggaaaatcaagtctccagcttttgcaaaagtgttgtaatagggaaacttggacactaattttatataccaacctcttcttggtaaagagacatagctcatgagcaccaaggcctttccagcattgcacatctatgatacttatactcaagtgcatttttttcttcagagctcaaggctagagttgggtgtttttgcctcactgggtttgtaggagactcagctacaaagtcattaattgctttggtgaatcaacaagtaaagaaagacagtccagctattgtccccacactgcaaaatcataagaggcttctggacttctccacaaaatcctcattaaagatgagtcctcatggctcttacagaattctttattatgtcctttgtgctgagactgcaaggtaaagaaagaaaaaagggaaataactaaatttgttatcatggaaaatttcaaacatacaaaagatgaaagaattgtataatatacccccatgaacttgtcatttagctttgaaagttaccaactcatggccaatcatttttcatctgtaccctactcacacactcccccaccataattttgaaacaaattccaaatataatttcatctgtaaatatttctgtgattgcacctttgttatggccaacaaaatccatctttctagaagagaagtcattcttccctccctccatgatgctaagaacatttggccagtacctgcatccatgcccaggagtggtctctgggttaggcaagcttgagggtttactgaatgttatccaaagtttgtccttttccttgggtagaaaaaggaacccataaaatgtctggtagaggtgccactgtgtgcaagcttttttttttttttttttttttttttgtcagcagggatgatgctcaatagctgtgatgaggtccaagctgagagaaaagagtcatgatcatgaatcccaactggattcatcattttccacatactttacttcatttagctttcaccaattctcatgttagttccattttacagataagaaaactaagacctaagctcacccagctagtagttacttgtggcagagacagactagatgccaatcaaattcagttcctcttttctgtagatacagttagattactttcccaggttctcttgcagttaggtttggtcatctgactaagttctagccaaagtaatataggccagtcccatgaaaaacatctagggcaatttagcatgttctttctttctccatccactggctgaatggaaaaaatttcaagggcttagaaggggacagagccacaagaaggaaggaacttgggtccctgggtgactatgtgaagtagaggtccctcccaacttcctttgaactgtgaaatacgcaaaataaataaataaataaatttttattatgtgaaactgctgaaatgtgggtgatgtatgttcaagtagtaatgcctaccctgaccaatacagtggcatagatgggatttaaaccctcaatctgactatgccagtgtccaaagtcttcccctaaaccacactgcctccaggcacaacaaataagaattgcttataagaatcacctacatgctcagcatgtgataggactgtcttcaaggagatctcgcatcttagatttgtgctaatatgatagccactagccacatggggctgtttaaattaaagtttaaattaattaaaataaagttaaaaattcagtttcttaatt

SEQ ID NO: 296 - DNA, 402756 bp, Homo sapiens
tccagaaaggcgggacaacttcagaggtggggagtggcttttaggtcatgggtggattcaaagattttctggttggcaattggttgagagttaagttgttatccaaagacttggaatcgatagaaatgagtgtctgggttaagataaggggttatagagaccaaggttcttattatgtagatgaagtctcattggcggctgccccaaacgcaatagatgacaaacgtttcttattcagaccatgaaaaggtacttctcagccaatctcttctggaccagaaaaagacctggaagggaagaggattctctacagaatgtaaattttccccacaaaagagagttttgcaggatcatttcaaaagatgtcaaagaaatatattttagggtaaaatacttcggtttatttcagggcctgctatctgtcatgtgatgctagagtcaggttggaatttggtatcttattgttgcgaagagtctcttctgtctgtcttagggtctctgttttgatgtttaatgggtcagttgtgtgcctgaactctaaacggagaagggtatatataataaggcatgtccaacagctcccccgactgcttgtcatggtccgaactagtttttcaggtttagttggatccccttggctgagaagtttcattcagtgagttggtggggcttagaattttatttttggtttacactttcaacatacattttcagagccactactgaaaggcacatgccaccctaggcactggggatagcgtggaagaacacagcccaagtccctgctgtttggagcgttcaggctagtgggggagcagatactaggcagacaaatatataacagagaggtagggagtggcacatactctgaggaaagataaaccggggagtgcctttctaatgcatgtcggagagacctctctggatgtgatgtttgagcaaagacctcaataaagtgtgaatcagcttggctggggatagaatgttccaggctgaggaagagcaatgcagaggctctacatctggagcatgcttggcctgtgtgacgagcaacaagaaggccagaagggctggaagggagtgagggagggggagagatgtgaggatggagaggcaactgagacctggtcacccagggctttgtgggtcccagtaagaatgtcggattttgttggaatgacaatggaaggtcactggaggtcttggggtaggagaaggacatgatggttggtggggcaataaaagagatcaggctctactcccagccccgctgtccaaccctcagcctctcagccatggaggtgaggtcttcatcagctccagggctgtgatgtcagttagctcagactctgggacccagaagacagggctgggaatgggaggctccatcagcagcttctccctgatcccttcccctggggcctggttctgccttcttccatgtccgcctgttaatccaggaccagagaacttttgtctgattttcacggtctctacaagctatccacagccagaactgtgttgggacttgaggagggtggagaccattcactattctgagatgaacttgcctggcatggtgcttggcacttagtaggtacacagacacaagttcccttcctccacagctacatgaaatgattgcccttgtcagtcaggagaccaagaaagatgtcttttagggaaggaggtggggaacatcattctctccggctgctgaataggcttgatgactctgtctctatgtagtcagaagccatagttgtgtgattctaaatgtcacttattcattcctccagttaactttcttactcctcttctgccctgggctttgtgccaggcactggggtaccagaggaaaaggtcatagtccctgtccttagaattacttgtaggacttattaaaatacagattccaaggcccatgcccagcagctagttctctgagcaggcccaggactcagcattttaccaggttcccaagtgattgtgatgcttgctgaaatttgagagtcagtcctcctagtgtctgggcatgggccctgaaacccacattttttgtaactcctgtaagaaattatgatttaaataaaccatattagtttcctgtggttgctgtcacaaattaccccaaactgggtagcttaaagcaacagaaatttttttctcattgtcctgaagggtgaaagtccaaaatcaggtggtggtccctcctgaggctctcaggggaattctgcttctggtggttccaggcattttttgacttgtggtttcatcactttcatttctgcctctatgttcacattgccacctcctcctttgtcttccttatcttctgtttcttgaaaggacacttgtcattggatttagggactagccagataatccaggatgatcttattattgcaagacgcttaattatatttgcaaagactcctttttcaaataagtcaccatgttcacaagttccaggctgtgaacatgtctttctgggggccaccattcaatccactacaaggacgctggaccatactttgagaaaaacttgcatgtgacttctaggaaatgggctgatcagagaaacactaaggaggtagaagtaacaggagctggcaatgggcaagctgggtggaagaggataagggaggagctgcgaatgactcccactgttctgacctgggtgctctgggacattgatgatgcagttcctggagacagagggtgtggaagaagccagctgggccatttggaaagagcagagccctgagcacctggaacacaggtcaggtatattttgatgggaaagagacagaaaagtagcatcgagaatcaatttgcatctcagaattgggatccctgccctaatctctctactttatgcggccgtgtcctgcttttcatgactctagaaagcagaggagaaagtggatgtaagatataaattagtctgtcttgtagggctttctcttggtcccattctgggaccagccagtgtccatacctgtggcctttggtatccaatttaaggcagttcttctctttccatgatcacacagtaaaggagcccccgtatacagtgctccaggactgagtccagtttttagtgtagcgtgcaacaagagcagaaaaggcagagttgggaaggacatgtcaacgggcagcaatgaggtggtataaagaccctgggcatttggaggcaacagagggagaaaggtctgcttcaaggaccaacttggtctcttcctatctctgccctggcagcaccagcagctgcacattggcccttcttaccacttccatggcaaaaccaaggtttctctacctcgcctagccggcccctgcagacttgctgacacagctgagtgcggagtgcatctagaccccaacatgaggcgcccttctctcaaaacaaatgagccttcgaaactccagcaaacagtgctaatgaattgccctcggcttcttaggcatcattttctcgtaattataatgggaagaagacatggagtcccactgagaacgtggagctagcctgcccctagagcaaggcaaaatccctctctgaggaccacactcaagcagaactgatttttctaagacttagagaagaaacaaaatctgatttaattcttaggaaattgctttttttaacccacctgtgtaagcctgtatttaaatgctaatatatttggcctgccgggatgccacatttattttcttccttagcagcaacaaaaatcatttatttatgagaattctagctcctacctgctctcctgagttcctcatcttcatttccatctaccagctggatgtttgtcttcccaagacatacaaaatctgtaaccgtctcccttcccagaccagattctctttatacctttcctgtttctgtttccagaactactgatggcttttgcctccctctgcttcccccgtgctttcctccaatcagtcattaatcacactgctcaaccttcctcccaccggggcaaataacataacttgcctaagcctccatttcctcatctataaaatgggtttaataaatactaatacctacttcatgagcttgttacaagactaggatgagctaatccaaataaaacactcagaacagcatctggcaacagagtaacacatcacagtgatatttctataatgattatgacaatgatcccgacccccacggaacctgtccctttcctctttgtagttgttctatgagctgaccagcaaactctgggagggccctatcctgctcattagaaaacacagaccggacactcttcatttcatcactattttcactgcctgaaattctctaccttatgaatttgtttgtttgtggtctgagtaccccctcccctgttcagcctgtaaaatgcaacttccatgaggcaagggattttgtcttatttaccagcatatccctaacggctgacacacagtaggtgtcggatagatatttgctgaatgaacacgtgaggagaaaaaggctctaggatttttggaaggaagacatctagacggcgctggtttttaagcccttcaacactcaggtttcagggctcccttctctgctctgctcatttctgctttgcgggcagccctgtgacaggctctgtcactacgcggggagagaggtgcaggctggaagaagagcgtttttttctagttcacttctgcctgcatctccacggcaatagttcttgaccctagcatcaatatgttccagctgcagcagctggttccagtttgtagtgtttttctttctttaactcccagaatgaagctcatcacacaacctcagagacatcagcaccagccagcaggcactgcctctgcctcactgggtccctttgctgaagttctaggtccaggggattccagtcttgatttcctttatcctctactcacccccacccaactctaggagtggtagctgcttcctgcatttcctatctctatggttcctcagtgttccttttagcctcctgcagtcctccaatgctagcttaacaagtctttatgtgaagtcctctctgttaaactggctgctgtggtctttttctcccggctggacagtgactgatcccttgtctagtcattccctgcctcccctcccacgccacagctctggccttagagggaattatttccaggacaaacatcttcaatctctctccacgatgcatccagggatggagagtgtatgatttaatagacagctgctaatttcttccaatatcgaggcaaaatatacctctctaacactgtgagtcactttcattttgagccctggtgagatatcaaataagtttttgtaaattttagagtcaaatgtcaaatgatctcggattcaaattcagcttcagctgtgtgaccatcaagaagttactttccctctccgggcctgtttcctcacctatagaatatataatatcgtaatagctacctcatagggctataataaatatttaaggtgtgtatgcacttagaacagtcacctgcacggggaagaaacttggtgaatgatgctgtcattatcatcattgaggaggacagcctttcaacttttgaaggacagcatgtttgtcctctcttagccttgcactcgaagtcggagcactttcccaggcccagacaccagctggagcccccatctgcttgtcctacttccgcctggaactggggtgtgaagattcccataaacgcttcaggtggagagaaaactctgacttcccaagttcctttggataacgcacatctgtgacccagaggctgactaacacatgcctgctgatggtctcatttctagggtctcaggtgctatgtaaatcctcttccctgttctttatttgcaggatagcacattccttgagcagagcacgattctctcctgtactctcctgtcatgaagtgcatactggcacaccttgccttcctttgatgggaatgttcttggcacactgagtcccttgcccatgtattggggggatattgctgtgtggtgttttggatattgctgaccctctctgggcctgacttatttgtccaaggctgagagttcaaacacatgatgccttgcagagatcagaggagaatccaaaatgcttactgctaggagagagaaaaatcaaagagctggctccataatttcgaacaattataaagtctcacctgcacagcctctatttattttcaccttcctttttctgtgcttgcttggtttccacctctgtgagttcttttccacttaccacagcttcagtgatctcaatcttctcttcctcttctggaattctctacccctcccttgataaaaacagtgttttataatggtttcatgtgagagcaacgatcccatctcacacttcctttggagccctccacagcatttgcctggcactgggcacacaacagctgttcaggactccagaccgatagagaatgtttcttgtctagtcacatagatggtaggtggtagttttggggatggggcaggaatggcatcagcatcaacagtaggagaggtaggagcagcagcaataacctttgccgttgacgtaataacctctgccatgtactatgccagccactatattaagcacattaatttcatttaaaccttccccagaccctatgagataaggattattattcccattttacagaagaaaaaactgaggctcagtgaggataacctgtttgttcaacagctgctgagttgaactcaaccctaggattgagctcaaggctgtctttggcctttgtgcttgttatcctctcagccttaactattcttccccccctcagagagctgtatggctggtttgagtctctgttcaaatgtcatcttaatagaaaccttccccagtggccctatctgaaatcggaactcctgttactctctatccatttgatcagttttctttttctttaaagcactatctcttgtatagaggcccatttgttgactatttctgtccctggaccacatgaatataatgtcaataagcccagggactttgtctgttctatctaccactgtatcctcagcacctggaacagagtccatgataatcgtatactttcaatatgcatgtgtaggatgaacaagtgagtcagtaaatacctagtgcgaagatctgtgctcttatccattatacatctggcttggaggagttatgggatgttcataggatttgtcaggtcaaacaacatatgcttttgtttctttcccaaaatatggtcaaatgttgggattccagattcctgagctggggcccaaatgcagatccaccctggacatttcttatcatccctgaacagaggctgctaactgtcttgtgggagccattcctccagcaggattcctggccagatttccaggctgaagactgagctctggatcaccttatatcactatggtcacagccttttttcctttggcttctcagtttttagtcttaccctctctggtgggatggaagagaggagaaactgggcatagttgagagtcctatgtcctgcaaagtgaactcacctattcagaggacagtattattgttggtaaaatgatcagatgggtcccacaccctcccttccaaactttctgtctctgatccttctccatggtgcctaggttgtctgctctttgcccactccttgcctgccaggtcgtgctccatgaccgtcttaacacctacctgcctcatgcctcaattccactaagattctgcaaagtgaaagaagttagttagataaactgattctcaacaaggactgagtgtctcgtggtgaatctcctcctctgtaagtccatgagggctctgactttgtcgtcttatttgtctggctcagccctttctgcatcctgggtgctcagctctttcctacacactgggagctcagtaaatattggataagtgaatgagtgaaccaaagactaagtgccattaacactctcagacaccgtgtgcctttttttttttttgagacagagtctcactctgttgcccaggctggagcgcagtggtgcaatcttggctcactgcaagctccgcctcccaggttcacaccattctcctgcctcagcctcccaagtatctgggactacaggtgtgcaccaccacacccggctaatttttttgtatttttagtagagatggggtttcaccatgttagccaggatggtcttgatctcctgaccttgtgatccacccacctcagcctcccaaagtgctgggattacaggtgtgagccaccgtgcccggccaccatgtgccttttaactgggaccttcaactcttaagacagagagtgcataacacggcaattttaagccctaagacatctagcacaatggggtatttcctgctagagctacttctgttatatatgctctgactcctaccatgctggcaaggcttgagggcttcggggttttgaggaggctctgagtttgcagactgtctcccaggcctcttttcagagctgaaatttgttgatgagcactctgaaggctgaagtttctttcttcaagattcacttccacattgactcccagaacacggggtaaaaatcagacctgatacatgagttctggcttatctggcatttgtcaactcagtctccattctctgtctcttaagcaacggattcctcttgaacatcccagagaagcagatcaaagggagacagtcgaggcagaagaagagactttccaaggcatagccttattcagatgaaggtgtttcatatctgctattcacaagtagccacactgcattcacagatgtacccatggccagggcccacaaggactttctgaggaaagcaaagcagggttgttttgggggaggttcacacctggtgaagagggtggaatgagatgtccctgccaccagggtcccttccaactcacggagcctatggtactgaatggcagccaggttttttatggagcaatagctggacttcacatttgcataatgccttgcagtttcactgttaagagtactgcattgtattctaattatatgaatctcggtcattcctttatgacatttctgaggaatactatctcaatcaagaaaagccctaattgcactcctctcctatcccggtgagagagcacagactcgtgcctgctccgcaggggtggaggctggaattcagtagtctgagtcggggatgcctggagcaggaggtggtcaggggcattgtcctttccaagtcaggaaggcagacagcacctgctgttggtgccaaggttactggacaggctgcgagggctctgtctgtctgtccgatgttcacaggccagctccccggaggctcagcactcagcccagcttctccgagatgcaaaccaggccactctgaggctgcctacaaactttctgctgagtgccgacagctgcttcctgctctgcggggagttcttccagatcctgatcaaggcacagagaattgatctatcagattaaccaggaaggaaagagtgggagagcgagtgtgggaggctgtggggctgagtgttttctgcgtagcagtcccctcccttctgacttgagtattaattgctacattaccgctgccatgtaagaaagacagtcagcaaagcctgggagagctccagctcctccctccctgctctgctcaacttcactctcctcctcggttcccttggagtaccttgtgccccggcagtgctgtcccggccctggcatcctgaggtcctcccgtggtgaggacttaagtggacagcaggagtgggtggagagagggagggagagtttgccctgcaggctctctggatgcagaagccagactcgctgcagaggcagctgtgctgttcccggagcctggcttcaggggtgcatccgtcactcagggttcattcacccaggcaggctccaagttcctggggtgcacaaggtgggcactgtcccttctgggtgctgacagcagagcctggctcccctccgccaccatgagcggctgctccaaaagatgcaagcttgggttcgtgaaatttgcccagaccatctttaagctcatcactgggaccctcagcaaaggtatggaaactggccttgacccttgctttctgtcttgatatggcctggctggtcgcattgcctcggtgtggtgagcgtgaccattctggtgcacccaggtcttggaaaaagctggggaaattggtggctgggattcgaggttgctgacaacctgcgtcctggctttgagtaggcgggcacccagccagggaactcagctggctgtaattgcctggaactttggaaatggagttggtggtgtgtggctgatacgttatgggcgggcagagggatagaaccctttccagagcattggaagtggcttagcgtgactggagtttcaagaagttatccatggaaggttgtattttgttgataaaagagagatttgatgcagtgggttgtgagtaattctgcagaacagagacgcttgagggggccagtgggaggtggtgatgggccggcatctgctttgccctggtggcttcagaaaccggatcagctctgcacctcaagtgccaagagcctcctctcatagggttccagcgtctcgtgcttctggggcttcattcatcgttctgctttcttggatccctgtccctccacatttcatgcctatgtccatgcctgtcttttctgcttctccaggaactggggtggcaggtggtttgcaggagtaactgtctgggcagatcagaaagtgtggctatggaccagaattagggctgcagccccagatgggcccacagccgggaggcagaaagaaggctaactcctcagggcccagtcctgtgtcttaaaccccattttacacttggcaccagggaaggtgaggccctcagaggggtctggccaactttgtggagatgatgtcaagggagagcagcagcatgatgtggttccactggctgaaaaaacgtctttaaatattcatgctgtctttcaggaagagtctttgggggctggggagagaggcactggaagcagcaggcagaatattcagggaaggagcccacaaaactttgatgggattttacaaaatgacaatgagagcagagaaaggctatatgcagccagatctcatgacatggctcaggtgcccgccacccagcgggtctggcccagtgtacgttgtgtggcatgtgtgggtggtgggaatgatgggattctgtttatctccttccttgggatgttctgaccttcctgttatttccctaccatccttctgaagtggggcactgctcttccaagatacccaggtgggctgagcccccaatgtggagggccaggctgcctggcagaattcctggaggccagaagtggggtaaacaggaggttaatgggtatagctgtgattgctctcagtggctttacctcctggagaaggagaaagcaaaggggttaggaaatttcacaaagtctccccattcaatcctcagagacagctggaaggttttctttcctcattacagatagcaggacctaagagggtaatgggtgtggggcagcaacccattgcagcctctcatggagggcttgtccccacctgcagtctagtggcgacccagaccccacacacagatgctccctggatgccacactgagtgctgagatgggggaatcatgggggtcaacaggcatagagaagagatgtctggggcagactaaggagtgcctccaaacagtgacatctaagctgagatgaggagaggcagggctgagaaggtgggaggaagccgaagctgccagagggagcaacatcagagtgttggcctctgcaaggaaccagctggagagtcagaatgcctccctctctctgctcagaatcccagaaactaagatccatgtgacacagaagggactccgtggggacctggccttcctgtgaactgcttcagtacagcctttcctgtggccagggctcagagaggcagcccatggcaggcaccagggcaggattgtgtcttaaccgcatctgtcttctttgcttcagctccgcagagaggaccaagtgtttacacagccccggctctgcgccaggcacgtgctaggtgactggtgttctacccgatccaggtgtttgctaaatatttgttaaatagtgaggaacatgggagcagggccaggctgggagcagggtagctgagaaaggcctgcagagagtccagaaaacggctttctaatgtttacacctcccctaggtggatttagattcaaccctacatggatacattatgattgcttaatgatttctgattttaatttgatttcacttattcattattcattgcactgagttctagatttgcagtaatccaaccctcaggagagggatttttctttgtcccttgcagaactgaggaatgtaaagaatgtgttggaccaggtacctgcttgttctatggcaatttactgtttcttaccagccttgcaaatacctgggggacaaggagggtccaggatcaccctccctgtcctgcctgttcctaacccttggccacctcctgccatgccagaaatccttcttgccatttgtctaagatgccagctagcccagatttctcatcagcgcttattgcagagataaactgctcatgtccacctgctcacatatctcatcaaccttgaactttccttcctatccctgatcataatttgtggtctgcattccctttaggaacatgtttgctaaaggctctcttccccactagacttcagctccatcatggcaagaccatgtgcatttttttgctcaccactgtggccagagctactagcatggggcccagaatggagtatgtgtgttaccgtgttaaacgaatgcaacggcaccgcacggcacagacaccagccgtcagcctgagatgacccctggtacaggagctttctaggaagcactatgcaacacctgtcccacaggtgctcagcaaatgctctctgaagtctgtttagctgcagcaagctgagtctgcagcctccagcctccagcctgcgtgagcctccagccacgtaaaacattcaggctgggtctgagcttgcatagtgtctagggaagggcattaagattgttcccagaaggaaaggctgggtgggcaggcttctggcatccccactcccacccctctggctctatttttatttgttttatttactggatttctcccacatttaaagaatctctttggcattaaaaaaaaaaaaaatttcaaaccacgaatgcagtgaggagcacagttggtttctagactgagacatccccggaccctgcactgtggctcggaagcctcggactgggtccctcacctccctggcatttagtttcctcatctataaaatggaattacaatacccttcttatggggttgaatgagattgtgcagataaagctccctgcctattaggtgctcagtagtgttgatggatatgacttctgttattagcggatactctcatggttgagagcccctccgggctgggactccctctcactcattacttgttttctcagcaccaggcacagattctaagagcaacatctcatgatcactttatgaaagcctatggccttgtcagttactgcatgactttatttatttatttattttgaggcagggtctcattctgttccccaggctgagtgcagtgatgcaatcacggctcactgcagcctcgactttctgggctcaagcaatcctcccacctcagcctcctaaatagctgagaccacacatgtgcaccaccacaaccagctaattttgactgtttatagagacagggtctcactatgttgcccaggttgatgtcaaactcctggctcaagagaccctcctgccttgggctcccaaagtgctgggattacaggcatgagccaccacgtccagccactggatgactttagaccactgcttcccctctgctcaacttgttttcttaagggcctacccagagccatctccctcacctgattccttattaggagttaaaagcctgactcccagagccaggtcctcgcctgctgtttaacctaggagaagcccagctcctggctcggatgcttggtgaaatcaggggtctggggaacctgcgtcttcctctttctgcacagtcagctcccctccacccgcctcacagacttcctgggggccgctggcaggaaccagaagttgtgcaggctccattctggctggggaggtttaaactcatctccttctgcactgggaacaaatgttaccccaggcacagatgacagagccaaagtgagcagaagggaggaatccaatccaggagagcttctagtgtcctccaggccacccatgaggctgcgggggtggggaaaaggggtgtgggaagatgagatctatctcaaggacaaggccctggagccgtaactctcccctcccgcccaggcccaggctgttcctcttttttcgaggcaaaacctcagctgccccatcagtgacacactgttcctcttgcctcctcccactgctgttcaagatcctcaagagactgaccttggacccgggcatggactctgccttcaagcaggccaggctggagtaccaactctgcctcttaccagctgtgtgaagttgtgtcatttgaacaccaccccaagccaaggctccccacttttaattggagataataataatatcaatggcacaaggctgttttttaatgtaatgatgatatgagtaagagatatcagctcacaggcaaatcccaactctgctcttgcagggcacccgcccccgcttacattttgtgccctaggcaccttccttgcctctttctagtcttgatcctggaggtagggattgcaatcaccatttcagcaggtaaggaaactggggtttagctaagtgtcgtggctcccctggtgagtggcagagctgggattagaacccaggtcttgctgcagccaagacaaggtacattcctctgcactcctagggctggagaagtcacgcctgcctgcactactccccaccttgccaccagcagagagtcccccagcgtcccactaattctgttggtgggtttttccctgctgggtctgatcagagcagccacctgtcatgcaaagggttgtgacaaattccataaagtgtcatcacctgggttatggggaaagggaacactccagaggccaagatcagcaggacagccatacccatgctctctcagtatccctatcacctctcaggcaggtgtgcaggcccaaagcacctgccagacactgagtaggctctgtcccatgagggccactcccccatggctctcccttcttacaggccaagtgtgagaagtgttcttgggtgtgggaaaatacacacaaagttttggacactaggcaggctggaattgaggtgttgcagctgtttactggaattgtctgggaaagcagaagccttcacactggggactttgagacctgtgagatatcatcatccctctaccaagaggagaatgccacctgtcccatgaaaagctaagcttcaatgctgccccttgctggggaaagagagtccccaccatccgagtcctggctcgctcactgtcctggcagtgaggggctgagcaagcactctggtcatgttacaacagccccactcactctctgcaaccctggaacctctgagtgccagtgctttgtcacaggaagaaagtttgattatccagggcttctgggtccctgcctacctctccagccccaagctagagcctgccaggaggggcatgtgttcaccttggccctcctgatgtccagtagccttcatcccagcctactggcctcaccacccttgcccctctgcagcaggcccagcattccctgacccatttgggttgttcaggtgctcagctcactagggtctccatagtcccacagtagaaggcagagaagaaggagggatcacctgcccctctggagcctccgggtctttctcctagataaccctgttaccatgcaggagtaatttgttcagggccatttatcctggcactgctgcacagacatcctattaacttcaggaccacaggggagcggctagtttgctccaaattaaaagtagctggaaacggggccctctggcaggcaggagagttcaggctgccacaccacagccctgggagaagtggatctagtcaggtcttcatcagccttctaagtccagggcctcctttgccatgccacagggaccctcatcttccccagtcttcttagggttacagaatctcccctgggccatctctctcagcagacccaggtcccaaatccctgaaagcctttgcttcccaagggtggaagtggcgatgtgaagtcactgtggaaggaagcaggatgcagggcgggaaaactctggacccagagggacctgggctccaaccctgccatgcaccaacaggacagccttgggcaagccattccccatcttgagtctgtgtccttccgtaaatgggccagtaatttccatctcatgtggctactggagatggaatgagatgggacatgtgacaggcacaggacctggctcatacaagctgctcagtaaaagtcaagttccccacccttcttttctatgatacgaccttggatttgtagccaagagaaacaaggctgagcctctgtgggtcaagtcctcttcccagctcctatccagatgtgctgctatttcaaaattatcccccctgcccccagtcactcttgatgacaagttctataattaaaaatgtgccaacaatggaaatgatcctttttatttagttgttcatgggagaattggtcatccattctcatgagaatgggagccctgtgaaagcgttcaccacgttcaccacgtgggaatcacctagagtgagtgcctcaagcacctgcagccgaggaaggaaggttgaataaataacgactaaatgctttccctgccgagcaacatcaggccatgtggctggagttccctttttgaggtctggtcttagtcaggcttgctctggagcctaccactccctatctcccttgtctgaattcctgtgctggagtttgacagcagtgaccagccagaacgacctggatgagacaagggtcagtgcaaacaagaccaaaggcctgttcctgcccccattccgctctcatgctctgctgggggactgcccctgggtgcaggcccacactgcctatgcatcacagctggccaggtgctcaggtgaggcggcggttcttccccgttgtccacctgcaccccacccagaagtgcaggaggagggaccccactgaaaggcaggcagcaggggagaggagctttgggggagaggatgtggaaatgaggaaattgcataggcctcccgggccagctggaggaaagaaaggccaggactcctgaaaaagactcatgggaagtcatttactatcaccactgaccacgctctctgtcacaggtcttcagtctaggggcagaagaaagccttccttctctgttaggatgaggggaggaggaccatgaacacaaagctaaccttggtcccctctggctgaagccactgagattccattttgtgttcttagaagaacacccgctttggagccagacctgggtttgagtccaaatcctcacaactgcttgctgtcttaggccatcaggctgcttatcaacctgatggcctaagctaccatacaaagacacggtggcttatcaacaacagaaatgtatttctcacagttctggaagctggaagtctgagatcaggatgctagcactgtggacttctcgtggggactcttcctggcttacagacagcatctcctgctgtattctgacgtggaggaaagagagtaagctagctctctggcctcttcttatagacacaccccattcaagaggctccgccttcatgacctcatcacctcccaaaggccccaccttcaaataccatcacctcaggagtgggatttcaacatgtgaatttgggggacgggaggcacaaatattcagcccattgcactaagtaaatggcttttttttctgggcttcagtctcttcatctctaaaatgaaggagctgctgatttcaaaggcctctttcagctttggaatttaaagattaaacaaaattgcagcactgctggtggcacctgccatgtgcccagcattgcctgagcactccatgcccaatattttatttagtgcacatgagaaacctaggaggtggagtgctctaattaaccccacttacagatataaagagcgagcttcagacgggggaccggcctgcttggagtcacacagccagcatgaagcatagccacaactggaagcctaggcggtctggccccaagccctgggttttacttccctccccagcccatccccagtacactctttccatttctgaaaatcagatccagggtaagaagcaacgaagacaaaacagattccttcccagtttggccaagaggcaacacacactcttgttttcgaaatcaagacttcaggacctccattctgactgaggaagtgcaattgaggagaatgccctctgagactcaagctccccgatccatcccctaaaccgttacccataggtcacctttcacagtcaaacaacaaaacatatggggagcaggcccgacagccaagactacagggaggggagaaaaaaggaaacaccacccagcaagatttcctgttgtatttctagtctggccaattttcatttattgctggaatgaggtcagttggaagctgaggcagagaattgggcaggaatcaggtagggaggtgtgattctggggcttgtatctgagaagctggggttagcctaattttctttctgtaatcttttgattaactgtgggccagtttggatgacatttttcaaaccatctgtgcttggcaggctgggccgagcccaggcttactgctcggtgtctgcaaaactcagcttggagccggctatcacccggagcctgggatgtctctaagccatgaagcatattggattgcagaatgatccacaacatccctgtgctgattaactctgcccaggcctcacaagttcagaaacagtggctgtcatttcaaacgcaacaggaaacatgaggggaagggccatcgccatcctctgttgagtgctacctattttctgggggctttacaaggattcctatattcagtccagccctgtctctgtgagttgtttttattccaaaccaggggctttgagaggctgaataacttgccaacatcacagatacagcactgtggttgaaaaggtcatgtgcaaacactaatgttcctttgaacacgcctggtcaaacctgtcagcaccgtcacttctgtcacagactgaattgtgtccccttaaatgtgtatgtcaaagccctaacccccaaggtggctgtatttgatgatagggccttgatgcaggagattaaggttaaatgaggtcataaggttgggatcctaatccaacatgactggtgtccttgtaagaaggggaagagaccaggagtacacacacacagaggaaaagccatgtgagggcaagatggccaactacaagccaggaaaagaaacttcatcagacaccaaccctgcccgaaccttaatcttggactttcagtgtccagaactgtgggacaatagattttcgttatttaactacccagtctgcgacattcgattatggcagcccaagcagactaatacagccccatagaccattctttgcatagcatcctttcctatatttttaactgtgacaaacatatataacattaaatttactattttaaccatttttaagtgcacagttgtggctttaagtacattcacatgttgtgcaaccatcaccaccaaccatctccagaacatttttcttctcgcaaaactgaaactctgcactgcacccactaaacccttccccatttctgtctaccctcaggctctggcagccaccactgtactttctgtctctattaacttgactgttctaggttcctcatataagtgagtcatgaacagtatttgtgtctggcttatttcacttagtgtaatatcttttttttttttttttttgagatagggtctcactctgtcatccaagctggagtgcagtgctgtcatcacagcgcactgcagcttctacctcctgggctcaagcaatcctcccacctcagcctccagagtagctgagactacaggcgtgcgccaccaccacacccaactaattttttaaaattttttatagagatgaggtttctccatgttgcccaacctggtctcaaactcctaggctcaagtgattggcccaccttggcctcccaaagtgctgggattccaggctgccatacctggccctcacttagtgttatgtctttaaggttcattcctgtaacagcctgtgtcagaattcccttcctttttaagtttgaacaatattccattgtctggatactacattttgctttttatccattgatggaccattcccatatttttaaaataaaaaatgaatcatatacgattataatccccttactggaaactgtctccagtggtttcttgacacatttagaattaaatgcagactcctctcagtggcctgtgactttgcatgatccgtcctctgcatttctgtccttctccttggactctttccaccaaatacccccaggctctctccctcaattcattcaaatcccctcctgcggttgccgtccctcctcatctcccccaacacattgcctaatgctgccttgcttttctgcacagcccttactgctcctgcaataatattacacatgtgtttgcttggtgattttaaatgttttaatggaaaatgtctatgtttaaggtatacagtgtgatgtcttgatacacacatagataatggcctgattatcacagtcaagctaatgaacatatccgtctcttttcatagttacctttctgtgtatggtgagaactactctcttagcaaatttcaagtatacagtgcagtcttatgaactacagtctccttgctgtgcattactctagagcttgttcattctccatagctgaaactctatacgctttggccaacatctccgttattcatttgtttatgatccagctcatccactaagagtcgagctctgtgagggcagggaattttgcctggccttgactacttccccagcacctggtgcagggcctaccacatggtaggccctcattgggagttgagaggttgagctggcagatgaggaacctgaggcctggggaaggccacccagcaagccagacgcagagctggccttgaatctgggcttcctcctctttccattccctacaggctcggcactgcatgccctttaaaggttccagttctgtatccaccatttccacgtccgtctgtccatccacacttcctccttagcaaggccgcccatgttcctgcatccaggacatgaggggttaattaagatagtcatctggcttctcaggctaccatcctaagaacagccctcctcagttctggagctggcgggccatttggttcatctttgatttgttcttgccatggagagaggggaacctgccgctgggaaaggatggcgatggtttccagtgtgctctgctccattcagccaaggggctcctctgggagggcatgaagtgagcagtcaccagcgaaggcatctgggggctgcagacgcagctggcttccatggctgtgttcccctccagcccttgaggatccaggactttctggaaacatgattttggagttcactggatgctgaatccattaccaccaaattgtgtgaccttgggaagtccaagggagtcactccttcgagcctagcctccttttctgtaaaatgtgtgcaataatgccaataccacaggtttattaaagtaacgcacttaaaagtgtttagtgtagggcttgtgtcaaattaaggattcaacaaatgatgggtggttttgcttttatttggctttgctgtttatcagggctgagcttaaatctccctcattgcatcctaggcaaaccagggacctcccatgtcttgggaaacggctgagtgactgaaatcacccacgtgggccagaaaagagtgagagatgttttcaacatactctttgcctttcctttccctacccgggatgcgagtatcagtgacaaagagttttattctagggagatgagacaggagagctcacactgtattcattgagcaagctcttcatgtccagaacctttaaaatctcctgtacactcctgccccactcccagcccacactctcctacggatgaaaaaataagaaggggcagtaaaaccttgtctttgtatagagtccaccgggggctcaacagaggaggtggaggaggcctcagacctggatgtcgtggcagtcactgcaccctgggtcagagccccctgaggacaccaccctggaagggagaagctggctggaaccacaaagccccatggacaagcaagctctggcactacctttgagcatctgctgtgcctgctggcctgtctcacagggcacatgaggtaaaaagacatcaggcacaggctcccccatgttcattatatctggaaatttcagtctggccaagggagcttctgagagcctgaaggtggccagtatgtgactggaagtcaaggccacatggcacagtgaccagcgtgagactcctccaaatgtcctcagtgtaagggtggggaaactgaggccagagcaaggaacacccttgagtaagctaccctcaaaacggagcctcctctggctggtagctgggggcacagggatggagggtagcctggcccctcctggaagtggtggccacccagcagatggctcttcattgccacacagccgatgactcatagactaagcccaagcaagacccctcgcctcctcccttcatctctgcactctccccttcatggcctcacctctgggggagactcccaagtctctctctcttgccttggctcttttcttaagctccaggcctgcaggtgactccttggctggactgtgaacttgttggaagggcaggggctacattttagttatttaagaacgtgcagtctggcacggtggctcacgcctgtaatcccaacactttgggaggctgaggcaggtggatcccttgaggtcaggagctcgagaccattctgaccacagcgaaaccctgtctctactaaaaatacaaaattagctgggcatggtggcacatgcctgtaatcccagctacttgggaggctgaggcaggagaatcgcttgaaccagaatgtggaggttgcagtgagccacaatcacaccactgcactccggcctgggcaacaagagcaaaactccgtctcaaaaaaaaagaagaaagaaggaaagaaggaaagaaaaagaaagaaagaaagaaagaaagaaagaaagaaagaaagaaagaaagaaagaaagaaagaaagaaagaaaggaaagaaagaaagaaaggaaagaaaggaaagaaagaaagaaagaaagaatgtgcagcacccagcacaagacctggcatagagtaggggcctaacaaatggatggattgatggaggatgggaggaaggaccactagacccttccagttgaatgtctttctatagcccctactcaatccttgtaaaaccaaaggagacctctctctcctgattttactctttctctttacatgtcccagtctcgagccttgttctttccatctgtcactccctttccactctcagaaccgttcctgaaatctgaacctttctaacctctcacccgctttgctgcagcagcctgcagactgcgtttcttcccatttcttccctttctgactcctccacaccattccaaagagatggcccatctaacccattgacccagaagccctacttctagaaatctattctaagcaaatcatcacagctgtgcatacggacttttatttagaggtattcattatggtattattgcattatttataacagtgaaaaactggaggcaatctaagtgtcaatggaaaaaattgtgtattaaataaattttggttcatctgtctgatggaacaatattaaactgttgaaaaattattttaggaactaattaataacctagagaaatgctattgatatcgtatcaagtaggaagccaggagaaaaaaaactgtatgatgaatgcagttccagtctgtgggaatagatgtgtatggaaaagtaaaatagagaagaaatacactgaaacattagtttaggttttagcttggattaaaggtgagtttttaaagtttttgtttgtttgtttgtttgtttgtttgttttattgagacagagtctcactctgtcaccaggctggagtgcagtggcgcaatctcagctcactgcaacctctgcttcctgggttcaagtgattcttgtgcctcagcctcccaagaagctgggactacaggtgccggccaccacagccagctaatttttgtatttttagtagagacagggtttcacaatgttttccaggatggtctccatctcctgaccttgtgatccgcccgcctcagcctcccaaagtgctggcattactgttgtgagccaccgtgcccggcctaaagttcttcttgatgcttctctgcattttctgaattgtcttcaataagcatccatatttaatcagaaaccacaaacatatcattcactaaatacacatcttcaatcatacagttctcagtatgggaacgcatgaaagttctgctttcactggcatatcactggctgttcatgccatgtggcaatacaccccgaactaccagatttggcactcccagccctaaccccacagtctcagacctcagcccactccctagtcctgtgtccccgtgaccaaacccacacacgcattctcctccagccaaactggtccccacatgtttccaaaccagccttctgttctgtgctcctcagcctaactctcaaatggttcagaaacacaaattcgcatgtgcacagagagagacagagacagagagaaaatccaaatatgataaaatactgatcatcattggtgaacctagatgaaggggaggcatgcttacaatttgcattgtagttggatattttcaaaataaaaagctggggaaataaaggagcagtgtagtatagtatttaagggcataaattctgcatgaaattaccttatttcaagttccagtcccactgcctattagttgggaagtagtaacattaggcaaggtacttactttctaagactcagattcttcatcagtaaaatggggataatgaaaatcctggtgtatttgtttcctacagttgcccagagaatggaatgtatgtgtgtaaagggcttggcgaagagtgccacacacccttgatcatgaactgttagtatcagtgctaaatatagaaatcaatttattaaccgtgactctattcatgatattctctacctccataagctgctcatccctggacaactaagtaaagtgctacagctttggaaacttttcttgcacggttctttttctgccactagccctggaagctgctccaatgcggtgcctgccccgctggtatccatacctccaggccctggcacagagcctggcaagggggaagaagccattaaatgcactgaaccccaaatgagaatctcaaagggttcaagctgtactttaaagaaaactcttctcatcaggaccaagtttgcacttttgctgatgcagccactctattcccatgggcttccttgagataaggcatcaccttgataaattagctgtagatataggcgtcttgcagttggcatgggaaagcaatttaatttccaattaagcctgatttctgggccaggaggttggcctacctcgcactggaaggattattctggccaggcctattattatcacgggtcatgattctcccatgaagtggactctcaaggaagctggtccttcaaccattggaatggttcagtgaggcagaaatacggcctctgtgggtaggaccctttttccccaggaattaagtttatacaagtagagtcagggaagttcaaagcaaagataggcagtctgtttgtggccaaaattgttaagtcagggtacccctagaaatgaagcaagaggggagagagagagggaggtgaggcagtcatcaatcaggcccacaagcaagagaggcgggaagttgctagtaagaaaaagacggcaggaggtagttctctgagcccaaatcgaaaagaatctgaattatcggttgaaggagacacacttacttgaagagagaacagacatttgtgaagcatcttttatgcaccgtgctgagtacttcacattcatgattgatgatacaatgcaccctgtaaaacaaacactgtgaggctcactttccaattgaggaaactgagattcaggaagattaaataaactgcccaaagtcatgaacaaggcagattcaaactcttgttttcctgagcttttctccctgcaggctccctctcaaagacaaatacaaaaacatcatttagggccataaggataatgccatactcagctgtatcttacccaccaaaattgtaagcatgagaaaaaggcctttcaaacaagtcctgagagagtgaaaataaatggtggctgaggctgcttggggcgaatgatctgatggaagagctaacaatatctacttctcttttgggtgttgtttttgctcccatctgtccctcaaggagggagacctgagacctgggcgcaatggcccagcatggctgagaggctcctgtgaggtcaggatctcctcccacagctcagactgcttcaaaccagcggggttctggcttgtggctgaggggatttcaattcagaagggttggaaagaaacaacagaggggaatgagggatcatgaccagtggagccacagaaaatttagttaggtgccaagaaggtatgacatggcctaagtttagttaacgatagtaaaagaggactctgaggcaatatgtaagcaagcatgctgtcaactcctggacaaattctagagcgcatgattaaacccatggtttgggaacacttgtgaaagaaagtagagatgaatgagaggcgggtgcatttgctgagaaggagctgtgccggtgtaccagtctcccttctgttctgcttttgcatagtgaccagttcaaggatcgctgcaaccatggtgtgcctgggttccagttgggcgtgtgatgagctatgggctggaaagcatagatttaggcaggtgccagctggcctcgtggtcctgtctgtcttggcagtgcccacagcagaacctttgtgggacattttcagatccttctgcttggccatcacccccacatctattgagacttcagaggtgtggccccagggagtcaattgagagcctgggctctgtgatggaaaggtatctggaagcatctaacaagctctcaatagttgaccttgacctgcttggcattttccacttttgatatggggtaaagacaagaacaggattcccagtggttagagtgttttctggagcaataccacctagatttgaattccagctctgctatttgctaacttctgccttggggcaagttaaatcttttccttgtgcctccattggctcattggtgaaatggagatactaataataacctcaaaggatgttgttactgttcaatgagctgtgcctggaaagatcctggcattcaggtaggtgttcaacaaatgctagcccttattaccgttaggaatgatagattcttgcacagcaagtgatcagctaaatatatgcccaaatgaaagtggctccatcttgctatagtgagttattcatccaaagaggtgttgctgcaggttgtcattgaagagaactattgtagaaagagtgtgactgtgttctccccgacaatacttctgacaccacgtaagagggttttcttcccccctactgataccaactagtttggacaccaactgggtgtcctacaatttaattcaattctgacactaactacccagagttagctcagaccccacaggttaagaactcagtcccacaagactgcccccattcaaatgccagccaccaatagggtgtcctgactatccacacttccacctgactgacagaacattcctacaacctcccctacacctccagataggatataataatttactagagtgatccacagaactcaaaagaacattttacttactattgacacttactattacatgttgattacagaggatataactcagaaacaggcagacggaagagacacacagggcaaggtatgagggatgcagggtggaggtgcagagtttccgggccctctcccagcaccttgacgtgttcaccaacccagaagccccccaaaccctattatttagggggttttatgaagatttcactacataggcatgattgttaaaccactggccattggtgattaaactcaacctccagcccctcttccctctgcagaggttgccgggtagagctgaaggttctaactctctaatcatggcttggtccttctggcaagcagctcccatgccgaagctatttacaggcccaccaagagttatctcactggaaaaaagacactcctatcgcccctaaaggacctctgtaccaaagaccaaatatctttctgtgagacaacagagagttcaagcaccaaatataaagtggagaagcactagatgatctctaaagtcttactggcacttggagaacaagtgtttgtatttgaacatgcggaatcaaaggggagttgagtaaaaggggctccagaattgacacaggaggaggactcagtgcagcaatctcatggggcgtggggacagaagacacatcccaaagcttcatgtgcctctcaagcccctgcttttgttttatgtgtactggggataggggaggttggtatggaatgatggagattatgggagaacagagtccatctaagccacttttgactctgcaactgggggagatgcagctggcctgggaaggaatcacaaacgtggtccagtactcagtttagagttgttggctttgcttccatatacctccctttctcatctcccaaatcctttgaggaagttggctggtgaaaatgtacttatgtaagtggggagggagagttgtgcaaagctaggaagaagctgagttctgcatcagaggtgacatgagaaagaaccaggaaagcactgtggagaggaggatgacccatcaactgactcatctgggggacaggatctgggagccagaggtgatggagaaaactaaagccctcctcctggcccccagtgggaatctgatggagcctggtggagagcctcacatttctacagggcacggtgtgggaggggcctggaggccttgtctctggatgcactaggctggcagttctgaagcttttcatcatcaggacccttttacatgcttaaaaaatattaaggatcctaagagctttggtgtatatgggttatatctattaacagttaccattttagagattagaactaagaatggtaaaaatatttaatttgaatttacttattttaaaataataatacatccattagttgctaacaaaaataacatatttttttgaaaaacaattatgcgtggcaaaaagtatattgggagaagtggtattgttttacatttttcacaaatctctaatgtccagctttagaaaggcacctagaatctcattgctacctcggcattcagactgttttaacaatgcatgttacatgacctctggaacattccattgcactctcataagagaatgaaaatgaaaaaggcaaataatgtcttagtattattatgaacagagttttgactttgcaagcctccactttgagaactgctacactggactgtagtgaatttctccatgtctctctgatctttctttggtcattttctttcccttccatgtgacagggcaatggctggtgaggtacaggaaggtggcactttgctcaaacagtgtcttcttaaatatttcatagaattcaaactcccccaaacacaagaccaattcaaagaatactggatattctcacataacagcctgtgctgccaatgaacaataaaataaatgcagtttgcaatgccctgacccaaggagtttaagataaattttggatgagttgttgatttagaggaggagctggtatcacttcagtaagtcacagaaaataagattatattaatatttatattgcattattttaaatctgcataatgctgagtcttcactgtgaagaaggaagcccctcacaatgattagtgaggggtagggagggagaatggcaagaagacaccaagttccttgcaggcaagcaaatagatacatcataaaagtgaagtgaaattccagtcctctgagatcttcataaatagaagaaaccctcatttctttcctcctctggttgcagcttggactgatgagctgaagctctgtctgagacctggcactgttaggatgtcccccagggttctttccaccccagttctggagctcaggtggccccttgcctctgaattccaccgctttgtctgagttctggaggacggcacatgggagaaccatccaggtgcacctctccaggtatgagtcactagtccatgagaggacaataataaatgatggaagcactagacactcattagcagagtggtttattaagaactgatgaaggttctctgctcccaggcagatattattgcaaaaaaacacgtaggcacagggtctaactccatcatgcctaaattcccattatttcatgcttatcccgtgcataaagttctgtgagcagcagacagttgtggcatttgctagaaggccagtctttattgacaggaggagaacatctatctcaagcaaatgaaggtcatcattaataatttatgggacagtgggggttaggcatcctcacatactaatttttctagaggaacatggccttttcccctgcagggattgtttgggtattctgagtttctgtgtattttagtcccaaattcaggtgcatggaaaccattgacaaaatagaccctttaaatcagactccaagttgggacttcctttcttatttttcttccttttttaacttaaatttttgagataattgtagattcacatgaagctttacgaaataatacagagacattccgtgccccctctacctaatgtccccaatggtaatatttaatattttgcaaaactatagtacaatattacaattaagactttcttaaaagactcacatgaggacctttgagacttccctgaccccagaaggaaaaaattccagggaatgatgagctgcctgcctttggaaggaaggtccaccaggtaagaaactggaggccacagggatacctctgggctccctggctggaattggcagatgctggtgcagatgccagggcctcccctcagaactccaacctgcatgagggcacctgggttccagggatgcaacgcagctccctgcctggcccctgtggctttgagtggctgtgtccctcagcccttcacagctggctctgcccctcagcccttcacagctggctctgcccctcagcccttcacagctggctctgtccctcagcccttcacagctggctctgctgagttctgtggttgagatgccaggtactggaacacacagctccaggcttgagtcctagcccctcactttacagatggccttggccagttacctcttacagcctcagtttttcatagtaacttagatagcacttaccatatgtcactatcctaggaaatttacataaaaatttgtttcatgccaaaactctatggaaagatactattatcagtttcgttttgcaaacgaggaaacaggcacagaaaggttattcgtccaaagtcacccagcttgtgaacagcacagctggaatttgaacccaaacagtgcacatcccaagtccacatacttagccactgtcctctgttgcttctcatcatctgtgaggcaggttcaggagtatctcatttttttttccaaggcaaactaattagtacagtgcctggcacagaataaataagcacccatacatgccagataacattgtcagtataacttctggaagtttctgagtattcatgacttattcttttttttttttttttttttttttttttgagacagagtcttgctctgttacccaggctggagtgccgtggcgcgatctcggctcactgcaagctccgcctcccgggttcacgccattcttctgcctcagcctcctgagcagctgggactacaggcggctaccaccacgcccggctatgattttttctattttttagtagagacagggtttcaccgtgttagccaggatggtctcgatctcctgacctcgtgatctgcccacctcggcctcccaaagtgctgggattacaggtgtgagccaccacgcccggccgactttttcttgttactaacaatagctctttttccctgatcctctccctcctcctacctcccgccctccaataggcctcagtgtgtgttgttcccctctttgtgtccatgtgttttcatcatttagctcccacttataagtgagaatatacagtatttagttttgtgtccctgtgttagtttgctaaggataatatttggcctccagctccatccatgtccctgcaaaggacatgatctccttcctttttatggctgcataatattccatgacgtatacgtaccacattttctttaataatgggtactagacttaatacctgggtgatgaaataatctgcacaacaaactcccttgacacaagtgtacctatgtaacaaacctgaacgtgtaccctgcaacttaaaatgaaagttaagaaaaaaacacacacacaaaacaaacaaaaaaaactatagttgccattttaaacacctatgatgtgtcaaacattccttcagccctcccaactatccagaaagagtccttcttttatagatgaaaaaactaagaatcaaagagatgaaatcgggcagagtagagacaggattcaaacccaagatctgcatcttggactcacaacactggaagaaacttcagacaccagcctaacttcacacccagctcaggactggccctgccgaatggtcactcacctgctctgaaaatcctcgcgacaggacgctcacttcctacaccggtagttctctggctcgaggtgtgccacagaatcccctacgcattgttagaacacagaacattgctacccccaccccgtgcagggcttctggcgtggtggggctgggacaggggcctgagagtgtgcatttctcacaagctgccacaggatcctgatgctgctggcccagggaccacacttggacagtcatcgttctaggaaaacttcctggagtgggaatggtaaaggtgatggcttcttcccattttgcccttttcaaatctgagataggcttccccagcaggctcagtgccagagtccataccctcaatttaaataacaaatcctcctctatatcatgacctttcctccagagggttgtttttcattttttgttttttgttttttttttgagacggagtcttgttctatcaccaggctggagtgcagtggcacaatctcggctcactgcaagctccgaaccccgggttcacgccattctcctgcctcagcctcctgagtagctgggaccacaggtgcccaccaccacgcctggctaattttttgtatttttagtagagacggggtttcaccatgttagccaggatggtcttgatctcctgacctcgtgatccaccagcctcggcctcccaaagtgctgggattacaggagtgagccaccgcgcccggcccagaggggtttttaagattgtgtgttctgaatggcctgtctctgactggaacccaactccgtccccagacccacttccatctttttctgtgagggggacacactctttcaacttttccaaaatggcatctaccatggcttttctgattaaaagcaaacgaaacacacccttcctataatcaaaaatttagaaaagcagcaaaaataaaaaggggataaggaagaaaacagaaattaaccaccatcccaccgctaaaattttgatgagttctcatgtgtttccttgcagctgattgttgtttggcatacatttattaatattggaattaaaaatatatatggcactttatatcctagaaaatagtaatactgtaaatgtgttctagaaatgggagctgctgttgctcttattagagaattcaaacaaagaagggaggctcgctggggacagcttctgggggaggatgggtaccgctttgagacaacagggagaactcaggcacagaggtgacgatcatcgttctctgtggggcacatagtgatgcagccggaaacaggtatgagtcagttgagtggggacaggtaatagagagctagaactggctggccttatggcctccaaggcattggggagccactgtacattcttgagcaggcaatgacttcacaaaaggatttctcaaaggttagtcctgcaacagaagacagcgtggattggactggaagagtgggagggcaggtggagaaggcattgtgctgcaagtggggagcagccctgggggcccagccagtcccctgtgccctgacaagtggtatggcatggatggatggctctacttctgggccgccaggatggacaggtactggttgctcttcaccatggcgataatgaggaggccaccggtcagcaggaaggtgggccagaagagggagaagaggagggcctggggcccgtagaggcgctggaataggacgctggtttcgttcccccgaggtgcggagaagcagtagaagacctgctgctcttggaatttggctctgaccttctccacgtcggcccgggccgtctggtaattgtccacgctgcctgggatgtaggagcactgtggggagaaacaagagcagctgtgggcttggaaatccccatttcttagccaagggcttgatatggagtaaagaaaaataccagctttgtagtcgggcccctggattggagtcggggctttggtctaaagcttggcaggccatgcgctgtacaggtctggagagcacgctctcatttgtgtcttgtgtgtggatggcggtgctggagctgctcggggtacaggctacacacctgggcgcaggtcctaccttggagtcctggctctgcttggattggctgtagaatttttggcaaatttctcactctttctgagccctgaagcttcatcacttaaatgggtgaatatcggtttcaaaggatattatgaaagaaggacttcacacagagctatctaaggaaaccagggagggacacaggccaagtgggctgtgtatttgaaatcgagatcatgtgctcaattgcctacagggctcatgaaggtattgtcagagggtgaagcaggcaaagcaatgagatgacaggtgcccactgactcttgccttggtgccaggaagaattgccagggtgtggcagggcctgtcaatagggagagagccagctgcctccagacaggcagtcaccactccctccaggcaatggatgtcaggccatccagaagatctataatagccagacctccaacactttaagagaagttagaaaccagatcacacctgtaatcctaacactttgggaagccgaaggggaaggatcccttgagcccaggagttcgagactagcctaggcaacatagcaagactttatctctacaaaaaaagttaaaaattatccaggtgggcatggtggtgtacctgtagtcccagctacacaggagactgaggtgggaggatcacctgagcccaggagttggaggctgcagtgagctatgatctcgcaactacactccaggtaaggcaacaaagcgagatcccatttcaaaaaaaaaaaaaaagtaaaatattagctaaatttaaaattgaaaacctttgcagtttcaacctgtgtacagcaaacaaactatgttggcaagcgggtatttgacactgggatccaaaggaaagaaagaatgcattgaaaagagttttgtgccagcagagcatgacacacatttaattctgacgttgattattgttattaggaactttctgccctgttcagatgaggccagctggaaagtgatgcaaagcagtcataaagcggagttttatctggttttatctctgttctgagctgcaagtgtggtgcccccatctgcagcagaatacctacagggcccccatagcccaggtccctacccactctgcatcactgagggcgagacccaggaatgtgtgattccttcatgcacttaattttgccctagtgaaatcatgtgcaagatcaaaatgtgtaaaactgagacccaaatggcaggtgttgagccagattccttgcaggcctcggccactccctggatttatatgaggtgccaccctggaagctgcctgccctgagggcattcactccagcaacacagaggagggttgcactgtagttctcacagcctgggaaatgcagatgctgcactcagatctagggccccagccagccagggagtagctgaggctggggagacgctggctcctcaggaatctggcattcagagctgttggacactgccaggtcctcagtagcatataatccagcatcctgagctgacggtgagggggcctggcctgagtctctccaatgcctctgactgtgaccttggctaacctagctccttaaatagcagtgtggctatggagtcagacaggcctgagttctgagctgtgtgaccttggcaactgccacaacctcactgggccttgtaaaatgggtttgtgaggctacctgcctaggagaactgtcatggggattaaatgagatgatgcatgtaaagcactgagcacagaagcccagcacacgataagaactcaaaaaagtggaagatgctattattaataataatatgttttgacttatctatgaaattgcaacaacagctccttctttaccttcttaaaaagaggtctatggatgagctctgaagtagaggcttctgtccatcctgggcctagtgtatcctctgcctgctcagggttcctctggatcttttatgctgggcctgtttggcaagacactgggcaggaattcactcttcatggccaaacccagaagccggggcctgaatgcatcctttctctcctgtcctgggtccagctaagcctgagttatctgaatgatctgaaaccaaccagctttttcccaagccctgcagtgtaaggtccccaggacagacaatgggagggaatttagaactcacctgctccaggctaagactcacaggaaaagctgagggcagactatggcccctaccttcagagttggagggtgggatgagagtcttcttggcccttcacagtgattccagaggacacccagctagcctggagccccagccacttgaacccctatgatggacataggcggaaggagcagctagcccacaacccagctgcttggcaaaaacacgaagggcatttccactgcttcctcccagctcctgcagcctgctatcagcaccacacctggtcaagcctgggcggcaggggagaggacagcagtggctccagcatgtccttccttcacatcctgctgacagttcattcaggggatgctcctctgagctggcaatctcaggaccagggaggcagcctgaaaaccagcctgctctggcccatatcactcccggagaatgttaccagttattgaaaatttgtttcttgcattgggataaatcaagggctactgaatgccaacgcagaggcaggggtcatgggtaggagctgcctccagtgggccctgagacctctctccaccgggtggggccgagtcatactagcgatgacagaacacctgaccatcctgcactgcccagacccacttctcattgaccttcagcactctcaagatcccccagcctccacgccccatcccaggcaccctgccccttcccgtcccatcagccatcaagtccggactgtcagcatctcccctgctgcaggccacatcttggtcgtgagtgcttgctgcggccttggctcctctgtctagtaactggacccacacacctgtaggctccatcttcccagcccaactctgaaactctgatcatgccctaaagattcccattgccaacagcaataatttccaaccttagaatcaccttgggagctccatgaatggatctctgaccagagattccaccttgatatgtctagtgttggaccctagttttgttttttaagactcttacagggttctaatgcatagccaaagttgacatatcttgagacatacacactcacattttaattccatattgtggtgatcaaaggcctctgggaacagaccttagtctgccctgacagccttttccagctgcatacaccccatcatgggtcattttctgtagtcagccctctgatccctgtctccacctagcccttccctccgccatgcctcgtcctataggcatacccgcttcctatatcacctcattctctatgccttgcatcctgcgcctgcctgatgttaaaagcctaatccaagagcctttcttttttttttttttttttttgagatggagtttcactcttgttgccaggctggagtgcaatggtgcaatctcaccaagagcctttctgatacccccatcattgtcagctggaaaacatccccctcctctaacccctgtaacttcctctgttcttctccccggtgccaattcttccctgctaggcactgttcatgcatgagctctctcctcttgagtcctacaggcttgacacaggaggtgctcaatggctgttgaataaataaatgagaggaggaaagaaggaaacaaggaaggaaggaaggaaggaaggaagggagggagagagggagggaaggagggaggggaaaaaaaagaaaagaaagaaggagggaagaaagggaaaaaagaaggaaagaaagaaggaaggaagagagacagaatatgggccaactgatcgctttaggaaaggatatggtggtgagttttgtgttttggagggggagggtgggatgttgggatgcaaggatggaaaaaccatctaaatgtttgtttatggaggttactccagccctgagtccctggtttcctggggagtcaccgggattccactttgaggatctggccctgggcctggtccctcatttgactgaggttgtagaatgaaagtactaacactaatcactgcttttgtttgagtgcccactatccactcagcatcaagcgtggcactttatatacagcgtctctgacttgataacagctcttcaaggtgcagcattagcattccactttacaagggtggaaactgaggaggtgagaggctaagtggcctgcctatgtttacacagccagttagcggcagattcaaacccaggtctgtgtgactccaacacagaagagctagggctggctcagtctcattccagctgtgagacctggtcaagtgggttgatctttctcagcctcggggacagggacagttaggaacaggctcacacacctgacagggataaagggatgtgtccccatccctccagttcagtacctgctggttctggtcccgagtgtcctccgtgtggtacagcacagcccacctgccggcagctgacacgttgacccacaggcatgggtactggggcaccttcttgcccttcagctcctcctggtccctgatgttggtctcaatcaggtggcacttggattcctgggtccacacgctgaggagaccacacacatgcacacatacacatctcagaactgggtgacacacagaacacccatttgaacccattatcccctgggagcctctagagggatccaggactgggatcctcatcttgtcttcagcatccagcaataaaggcacatgaccccacagtccccggacacagggaggaattgtagaagctggatggggtcttagacattatctatatgactggttctcaaccttggctactcttgcaacaacctggggagcttctaaaaagattcccgtgtccaagctacaccccagagcaagtgaatcagaacttcttgggtggtttggcccaggccctgggtgttttttcaaagctccctgatgtgattctgacgagcagccaaacctgagactttcttatccatatcgtcttcattttgcagaggcagaagagaaactcagaaaggtcaagtgactttgctgagaccttgcaggacctgaagctaggtctgagtgggttggagagctgtgttctttcccctaaaaggagcagatgtagaaggggtttgagttgagccaggatgggaaagatggtggggacagtctctagatggtgcttcaccagattaagagtccagcctggaatcgcttcagcgttgtgaagagtgaggctgcagcaggcccgggagaggctaacaggttcatcaacatattagtaaatcagttgtgcttcaactcccaagtatcctgtgggagacccattgccagtcagaagggggctgtcagctgctggaacgtgcccagagcacaggtctgagacttatcctaaggacaggctgggggaactgagtgtctttgttccaaatagaacacgaattaggaattcacagcttttccttaaaatctcaagtggttgatatgtcatggagcaagggcatggaccattctctgagattcctgagcagaacttcagggaagcagatgctggctcaatgcagacacatcagaaaacctcaaacatgaaatgtatgttcagtgaggcaaggagctccccgtctcttgaggtattcatcaggaggctggatgcccacctgacagggaggcttcagaggggagagaattatgcagctgagctgtaaacatctgcaattctctgattcctcctgggatcaaacttgcactggaacctttgctctgattctttgctatttcttctgagaagggcatcatgtgtctgttaccaccacgtcctagatcatgtgtctgttaccaccaggtcctagaatctcagaccagtggggctcagttcatcctaccttccctgcacttgaaccctagaacctaagaatgagcatcgtcttgaccctgctgccttgaatgagggtcaaggagaggggtgagtagaaggccagggttccttacagatgccagacccttaggagagggttggggggtgggcaggccgggagagctcagtaccttttctggtagaggggcagcacagtcgtgaccaggatgtagtaggtgatgacggcacacaccaccatggttacacccaggcaaagggctcgtgtctctccccgcttctgggccatcaccagcttcttcaccatattcactgggggcagtgatcatttctaggtccacagaagcaaacagaagtgagatcagcccagttcacaggtgatccacagaaagagaggacaggtgagaggggaaggtactcaactattaatatcactcttgtttatatttggagctttgcaacttccagaagtcttgctttttggaccccatgtaagccttccctgtgcaattgagaggcaattgcagataaaagacctacggctcagagaggtaaagtgacttgccctaggtcacacagtatgtaataggctcagtaatggccccccaagatgtctatgttctagtctctggaagctatcaatgttactttatgtggcaatgactttgcagaaatgattaagataaaggctcttgaaggccaggtgcggtggctcatgcctgaaatcccagcactttcggagaccgaggtgggcggatcatgaggtcaggagatcaagaccatcctggctaacatggtgaaaccccatctctactaaaaaaaaaaaatacaaaaaattagccgggtgtggtcgtgggagccagtagtcccagctacaggggaggctgaggcaggagaatggcatgaacccaggaggcggagcttgcagtgagcagagatgcgccactgcactccagcctgggcaacaaagcaagactccgtcaaaaaaaaaaacaaaaaacaaaaaaagataaaggctcttgaaatggggagacaatattggattatccatgtagctcctaaatgtaatcccaagggtcctaataagagggaagtgaagggagattaaacagatgagaaagctaaggtgatatgaccagggagacagcaattagagtgatgtgaccacaggccaaggagtgcgtcagaagctggcgggggcaaggaacaatggctcatcccccacggccactgcagggagtgcagcctgcagacaccttggtgattttggacttctggtgaaatttctgtcgtttgaggccgtcaggtttatgatcatttgctacaacagtcataggtcccatgcggtgagcgagcagtacatgtgcatcatccatgcacctccttccacggcacttatctcacagggatacttggagtatttctgcccagaaacagttctgtggcagggctagctgggccgggcacaggcagggaaaggagaggagggccccagaaggcagctgcaggttgtcaggagaggcaggaggtttaccatattccggtgttttttttttttgtaaggaacattcccctacttcaagcaaagaaagaagaaagaaggcatcatggtggcctcagcgactgctttcttatttcagggcttgaagccacctgggacaaagcagaatgggcacattctgctggtggttgctttccttctctcctctttctttaggcagcaactccttgtttttcccctggacattgactccaccccaatgcaagcaaagattccaccctcccctgctaggctcctgatcgctcccccaggagtgtgagtcttgacaaagacttcaagaaacagcccctcaatctatgccgcctggagccacagagatgcccagccatggtccccgcgtgatttcccatggttccgcaagctgtcctagagcctctggtaaatttatttgctgttgtttttatttgtttaaagtaaccagagtccatttctaccaaaaataccaggaagctatcaatgtaatcctccattttaggggaaattttaggggaatttaggggaaattttagccagatatcagggggactttattctccttgccaggtccctaaagtaataaacatattatggtttttgtttgtttaattagccagtgtccgggtgacaggccttagtccaaagagattttctgcaaagtgctctattttctgctcaggcgtctcttaactactagactgtttcaaatattcagagattcttgactccctccccttagccaggctgccctcatacccgggcatctccgctaaagggaagagaccagggtcaggcaccacggatacccatcacaccttcccagtgagctggtccacctcccctatcgatcggcagaggtgacatccaatgacaactttttctcctttatttggcaccaggaggtgagtttctcctgcattctaatggagacattataaaagcacaagcaagcagaaattgcccccgacaaagagagatgttttattcaactctttttattcaatccttttcctcctgttctgtgatcttgtgggaatgggagagcccatgcctttttctacctggcgtcagttgaacaagactctccatgtattcacaggtaaagcaacagaatcacctggaggtaagctaaaagccccaacagcctgcttccccaggacctgcaagggtcactggcacttggccccaccccagatactgtgagacataaatcatttgaagccaatgggaaatcccatcttggaagcctagggctgagtgcccacaacaaagccatttctctcctgggggaactggatcgcacctgtgggggcttcctgtggctccttcctggctaatcagccccccccagcgcccagggccatggcctcctctgctatttggcttctagtgccctctcaggcccctgggcactcctgaggctggtgaaggcaggaacctggttttaccagttttaggagctcagaaggaaaggaaaggagaggcttccctgtcacagagaagtctggaaacttggcttattcaggtctgacccgtctctaatggtctgatgagattgttgcctgcactgagtgagtttatagagtcatgataaatcctcctaagaccatgcgtggggttcagtgtagatatgacttcagcaagaagttagtattcagcatccaaagggagaacctttggcgggaggaaggatgggaactgtcaatatcccccaagggacagaaagaaaaggaagaagtgggtttcagctatcataggagggatttcagttagactgtaagaagaacttcccagttttgagcatttctaaatatctctgaagttccaggatatatcttcccatttagaaaggtcacttgagatctgggatagattcagagaagatggagaaggacaaaggaaggcaggactttggagtgtcctgggtgacctgatagctgggtcgacatccttttccttagaaggacaaggaatagagtacattgttgaacagtttggtggggtgtggacagggcgattctgaggtcctcagacatggaatcaaatcctggctctgccacttacacttagcaaccacatgactgtgaaacgagaaccatggtacctgcctcagagagttcagctaaagatcaaatgccatattgagtatcagacatgtatcatagcacctagccccaaatcagcccccagtaaatattagctattactactaacgaaggaaaccctgaaagtttggagcagaagtctggacccctcttgatgaatctatttttgtcccacctctctaccggtgacaagtgccagcattggtgttaatctccaggctgcagccttctggccactctgagaactgggacctagagggccagggcgcttactaccagagtaacctggccactgtgccaccctccccactggccaccagaccacgggccctccatccagaaggacagccccgagaggaagggagtcctcctgcctgcctccctccctgccccgtggcaggctgctttcccctgtctccctccagcccggtcttcagagaaatcacttcccaagtgctttcaggcccggtactcacagtcttcccggcgtcctgtgggtcttgagcagcagacagtttctttctgcctggacccccgcccccaccccaaaagaggccacagagcttcagcaggaagtttggcctccccgcccgtctccagggaagcagcttttggtccccatctggggcaagcctccatgcccaaacatggtcaagtctgagcacacagcctggagacacagactcggagagcaggtacccagccctgaggaaggcagctgttacccaagccctgcacctccatcttcccagagtctcgtgggaaacagatttcaaacaacaacagacagcaagactgagaaactacgaaagatcagcctggtatatttggaaatatttcttcttctctctgtctctgtgggctggcaaagatgccagaaataggaaatgattctccttttgttggcatgaggaagggtggagttgggctggaggggttgggcttgtcactagtccctggcatatccacgctggagcagctacagctccctgcctttggcacttacgtgctgtgtgaccctgagcaagttatggcacctctctgggcctcagtttccttttttgtttttggttttactcccaaacttatcgttaaatgacctcagttttctcacttgtgttactggcatttttaaaacctactttgctttagggtagtgatgggagttagagacggtggggatttatggcaaggggagagaactgactttttaaggaccaactgagctgaagctgggagtagtgagagctccacaactgcttccaaccaggtccagggacagtctgctcaccaggggccctcccagagaccgcgaaagtacagagatttcttcctagcaataagacaagtgaatgtcagcatttgcaggcaaaaaacatgcttttagatctctgcttcttcatctgtaaagtggaagtaaggattaaaaatcagcaacaaagggcaggcacagtggcccacgcccataatcccagcactttgggatgccaaggtagatggattgctcaagcccaggagtttgagaccatcctgggcaacatggcgaaaccccatctctactaaaaatacaaaaattagtcgggcatagtggtgcatgcctgtggtcccagctacttgggaggctgaggcaggagaatcgcttgaacctgggaggcggaggttgcagtgagtcaagattgtgccactgcactctagcctgaacagagcgagaccccgtctcaaaaaaaaaaaacaaatatatatatatatatatatattttcaacaaaacaacaaaaacaatcccagatattggggctttcctaagtatcaggcgtggtggtagaaggcagcttatctccacccttcacttgacccaagaatcaaagaacctgaaactgagacttggaggcttgaagtcactggtgcaaccctaggggccagaactagattcgaagctggcccttccagatggcacagcttggtctgtctctgatgaccctggggctgctctgagacattaaaaatcacctcgatcatacagtaagctgccacctgaggctctggaggtcaccctgagtttccccagcccccagggaggtgggtgcagcctggccttccctgctgagcgagctcaccaccttcctccctcctgcctccagcaggcgcgaaatgaaggcagccactcaggcctccctgacacactctcaggcggtgagtgcccttctccacccctttcctaattgaatcttattaacaggagactacagtgtctgtttaatgggcaccatagcaccagagggtctaagaccagcttcagaccttgcaggcagattgacagagggatgtaggatctggaattcaatctcagaagagcaattttccaaggatgatcctctgtccactcagaagcaggaaaagtcctcctggggctaatccagaaatgccaggcccccctcctgcttccctgggggagagatacacagtgcaacaggctgccatttatgagtataaccgaagggctccttgctcgtgatactctgaataagttattaagggctacatattatttggaaatcataaacaaactttagcattcttcccaagggaaggtgggaacaaacagggaaggggggccgtggggtcttctgctccccctaaatgagccacaaccaaaaggcattgacaagccctgtcctcgagggtttgtgggtgaaaacccaggtcctttgctggctgcggggttgtgtgtgacagatggctacaggtggagggcaagaaaataacaatgctgcaacaataaatattgacggtttgcattagtacggggtgtcagagatcacaaaatatcttctctgactcttccaacagcttcttaaggtactagcacaataggctcacaatagaccactgaggtggagatttttctacccatttgatagagggagtaactgagcctcagagaggtgaaataaattgcccaagcaagttactttgcctctctaagcttcagtttgtctgtctctaaaatagagataattatacctagcccctcagtgtttttgaggaatgagagatcacctaagctacctgacacatagtatggagattgtcctttccaaagatggtcacaccaaatacttcccattccatgtgcccttttcacagtgtggcatcaacactccaccatcaagaggggcattgatgtctcttccccttcaccctgggtggagcttcgtaagggcctcaatagtagaatatggtagaaggacacagcacgatgttcaaggctaagtcatagacgggggctcgagttccccccacacgctctcgggacatgtacctgggaaccagccaccatgttgtaggaagccgaggccccgtgctccagctgacagcctcagctcagatctcagccaacagctagcaaatctcaccgggcatgggagagaacaagcctgcagacagttccagcccccagcctgccagcctcccagctgaggcctcagagaatgtggagcagagacagcccacctgctctgtgctctctctgaattccagagccacaaaatccacgagaagaaaaaaactaatgtttcatgcccctgcgttttggggtaatttgttatgcagtcatagtaactggaacacacttgcaagtgatttcaaagggggactgttacagttgctggtgatagtggtaggattaaaccagtgagaattaaaacacctgagattgctatatggagtgttacaggagagtttagaaatgctttatctaggtagggcatggtggctcatgcctgtaatcctagcacttttcgagaccaaggcaggcggttcatttgaggccagtagttcgagaccagcctggccaacatggcgaaaccccgtttctactaaaaatacaaaaattagctgggcacgatggcaggtgcctataatcccagctattctgggaagccgaggcatgaaaatcacttgaatccaggaggcggaggtcgcagtgagctgagattgagccactgtactccagcctgggcgacagagtgagactccatctaaaccaaaacaaacaaacaaaaaaagtgctttatctactcttaggtcacacactatggcacaaatggaatagaagggcagtgatatgggagggtatttttgtttatgaagcacctactatgtaccagggaatgaccacatagatatgcaatacatacacatacacatacacatggacattcctctccacaatcccccacaaaaggccttgttctttctgtaaaagcacaaggcaaagtgattttcccaaggtcacgcccctagcgtgtgatgtgatggagcctggagtgcacctgtgcccgctgactccacagcccgtccctgcccctctgtcaccccatgactcccttgggagcagttttcaagagaccccaggtttcttcatgatgtctgcttccactgctttccagacaccctcagctcagtctgtacccctctctggattatgcacctgcttgtttatttaagtctttctgaatcaatatctcctctctgctgacacttgggataataagtcccataaatcaaattggcaactgagtcttgagcccctgtgtgtgcctctctgagtgctgcagggatgggtgttagtcactctcagtcctagcgaagctgtgcgttcacagacatcccagcacttgctatgcagaggctctggatacaccactgtgccgaggtgactcagacacggtcccttcactgcagaaaagcgatgccagatttcctcaactacaaaaatacagaacagaaagtgaaagatgtgttttaaatgagagacagtaataaaaggcagaggaaataacggtgggaggttttttagtagagttgagatgacaaagtataacaacagcaaaagtaaatgccgatattacaattaaatggtcacacaacaagacacgacaaaaaacatggtaaagttgttccctgctgtgtagggtgatactcactcctttttcctctgactcttttcaccatattttcccttggcctgatttttcttcctttatcctgccatgctgttaacataattgtaagcaccttgaaaatcctctttgagacaaagaggagcataaataaataaacagccctgctgtctgtctgtgtggtaaggttggtttttttaaaaaaatgctttttccttagtgcaaatcatcccagctctgtgggaaagtggcatgatgtggaagtgcagggagaagatgaggtacagtgttagcctcactgctcagagagagttgctgtaagagtggtggtggccttttcaacacacataaaggaagcatgtgccctctccttccatggcacatgtctcctctgtccttgcctcctggccagctcttcctcttccacaggactccccgctggggccttccctcgcccccagccccttagccactctccgcgcctcctgggccaggcggaagctctgcttccgcatgctgggagcaccgcatgcctcttctgcagaacacttcctccgcctgtaatttaacatttattcatgtgcatcctccattaacatgtctcctaacccaagggtaagctctctaaaatcagggactggaaccgttcttattcactgccgcatctctagcgccaggaggaataaacaaagatcttgcggttttgttgtcatcgtgctttggttttcgggaaaaaaaatctctcgcttttttacataacagaatattataatcattttcccatgccatgaaacatttttcttctttaaattgatatattatagtttcacagttgtacataaaacacttttctttcttgaattttaattatagattcgggggatacacgtgcaggtttgttgtgagggtgtaatgcgtgatgctgacgtttgagcttctattgatcccatcactgatagagtgaacatagtacccaaaaagaagattttcagcctttgccccactccctccttccttttggagtccccagtatctattattcctgtctttatgtctgtgtctacccggggattagctcccacttagaagtgagaacatgtgatatttggttttctgtttccgcattaatttgcttagcataatggcctccagctgtatccatcttgctgtaaaggacatgatttcatcctttgttatggctgtgtaatattccaaggtgtatacgtagcacactgtctttatctaatctgctgttgttgggcaccaaggttgtttccacacctttgctattgtgaatagtgcggcaataaatgtacaagtgcaggtctctttatggtagaatactttattttcctttgtgtatgcatccagcagtgggattgctgggtcaaatgatggttctatttttagttatttaagaaatctccaaagtgctttccacaggggctaaattaatttatatttccaccaacagtgtaaaagcattcccttttctctgcagccttgccagcatctgttatttttttactttttagtaatagctattctgactggtacgaggtgacatctcattgtggtttaatttgcatttctctgatgattagtgatgctgagcatttcaaaaacatttttctagaaaggctatacagttttctaggttatggctaagtcgggatagatttcatcaaagccatgttgtcagatatttaagaagggtacttgcttccctgcatgcttgtttgtgtttagcggaaggcagagtccgcctctgctatgggcagacctgttttattctctacccctgaaccacacccatgcccagatgtcatttttcatgaatggacaggtataagggagactgtatctataagcacaaagtttggggaccagaacaggtggatagagatggcaacatcatagaagtgggagatggtgacaggttggcaattgctcaaccctgtcccaggcctgacttgagccttagtgagtgagagagagcaagagagagaaagctgttgttagggcttgtgggactcagaacacaagaaatgccactttgggacctacgaagagggtgtttccacttctgcttagctgtggccttgggcagtggccctgacagataatggccatcattatcatctaaaatagctgcagcaaaggtagactcctgtgtgaatcggtgtccctaggtgtgctgcagctggctcacactggcaccgtgagagcctttgcaagccaagtgttcaaccatcaggagctgaaaatccaccacagtgatgggagtagctatactgtggaaatctacaaacaatacacatcagggcttttgtctttttggagagctgttttgccagcacaccactttagaggatacacttcaactgggaaacctgaggaggtattaggaatgaaggtgtggacaggttataggaaaccacagggaacagtgacctaggggctcgcaatgttggttgagggctgagggaagggagctctgtccaggatcagcaggagaatcttcttgagaggggatgctcccagcctggggagaccctcagggaaggaactggggaatggactgctatgctcactctcctggaatgtgttgatgaaaaagccaaactctgcaaattatttgaagagatttgttctgagccaaatgtgaggaccatgacctgtgacaaggcttcagaaagttctgagaacatgtgtccatggtggttgaattacagcttgattttataaatgttaaggagacagaagctacaggcagacatcaatgaatacacataagatttacattggttcagcccagaaaggcaggacatctcaaatggggatggattcaaagatttcctggtggattcaaagattcaaaggtggattcaaagatttcctgaatagcaattggttgaaataattaagttttgcctaaagagttgaagtcaacagaaagaaccacgaaggggggttatggaaactaaggttattattatatagatgaagcctccaggtagcaggcttcagaaagaataaatgataaatgtctcttaccagaccttagaaggtctgattagactcttagttaaatctctctgggatgagaaaaagacttagaaagggaaggggagtctctgcagaatgtagattttccccacaaatgacaactttgcaggactatttcaaaatatgtcaaataaatatagtttggggttaaaatacttgtttctttcagagcctgctatctgtcatgtgatgctatactacagtcaggttggaatttggtatttattactacaaagagtctgtttgtcatcttaagacctctgttttaatgttaatgctggtaagttgtgcctgaataccaaagggaggaaggtattttattaagaggcatgtccaacatcccctccccattatggcctgaactagtttttcaggtttctttgaaatccccttggccaagaggtgggatccattcagtcaatcaagcggcttagcattctatttttggcgtacagacccttctgcagacacctgatctcctttggttgaatccaactggtagacagacaaagagcttgttgctgcagtccccagtgatcagtttccagggcagagccagctagagagtgaggaggggtcaggaggggcttacatagatatcagtccatctccctgtgtatgtggctttgggacaggaaaactaggtaagagcaaaaaaagagggcttgagcacatggggactccctgcaaatcccccagaaatatttgtaggggtctgaaaggtatgtaggtagggactctaaacatttgtaagtcaaattttatgtggctaatttggagccccaggctggtaagagctcaggaaactcaggttccataaacagtgcctcattaaatattctttgcataaaataggttgatgaaaagagtcaaactctgtaaaatatttgaagatatttattctaagccaaatatgagtgaccaatggcccatgatgcagccctcaggagaccttgagaatatgtgcccaaggtggtcagggcacatcttggttttatacatttttgggagacatcaatcaaatacatttaagagatggcttggttcagtccagaaaggtgggacaacttgaagagggggctgccaggttataggtagatttaaacattttctgattggcaattggttgaaagagttataatctatagaaagggatgttggggttataataagaggttgtggagactgaagttttatgatgcagatgaagcctccaggaagcaggcttcagagagaatagattgtagatgtttcttatcagacttaaggtttgtgttgacgttaaatgctggtcagcttttcctgaaatccaaaagggaggagggcataatgaggcatatctggacccctctttccatcatgacctgaaccagtttttcaggttacttttggaatgccctggtgagagaagggatccattcagatggttgggaggaccttaaaattttatttttggtttacgaatgtttgcacactttttgttatttccctagaataaagactggacctccaagccaaaattctagggcaaaaggtttctacatttttaagattttggtatatatttcacaccttttaccagaataccgataccaattcttgtactcactgctggtagaggagactggttaatttcacacataatcaccaattcttaacactcttaaatttggaaatatgtgtcttttggctaggtgaaaactctttcatctgtttttaaatttgctttctttagattactagcaagattgtacagtcctttatatgttcattggaagtgaaatattttatttgtcccaaattgtgatcaggaataaataagaagcccctgttttagaccattctaactgtcctttttctctggcaagattcagaggcccaatcttcatcagctgctctaagtggttcaggtcaggaccggctccaggggctgaatgccccaccccaatccctcccagcctctcagcatgggcagggggttttgagattataaacaggttattctgtaaactttctttgctgagccatagaatgtcagccctctaagggcccttagaggtcatctaggcttgttgctggaaaagagggtcctgatccagacacctagagtggattcttggatctcacgcaggaaataattcaaggagagtcacagaggacagcgaaagaagcaagtttattggaaactactttgttacagagtagggcatcctcagcaggaggaggagcatgccatcctttgtgagtgtgtctacttgcaagaaattagaaggagctctacacttggaatgtgtagatgtgcttaccaaaggtaagggctattggtgttatcaatgaccatgaatcttttaccctaagcctgctaaccgatgttatctttaagtaaaattggctgtactcttaagatatccggacattgtacaggcttgctgggagatgctctgtatggccataaatattacataattataagtggtggtcagcttagaatttggctattttcagaccattagcattaaccttaaacacgctttgtgaatgcctgcctgctcacttcaatatggagtcactctagtcgcattttattaaaccagaggcctggtaaacaggggtttctataacaggcctacatgaccactttgtccttgagtaatgttttctatttacaaagtaatagaggtaagtcatagagaacttgataatacagaaaagtaaaaaagggggaaaataaaaatcaatcaagattcaatatcctgaggaaaccacagtcaaaatattagtggattatgttctaaagattgatacaaatcctttctaaaaacaaacttaggaatatactatacaatttaaaatgtgttcttattttaaatagaaacactttccccatttatgtaatattgcttttcaaaataccagtacttcatggccctataatagtccatcatatagatatgtcataaaatgttttactatttcctcttctgagacatttaagctattttccaggttttgctattataaactactctccagtgatgatctgttcatgtcatctttgctcacctctctgattatttccttccaacaggttcctaaaagcatgatcagagccaaagaatattagccattaaaagcctctgcctcttctctttttctggaagcataggatctgataaaatacacacctctgttctgttggtgagccatgtgagctcagacaggtgcagtgatttgcccaaagccacatagctttgttagaccagggattggaattcaggcctgtctcgacagcctctcgtgagtgccagaacccagccaggagtccatgcttcctgactcctatgccatattcttgccttattccttgcattagtccgttttcacactgctataaagatactacccaagactgggtaatttataagcaccagaggtttaattgactcacagttctgcatggctagggaggcctcaggaaacttacaatcacggaggaaggagaaggggaagcaggcacctcttcacaaggtggcaggaaaaagagagagaagcccaggggaaattaccatttataagaccatcagatctcatgagaactcccttactatcatgagaacagcatgggggagacttcccccatgatccaatcaccccccaccaggtccctccctcaacacctgggtattacaattcaagatgagatttgggtggggacacagagcctagccatatcattcctctttgtagaatatttctccactagtgagaactctcaattactgatcaccaacatgtgccaagaactgtgctaagtacttgaactgcagtatctcatttgatcctgaccctttgaagtggttactgtggttatcctaattttatagatggggacactgaggtggaaacacagcatttcttgtccaaggtcatgatgttagtaccttagagccgaaacccccattccttcttgtctgagcagtgtggtccaaacagaactttctgtggtggtggaaatgttctataactttaagccattcgatacaatagccactagctacctatggctgttgagcacttaaatgtgaacagtgtaagtggagaactaaacttttaaccttaattaatgtaaatggaaatagccacatgtaactagtgatattggataggtatctctggagccttaagtttccctgttccctccatcatagcctgactcaggcagctctgaagagggctcccctaccatccttggacctcagcctggggtgggactcagaatagccctcctaacacgccttgctaatcctgagccagagactctctctgagccaggaccttgtgcctgagacagattcttcagctgcctacagggctggcagtcccaggagctacttcctgtgggcatttacaaagacacactgcagagagaggctttttaatccccttttgttacacattaatgaaaatgtatgtctgtaatccataaataataagattgctcctgcaaagctcaaggtctacatttacactcagagtgaatattattatgaacttcactagaatcttctctgggagttctcagcagagcaccatctcccagaagactctgtctctaaggagggaagtgaaggagcataaaaggactgattttttaaaaatcagcatttaatctgggcacggtggctcatgtctataatcccagcagtttgggaagccaagacgagaagattgcttgagcccaggagttctagaccagcctgggcaacatagtgagaccccatctctacaatttcttttaatgagccaggcatggtggcgcatgcctgtggtcccagctacttgagaggctgaggtgggaggatggcttgagcccaggaagtcaaggctgcagtaagccgtgatttcgccactgcactttagcttgagtgacgttgagactctgtcaaaaaaaaaaaaaaaatccctcataatttactgagtgccttcttcatgccaggccctgcactaggcctggcacatggctccctacggtactttcatagagttgctgtgacacaaatcactacaaactgggtgggtggtttaaagcaacagaaatgtatttcctcacagctctggaggccagaagttcaaaatcaagctgtcagcaggcccgtgctccctccaaaggctctaaggggaaaatccttccttgccttttccagcttctggtagtggcaggcactccttggcttgtggctgcagcactccaggctctgcctctgtcttcatgtggccttctcctgctctgtcagtggcttcttctctcctgtctctgataaagatacttactgttggatttagggcccacccaggtaatcaaagaagagctcaagatcctttgtttaataatgtctacaaagactctttttttcctaataagatcatattcaaggtaccagaaatttggacatggacatatcttttgtggggaccccattcaagtcactatactcatcttattcaatctatataacaactctgagagggaggtgaattagccacgatggactaactgccgcaaccaccccaaggttttaatggtattatacaataacagggcatttctaactcgtgggaagtccaatatggatgttcctgcttgggaggctgtcctctaggtggttgctgggggaaccaggcttcttccatctgtggctgcaccatcctgtggccttgaggtccccctggagttatccagcaggtagactgggagcaggagaggcagagagagcatgtgaatcattgaacatctgatacacagacacattggcctggaagtgacatacgttactgatccttacatcccattggtgaggactagtcatgtggtctgcccagctgcaagggagtctgggaaatgtagcccctgaaggctcagtggcttctcagcatgagtatcacactcttgggatggaggcagggggaaagcaccacaccttgttggtcagctggccacggctgccacagtgtcattcatttacttattcttcattcatgtaattcattatttcactcatttttcagaagagaactttgaggctcaggaaagttaggtgatttcactgtcacagagcatttaagtcacagttcaattattatttattaaggggtgctgaattaggtgcccctcgttcacgtacgcctgttccatctttggatttaacccactatatgatttatctatatgcgtgccaggaacatgattggtaagactgatttacaccacctcccaaattgtactttggctctcagttctcctccctctctcatttgtccctttggagaatgggtagagagagctagagctggaaaggcaggaggcagagaggtaccagagataagagccagaaagggagggggtgacagaaagatagaaagaaactccacgtgggccagatgtcctagaaaagttttcctagtttgacatgtatgggattttggagcagattcagttaggaaagattcaagagcagaggaaaaatacgagaaacataactgagaattgtgaacatgatcttcttttatgtgtttatggaaaagcagtgactttcttctgaatttgtttaaagtccttttgtgtgctagactgtacatcttgactatgaccccatacagagggatggggctgtaggcagcatgaccacaggtccccatcagccatggaaaggccctgtttactcctgtcatctccttttactctcaaatgtgccctagtttgagtaaatgaagtggccatcctaactttggaggacagtggcttttgagtgtataggtctccttcccaaggccaagtgctcctctgggatggaagccgtggtcagcttatctctgaatgttcaggcatagctcaggccctaatgcatagcaggtgcccaagaaatgaatgcagaagccaggaagaaccgaactatagtttgagctcaggcctttacactccaaatgccagattcctcctactacgccggctttggttgaggagctctttgaacacagtgaagcaattaaagagtgactcctggtgtggagccacctgcactgcataccagagggattcacagaggggagctgcatattgtagtagaaaacagctcctaagcttcccacttcagagcctgtggggaagaagcagagtggggctgaggaccgccctccagaaaccactgtcttggtcctgcactagagcacatggcttaagtctcctcctgcatctcttgtgggcaggaggcaggggattataatgaggtcctaactctgaacacaaacatgccagagaggtttgaattagaactctccagagaggaaaattaagcttcaggttttagtttttaaaatgtgcatttatttatcagtgtaaatagcttaagcacagtcttaaaaattggaaactaataaaaaatcatctataattctaccatttaataaatgtactatgtgcatttataaatttttttccaagatttttttttccctttgtaaatggtttttctgtacatagttatcatcataggctgttgtattggttatccattgctgtgtaacaagcagcctcaaaatgtagtggcaccagatgctcaggattctgctgagtggttcttctgggctgggctaggctgatctcagctaggatcactcatgtacttgcagtcagtcggtcccaggggcctcccttgtgtcaggtggttgcctggctatcatgggtgacaggctagtgactatgccatgtgtttctcagcaggctagacgagcctgttctcatggtgacaagatgcagaagcagtagggaaagcagaagctgcaagtcctctagaggtccaagcttgaaactcacactgtcacttacaagcatttgattggtccaagcagatcatgaggctagcccagactcagtggggtaaagaaagtttatttcttgatggaggaactacaaaatattgtggccatttttgcaatctatcaggactgcgtgaagttttttacctttccatttttaatttattatcgcattatgattttttccttactaatacaaaggattcatgacattatttggatagtagacagactacagtttacttaagcatctcccaattattaaacataaagatgacttccggttctccagcacataaataaagctgcatggaacatcttgatgcagacaggtatttctgtaattttgattgtttccttgggatagactcccagaagtggattcaaccaggcataaatggtttttgatattctgataaatgaaagaaatatggattaaataatacatatgccaaattgccctgcaaaattatgctgctttacctccagccacagagagaaaagggattttcttttcttttttttttgagatgaagtcttgctctgttgcccagggtggagtgcagtggtgcaatctcggcatactgtaacctccgcctccaggtatcaagcgattctcctacctcagcctcccaagtagctgggactgcaggcaccaccaccatgcccagttaattattagtatattttaattttttagtagagacagggtttcgccaggttagccaggctggtcttgaattcttgacctcaggtgatctgctcaccttggcctcccaaagtgctgggattatcagcctgagccgttgtgcccagctgagaagagggattctcagcagcagcctggactcaggcatccttgcagggcctcctggcttctcttgattcattttgttttcctggtgcctcatgccaggaagctggaatgaagcacaactgggcagacccttccttgggcaaaagtattagtgtctgtggtcattgttctctgacagtcagttctgtggtacataacgattggttcaggcccctgtgatcttcttgtccatgtgagactggatgaggagtctcctggaccagtgatggtaacacctgcaccctgagctggggagcaggtggtatcacagacgagctcccatcccaggctggctctcacagtccctttccacagctgtgttaccagcccctgctcaatcatgtttccatgtgattctcatggaaaccttgtgtgattggcaacaccaagatttgtcccacatccagatagagactaggggctagaatacctctcccctgcccgtttctccgggcttgacatttcagccagacacctcttccacttcctcaaaacttatctgtctcctcttttacttcctcagttccttgtttgtctaaaacaccagctaactgataattgcatttatagttactatgttttcctcctagataacaagcttcattgaagattttctaaaaatatttggctctaatataagggaaattgggatcaccatgagcagtgagttggtgggagagagattgggggtacgtttatggaaaatcacggatccgtgggtctggaagttaaaagaggactggccctttgagcaaataaatgaagagtaagctggagagcttgtgtgtatagcatttgagggcaagggctctggagttcaacacactcagcctcaaatcacctacccattattggtcgtgtaaatgtggccaagttacttgactgctctgtgccttggtttttccatctctaaaatggacataataacccatacagggttattataaggattttgacaagaaatggcaggtagcaataattacacctactgaatttaaaaagtggctcaggcacaagaggtgagtggcctgttcaaggcagcatggcctggaagaccttcagcaggggccagtaagcttactagccctcatacccaggaaagcggtttatttctcctcccacatcagcatccctctcttcttcctatgtcggccccagaaggttcacaccctctccctcttaggctccttcctcattccgaggcctggagggtctttgcacagagaggaatctgcttcctgcctagagcttggagaaccccaggccttccgcattcatgaggtccaaggccaggcaggaggcaaggccatgggcccaaatctgtgccatgagtgtcaacagaagatcccaaagctggagaccccaaataaaaaccccaagagatgtgggggcatcagcttcctcagactcaacccagcaccattcagcagctttcaagaccaagaagtccatactgttctcttgctcgcaagatactcagcctatgaaatcctcagctaatggagtcctcagagcagcatggagccttgggggtgattttgaggaactgacactgggaaacagcctagggtctgtggtgcgcatggtgggcagcagcccttgcctgtccacaccacggaccagctaaccatagacgagttaagagtgacagcatgctactgctagcgggggaagctgcacgtgccatggttaaggaccccagggctgggtctgtgccccatcatgttgcgtaacaagaaagacaaggattgcaggtgctttcccacaactaaggtgggtgcagctgctgggaatgggagaaacatttatagatctaaggatgggcaggaatttagaaaggtaagggtactgtctgccttggctgatacttttatttccttctatccataagtgtaacaaaaaaatttttttaaatgctatgtaaagatagggaggtttgaaatttttaccaacaatcccaatccttgaacacaaagactattatcatatttgtgactgttgaatattttttaaagacatgttaatactacagggaactgcatttctatagaatgcactttggaaagcattgccctacagtatttataaatttcagaacacattttaggatctgccttgtgttgtttctgtcatcattttacatttgctagtcttgacttccaaccacccaacacgcttcctgagggcagggcaaacttggacattattgacagaacaagtgcccaatctgaaaatgtgtcacattcctgctcaggttccaaacatgtcatagcggatttatgggtgtaaattatactgtttgctcaaaacactacctcatcttcagtggcgtagtgacagtgaccttcaaactatggtggcatcttagctataggggtgtccctcaaaaagcatgggctttgttgaagcacaacttactctgctgtgtgacttaagtcaaatagcttaatctctctcagcctcaactttcccacctgtaacctgggcaggataatagtttttagcttctagaacagattaagggtggtaatatgagtggaccatttagagtagctcatgagataaaactcaaatgctagctgttgtcatttggctgttaatgttatcttgaaatcccacagtagtcaatagtggatggcattaattggaggagggaattgttagataaaagatggttactagatgatagaaggagattcaaattattgactggcagagaactgtttatggaagagttcttggctcgtaagagcctcagttagatagagcagggccattggagggagaccagttgcttgaatgcaagctgttaatcctcagggaatctccatggctcagccagatcctggtctgtaatctgctctcaccacgggctgactgaatgagctcattgtcatgtaatttaataggagccaggtgtctgtgatttccaagagcgtgagcagaatcatcctgcaccccaaactaggagggggaaaaacacctcgcagaagcacacttgtccctagctgctttccatgtgtcagacagagaggaaattgtccaattccaaatgcattcctatccttctcgggcgatgagagaaagtaattggcatagtttgagtgaaatgaaggtggtggtttggggtatttggtatttcttattggcataaaggaaaacttgtattttaaataccccctggcttcttgaagaacgctttctctgctgtcactgcggcccttgtcaaaaaaaccttagctgaaaagaaaaaagaatgcacagaaaaagagcagcagagtgaaggctcagtcaggcggtgggtctttttgcgtgggtatttgaaggaagaaggaaggtgctggagggaaagtcaggctgctctggaaacatttcagtcctggaacacctggtctctaaaggtgccatcaatagcacacactccccaggcactgcaaagtgggcaagcaggtggggtttgccagtgagcaaccctcagggctgcagaggcgggaggggcagtacggggagaggctctattctagggacccaacaatcagtgactgttcatctccagactcagcctgattactgatgcacccgagctcacacagacctaagaggcagatccaggatgtgaacactggtctggctgatgctcaagactgtgccattcctctgccctcatgccatctcctgaagttgaaatctcaaacttggctgtgtcaccactgtcctccttggctgggagtgggttcataatttacaaaaatccatcaggacactcccctgggaccacctgccttcagggtcttgaggcctcaaaaagttgccctcagggattagacctggggtcacaatgtgtgcaatgtgggtgtgaactcatgtgtccagttgctctcagcaagccaacaagttcaagtcacttctccatcccacggctttgctcttgtaacttgggaacaaacagtaccccatgaataagttcacagaggcagggttgtgcagtagtgacacgcacaggctcttgaggcagtctgggttccaatccacccctgccaccaggatcgccatgtagggttgtgtggcttatggcccgttccagagctccaggccaagatgacaaggggggcccagcctgtgccactctactaagccatggtccctggaattccaccgacagcagggtgtcttatgccagttctacaaagtattcacatgggcgaggcctggccctgtgtgctgctaagagctgaggaatttggttgagttacataccctcagtgtgcctcagtgtctttccctgtaaaatgggcaacataatgtatttctcctctgggttgtcatgagcattcaaggggttaatacccagaaagaacttagatcagtgcctaaagtctggtaaatactcaaaaacaagtagtaaatatctaagaggctagctgttagcatttgactggcatttttaagtgtgttttgctaaaggccaaatctgaatccatagtgttttccagttttatatgattttgttctaagatccagtgtaactatcaggaatcctgggcaaagccatcagagtgctgtgagcccctgccagccatcccgtctcatcagcctgccctgtgcagggcctcctgagtcccccactcaggggatcacagacacagtgcagggcctcctgggtcccccactcaggggattgcagacatagcatgggtgcacctgggtcccccacacaggggatcgcagacacagtgaaggtgtaccaggtcccccactcaggagatcgcagacacagtgaaggtgtaccaggtcccccactcaggagatcgcagacacagtgcaggtgcacctgggtcccccatgcagggtattgcagacacagcatgggtgcaccgggtcccccacacaggggatcgcagacatagtgcaggggcacctgcatgttgttcttgcaccctgaaatggaataggaaggctggcttttttttttttcttttttagctcatcttctgttttggaccaattaaaataaaggcattttaaataggccctgtggaaagggaactgaagttgtttccccaggctgagctctgcaccagaggtcagggcaggattaataaggaagctataaatacaaacaatggcccatgtctctgtgggcaatgtgctctggtttgggaggaagggagaaaattaaattataatgggaaaatataaattatttggatcaggataaaaaggaagaaatcagtggtgtctgaatgaatctcagtgaatctgtcagaagagttgtgaggttggctcagtgtaggtgcacaaagatgcctaggaggatggtggaacagggccccacacagacgcaggtgaaactccagagtcctgccttttactgttagccatgccccacctgtggaattcagtgctattctgagatgagagatgattgtatttgtcagattttctatcaaagtaaatatagatggtcacccacccagtgaatgtgattttagcaccttccctgttgcagaccctcccaggtactggaggtttagagggaaacagagccagctctatgttgccctcaaggagcacccagacatatcatgtggccaagatgattgcatccaagcgatgctaattgattgcagccttgcatggacctggccaggtgctacagctccttggtagcacttgctcacttttatttcatggtacctcctctccccgctagggggcaaatgtcattatgatgcccattttacagataaggaagctgaggttcaaagatatgaggggacttcctcacagccaatatgtggcagagtcatggttcaaacccaggggttcgtaccttcaaagaccaagttctcatccactgtgcagacaaatgttctgacagaggacaggcaggggacagagagtgagagaaagagagagattgtgtgtgtacatgtgtgcacatgtgtatggcagtggctctgtgtcaacctggaaggcttcttggaggtggtgatgtctagtggaatcctaaaggaaaggtcttaaatgctacactaaggaatttggattttatcaacattttttttcttttttgagcagaattcagacatgattatatccccccaacaaatctatatttaataagcaactccaaggtgccagacaatcttctaggtgcagagagggttgcagacacttaatataagatgtagtctctgccctttcctagcttcagtctagctggagagatgaaacacagatttatttagaagataataagtaacagtgtcaataaaccaatgccgagcgccaaataaaagtcagtgagtaggtgagtggaggtcagaagagggggcagtctgggctctgggttggtcaaggaaggctcccagggtagatggagagagagaggttggaggggttatggaagattccagaaagggtgcactttgagggctggggcctagtgtttggcagtactagttcccccatgcttagcagagggcctgcccatagcaagtgacggtgcatgctggctgaatgaataaatgttggacccaatgaaaagaaaggacaaacggttgagagatgaggcataacaaacggactgtgggttgcagggatgtgtgaccactgagcctctacccagcccaccaatacagtttagttgacttgtggccccaccagtcagatgaccttccttggctttccatttttttttaggtcatgcaggcacatctgtgggagaagcaagtagactctataggggaaaagcaggagaaaagatgggagaagccttgggtgacagaaggaggaagccttgaatgtgagtccaacatgttagcttttttcctgcaggcaggaggcagccattgaggcctctggacattcaagtagcaagaggtaaatgatttggggagattgatctggccctccaagggggaaagaggaaaaatgctataggagagggtttcaggaagtgactcctgctatttaaaacgtgcaaaccctttcatccagaaatgtgacttctggagatttgccccaagatcgtggaacaagtgtgaagaaacaaaaacaaacaaaaaccagcaaaatgcctcctggaggtccttgcagtgctgtcttgggtggagaaaactagaatgcagctttctccaggggtgcagtgcagagtgagggagcttgctttttctctgctgcctctcacctcagggcctctgcaccagatgttccctctgcctgaaatgcttttccctgccaggtcacatggctcaatccttatctttgctgaaatgcccccttctcagcaagaccttccctgatcaccctattcaaattttcttctgtagccccaccccctcatttacaccacacacctgccgccccaggcacccagcctcgtgactatctgacatacccttcattttatttgtgtatctcctgtccctctggaatggaaactgcagtggcgattgttgtctgttttgcacacaggcagtatcctcagtgctaaagcagcgctgggcgtagtaagtgctcagtgaagatctgttgaatgagtgaatgaaggaagggaggaaggaatgatggtgggtaaatcggcgagtgtgtggcctacacaggacattagcttgagcaccagagagcagaccaaggcaggtccttggttcctgtgccgacctgcattgcggaggactgcggggtcttggtagatgaagcctggcctgggtctttcagggccctctggctggggccaggaggcacagctgcagtggacactttcaaactcatcgtgcctggccttggcactcggtgggctcatttctggtcataatgacacctttctaaacatagctacacaaaattaaaatgtcacagtgcaaatgctgcagctgtgtggtactagaaagaacactaggtcttgagtcagaagagatggactcaaatcccaaatatcaagccatctctctcctgggtgtgaccttgcacttctctgagcttcagtttcttcatctgcaagatgggaatggtaccagtagctgtgtcacagactgttgtgaaggccgaggaattaagcacggcgagagatttttggaagctgcaaagcatcacacattggacatgacttttacacataaatatgtaaaaatggtctcctgactgcgtccttggcttcctggcctgccacatggaatgagggcagggcctccctctcagcacagactggtctcctccaccagcccagcctccccttgtcacagtgagaaggagccattgacccactcagaagccactcacttctctcttacatggggaaatcagcaaaccacaaccatttatgaatcctgcatgttcccctggtcttgtccaactgtatctgctaccattcctgagtggaagttaaaaaaaaaaaaaaaaaaaggcagagcaagttgaagatgggaaagaggtgacctaaggtgacaaagagtcaatgtagaaggcagatatgtctcatcctcgcagtgactaagattaatgggcatggagtgtcaggagccctgccttaggaagaactctgagactggctccagaattctgtaaatccaatcaagagtgttgcaatcagttagcaatgtctgcctcaggcaagggagaagaaactatggtctgtatgtcatatctaatattctcccttatatctaaggtaccctctgctgtgagacatgcaatcaacccgatgaagctttttaggaaaaagtctattgttacatcaagtttaacgtaaagctgcctccttacatattttaaggtcagcctaaaggtttctctgcacatcgtgaactatagcaagtagagatgtaaacagactgtagcctacacttgtgccgatcaatgagttttggccaatcaaatgtggccaactgtttgaaccatgttcaaacagggcaaatgctgagctataaccaacccagctgtttctgtccctcacttctgttctctgtgcatcactttcctttttctgtccataaatctttttccaccacgtggctgcgctggagtctctgagtctactctggctcaggaggctgcccaattcaaaatcattcattgctcaattaaactctttcaaatttaattctgctgaagtttttcttttatcactctattaatgctagatgttgactattgaatggatccaagtttcaggaacttacaaaatgtgtgtgtgtttgaaagaaggaaatcattacttgctatcccttctctatcaaaatctacttgagcttttcaactaaaaattcaatgcgtattctttggggtataaataaatgtgctgaatctacctgggcttttcccactctgtggcttcttgtttctatgtgtgatgcgaaaaggaagctgtggaaatggggaggagattcttccaggtgttgggaaggcttccaatgcccagcatgtagtaggtgctcagcaaatgtttgttgaatgaattttcaatgatgacctcagtttctgcataacttttcatgattcataaatgctgttaccttagctaagtttaaatgtagtattttatctcctgtcatatatatttttctctctttttctgtgagtagacgccatgataatcaatcgggataacccacgaggacgttgtttcattctttctgagtgaggggatggggctgatagaggaagccggggaggggtttgcctgctgatttcttcctgcttttgtgtttgtgtttgccgtctgcctgtccctcacatttccctcagtgtgttcctatccttggatccctaatcctacagcccaggactttctacaacggtactactgacattttggatgggataattctttgctgtggggggactctcctgtgtgctgtgacatttagcaatatccctggcctctacctactggataccagaggcaccccccacccccagccgtgacaactaaaaatgtctcaagacacaccacccaggtgagaaccactgcttagcctccccggggaacatggctggttccttctttctgaacagtttcagaaggaacatcaagtctgcaacaagtcttctgacttcatggtccacaccagtgtcaggcccaccgtcctatcaaccctccaggctcatgtctccaaggagctctctgatcattccctggtgtctctctcgtttgctgtctgcccctctcccctgggctatgagcgccacaggagttttttctattttgattatctctctatccctggggcccagaagtccctggcactcaataggttctccagtggataaaggtgaggacgaggtgactgggggagcctccctgtggagtgacgtctccatgccatgaaattgccagccctgggaagtcatgaggaagaacactccaggcagagggcacagtcaccgcacagctctcaggcaggaacaggtttgccttgtggaaggctgctggggaggagaggggagcgggattggagaagggtgctccaagagccagaaaagctagtcaggaggccacagtgaggggtgcaaactcagttccaggagtgacaacaagccctctggaaacctcccagatgtcccaaggtccacccctggcccactctcactctcctctctccttgtcgcccagcctcactctgggaaggctggggaggattcctaaatctggtctgaactcctgaggctgaagccagagctggtgtggcccccaagtcatatctcagggtgggagagagtccttccatcaaggaggcaacgctatgagggcagctcagtgctcagcccacccctctaaccctcatgggcgggccctcaatcagaaaccacaaattccaggctcagtcagggaaggcctggatcctccacttccggctcctcccggaagtcagcttaaagaaatgatgcggaggaatgatcactgaagagactcgtcattcctggtcaaaccatgctggaggtcaggggtttgttaactcagccttgtcacaggggccttcccttccacctcaatgctacgacagagctggtgttgaaggtctttgacgaaaaagctacatttctgcatttaaaatggagaagatcaggccactcagtatctccggtgtaagaagacatttggcaatagtaacagctaattttttttaatacttaccgtaactcattttacccatttcctgcctagaaaaaaaaaaagtgcagctcactgccagcactcatttcttggggcaaacaggaaataagttaatcttaacaacaaccctgtaaggtgcatagttttattatcatccccattttacagatggggaaactgaggcagtgaagtttagtaattttcccagattcactaaaatttctaagatatgtttaacaaagaaatccaccctttaactcttaaataatatcctctttttaaaattaatgctagaatatggtgcaatatctttttaattgagtgtatcttttgccccagcaattctaccactaggaactgagcctaaggaggtataaatatttagttagaaggatgcagtattatttagtatgtggaactcaatgagaatctccactaagaggggttatttaaataaactgtgatgcctccatataaatgtagctgttcaaaatgacatctgtttgtatgtaccaacataaaaagacatctaaatcatatattttaacagaaaagtccagaataatcacatttttgtaagcagtcattttgtctgaggactgggatttctattgacttttaatttcttattttcacgtgtctatagtctctaatttttctacaatgaacatgtactacatttataataagaaagaaactcaataaaagttattgagtaaaagaataagcagccagaaatctgtctcttctggggaattagtgagcctcttcctccctgagagtagacgctatggctgctttgctggaaccttccatttgtcccaaatgctccactctctgccaatgggagacggggtctatattcacctggtcccttctgcgtgaggccaccttggcagaagtcactgcccctcccaaggcatctgaccctgcaaaaccctcttgtcgtctgggttctggtaaactccccattccctgttttttttgtgggtatacagatagtaaaagctctgctgccctggccctggttttaaatgccccctggtgttttctctatacgccactgacaccttgatcatgagtcaaatcacctgaacatagagtagcatctgcttcctgttgagaatccaacgaatacatttacctgatttgctctctcttcttttcctaagtcctaacttcctaaaataaaatgactctccaattcacctgtccaccttggccttctctccttatacccagtcttgcccactagacgtcttcgtttgggcaaccacacagcttataagcctcctgatgcccaccacaggagtcttattttgtgctgccacgttaaattctctcttccatgagcaccactctttcactttccacccactccaaacctgaaaatcacctttctccacccctcctttaattttttacatctcatcagtgcccaaaacttctgaaatcaacctcagtaatgtttccttcaaataaccccttcccggctgggcgcagtggctcatgcctgtaatcccagcatttggggaggccaaggtgggtggatcacttgaggtcaggagttcaagaccagcctgaccaacatggagaaaccccatctctactaaaaatacaaaatttagctgggcagggtggcatgcacctgtaatcccagctactggggaggctgaggcaggaaaattgcttgaacccaggaggtggaggttgcagagctgagactgcaccactgcgctccagcctgggctacaaagtgagactctgtctcaaaaaaacaaaacaaataccctcttcccatcatttctccagcccttgcctcctcaagtcctcctgactgggttcccttggctccctgcttccccctcagtctgttatgtgtgacttctgggtaaaggttcttaaaatacaattcagatcctatccagtcccctactcaaaactgtgcccatgggatcaaaaccaaactctgcaacattccattcagagctttaagagtacttttcagcctgaggtctcctcctcaccactaacacccttccctccaatcaaactgatccattgtacctacaaaaagcccgtcccacctcctagcctttgttcacactgggttctctgctggatcaccatccctccacatttccaggtgtccctcaagactactcagcagcagctatccatacaagttcctcaaccctggctttcttgccctcaagtaaccagttcatcctccccagtcatatagccctctatttacatttcttttctggaagctatcatttttcacgtgccatttgagtgagtgtcctcgctaagacgatattttctttgagggcagtaacctttcttatatgtctctgtatcccatgaacttagcaaaaaacaagggacagaacaggtgcaaagtctacgtggttagtgaatttaacagatcttcctaacgtgtaaacgtcgttgtccaggtgaatggaagaagtgagctgagatagaggggacagacagagtcagtgtccagtgctgacctctgaaatggaaaaacatggccagtccttaggaggctgcagaggccaagaccccagtgaggtttgggggttccacagcagaggaggagctgtggaccacagcaggaccccgatgccatcagcaggggaggaagtaatcagagaggtggaggaaggaagccaagggaagtcaagtaaacaccaaatattccctcccggtccaatgctgtgacctgcataagccaccactcccccagtctagactctacccatggaagaaggaagaagatagaactctggatttgaatataattctaaaataaccaaatttatctgaaaatgactaggctgagttttctgcttcaaccagaaatggagcttggagtcagaaattatgtgaaattatagaagagaaagtcaccatcttccatctctgagtcgtatgatcattttagacataaaattgtgcacttacgatgtaccaagtgcttaatatacgtgatctcatttcaccagggaaactgtataattcattgctttaactgacaaaattctgcaactgaagaaggtgctgttaataattgcattgggacgcaggcctgagcaggccatgatttgtggctgtcctacatctgaccctcacagtatccatgggagaaggcagcatgtttatgccccctgacagctggggaaaccaacacttaaagtgattaagtcacaagtccaaaataaatgacagagctgcagttcaagcccaggtggtcatttaccaaaggccatgctcttttcactttgcatgggactgtgaccgctggctctacccagcttcccagtgcgacccttccccgcccactgtttctcttctctggccaacggaaacacaatgagaccacatatgtaacattacattttttcatagccacattgaaaagaaaaaggaaccaggtaaaatccattttaatatgatattttatttaacccaatacagttgaggcttgaacaacacaggtttgaactgtgtgggtccgcttacacatggcttttgttcagtctctgccacccctgagacagcagggccagcccctcctcttccgcctcctcctcagcccactctacatgaaaacaaagaggatgatgatctttttgatgatccactttcacttaataaatagcaaatatatgttctcttctttatgatttctcgtaataacattttcttttctctagcctcatttactgtaagaatacagcatattcccagctactcaggaagctgaggcaggagaatcacttgaacctgggaggccgagtttgcagtgagccaaaatcgcaccattgcactccagcctgggcaacaagagcgaaactccaactcaaaaaaaaaaaaaataaaaagaatacagcgtataatgcatgtaacatataaaatatgtgttaatcaactgtctatgttatgggtaagtcttccagtcaacagcaggctattaggagttaagtttctggggaatcaaaggttatacacaggattttgacggcatggtggttggcactcctaactcccacatcgttcagggtcaactgtatattcaaaatagtattcaaaatgtaatcaataggaaatagtcattcatgaaatactgcgtcttcttcttctcccccccaaccccacttctttgtattcagtcttcgaagtcagtgggtattttaaccttacagcatatctcaattcagattactcacactctaaggactcaatagccacgtatggctggggtctgccagccggacagcgaggtctagccctgatctgagcaggagccatttgattgggttgttggtacactgccatctggtggacagatgttccttgcttgaaaaaccacctcgaaggaaagtatcagcatcagggacaatagcacagtgggcctcaggatcagctccccggaaagagcttggggttggagggggtgttgttgctgaggatgtccccagagaagatgtacagccatggagcaaactcaagtcacttatgatgtcggcaaaccttggccgtggtgcactcttgtttcctggttgcaaaaggatttagcagaaaatggtaactctttttcagaaggcatatttaaagcagctctttaaaaagcaggagtttctttcacacccagtttcgccatgtggttgtgtgaagggcttctccccagaaatcatgtggtctctcttttaattcacagtaaaaacctttcttctgtcttggcccattatggctgctataacaaaatatcataagctggccttatataccatagaaatgtatttctcacatttctgaaggctgggaaatccatgattaagagttggtgtctggtgggagcctgctttctggttcactgatggcgtcttcttgctgtgtcttcaccgaggggtagggacaaggcagctctctgcagcctcttttctaagggcactagacctatttgccatggttccagcctcatgaactaatcatttcccaaagtccccacctcccaacaccatcatcttcatgattagatttcaatatatgaatttgggagaggatagaaacattgagaccatagcatctgccaagttgtgtcttcctcactcaaattgggtaggtgtggttattccagagtttcagtgaaccaagacgtatttttccaatgtgaataattaattaagaacacttgattagggtcaatgttattctggacttctgaatcactcccacatttgaaggggagttttaaacacaactttgtgtgaataaaatgatgtgtctgcatctctccaggaagcagtgtttggagctgagatgacttggcagggagaagaatccactgggacattcaataacttggcattgagagtgttttcagcaccatgctgtcctcagaatagtgttagaatttatataaacacagatgtgacttgtgccttgaaggagaatacagtcttcccaggagagacatgcaaaaccatcatagacaaacagcaagaaaacagcatcaaggatgtacatgcaccgggcagaatgtaaactggatgtaaaaccaagcatttgagggcaatgagaaaggaacttggttctggtctcaactctgccacccacagctgcgtgactatgtctctgtcacactgcttctcaggtcttcaactttatcgtctcatactgagcaagagacagtctggacaatttatgcttctagaatggggagacaagaagaaaagaaagatagatacccaaggacttcagtgactggctcaggaagaattactcagcagtgagggggccagcatgagcccaggggcaagaagccgggacttggaacaggaaggaaaggtgctcagctggctaacctagaggaaagtgattggctggagtgtctggtttatctgtttcagggatggttaaagattgccccgttaataggcaaaaattgttgccttaaagaacctagaatctaaaggggtctttgacataatacagaataacaggtcccagagattattttacagaatgttagtacctcatgatattaatagatatataacaaaacagacttctttgccacaagacttctcagtacctttaacattttatgattttcccaaaggacaaagagtatgcagcatttcccagacttaaatttaactgtgaacacctgttatcctggggcaggcggattgcttgagtccaggacttagagtctagcctgggcaacatgacgaaaccctacctctaccaaaaatccaaaactcagctgagcatggtggcatgtgcctgtagtcccagctgctcaggaggttgaggtgggaggactgcttgagcccaggaggtggaagctgcagtgagctatgttcacaccactccactccagcctggacgacagagcacaaccctgtctcaaacaaacgaacttcagtgactggctcttaaaaacaaacaaaaacctcacagaaccctcactgctctagtcctgactttttatagatagggaaactgaaaagctaagaggcaagtccaaatttcacaaagatagtggcagagccaagattggatttttggtcttttgactctaatacccagtgaatttctttttctttcttgttttttttttttcaattcctattatacactatttaagacacacaaacagataaaaagactaatacaagatatccatgcaccaccacctagtgtaagaaataaaacatcaccaacacaataaaacccccttgtgtacctctctccatttgtctccccaagggaacccatatcctgaatttggagatataatacatgaaaattctggtggaatttcaaataagtcatattgtctttagaggatcttcttagcatctcccatgatgtctaagttgtttcaaaacaaaaccaaaaaccccacttggcccagaagagcaaagattaaaagccagcctcgaggatccccagcttggctacctgcagctcacagcatattggaaaaattttatgaatcggtgaactttttcattctcaaatgggctcttcagatggtttattaattctgttagatgcgggggtgcgtctggctttattctgtgtggaatttttggatgaattcactgcctcaccccctcccctccacaggccagatggggagccgggtgctgtataaatgtttaattgtggctcagtaaaaatatttgctttcagtagctggaagctaccaaacggaggtagcgctgtctactagagttgccagacttcattctaatgagaacagaaataaaggctgattaaatcaaattccccatagtgtagaaccacttaaataaatgtttcatattgtttgcatgatgattttaaaatgtaacagctgcttatgtaaccattaggctggacataaatcattcatcgccatcactgccgtcaaagcagcactggctctttttcttctgctgctgacatttccattactagggagcttctcagacatgctcttgggttccctgtccttacccaagtgcggggtagcaggagactgagggagggatgaggaatgaagagcaggcacgaagctgccatttatcgaaggcctactttgcacatgtcccattgggctggcattgtcacatttcatccttcccacaaggaggcattactgttcccattttatagatagggatgctgaggcctatggaaatgaagtgagctgcccccagagtagggaatacagcctgtatgtgaactcaggtgtgtctgagccttggcaactcacacaaggctgcccgagaacaaagggtgcatcccaccccgaggctccacacacctcaggccttttagcaatgatgagagcagtgaagaccagaccaagactcagaaaactgcagaatcctttcggctggggctaggggtggggcagggtagatactgatccaaaggatttggactccttttcctagtccaaatccccatcgtctctcccctgttcactgtgtcagcctcctgactcccctgcctccattcttgcccatctcaatccatcattcacccagtagcctgagcgatcttttaaaagtagaagtcagattatgtcattctcctgctcaaaagcctccaatggcatcccaccactcttagaataaagcccaacctcccaccatggccctcaaggccttttatgatatggcccctgccaacatttgctcattcgttcctaccccactcctttatctgggcgtcttggcttctttctggtcttcagacacaataagctcatgcctacctaagggcctttgcacatgctggaaccatcctcctcagacccttcccatgactagcttcaacctgtcattcagacctcagctccaagtcacttcctcagaaaggccctccctgtaccctggattgaaaacagccctcccctgcacacgctccacaccatagctctgtttcatttactttacagcactgaacactgtctctatttcttatttgctattttcctatcccactataatgtaagctccatgacagatatctgggcggttctccactgcttccccagccctagaatgctgactgtaatgtagtaagtgttcaataactattacttaaataaatgaattaacttgtctcattcttttcccctgcatccaagttgggtgaaccctgacctggccccttgaaagagacaatttgattctgaaaaccaattcttacctccaggctcaggccccatgcaggagtctttctccaggtggcctggccatgcaggtgatggcagtcatggggggaggcagagagctgctggagaaaagctaggaggccctttggggttccctgtattcataggaaggaggatcccttggatccatgcccccaactctgcaaagctgagtctaaaggatacacagaacacaagacatccttctgttgccaccaaagcttctgacaccccattttggctggagagagacttgggcacagttcttgaattggctgcaactccaccctccctcctgcaagtgcctcttcctctgccacggaagcctctgtgccatgaagaagaccaccagacctctccaggtgagggctctgggtgtcagtcccctacgccctagcaagatctggaaggcaggagccaccttcctgcaggcaggcaaggtcctggaaatataaggttgtctgtggccattgaccatcctactgcttcctggtgacagaaaatgttgcattggtggcagccatggggacagcttcctggttcctgaattgcagcactggtccgtggcatgctctaggactcaggcattttctcagcagcttttgaggtagtggccccgggcaggtcagtttggcagtgtgctggggattattcctggaggcccagcctggtggccgcttctccagcccttccagtgatttggaagcggctggttccttgcagtaagtcccttcttcctcgaaccactgactgatgcagagctcctccatggtagggactggttctcttaggcccctgtatcctcaggcccagcatgcttgggaaaatgtttgctaatgctttgtgactcaaaaggaatcacacacacacacacacacacacacaaacacacacacacagtttttaatattatcagtcatatcagccccctgaggcagctgctctgttccagacaaaccctgttaataacattcttatcctctttgtttcattttccagctcaatttggaagcctgaccttgtcttgctttgcctcctactgagagttaatactgggacatactgaagggcgaaggcttgagtcacaaagtcacagggataaatcctagatccagcagttactgtctacatgacactaagcagattagttgccactgggactcagttttaccagtctgcaaaatggagctatcagccgcatctagcactaggggcgctgtgagcatggagggcagtctgcacacagaggcttaacacagtgcctgagcttgcaggtgcttggtaaatggcaattgctgtcagcattgtctgatttacctgaaggaacagttcacactccacccagattttcactgcagcagccaagaaagaacttctgggaaagcatctgcttccacccaactcccaagaggggttcgtagagggtggagctgagagcccgcctcccctaccagcctgcagaaagaaagccatgttttggcctcagggaggagaaacccagataaaaaccaccccatgtgcagcctttgcgtggccacaggaccagctccacagggagagggaagaggcgcggccgcaggaccagctccacagggagagggaagaggcctcctttcaggggtggggagctgagggcaagacagaccttttctgactcagcccaaggagggctggagcaggggctgcaggttccctgctttctgctacaacacagggtaggggagagtcatggcctcccagagcctctgcaggttcacctgccaaatggaaataatagcatcctcctctgcaagtcacagccttaaagaggtgctgagagtcactagttagacccaagccagctgtttctggtgcattaggactatcgaccagaacccctgcattcccagcccctcctgcggcctccaacgaccaggagagaaaggcgtaaggtgtaagactctgggccaggttctggcagcttatggccactcttttcttgtgtctggacaggagcattatagctacaaccatctcatctaatcctcactgctgccctatgaggcgggcattcttatttccccagttttgagataggcacagaaaggggaagcgacttcccaggttcacattgccagtaagtggtaggactaggccctgaaaagcacagcctgccatggggaagagaattcatccccagctgagaaccactgtatcctcacccaggggttcccagccaatgcaaacagggacgtgaccagtctccactggtcccctgtaccaggtctccaccttgccggcctgctgctgggccccaggactgctcccaggctgcacctgtggggtctgccacctcctccacttccttttgagaagctgctcccaccccttcgccttcatctcaaaggaaagtgtgctgccaggcagctggagccagatggcccagagacaactcttcccatcacacttcctgcagcatctgagtccaacccccaactccagagctggcaagctgcccagagcctcccagaggaggcctatgggttaacttcacatttagtattttcagcatatggtagaaagaaaatagtgttgttagatgtacaagtgtgatttcccctttccagaatgccttcctctctcctccacgtggtgagctcctattcatacttcaaaaccatgctcaactattccctgcccacctgtttccttccactcctccccttctaatgtgggtgtgtcccagggacaacatctgtgttcctcagtgaagttgagagaagcctaaatttgctctacataagaaaaaagaataaggaggtaaactggaaacgggaggaggctgggaaacgcagggttggtggaaggacttgtggggatgtcgtggcagccacctgagggtaaggaacgtgacagccagagcagctatgcttaaggggctttgccacagtgcgaaagataggatacaaggtcctcttcagtctctccatgaaaaccacagtcaaagtacacattactcacccatgctttggagctagatttgggcttaatgctgtctttttttttttttattaaaacaatattccaggctgatggaatttaacaacaaggaacataatatctgacacaaacatagcctaagccttgatatttatcatcttatatagcaagagatcagggtgttgagaactttagagcagctccgttatgtccaggctctgggcggtttctgggattctgtctgctgtcccatcagtactcacggggtggctgtgtctgctacagacatcatagcctcacgaaaccacctacactaaagccaataggaagaaaggtgtgtgtcaccttcaccttcccaccctttatgggggaggaaaatatttgccaagtgacccacctttcccttctcaatgcccctttgatcaaagcctggttctatgtccctgcccagctgcgggtggtgctaggaaagaaggtatctggggtttgacagtctgctgtgagggctaaataaaaagggcgtgagaggtctgccctctgcttgtactcctctgctgagggagaacttgctgcttctggataccaccctttcccatcgtatgatagcctgaagtgttcagaacttttcccattaaatcacttgaacccgggaggcagaggttgcggtgagccgagatcgcgccactgcactgcagcctgggcaacagactgagactctgtctcaaaaaacaacaaacaaaattgactttctcccactgagcccaaggtgctttcctggtaacttctctttgacccagtcctgcctcctgcatcttccttcagcaaccctgttctccacatcagccaccagagggaacatcttaaaacacagggctagactgggcatgccgttgtctctgctaaacccctcactgagtccccagtgtctacaggataaaatccaagcttcacggcattggaggctcaccacagtcctacttcagcctagtctctcttccttattcttcccctacatatatatgtatatatatatatattctcatactgtaggtgaagcaactgaaatgctttttattcccctgacactttttgtttttcaaattcttgttgtacaaatttatgggggacatctgcagttttgtcacatgcatagattttgtagtagtgaagtcagggcttttagggtatccgtccccacaatgacgtatattgtacccatcaactaatttctcatcatccactcctcccccacaccctcacccttccaagcctccattgtctattatcccactctctacatccatgtatacaggttatttatctcccatttatgggtgggaacatgtgatatttgactttcttcacctggcttgtttcacttaagataatgaattccagtttcattccagttgctgcaaaagacgcctcacagaattttaaatgcttatatatatacatacaccccctttgtatttgcctacacaaaactaacaaacctttgtgaaatgtaacctacaggaaatatgatcatgtctaatgctggacatgaagcagatgcaatacacaaatccatgaggtagacccaggtatttcagatcctgaccttgatctcaggtttacttattagaccacagaccaaagactcccactgatgtccccacagatttcaccacttattcctcttgtcccacacactctactccaaagtcaccctcctctagaggatagtcacctgagatacttcagcgaccctgctcaccttggaaaatcaggtgacaggaatcatcagttaagcctgtggacagtaagcatctgttggtctggatggtgtggtgggcggaaggtaggacccaataggggcttttcatggttccagccccaaacctctgaccatgccagtgcatgctgaaggcccccattccatttatggtcggggccacatgatttacatttactgtctcaggttcttcttgtaacactgtcttctccaatttttgataagccaatgcccctgacacttctatgttttgttcaaattgttctacttgcccagcattctcttccaccttctccagctgtcaaactcctacacacccttcaaagcccagctcatgggtcctctccctgacaatgattccagctgaaggagatgacattgctacttccttggctcctatcatacccggtatggctagtgtagcacttaacattgcttggtgcttggtgacattcccaaacgttcatctgtcctcaaggatgggaacgtcctcatttcccatcatttaggaagtgcttgctaaaccaaagactcagcccctcatcaggaaccagtgaaggacagagctgggaaagagttgtcatgggcatggggactatgtgaggtcatacgcagttcctgggtcacagaggtgacccacgaatggtagctgcagcgttgattgttgcccctactattactgtgttattactgatctcagcccttctcttaagtgaccccttcactagtctcatagatgagcggccagcctgcctcctggatcccagaatttgctcactgtccacgacttcctgtcatggctgggaacattcaggcaggatctggtcccactcgtaggaggggaagacaaagagtgccatccctccaggccctcccctcctgcaggacagatcatcctgcctcactccatctgcagatgctggcaaagcacattccagccctcgcctctgaggcagagaaacagattccaattaagggacttgcggaaagtggcttcattttacaagcaattgggttgtgaattgaagcgggcattaaagtttacaagctaggctggcggaggagccagaaggccttgctgccactgcctgtcaggagacatcttctccagttactcaacaattgtgtggagtgagtgaggagtcggcacgaatcctgccctccatggctgatggtggaagaaatgtccattcattcgtcttcttaaaaccaaggatcaggctgctggagggcacaggatcatctctctcctgataggctttccccttctctagccttatgtgagaatctgggggattttaggtggtggtgagaaaatggggaaagaaatcacattcgttgacctctgcttacagctgggatccccacgcagctgagaaatttccaggaaattacctgggttcaatggaggaacttaacacttcaagctgtcacctggtgggaaagggtggtggcaagaagtaacaagatctcccaaatggatccaaccagagagaaggcctcctcatttccttctcagccaagcccacgggggccctggaagacagaggttgccggggcatccagggtctacacgggctgagctccccagacctggtgcaagggggccaggcattcccgccaaggctctgccacctacccagcaggacccatgagctcagcacctttctggacttgaggagatgggtctggttttggccttttccctccagacttccttctgtctctgcctctccactgacacctgcctctgctgtcccccaggacattccactctcttctctaaggctcaggcctgaggggttgctggtgggcagattccatctcatggttgagctgtttggcctcaatggcattttatctctctctctctctgtgtctctctctttctctttttttttttttcacattgagccatcttcttacagctgaggttttcatataaaaaagcaagttgctggtttctctttaaaagtagggcaatctggcagttctgggcttgtgtaaaaacaattcggtagagctaaaaacaggggcttctgataaagcctgagctcccagcagccaaaggacttatcaccccacaaaaaaatcccttcctgcactcatttatatcaacccctgcccctgcagacacgtattgtaggttttaactagaaacaagaggattagctttatttaaacagcaaaactgcttaaatgagataatatatgtattgggaatggtgcctggcacctaacctaatccttagttaattaatatttattgagcaaatcatcttgattattaaaaagacaggccagctggacacaataagaatgctagctcagagctggcacttgagggttcggtagaatattcatggcttggaggtgggggctatgatacgagcccatataatcagagaagttcagatgggaaatgagaaccacttggtagcctaaattcagagaaactaaagccagcctaacgctctgaagctggcaagtgttcatttttggaaatcagaaagtgatgatgtgttatcccaagagactcctgggacaagatgcagtgagcagccattcacaaagactaccttgaaccgggctctttccctacattttgttattatatcctcgctacaaccttctgaggtggaaattaatatccccattttacagatgcataaactgtctagtgagggtgacagatagtattgacatgaccagaagaataaatataaatgagataaattctctctgaaggaaaggaatagggatttacaatggtgtaaaacaaaggaagtggggcctggtctaagcgatcagggaatgtctctttaaagaagtgacatttaagctgaggtctaaaggattagatgagtgttaaataggaggagactgggcaggagggaaatcttctccatggctctcaatccagacacacaatttgaaccacctgaggttcacaaacacaaagaaagtatcgtgacctgatacagtcccagtctaattaaatcagtagaacccaggtgccgatgtttttgtttctttttattttatttattactattttttgagatggagtctcgctctgtcacccaggctggagtacagtggcacaatcttggctcactgcaacccctgcctcctgggttcgggcgattctcctgcctcagtctcctgagtagctgggattacaggcgcccaacatcacacctggctaattattctatttttagtagagatgggatttcaccatgttggtcaggctggtctcggacccctgacctcagatgatccgcccgcctcggcaccccaaagtgctgggattataggcatgagccactgtacctggctggtaccaatgtttttaaaagctttatggttgaaccactgaaatgaaacaaaaagtaaatccaaagctcatatactctagccaaacaatagccattaatagctattaagtaaatagaggagatgctcagtgataatgagcaggtagatcatcagcatccttgtcatcaccactacatctgcctcctccagatcatttggtagccaagtccaatgtcaaaggaataaaggaaatctgcctctgttgagggcttgctgtatgtcacgcactatgctaaattcttcactgtttcatttaacgtttaccgaaacccttattattttacaaatgaggacgttgaggctcagaacaaggcaccaatttacccaggatttcacagctcatcggggcagtgggggaccctcttccaggcccacctggctgtagagaccacactctttcctgtctccatgcagaggggcctcctgctcactttagctcccatttcccagcctgactgccttgattgggccgcatttctttgttctgacctcaaaaagagttttgtagatttgtgcccacttttctcatcacgcttaagaaaagtgaccaaagctgaaccaagctatctaggttcaaatgctgcttactggctatcgggccccaaactatctgtggaacttctttgagcctcaattttttgttttctataacatgggaataatatcagtacctccctcataagtttcttatgaagattaagtatgtatgtgttaagattcatattaagtgagaattacgcatgtacgcatatacatacaagattaagtatgtatgtaagcatatatatatacacacacatttagaatagagcatgaaatatagccagtgttcagttaatgtcaagtattgttaatattatcctatgggctggagtgagaggcctcctggggtgtttgctttccagcccccaatcgggtggcatcctggatagggtatcatcatacctctccccaggagatcaggatagggaattgtaagagcactcaggttggaggtaggatgtgcaccagggaagctcaggcaggaagctgctgtctttcctggtctctgcagactaggagcagcagccagggacctgggttgactgggggacgggtcggtgggtggggtgagatgactatcacacctcctctaaaaacaagatggggcctggtgcgctggctcatgtctgtaatcccagcactttgggaggccgaggcggatggatcagttgaggtcaggagtttgagaccagcctggtcaacatggtgaaaccccatctctacttaaaatacaaaaatcagccgggcgtggtggcacgagcctgtaatcccagctactcgggaggctgaggcaggagaatcacttgaacccaggaaggggaggttgcagtgagccaaggtcgtgccactgaactccagcctgggcgacagagcgagactccatctcaatccatctatcagtaaaatacaggatggaagggaacgcccagctctcagtcagctgccagcccacggccttggacgccactgatgtgagcctgtctgggctggggcagaaggggccagcgtcaggtcctcagacaatttcctcctggtagcctggcctgaggcccacccaacccagggagccggccctggccagttgcagccagtaccacctggtgcccagcagagggcagcacaggccacaggctggctttttctaggtgaaattttgctacaacgtgtagcctcttgggttcggtgtctcccctgtacttctttgcaggccggagaagtcccggacattatcacagacaccctgcctcatccccagcttctgaggtctttctggactctgttagcatatttcagaggttcactgcaaaccagaaacgggactttgagcttgtgttccagggcagagggccccagcgcctgtaggtgcagacagcgcacccccaacacccccgagtttccgcctcctcatctggagagcggggctggacaggatggtttttggggcttttttgcaagctcaccggggccaagtgagctatttccccttgccattctctcccaggaggagaaggcataagatgatgctgaaggcacaggctctggaagaggacagggccatgcttattcctgccttgttatgtgattatggacaagccttcactgacccttggagtgatggataaaatccgtaccccacagggttacaggagaagtaagtgagggaccacgtgcacggagcccagcaaggtgctcaggaaacaatgctattgtttttcaggttacatcttggggagaccacccagaggaccttctttcaaggacaggtacctggaatttctctccctttcctacatcatcttcttgttttcatgcgcagggaggccaccactacctgagccagaccactcccttcttaagccagggcctgcaaattgctgcagcactgccccctcgatctcaatcagacacccacattcctgcccaccatgcccaaagcccttcattgaccaagaccctggcctcgtcccaatcctctgtaaagtacacatgcgtcttcaatccaccctacaggactgtggagccgagaagatgtggggctgagcatttacctttccataagttctccagggggttctgaggcccacagaatcaaagagccactgctctaggcaatgagatagtattctaaaacaattaatgaaggcccatgatggggacaggagagccattatgcaaattccggccattcgaggttattaatttgcaggagagactgtagacgctgggtaaagaatgcccacaatattaggcagtcaggaggctaccctgcagggcctgttcctgctccgcctggtgagcagaaaggtctcagggaccagctttaaaggatgacaggcctcccactgggtcacagggcacagctgccaggactgaggccagaatgaaggcgatcgcccatccggctcagtggttctcagtcttgggtcagcactggaatccccaggagggaacacggaaaccccgagagctggctccgcccctagagctgacctcagtaaatctgagatgaggccagagaaattgcatttcgacaagttcccaggtgttgcagcgcaggtgtgtgcatgcatgcatgcatgtgtacttgtgtctgtgcccgtgcatgtgtgtgttcccctgttttctgctttctgcagtgttttagctcagacttcctgattggggtcccattcttgaccagaggcccagtctagacctagaagaatactaatacatgcccagctgtttagagcccacaagccctctcatggcccttgtttccaggccccataacagccccataagtttgttttaaaagtgcatctgtaggggagaaaagatttctttcctcatccatcactaggttcatggctgaggcacctgtaacaaaagacagactcacaagagaaaagcaaccaagtaatttaagttttgtgtgacatgggagccttgagaaatgaagacccaaagaaacagggacatctatgtgattttttgccaagtttgatgaagaagcagataattgtggagaagtataatcggaaaatgggggtatgatttgatggtaatgacctaagtggcatttggaaggcctgtttcttcagattcttctctgcgtctctgcatcttcatagagaaggactttccttccctgtgggtctagggaaggcacctcttaaatgaaggtttcatgacccacttgagaataaattcaggaaattcttttatggcctgcttcaggggagaagggcaggagaaggtcagagagcgaccttccttcttctgtggttttctcaaatgccaaggtggcagatctgggacagtgtgtcctgaactccctcacaaccatggctgtctgcaggccagtcactcaacggccatgaatgtgtattgacttgtgagatcctccaaacaaaccttcaaatctctgctcacccccatttgagagaccagagatgagccaagagacatgaagcaaccttcccaagggagcagagccaagatttgaaccagggctgttgggccagtgagcaagggcttgaaatccagtgcagcacaggtatcttcctcagcaggctcagagacaggaggtggaccggccggagcagaacggaccctccccttcaaagcgggactctgcccttgagccctgagcagccactctggacagggtccacagaggaaggcaatcctccagcccgccatgcttcctctgacctcttccctctctcagatggaactgcaagaagatcccaaaccatccaggtttcccctacctctgggcctttgcacagccttcagagcagccctgaggtgatctcctgggccatcagcacatgaccgaacaaaccttgggccaccaagctccttccccggagttggctctgaggccaatcccccgatttcacaccattttaccattcctagccttggtccctccacagagccccctgtttgctccccgctgtgcttcctggcaccagcctcagtatttccagaaacacatgcagagactcaaggcttggaggactggctttatcgagaggctctggaaggctctctgaccccagtggaatttggctctctccgtccctccagatgttactcaggccccaaaccttgcccagccttgttagtggcttctccttcccacacaggctgtgccaccccttctccctcagcctggaccccagaccagtactgagcttttcctgtcagccccttgggtcactgcagacaaggctctagtgttcaaactctggcttgagctcagagcagggcccactctgggcttgaaaatacctcgtgtggggacagcagggcacactggagaggtgaggagggtctcctgtcctaggctgaggagctggcccagaggcagccctggcctcctcgccactcccctgaaatcaattcctcatctgagggagctttctaaaataaaatttaaaaattgcccacggacctgcccagcttaaagcctttgcaaggctgctcttgaccccagcatgaaacccaagctcctctccatcctggctgccaaggccccaagccactcgcccagcccaccagcctcaccacactcccatagacttccccactcttgggtgggggtgggagggctacacgaagctctaaagtcagcccgtgctctttctcacccccaagccattgcacagcctgctcccttggtctagaacactccctgtatctgacttcgacatgtttcttcctccaggaagccctccctgatgccccattccccctccaaggactgcccagcatctggagcaccctgtaccgagcggcacactgtggtgctggaaacatccttgttgtactcctctgtgcctggacactgcatgtgggcctgtccatacgccacccagacccctcgggtacctttcaccatttctgagcactcttcccctggcttctgtgtgtttttgcttctaagaatctgttgggaagaaaatattccctctctatcaacttagatcctagtggtagggtggagggctacaaatcaactgacaatggacagattcacaggagaaaaaaacaatcagttgtactcacatgcctggggaagactgaacagctgggaataagggcttctatacccacttaataaaccgggtgaactgaatggggttagggctgctgtggaggcccaggaatcaatcagaagccttcagctttcacctcccatcccccgttccctgaccccatgccaccagatgcaaataagaaggaaactttaattccacaaattgaagcatttatgaagctcagcaggcaacctggcaggcaggcaggcacaagtgaggaacaagggccccgggctgggctgccttccaggcaggtcccctcgacacaggccactgcagctctctcctgcaatgtgtcaggagagcctggcacaatgtgggggacgggggcgggggggtgcggagcttggcaccacctggtggtctcagctgccactccacacgtaggaggctggatgcctgctggggcagaaggcggaatccagcctgaccacttagtggggctcatctacgcaagccttgggagcagtggcaggctgctgtgaggggcgcgctagcctgaggaaccctcagcctcagtactcctgggtcgagctgcaggagcaggcctggcaagtccctaaggcttccagcaacattccccttccccaggcttggcagtgccagcccacaactcagtcatgggacaccaggtgggctcctttcttgtgggcctggggcagtctgctgagaagaagtgggcttgcagccttgagggggattagatcctggaggagaggcccatcccttccttcatacaaccggggtatggctggctgtccacaggcggccatccccgtgccacaggctgagttctgtcttccccaaactcacgtgctgaaggcaggaccttgcaatgggactgttcttggagacagggcctttaaaggggtaactacattaaagtgaggtcattaggttgggccctcatcccatgtgacttgtatcttcatgcgaagagaataagacatagacacacacacaaaggtaagaccacgtgaagacacggagaaggcggcgtctgcaaaccaaggagagaggcctcaggggaaaccaacctgctgacaccttcatctcagacttccgggctccagcactggaagaaaatgaatttttgtttaagccgcccagtctgtggcaccttattatatcagcctgagcaaaccaatacacaagggcccagatacctaaacagaaaagtgtgataaggccatttaaaccacaaatacacagcgggggtcccagatcccagagcagggtctcagttatttcacagatcacaaaactgaggatgctgaggaagggggcctccccaaggccacacaacaacttggaggaaacacggaactgaaggaaattgattcccaggggagggcccttgcctgaccccctcctaggggagagtcagagggtttccaggagcatgaggatgctgagactacaggactacagatggagggtgtttcatggctgagtgaaggggtagaagccaggcgagtatgacacaggatccctcttgacagaattagaacacagagatctggagttcccatcatgcccctaccacagattcatggtggaaacttgggcctcatctgcttatctctgaagtgcagaaatttatagcacctacctccagggagagttgggggttaactgagatcacgatgtacaaacctgtaagctgtaaggcaatggaaaagtggagggtatgtccttggatgaagcttccgctctggacagcatggaggacccaggagtcaggctgggctgctggctcacaggtgttctctccccctggcccaatgccctggttcccattgccgtctgagctcctcccttccatgtctctgttcttgcttccttccctcggtctgccgtcgccctttgtcagtgatcagacgtgaccatgggtaacaggcatgaattttagtctctgcatgctcaggtgtgtaagaaacatggcttcctttagttcctataactaaactttattttcagtttgcactgatcttcctccagctgccctcccagcccagcagggcctctgccctggcagggatgggatcagaactcaaagcccctttcatgcaaccgtgtgtgcacagttacacacagatctgtctaaaatctaactagtaggaagcagtgagaacttggtgctttgtagagaggctttgtgattcagataacagggctagctccagggagtgtggaacaaacgagacccctgagggcacagacacctcagagcatttgtacctctggtgctggggaggggtggggggcccatctgtgagcctctggtgcccatgtgcccacgtgcagggtttgtatctttgtgcactttgtacctctgtgtggcaggcgatcaatggtgtttctatctcagccagggactcaggtgcgagactgagaagcccaggaggcaagaggcacctgcagccctagagcccactgcagattttccttgagggccgtatatccagaaccatcccagggcttggcttttgagagaaaatgtagtcttaaagaatgaacaagtgggccgggcgccgtggctcacgcctgtaatcccagcactttgggaggtcacgaggtcagaagatggagaccatcctggccaacacagtgaagccccgtctgtactaaaaatacaaaaaaactagctgggcatggtggcgggcacctgtagtcctagctactcgggaggctgaggcaggagaatggcgtgaacccaggaggccgagcttgcagtgagccaagatcgtgccactgcactccagcctgggtgacagagcgagactccatctcaaaaaaaaaaaaaaaaaaaaaaaagaatgaacaactgctgactactgtttactacaataagcatagctgatactctatccaggaagaggaagccaccactcagtgccccagccaagattgttctcaagcttttgtccgtcccaaacctttatgaagcatcctcacccactgacatgtgcagtacttaagacggtgcaccctggagtcaaatcccagcttggccccacatgagctctgaggcccttgaggagacagcgttgcaaagaccccaggggccgagtaagcagaggcctttcagagatcagagaaaaggccacatagctgggagcctttgtgaaactggagaggtcatcggggccagatcctcaggggcccagtggccctggaaaggaatctggtcttgtacctagaaatggtggcattaattatgtgactttgtccaagtcgctgtcctattctgagcttcagttttcttgtctgcaaagggctctggaccaaaccatctaggatccaccctgaccctgggccttcatgtcaggttaaggagagacagggcctcgttctgcgttcaggatgagtttctccagggaaaggccttctagctccgccctgccctgtctggctctggggaccacgcaggactctcaagacactaggtcactacactcaggagtttcccatttctgccaagacaatctggagaagacatcaccccacttgagtcatgagatgtcctcaacagcaccttctagagtgcagatctttttgctgctgtgagagaggggcttatgcagaatgatattgtcagtgtagacatgtttcacacagaggagaactcaggacaggggacaggaatggaggcaggaactcgatctattagaacaagttttctgatgtggttatgcatcagggatgtagaatcctgtgccttcaggatttctgggattaaagacaatcccagaaaacaggcctggacaggtcctggaatcagccccaggcctatttggataggggattctggggtcctcgtacccagagcctggtctagacagaaggagggagtgggctctgggtgggcaaacccaccttggccctttcccttccctcatcctgtggggaggggctcagctagtggagggtcagagagggtctaaagcaggggttccatggtaggcacccctcttgtccagacccaaaggtggcttggatcaccaccgaggcacagctgagtgataagttgatgagcagctgtgttttgctgccacataaaaatggctcattccccaccccccggccctgaagtgactatttactgagagaggcaaccctactgaacaaaagcctgctatttattacacgttcggtgaacaccccacagttccaatgcatggggagggcttggaaaccaaatcaaccttgggaaaaggaggtgcagaggccaaggtcaaaaccaattcatggaagtgggaagaaagcagggctggcctcaaccttttcactattagagagatggccatgtaaagtagtgagcctcctgtggaaggcatatgcaagaacaggtagaatgattatttcttaggggttttgtagaaaggattccttacacacaaaggcacaggattctacatccctggagcataactacatcagaaaacttgttgtaatagattgagttcctgccaccactcctgtcctcgtcctgagttctcctctgtgtgaaacatgtctagactgacaatgtcattctgcataagcccctctttcacagcagcaaaaagatctgcaccctagaaggtgctgttgaggacatctcatgatgcaaatgaagcagctgcttgcaggagccatggaggggcttgggcagcaggcggggggtgcccacaggcatgtgcccctccagaaatgggcaggaagtggaaggaagagaaagggagtcaggcccagggcaggggtgggggctggggtctgctttctccacactgccaggttctggtgaggacctcccaggtgggtgtaaatttgcaaacccaaatggttaagaagatatatctgttaatgtagaacattttgtatttaaccagtaattgacttgattcataactttaagtatgcagatgtggtaagtggacctcagtattagcttcctattgccactggaacaaatgaccagaaacttcgtggcttcaaacaacacacctttattatctgacatttctgggggtcagaaatccaaaatgactctccctgggctggatccgggtgttggcagagctgcgttccttctggggtcctgggggaagcctgtttccttgccttttccagtgtctagaggctgaccccattctttggctcatggcctcttcctccgtcttcaaagccagcagtgttgggccgagtctttctcaggctgctacctctgttctctctctcgtgcctccctatgtcatttgtcaagacccagaggattccacaggcctacccagataacccggggtaatcttcccactttaaagccagctgattgacaaccttaatcccatccacaacctctgtgaccctctgccatgcaaggtaacatactcacaggcatagggatgaggatgcggatgtctttagagggccactgttttgcctaccacagcttccatttggattcttgtcccaacccctacaaaagtgaggcatataatttgttgaattctgaataaaatgctaccagtgtctacaaattatattttttctttttttaaaaaaaaaaaaaaaccttcttccccaagtctggtttcctttagacctcaggactaagtacctgagaagatctgcgggcaaggatagttatgtgattatctggacagaatggcatttctgattgacattgttgcattactttggctccagatgcagtggcctgagagcagaaataaaaccccctccagctgcctcagcccaccctttgcagagggagaattgagttggggccacacggtgggaagcactaatcctcagtccacacaaaccctcgctttccaattattttgatggaagtcatgaaagagcactcagctaggcattattaatccattttttcaattcagcaagtattgattgagcagctaccctgtgccagtgaggttggaaacacaagggtgatgaacaaggtacatgtgcctggccgtcactggccagctctgtcactgcaggcgggaactttccttcctgtggggcccagggttttataatcacatgagcacctacacatccggtacagagccccgttaagggggcagggcctggcctgcctccttcactgttgtctccaattgcctcagatgcatgtggatgctcattcgttgaatgaatgaatgaatagatggtccttgctgatcggagagtcaatgactgtatcaggccaactggaaaagcagagggcaagccaagagaagacttggacagtgcctgccaccatggctgcgagtgagaggactgcggatcccgaggtggattcctggggtggcagctactgtttacaaagcactttgctggtatttattaggccacgcagttcccttccaagtttcctcctgttatcattctcactttgcaaatgaagaaactgaggtactgggataaaacttgctgaagaccacatggctagtaagtgtcagagcttggatgtgaacctgaatgctcgctgaggagagagcagctcgcctccttccctcacaggcacatagtcagccttcccgaatttcatccggcaacaattaacctctcccttctcactatcccccgctccctttccatctgtagagatctccttggatctaaattatcagggcctaaagccaggccatactaccgaggttaaagaaggtgaaagggctgcattgggcaacattgttccttcaatcctaactctttaatcctaattcatcactgcacactctgctcccttccctgggtgaagacagtttgatttgcccagtatccagaaagtttgtgctaagacaagggaaattgccacatggctctctgtttcattcagtccttcataagcatgcagcctgacctggagaaactgacagtgtaaaatgcatggagcagctcctgtccctctctttcctacccttgagcactctctaagcagtagctggccgatacagtcgcccaggaagtctccctgtagctcggccgtcagtcattaccctcactggcagcacgggacagagaacgggatatgttctccccttttattttgtgtggtgagacttggaaaactctgcgcctagaaaaatccatttctgaaggttgctgctattgagtagtgcagtgagactgggtttgaaggtattggactcttacataggctatgtgaacgtgggcaaattgcatcttctctttgagaagtctgagctcaagtcttgctttgagttatttgtgtactaacctttgaccttgctgacaaaaaaaaaaaaaatcacagtgctgggtacagctcctgacactccacctcccctacttcttttttagatacagggtcttgctctgttgcccaggctaaagtacattggtgcaatcatagctcactgcagccttgaacttctgcctcaaacaatcctcccacctcagcctcacgagtaggtgggactacaggtgtactagtatgcccagctatttttatttatttattttgctgtccatcctgatctggaactcctgggctcaagcaatcctcctgcctcggcctcccaaaatgctgggattacaggcatgaggcactgcacccagcctcaacttctcccacttctatcttctccccagttctaggtgaggcaggacctgccacatgtccaaatctccatctgtccccagcactctactaaatggcttaactgggccctcacgtccctccctggggatcctgtgaaaagacttgtgaacctgctccaggtcctgactgaaccaaatttcctctctctacatgccgaaagagtaataggtgttcctgcattaagcaatggcttaatttaggtttattttcattcttcagatatctctcccatttgatgtttcacccccttgaagctcaggtgaatctccatcttcttattcatctgaatattcctcatgcctggcatcacgcctcactcatagagtaggaattcaaaaacatcccagtaggagctgggaaagctcctactgcatgtcttgtacatctgctgtatgccagctgggaaagctcctactgcaagagagaggcaaaccacaaaggggactaaggggaagaattgggaggggggcatttattgccccaaatgactgaatttgggtcaaataacaggaccacgggcactcacatgttcaagttatgttcaggaatcttcctgttttctttatgaagcagaccctacctctcatcataaagctggaaatgccacgttccctccattccagcctctcttgcagctatggtgagcctaaatgagctagactcagtcaatcaaacccttctgccctagagtttgaatgggaagttctgacttgaagaattaggaaccacacaggaccccgtttgtgaagggggtggcacaaggtgcgtggcctctagctcccaggggcagcatccagaattcagcctcagggatgttggtcatgcaagccaccaaatcagtgccagcagccaagacgggggtgtcttcacagggccagtttcgtcatgttatttcaagggttgctcctggcccgtagcctctgaatttattttagtttctcagagatttcagtgggccaacgaatgtcacttaatcgatcccttttctgcttggaggagccagactccgtgtttgttgcttacaaatgagaccttgactgagacaagttgtcttgagtttccagttgaagtcatcctattccctttcaccttgaggcctttgcacatgtcatttctctcacctggagcaggcattcaccctctttttgtgactggatgactcctacccagtcatccaagggtcaggcttgaagactcttcccctgagaagccctcccagatcaccccaaatctgggctcccacaccaccctgcatgttcctcttagtagcatcctgaccctggattttactgtttatttctgtgtttcctcactattctgtgagctgcatgaggacagaagtgcatctatttcatcattgttagtagtagttagtatagttgcccagcctattgatattgttgaatgagtggatggattgaactctcttaggccagagtgatcccccactatcactgcctggcagcatggagcagcttcagtttttggactcagggcaattgccctgttccaggaaaccccaaaatagagttgcctcatttcacttctaccagcatgtcttgtacatctgctgtacgccaggccccgtgtcctcttacgcccacatcccagatcctgcaggtagaagtgctcacattgctgtgctcccttttctctgaccagccatggaggccctgggggcttggaggagtggctgcttactccctgggggaagtgtgggctgcaagccccttgagtgggcaggttgccatggtgatgctaatggagagacttgcctgaggaatactgaccaccaaaaggaacaattaccagagaaggcccatttctttagcaattttcaagaatgggcaagataaaaagccacaagtgaaaaggcattgcaaacaaataatagtgtatgagctggtctggacccaacaaggcctgtttcccacccctctttccctctggttgtagtgaataaagccatacttttcagtgatttataactgttcaaaaatgactcgtttccatatcttctttcatctacccagcacccattatgtaccaaatgcctaacagacacttaaaatatactctataattatgaaaacaaccctacaaggtaattgttcccgtattacagatgagaacactgaggctcagggagtgtaagggacccgtctagggctacgcagctgggaagcacatgcagcactctacttcatgcttaattcaaggaagcgaattctccttgtgggttaacatcatcacagtggcaattccagtgcctccataagaaagtgtccttggaaatgagacactagccctctcctgtctcatctgcacaatatcctattgccatctatttagaagagaggtagtgagttggttcattcattcattctccatttgttcattcatacacatttattacactcaaacttctagggcaaaaccagcaagccccgtactggacacttcagactcaaagatagcaacttgctaagttacaggagcttcctcataattgctgagcttctaagctctttgtcccaactcctgaaaagtagccctcaacttccaaactgtgcttcgggcactgacattccctgagctccacacacccttggaccacagttttctgaggcccagatgagcacaatgtgcagggcagagcctggcacttccagggctccaaggagtccagaggaaaatcgggcaggtcctgaatcaggctgctgtaggttgaactcctgccccacttagcagctggatgatgtgcaaattgctcagcctctctgtgcttcagtttcctcacctataacctagggctaaaaattagaagcacctactccatacagctattgtgctgatacaatacaataatccacataaggaacttagaacagaacagtgccggcggtgtatgttaaatgctgagtggacaccagttgggattagaagtagcagcattgccaggtactcctgagcaatgggtcagctaattccactctaccctcagaccccaccctcctttgcagttccttctcctgctttgataactagaagcagtcatatagggcctggggtctctacttgtaggagttcagtcagggtggtaggaaaaattataaaaattatagaaagactcaaaccttcttggaaggccgggaggttttgcaaaagttttgggaaaggatttggctgaaggcagctgaattttctcagagtaaataacaaggaagtgtaagggaattaatctagataagttagtttacttaggccttgaaacatggcctttaatcatccatgctcaggactgctctcttgggggaaaggatcgcccgaccccccaccccaccctcaccccaccccctgccaccatgttaattacccacaagtgtgttgactcaaagcctttgtcattaaatctgtactgaatatatgcccacagcaccagcttgtcaaggctgcagctgctgactctttacagcaccctcctcggtgcctgtgagtggcccagtcccttagccgtgcagccaggcaaaaaatctgtgtctgcatacattttttcatccatcactcagccagggtctgcgggttggaccccgcatctactcacaaatcaagatgttcagttccgccacccacccctgtctgtcttcctttctcacagtcactctgtaggtgtatcctgaaaatgtaaatcagaccacagcattccctagctgaaaacccttccgtggctccctattactcaccataggctaaattccgcccagactcctctgaagggcttgcaaggcctcctgtgttctagctcctgcctgctatccacccacacccctcattcctgcccctgtaaaccccttgtagctctcacatctcaagaattaaagatttgacccagttgctccgaccacctccgccccgatccccagaaacagtttcccccttctctttctctggccaacttctatcggttttcagaatgtctcccctggccacgcaggatcccttccattttgaggctgataaaatcctgcggatcgcaagctgagcgctcatcacaccccatcgtgattatctcccctgcaaggccaggggctttgagagggtgggactgtggctgacacgttcagtgctccagtcccatcacctgacacttgccatagagaaggtgcttagtatttagaagagtgtgtgcgattaccgagagcatggatatgaagaaggggatcacaaccttgaaaaagtttgttgctgagaaagaggcaagcagccccaactgacgggagctggcctggtcctcacagtttgtctcctgttgaacaatttcacagaacattgacatcagacaaggctattctgactgtgttggagcaagacaaaatcgagagcacttcgtagtcatgtctaaacgcagataaaacaagaacattgtctaaaccacaaaaatgaccagacatcccgcttttttgggctaatgggagtaactgtttaccaatgtttataatgttggccctgcactagtccttctaccttatagataagattataggtacccaattatagaatgattcctactgcctgatggcatccaattgaaccctccctagtcacttaacacaagcccccatccttttgtaagttcttcgtaacaccctctcacaaagacccctcactgttccccacagtgcacaatctccttgctgcaatgagccaataaacccagctccgttcaactgcaggtgtgttcctggtctttggctaaagggcattgacaccacccatttcccagaaacctgaacttgcaaaaaaaaaaaaatacctaattaaacaatttctgcaagctaattgatagtgagaaatgtatttctgatagggagcatcagctggagtagacaactttgtacatactatatgttttccggacagttgcttcagcttctcctgcattgtgtgtgtgtgtgtgtgtgtgtgtgtgtgtgtgtgtgtgtgtgtgtttgcagggggaagatgcaagctttgctgtcctgggtgtccgtgactgggcatgtctcatctggaaagagatcagctaatattccttgagaaaaagaatgttatcactggatgattacatctgcttccagagaggtaagagcatgcagcatggagcagacactctctatcccaggagctgccctgcccaggcctgggctggtggctattgtcatggagtggtaactgtaaggccatcctcataagtcctgctgatatcactccaatccatggacacccctgtgactccgtctccattcctcaggcctgcttcccatggaaagacccagagggaaacgtggttggtggcattggggactgagaacagaacaaaattcaggctttgagtgtggattagagacgcactgtgtggtgcttgcatcacctctgacagtggttgggtaatgggctgaatcacccaatggagacagaatgccaacagatgttagttgaggaggatgattaatctccttcttcgaaaactcagagaatctttattggcaacgttgaagtcaagatagggcttctccttagcaaccggaaagcgcctagtgtgcatggctacagaattcaatatgaaactcagatgatgaaggtagccatgggcacctctgattgcccattgtaaatttctgcctggaatgagggctggggcctcataaatgtcaacaaaagctggtgatgggtccagagagggatgttaggccagccttgatggatgaggaagtttcatttaggggctcctgtcacttcccatcttcaggccaagctgacatccatggctgtaaaattgtcacccttctcctttgcctctcaggaaagcaaaacttctttacgacacttttaatcaaatctgtcttttgccacttctctccccaccctgctccctctgcctttatcctgacaaagaagcgaactgttactctctgtcagttatttgtctgagtaatttcttgatgaaattgcaactataattgaattttctgaaaaccaggaattcaaatgaggcgacaacagaggaaacagcgtgattaaggaattgttattcactcgttgtacatcattaccacccagaattcatcgctggatcgttcacagatggagttgctgaactatgattatattttagaaaatgaagggggaaaaatctaaaaaggcaataaaacatattagaagccttcttgaggaacaggattattactgattaagtatattttgcatgaaaaatgtgctagcactttggcagtttaaattatacgtccgtgcagtcaacatttttgctggtctcaaaattctttgttagtttggtcttctaatcacattcctcttcaccctccaaattgacgacttgaaagaacattagaaatgatcattcctgaaggagcatttgctctcaaaatgcatttacgctcagcagccattaaaaggatatcatccagtcacttagtttctcaatttaactttaaaggaaagttgccttattagagaagtggcctctatttcaatgtaatggtctttgtcacatcttccaatgtgctggcttagtgctgaaggatggggaaaggcagttttcacatattgcagccaccataccaccaaagaaaacaggtgcacttccaggcatcatttagcggggtaccacattcctggttccagtttcctttttagaaaatctgaaagtaactttggggcatatcttttaaggagtactccaacacgactagtggacagaccctaaattaattgccaatcagctctgccttctggtatttacacctttatgtaataacctccacttgaaggtagatgagatctgtgacttgcttctaaccagtggaatatggcggaggtggtgggacgttactcctgtgattacattacatcatgtggctcctttatgatggaagattcatgctagagattctccttgctgacttgacaaagtatgtaaccatgatgaagacttccacgtggcaaggagctgtgggaagcccaggtgctgagactggcatccagcaaacacccagcaagaaacagacgtccttggttctacacatacaggaaatgaattctgccaacatcctgagtaaggctggaactagattctccccaagttgagcctgacaagtaaaatacagaccagccaacaccttgattgcagtcttgtgagacctggggaaaaggacacagctgaaccgtgtccattcttctgacccacagaaactgtcacatcataaaggtatgttagttgttacacagtttagaaaactattacagctgctcaagaaggttagctagctccagatttcaatccattcacaggaaagcaagctttattcctagaagaataattcatgctttgcaaaaagaggaaaacgtcctgcagttttagaaggtcttttctttctcaacacacccaaatttctttaaaatcctcaagaagtgcatttgttttcatggttgactcgaagaagtgagtataattaactcacaaaaggtgggaggaagggacaaattaaattttggtatgcatacaggtagcttcttccaagtgataatgagcaatgtgaaacaaagagattggcattaaatgtaatgaaggactagaggagtgtacctaaacctgaaacaaattccaagaagtggccttgacctaaaatgtttgcatcctgccagagacccttacttataagtcaggagatacctgatgcccaggagaactggtttttgtactctgtcttacacagactaagaattaagaatgcaggtgagaagtttagaaaacttcctgatgatcatatgaaaagacattaaactttacctggtaaaactatgaaatgttgcctgtagatttctaagaaaaatgagtaggaagttggaaatatttcagaattaagaatgtttttatataattagaactctttaagctatgtaattctgaaatctgtgtgacagacttctgtgtaaacataaagaactagttatttttacagattatctagtctgtgtattcatttgatgtttctattacttttaccctcactacaaagttcaatgaaggttaaaaaaatattgttcttaaaaaaagaagagataaacctggagtagctatttcaatgttagacaaaatggattttaaaacaaaaatgttaatacagatagaaagggacattttataataataaaagtatcaaaatatcaggaagataccacaattataaacaaatatgctcctaaaaatagaatctcaaaatacataaaacaaaaactgacaaagttgaagggataaataaataggcagctcagcaatatttagaaacttcaatacctcactttcaataatggatagaacaactagacataagatcaacaagaaaatagaatattttaacaaagctatacaccaactaggcctaatggatatctatagaataatccacccaacaacagaagtcttcctcctcctacttctcctcctcctccccttccccttccccttccccttcttcttcttccttcttctctttctccttctccttcttcttcttcttcaacaggatcttactctgttgcccaggctagagtgcagtggtgtgatcatggctcactgcagcctcaacttcccaggctcaggtgatacatgggcctcagcttcccaaagtgctgggattataggcacaagccacatgcctggcccacatattcttcttaagtacacatcaaacattctgtagaatagaccatatgctaggccacaaaacaagcttcgataatttaaaaggactgaaattatacacaatctgttccttggccacaaagaataaaattagaaagaacttttggaaactcacaactatatagaaattaacatacccataagtaaccaattggttgaagaagaaatcacaaaataaatgagaaaatactttgagatgaatgaaaattaagacacaacatataaaaatttatgcaatatagctaaagcaatgcttagagggaaatttatagctccacatacctacattaaaaatggagaaagttacactgttggtgggactgtaaattagttcaaccactgtggaagacaatatggcgattcctcaaggatctagaaccagaaataccatttgacccagcaatcccattactgggtatacacccaaaggattataaatcattctactataaagacacatgcatacatatatttattgaggcactatttccaatggcaaagacttggaaccaacccaaatgcccatcaatgatagactggacaaagaaaatgtggcacatatacaccatggaatactatgcagccataaaaaagaatgagtttatgtcctttgcagggacatagatgaagctggaagccatcattctcagcaaactgacacaggaacagataaacaaacaccacatattctcactcataagtgggagttgaacaatgagtacacatggacacagggaggggaacatcacacaccggggcctgtcggagggtggggggcaagtggagggagagcattaggacaaatacctcatgcatatggggtttaaaacctagatgacaggttgataggtgcagcaaaccaccatggcacatgtatacctgtgtaacaaacctgcacattctgcacatgtatccccaaacttagagtaaaatttttttaaaaaaagaaaaaacatctcatatcaataagctagacttctatcttaagacgctaggggaaaagcagcaaactaatcctaaagcaagcagaaggaagacaataatgaaagtggaaattaatgaaattgaggacagaaaaacaatagagaatatcactgaaaccaaaaagtggttcttgttttctttctttctctttctttctttctctctctctctctttttctttctttctttctttctttcttgtttcttttgagacaaggtctagctctgtcactcaggctggagtgcagtggtgcaatcacagctcactgcagcctcgatctcctggacttaagtgatcctcctacctcagactctcgagtagctggaaccacaggagtgcaccaccatgtccagctaatgttttcaattttttgtagagatgaggtttccctatgttgcccaggctggtctcaaattcctaggctcaagcgatcctcctgcctcagcctctcaaaatgctgagccaccacacccagctggttatttcaaaagatgagcaaaagtgacaagcttttagctaaactgaccaagaaaaaaagaatacttaaattaccataatcaggaaagaatgagagaacattactaccaacctcatagatacaaaaagtatagaggaatacaacaagccaattgatatgccaacaaattaaattacaaatgaaatggacaaattcttagaaagacacaaactacaaaaactgactcaagtagaaatagaaaatctaaataggtatttaaaaaagattattaaactgagagctgaagacagggcagcaaaactgcaggggccaccaccaccaccaccacatgtcaggaagagtacggagaggccctggaggggcataacgactgcaggaataaattaggagagccaagagaacccacagaccctctgaaggaagtggattgctcctgcaggacctgggagacacctcaaatactgtgctggtatctgtggctgagaaacccacagatggtttgcatcacaggactctgtacagacaacccccagtaccagcctggaacctggtagacatcctgggtggctagatccagaagagagataacaatcactacagctcggctctcaggaagccacatccctaggaaaagggggagagtaatacatcaagggaacaccccatgggacaaaagaatctgaacaacagcctcgagccctaggccttccatctgacagacactacacaaatgaggaggaaccagaaacccaactctagtaatatgacaaaacaaggttccttaataccccccaaaaaatcacactaggtcaccagcaatggatgcaaaccaagaagaaatccctgtttcacctgaaaaagaattcagaaggttagttattaagctaatcaggaaggcaccagtgaaaggcaaagtccaacttaaggaaatcaaaaaaatgatacaacaggtgaagggagagattttcaatgaaatagatagcataaataaaaaacaatcaaaacttcaggaaacaatggacacagttatagaaatgcaaaaggctctggaaactctcagcaatagaattgaacacgctgaagaaagaacttcagagctcaaagacaaggttttagaatgaacccaatccaaaaaagacaaaggaaaaattataagaaaatatgaacaaagcctccaataagtctgggattatattaaatggccaaacctaagaataattggcattcctgaggaagaagagaaatctaaaagtttggaaaacatattcgggggaataatcaaggaaaactcccccagccttgctagagccctagacatccaaatacaagaggctcaaagaacacctgggaaattcattgcaaaaagatcattacttagacacattgtcatcaggttatctaaagttaagatgaaggaaagaatcttaagagctgtgaggcaaaagcaccaggtaatctataaagggaaacctatcagattaacagcagatttctcagccaaaaccctacaagctagaagggattggggccctatcttcagcctccttaaacaaaacaattatcagccaagaattttgtagccagtgaaactaagctttataaatgaaggaaagatacagtctttttcagataaacaaatgctgagagaattcaccactaccaagtcagcactacaagaactactaaaaggagctctaaaccttcaatcaaatcctggaaacacatcaaaacagaacgtctttaaggcataaatctcacagaaactataaaacaaaaatacaattaagacaacaacaaaaaacaaggtatacggacaacaaatagcatgaagaatgtaatggtacctcacacctcaatactaacattgaatgtaaatggcctacatgctccacttaaaagatacagaattgcagaatggctaagaattcaccaaccagctatctgctgccttcaagagactcacctaacacataaggacacaaataaacttaaggtaaaggggtggaaaagacattctatgcaaatggagtaactattcttatatcagacaaaacaaattttagagcaacagcagttaaaaaagacaaagagggacattatataatgataaaaggccttgaccaacaagaaaatatcacaatcctaaatatatatgcacctaacactgaagctcctaaatttataaaacaattactaatagacctaagaaatgagatagacggcaacacagtaacagagggggacttcaatactccactgacagcactagacaggtcatcaagacagaaagtcaacaaagaacaatggatttaaagtatatcctggaacaaatggacttaacagatatttatagaacattctatcaaacaactgtggaatatacattctattcaactgcatatggaactttctccaagatagaccatatgataggtcacaaaatgagccttgataaatttaagaaaattgaaattatatcaagcactctgttagaccacagtggaataaaactggaaattaaggccaaaaggactttctaaatcatgcaaatacatggaaattaaataacctgctcctgaatatcactgggtcaaaaatgaaatcaaaatgcaaatttaaaaattattcaaactgaatgacagtactgacacaacctatcaaaacctctgggatccagcaaaggggatgctaagaggaaagttcatagccctaaaggcctacattgaaaagtctgaaagagcacaaatagataatctaaagtcacacctcaaggaactagagaaacaagaacaaaccaaacccaaattcagcagaagaaaggaaataaccaagatcagagcagaactaaatgaaattgaaacaaaaaaattacaaaagataaatgaaacaaatagctgattctttgaaaagataaatacgattgatagaccattagcaagattaaccaagataggaagagagaaaatccaaataagctcaattagaaatgaaatgggagacattgcaactgaaaaccacagaaatacaagagaacattcaaggctactctgaacacctttatgtgcataaacttgaaaacctaaaggagatggataaattcctggatagatacaaccctccttgcttaaatcagggagaattcgataccatgaacagaccaataacaagcagtgagattgaaatggtaattaaaaaattaccaataaaaaagtccaggaccaggtggattcataccagaattctaccagacattcaaagaagaaatggtaccaatcctactgacactattccacaagatagagaaagaaggaaacctccctaaatcatcctaggaagccagtgtcatcctaataccaaaaccaggaaaggacacaaccaaaaaagaaaactacagaccaatatccctgatgaacatagatgcaaaaaatccttaacaaaatgctagctaaccgaatccaacaacatatcaaaaagataatccaccatgatcaagtgagtttaataccagggatgcagggagggtttaacatatgcaaagtcaataaatgtgatacaccacataaacataattaaaaacaaaaatcacaggatcatctcaatagatgcagaaaaagcattcaacaaaatccagcacgcttctatgattaaaactctcagcaaaattggcacacaagggacatacctcagtgtaataaaagtcatctatgacaaacccacagcctacataatactgagaactggaacaaagatgcccagtctcaccactcttcttcaacctagtaatggaagtcctagccagagcaataagacaagagaaagaaataaaaggcatccaaatcagtaaagaggaagtcaaactgtcactgtttgctgatgatattattgtttacctagaaaaacctaaagatgcctccagaaagctcctagaactgatcaaagaattcagcaaagttttgaatacaaaattaatgtacacaaatcagtagctcttctatccaccaactgcaaccaagctgagaatcaaatcaagaactcaacctcttttacaatagctgcaaaaaaaataaaataaaatacttaggaatatacctaaccaaggagatgaaagacctctacaaggaagactacaaaacactgctgaaagaaatcatagatgacacagacaaatggaaacacatccaatgctcatgtatgggtagattaaatattgtgaaaatgacaatactaccaaaagcaatctacaaattcagtgcaattccatcaaaatactactatcattcttcacagaattagaaaaaaacagtcttaaaattcacatggaagcaaaaaagagcccacatagccaaagcaagactaagcaaaaagaacaaatctggaggcatcacattacctgatttcaaactatactataaggccatagtcacccaaacagcatggtactggtataaaaataggcacatagggttgggtgcagtggctcacacctgtaatcccagcactttgggagaccgaggcaggcggatcacaaagtcaggagattgagaccatcctggctaacatggtaaaactccgtctctactaaaaatacaaaaaattagccaggtgtggtggcagacgcctgtactcccagctactcgggaggctgaggcaggagaatggcatgaacccgggaggcagagcttgcagtgagctgagatagagccactgcactccagcccgggcgacaaaacgagactccatctcaaaaaaaaaaaaaggcaaatagaccaatggaacagaagagagaacgcagaaataaacccgaacgcttacagcaaactgatctttgacaaagcaaacaaaaacatatagtggggaaaggacacctcattcaaggaatagtgctgggataattggcaagccacatgtaggagaatgaaactggatcctcatctctcaccttatacaaaaatcaactcaagatggatcaagggcttaaatctaagacctgaaactataaaaattctagaagataacattggaaaaccccttctagacattcgcttaggcaaggatttcataaccaagaaccaaaagcaaatgcaataaaaacaaagataaatagctgggacttaattaaactaaagagcttttgcacagcaaaatgaacagtcagcagagtaaacagacaacccagagagtgggagaaaatcttcacaatctatacatctgaccaaggactaatatccagaatctacaacaaactcaaacaaattagcaaaaaaaaaaaaaaaaaaaaactaccaaaaaaaatcatcaaaaattgggctaaggacatgaatagacaattctcaaaagaagatatacaaatggccaagaaaaatatgaaaaaatgttcaacatcactaatgatcagggaaatgaaaatcaaaaccacaatgtgataccacctcactcttgcaaggatggccataataaaaaaatcaaaaaataatagacactggcatggatgtggtgaacagggaacacttctacactgctggtgaaaatgtaaaactagtacaaccactatggaaaacagtgtggagattccttaaagtactaaaagtagaactaccatttgatccagcaatcccactactgggtgtctacccagaggaaaagaagtcattatacgaaaaagatacttgcacacacatatttacagcagcacaattcgcaattgtaaaaacgtggaaccagcccaaatgcacataaagcaacgagtggatatatatatatataaatggaatactactcagccaaaaaaaggaatgaattagtggcattcacagcaacctggatgagattggagactattattctaagtgaagtaactcagcaatggaaaatcaatcatcatatgttctcattcataagtgggagctaaactatgaggatgcaaaggcataagagtgacacagtggactttggggactcagggggagagggtggggagtggatgagggataaaagaccacaaatatggtgcagtatatactgctcgggtgatgggtgcaccaaaatctcacaaatcaccaccaaaggactcactcatgtaacaaaacatcacctgttccccaataacctatgaaaataaaaaaaataaaaataaaattttaaaactaccaaataacaaagaaattgaatttgtcattttaaaacttcccacaaagaacagcttaagcccagacagcttcactggtgaattatacagaatatttaaattaaagaattaatgtcaattcttcacaaagtcttctaaaatgtagaagaagaggggacattttccatttcattttgtgaggccagtattatcccattaccaaaccatacaaagccactacaaagaaaactacagaccaatactgcttatgaatataaacataaaaatcctcaacaaaatactagtaaactgaatccagcagtctgttaaaaagactaacaccatgaccaaataggatttatcaaaggaatgcaaagttggtttaacatttgaaaattaattaatataatacataattcaatagaaaagagaaaaaaacacatgatcatcttattagacacagaaaaatcatttaacaaaatccaaactgacgtcatgataaaaacactcaacaaactagaaatagagtggaactttctcaatgtgataaaggacatctaccaaaaatccacagctaatatgataaataatggtaaaagactgaatgtttttcctctaagatcaggaaaaatacaaggatgtctgctctcagcacttttattaaatattgtactggaagttctagccagaacaattaggcaaggaaatgaaataaaatgaactcaaattggaaaggaagaaataaaactatttccggatgataccaccttatatagagacaatcctaaataatccattattagaattatcagaactaattaacaagatcagcaaggttacaggatataaaattaaaattcctatacactagtaatgaataatccaaaaataaaattcaaaaaacaatcccacttacaatagcatcaagaaaataaaatccttatgaataaatttaacagaagtctaaaacttatatatactctaaacacgacaaaatatcattgaaataaattaaagatggaaataaatgcaaagacatccatgttcatgatcagaagacttatattgttaagatggcaatacttaatattataaagtgatttacaaattgatttataggttcaaagtgattcgatgcaatctctgtcaaagtttcatagcattttttgcagttatttatactgcaaagtgatttacagatttaatgcaacccgtgtcaaaatcccatggccatttttgcagaaatggaaaagctattgctggaattcatatggattgcaagtgaccccaaatagccaaaacaatcctgataaagaacaaagctagacaaagtccatcttgcacttcctgatttcgaatcttacttcaaagctatggcagtgaaaacattgaactgagtacggtaatatttatcatctcaaaacctcacaacaatgcagtcaagtggaaccactgtctcagtatttcagatgcagagcccaggctcaaagaaatatggggaattgcttgaggtcagagagctgggtaaccacaaatgcgggtccacattcagatctgccctaagtataaagacattgcatcctctcagccactacctacaccactcttgagtttcttcgacacaggacctgtgaacagacagcccaagacgcttgggaatcatggaattctaacccccaaagcctggcttagggacctcatccagcgaccagacagggcgtgttgtgcctcatccacatttctgaaagtgtccactcagtggacagcctgctttctagtctctgccctactggcttgagtgtggatgcccagacggttaggaggcaagctccagagctcccatatgatcacttccactgtcacctgtgtgccacaagtgctctctgtacacatgctccacctgttctgatgatctttcagtctttcaacttccaagccatgtgagggatccttcaggaacatgagcactgggacatgctggacgctggagagagatgcagacacccagagctggctgagctaacatgctacagtttgtgaggaggagacacaaaatttcatacagatgataaaatttttctgtacaacaaacctttgctatagatcctacaatatatccattattctcactagaatgtgaacatgattctgcaaattcctagggagaaaacccagcctgccccttatcagaggctataaaccacctgtttttctttccatcctccttcccttgcttccctctcacacatcagtcctttagagaaaactgagcttttccaagctgttattgctcaaagaaatgtcttcatccaagggaaccaagggatgtgaagggcactggcctccgaagcatttgccattgtcaacttttattgagcacctactatgtaccaagtactgtgctaggttctgacgacactgaagaaacaaaaaaatagatacttcctaatctcaagggacagtccactggtggagtcagaccttcatcacgcacacacacaaacacaaagagagagacagaaagagagagagagagagtgagagagaaatacatgtattcagatactgctctgaaccttatctgggtccggagggcagagaaggcttcttgaactaggacctaagaaatgggaagaaatttgctagttaagcaggtgttgggggaaggtcctcagaagaacattctagaacaagtgcaaggtcccaagagggagggagatggtccattcctgcaactgaaagaagaccaatgtttctgaaccacatggagcaggaggaagcagcaggagaatccaacagggggagggtcagaaagcccatgtttgtaactaaccggaacgatgaatgtggtttggaagacaagtgagaggatgtgtaccacgggccagatgtgggagaccaaggaggggactagtgcatttttccagtaaagaaataatagtgcttggggctagggaggctcaaattgagaagaagacaagtggggaggtttaagagagatttctaaattaaaatgtacagggaatagtgacagatgatgcatggggtagagagagagaaggcaatgtcaagagtgactcccaaatctggcttgcaaacagaatgaacggtggtgtcattcactgagaaaggacacccaagaggaggatgtgattagcaggggagagagcaggagttcaagctgatatgtagatccacattaatatgtctagtcagaatgtggatacgtaggtttggggcttagaagaaaggtctggggtgaagatctaaccctagcagtcatctgcaaagagatggtaataaaataaatacaatttttaaatggatggaatttccagggaaaaagcagagggtgaaatgagtaaaggatctagggccaaggctaaaagaaatccattattagaaacagaaaaggtgtcttagtgcattcaggctgctataacaaagtaccatagcctgagtggcttataaaccacagaaattcatttctcacagttctggaggctgggaagtctaggatcaaggtgcaagtgagagtctgccttctggctcatagatgctgccttctggctatgttctcacatggtagaggatgtacggaagctctctgcgacttcatttatgaggacgctaatcccattcatgaagactccaccctcatgacttaatcacctccccaaatccccacctcctagtaccatcaccttgagggttaagatttcagtatatgaactttaggggtcacaagtattcagtctatagcaggaggaatagccaagaaggatgaatgaaaatcatacaaggatgatttcatggaaggcaagggagtacaatgtctcaaataaaccaagtcctgagtcaaacattactgagaatgtgagtgtaataaaaccgagactcaaaagtaggcattggatgtgatgacatgactatcactggttaccttagggagagaagttttggcggagttgacaagcacagtcagatggaatgtgctggcggatggcaaagatggggaaatgaagatacccagtgtagacagcttctgaaagcagctggccgtgagtcagaggtagacaggaaagtgactaatacagtgcagaggtcgacgtttttagctttattgtatttaagagagagacctgagcacatttaaaatgctgatgtgacattgtccaagctgagaggaaacaattagatctatatgagagaaaagaatgatgaatatcaggcaagtatggcaaagaccaccattacttttgcaccaacccaataagaaagttggaggatcttcacaaaacaaaggtggttttggcctgagtggggaggaggaacagcttctttactaccagtggaaagaaggagaggctggtgcaggggcagggaggtagcagggagcagagggaggccccatccacgctcaggttcttagaatgaggaagatgacattggcaggaccataggtgagcatcttctaacccaaggaagatttagaactaagtataggctgggcgcggtggctcacgcctgtaatcccagggcttcgagaggccgaggcgggtggatcacctgaggtcaggagttagagaccagcctgatcaacatggcaaaaacccatctctactaaaaatacaaaaattagccaggtgtgttggcgcctgtctgtagtcccagctactcaggaggctgaggcaggagaatcgcttgaacccaggaggtggaggttgcagtgagctgagatcacgccattgcactccagcctgggcaacaaagtcagattccatctcaaaaaaaaaaaaaaaaaaaaaaggaaactaagtatagaagtatggaatagaactatattctttctattaagatatttgtgctttgaaataagctatgtttacacacttgtaatgtttaagaatctgtggcctttcagagtcatatatgaacttttccttctaatataaaatgtttaacggagcaattgactttgacatcagattctaagttgaaatcttactgtatttaaataagatttggaacctgtaaaagaatttaagccttgccgtctttagaagtttaatgaattagatttataacaattacttaaatatctgagaaggtttgttagacaattgaagtacttaaaaaggaattaaaatatattaagcctataaatgcagtttacaatgtttagagcaatttaattaaaaacatttgtaaatgagacgaaacatttctcaaaggtactcttaaatgtgattgttaaaatttgctagacctataaataaataataagattcgtaagctgaatttcaaagcttatggaggaacttgggtccatatgaatttgttactttaataaattgaatgttaattttgaaaaacaaagaaacctttcatcaatatttttggcgcctaagagctgctcttgagggcatctaattaatagtttttttattatttaaaaaatatcattaggccaggtgcagtggctctctcctgtaatctcagcactttgggaggccgaggtgggtggatagcttgagcccaggagtttgaggccagcctgggcaacatggagaaaccttatctctactaaaaaaaaaaccacacaaaaattagctggatgtggtggcacaccgctacttaggagactgagatgggaggatcacctgagcccaggaggtggagggtgcagtgagccgagatcgcgcccctaccctccagcctggaagacacagtgagaccctgtctcaaacaaaatttttttaatggctataatgaaaaaaaaaaatcaaccagtatgtaaggaaaaagctgaagccctttgccccatttcccagaggtaaccatcattacaagttccttgtgtttctgcccagaaatgttatttgcataagcatagaatctctccccagccccatttttaaacaaagagatatattctgcatctaacattctgtactgcttttgtgcttaacaagataacttgagccgggtgtggtggttcatgcctgtaatcctcaagctttgggagctgagacaagaggattccttgaggccagaagttcaagatcagcctgggcaacatagtgagacccgatctgcaaaaaaacatgtaaaattagctgagcatggtggtgtacacctgtagtcccagctatttaggaggatgaagcaggaggatcacttgagcccaggaattcaaggctatagtgaaccatgatcacgccctgcactcctgcctgggcaacagagggagaccctgcctcaaaacaaacaaacaaacaaaaaacaatatatcttaaaaacatgttcatgtttcccataagaataaagattaacatccctctctcccttcctcatcgcctttggggtgtggcctcatgcctcccctctgggttgtgcccaaacttctctcaagagtggatcctctcactgtctctacttcctgcctccccagctactgactgtaccaagactgtgctttctgagggcaccaatgccctccaccttaccaaacccgctagaggcttctcagttctcatatctcttactctccggctttcaacacgtgagccatcttttccttgctgcattgcaaagccacctttatctagcaatgaattcccatttgtatctgggtctatttctggcctttccattctcttccattgatctctctgtccttgggtgcaagttttctgatgacctgacttgattcatggataaaacctatactcttgcagaatgaatgtccttcactcaatcctccataaataacaattctttcaatagagcttttctctctttcttaataagagatagggacagcagaggttcacgtatttcctggcaaggcccagaatgccgttattcttgattgagggcagagttatcagccaggcagatagtggaattgatatccctgtgtgaaaatggaagagccaatctgagctgtcgccccattcctacagaactagctgcccgtctttgaattcccagtgctcattcaggcctctgcactttcacttgagcacatctggcccccactttctcctttcctcctctcttctactaaatagtaaaagagctcttcttcacatctcagctcaggtgtccccttgcccaggaaacctttcctgaggctcctccctatgccccacattagccactctgggcttccctctgccccagcccttaacacaacagaatcaacatgcctgtaacagaattgccctatgccccctctcccctagaccaccgtgagctccccaagggcaggacctgtctctcagcagacttttactcttgttaccgaactgatcttgggtctgcccacccggcacagtgcagccaaacactgatattgggattgcagccagagaaagtgaggcatttattgcagggcgccaagcaagcagaattgggcagctcatgcttaagatcagaactccctgatggcttacaggtaagggtttttaaaggtagagggggagaggttacaggcaaaatcataaattaatacatggagactatgtgttggtttggcctaaaaaggcaaagcatcttgaagcggaagtttgggagtgtggcaagtgaaaggtggattcaaagatttttcagtgttgtgatgggttaaggaggtgaagttttgtctaaaattttggtgtaggcagaaaagaacgttagctcttgcccgtgggcatgatctcttccaggtccctcagcaagaaacttaggagaaagcatggtggttggagttcggtcctcagcttccccttatccaaggtctctgtgcctgcagatggcactttccatttggtggaggtctgggtttctgaaacacaactcagggacgtaggttgagatgttatctttagtttctacaggaaaccaaatatcctatgactctaatttccttggctattgtcttaagctactattaccttcttgcttgtcaagttgcgcatttacttttcaaggcttgctacgtgcctggaatttctagattttcctttatttccatgcttggggagaggagtgcctggcaggctcctaagaggggtctgtgctccatctcgccccctatcttgaactatcggttgggtgctctagaatctgtatggggtggaagtgttcattcattttctgtacaaaagcaatcaatgcttattgtggaaaacccaaataagagagttgctctaaacaacaccctccccagtcccaataccttgtccagaagaaaccactgtttggtgagtatattagtcaatgtctgcagaccagatcggatgaccaagttttccataaatggatggccatccacttcccttcaagggcgagggtagtttgttctgatccatctcccttttcacagctcagggagggaggaagacccaggaaggagagctgccacagttactagtggcccagctgggatttaaagtccgccgtgactgaagcttggctccacatgccagtctgcaaggccctgagtgccctcagcagtaattccaagcaaagcagggaagcagcgggccaggtgctgaactgaactgctgctcagggctcctgagcctccccctgcctcctccctctcttctccaccctggggcctctctctctgtccctacttcctcctttagatcctctttcccctgaacccactcatttatcaccttttgatgagttccaccaggcagaccatgtcaggaaatttcttggtgttcattttaataaaacttaattattaagacagcctcacaagtcatgatacatttactggttcatttttcacatctccgtcagaggcctcctggcagccacgtgggaggcatgaaggctatggggtggaagtgtcagagccttttctggcctcctgcaggagctgggtttggggaagcagttcctgacccttcctctgccggcccacccccgttattctccagacgctgaggatgggatggaatgagcaccaaacatggagtcaggagacctgggactcaatcctcctcctgctgcagactatgctcagaccctgctgaaggaaggcatcctctctgggcctcagctgtctcatgtacaagatgggaatcatctcagtccaaaccagacagagccactgtgagattcagaagaaagctctcgcaatgagaggcctccccaggcagatggaggcaaaactgcaagggtggattgacgctggggcggcgcctgccccacagtcctgtaggtccgcccgcctgggtaagggatggggtgaaattgggggtctctgatgatcacagtaataactgactttttaaaaaattttatttttccataggttattggtgtacaggtggtgtttggttacatgagtaagttctttagtggtgatttgtgagattttggtgcacccatcacccaagcagtatacactgcactccatttgcaatcttttatccctcgcccccctcccaccctcccccccaagtccccaaagtccattgtatcagttttatgcctttgcgtcctcatagcttagctcccacacatcagtgagaacatacgacgtttggttttccattcctgagttacttcacttagaataatagtctccaatctcatccaggtcactacaaatgctgataattcattcctttttatagctgagtagtattccattgtatctacatataccacagtttctttatccactcgttgattgatggacatttgggtcggttccacgattttgcaattgcgaattgtgctgctataaacatgtgtgtgcaagtatctttttcatataaagacttcttttcctctgggtagatacccagtagtgggattgctggatcaaatggtagttctacctctagtactttaaggaatctccacactgttttccatcgtggctgttctagctgacattccaacgagcagtgtagaagtgttccctgttcactgcatccacacctacatctactgttttttgattttttattatggccattcttacaggagtgaggtggtgtcgcattgtggttttgatttgcatttcccttatcattagtgatgttgagcattttttcatatgtttcttagccatttgtatatctttttctgagaattgtttataattgacatttattaagtgctttgcagacgctgtgccaaggatgtcatgttgtcatatgtattagctggctaaatctcacagttgctgtacttgttactaatattgtaaaatgtgtaccagtgttatgcccattttatagttgagaaaactgaggcatagggaggcaaaagcaacgtgcccgaagttacaaagccagtcaatggtggaaccagaattagaactctggccaactccagagtctaccttcttaccaataaagtcatcacccctgagaaatcagggaggggccaggagtttttaataatcaaagcaacctcacaccgaagtctaagggaaagcagaggttcggctgagcaccagggcccctggcagctcagcatgggggccgtcagtgacacctgcactcatgatatcccacacctgtggtcttccaaggggacagactgaactcttgccacttcatccacaaagcccccctctatttcctcctttccctcgactgcacttccttgataacagacccaattttgttcagcaattcacccccagggaagctgacccacaaatcccatgatgccaacagggtcccagtatctttgccagttctctgacccagcctcacaccagggtgtggcatgagcaacgagacagggtagtgttggtgcaggtgacacagggctaggatatggcacaggaatttagaaaataattagactgcgttgggcgtcaggacacaccactccaaaatatgactgtaggcgaccaggaatctgccacagcaaaatctactttggcatttttcaagctagttattatgagaaactgcagacacaggagtagctctgaaaagctgtccttttgtaaaagaaatttacatctataaaggaaatccacattagtaaaacaatctgtatcaggaagagggctgctcagagacagcttctattacccgagaggctttttatctttataacgagacaacctttacttatcatacatttcctccccttaccctccaagaactccaccatctccgagaaacccaaagcacccctattcctttctgtagctcaggatgctacattagcttcaatcatctggccctactttgagtctcatgtattgtgggaacccccgccccccatacctatgcaagtaattataaatgtttttgcttctgctaatctgtcttatgtaaatttaatttatagctcagtcaaagaacctagaagtgtgggggttaaccaccgttccctcccctgcaagaggattggtctatgagagaagtcagcttccatttatcgagcacctagtaagcaccaggccccagaccttaagctttacatgtgttatttctgattcccatagactcctctagcttcagtggtattacttgcattttgctgatgaataaacggaggttcagagagggtaagtgacttgtccaaggtcacacaaccaggaaacagcaatgctgcgagtggaacccaggtgttgtgtccgtgggtctgtggtctcgctgacttcaagaatgaagccaccagaccttcacggggagtgtgacagccctcaaaggtggcaaggacccaaagagtgagcagcagcaagattttttgtgaagagcaacagaacaaaccccccaccgcgtagaaggggaccccactgggttgccgccgctggtcagggtagccagcttttatttccttatttgtccctgcccatgtcctgctgattggtccattttacagagtgccaattggtccattttacaaagtgctgattggtccactttacagagtgctgattggtctattttacaaacctctagctagctacagagtgctgattggtgcattttgacagagcactgattggtacatttcacaaacctctagctagctacagagtgctgattggtgcattttacaatccccttgtaagacagaaaagttcttcaagtccccacccgacccagaagtccagctggcttcacctctcagtgtgaccaacctccaagcttttttatttcattgcttggcttccctctctaccatgtccatttctgcacatttatttcagcctcacattgaccagctcctgcgtgccaggcatggcctaagtgttattcgaacaaagcttcggaagctagtccacttgcttctgtctagaagaggagggcggtgctgggaggaacctccctgactcctgctgcagacccactgagaggtgactcccacacggctgtcctggaacaagacagcagcttttcttaggttgttctaagttaagggctctcactgctggtaagacagggaaatagaggagataaaaataacaaaacaaaaggagaagtcacaaagttacaggaaatctcaatatatctttctgttctggatgctgctccaaacacaactgcagcagggcctctttgtggggggttcttatttgagagccacaaaggacctcaaagccaaaacagactgattatctagcccacctccatgtcctcccctccttccccctacttccttactaacagacccaattttgttcaggaatccaccccctgccgagaagaaactgatcctattcccagctcagagccaaatcctgaatcatccaatattacccccttgtcaggagtaggttgaggggtgacaagtggcccatgctttttctggggtcagggagaagaaatgattattagaacaattttggtttaaactttttttttttttttgaaacagggtctcactctgtcacccaggctggaatgcagtggtgcgatctcagctcactgcagcctcaacctctgcagcctcaagtgattctcccacctcagcctcctgactagctgtgactacaggcctgtgccaccatgcctcgctaatttttgtattttttgtagagacagtgttttgccatgttgcccaggatggtctttcacttctgagctcaagcaatccatcagccttggcctcccaaagtgctgggattacaggcatgagctactgcacccagcctaaacttgtttctaattagcagttccaaatttttagatgctcatatctctgactaattacaataacagatgatgaaatatcgaagtgttgaactgtcctctcaattccagccggaacaaacagattctgttttctctacattttgactgaactgtcttggtgtcatacattagatggtaaacttctcctctgttccaatctcccccttcttcatggctaattagttaaaagcacactgttgataaacacaatatgaatagaaaaatttttgtttagccttaaaaaatagcagtatgacaatttgtcttgaattttgacctttcagtggtggcttgtatcaaagttacggtcttgggatagtgctatgacccgctgaaatggctgcgggcctgaaattttgatcgtaaggcaaattttggtacagaaaatcgcctgtttctgctgacttctgctttagacatccactcttaaggaaaagcattgttatcccaccagctaacacatcactctctaccatatatcaaagagtctcaagatccttctattcatgaaaaatgaaaatattctcaccacatcctcgcagtaatgttcaacataaattaccaagcacagagacagtttgggaatgtacattataaatggccttccctacaagactaagagtgaatcctaatgtaaactatagactttgggtggtaataatgtgttaatgtcggttgacagattgtaataaatgcaccgctgtaatgtggaatgttgaagtgagggaagctgtaagtgtatggagacagataaatgggaattctctgtactttctgctcaattttactgtgaacctaagactgctcaaaaaagtagaagtaagtaaatacataagtcagtaaataaatggccttttcttgggctgagaaatgaagacatttcctatatgttacttggacctgtaaattcactctggggagatatatatatatatcagaaagtatatgttacttggacctgtaaattcactctggggatgtgtgtgtatatatatatacacatatatattacatatatatatatacacatatatattagaaagtaaatatttcttgttaaaatctgagatataactgccctctaaaggtgtttatttcctgggttggcttttttgttttgttttgttttgtttatttgtttttgaggcagagtctcgttctgtagcccaggctggagtgcggtggcacagtctccactcactgcaacctccacctcctgggtcccagttcaagcaattctcctgcctcagcctcccaagtagctgggattacaggcacatgccaccatgctcagctaatttttgtattttttagtagagacacagtttcaccgtgtgggccaggctggtcttgaactcctgaccttgtgatctgcctgcctcggcctcccaaagtgctgggattagaggtgtgagtgaaagcacctggccgggttggctcttatctatttacttgatagccaggtttggagtcattagtggctgttgcttactccttgaacaaacatttttgagtgttgtgctgtacaggccactggatagatagcgatgaatcccacacagtcctgtcctcagagcccacatcttcatagatctataaattaatatttgcagtagagtatgacaaaaaaactccaatagaagtgcctccagggaagatggtaccaattgaactggttgctggggaggtgtcaggggagggttcatggcagaagcctcattgaaggatctcagaatttcatgcctcctgggaggttcagtccaagacacctacctccatctttcagtgcagagggcacatgaggggacctgccaagatgaagccagagaggcaacagtggtcaaatgatagaaggcctggggcgggaaggggcaggtaaagatttggggctttatccaaatggactttattgtagttgtattcatttgataccttttgtaagttccttgtttagttattacatgattatcataaagtttgggagcataatggttagaaagatatcacagacttaggaaaaggatgcatgttcctttaatttggctcttttaatggactgagagactatgcaacgctcatggctggaggacaagcttccccggccttccagtcccataaggacacctgctgttaatggcagtcctgatggagtgtagatccctcgggctgccatcctcacaaaggtgtgttactttctggctggcagctccagatggccctagggactctgaactcagcctgtgtccgaaggcttactgcaagactgtgcgactccaccatggtcagtttccccggggaaccatctctctaccaagcccagttttccattgcaagaacaattgccaagatgtctaagtttctatgtgagaattttggcatcttgggttccttttaaataggacacacttgtatgctctaaagaaaaaaagaaaaggtttctcatgaagcattagctttcaagattacagttcggtaggatgttcaagatgcttagggtgaataaaaatgacagacagctgaacacttcctataaatgaaacaccaatatagatctaagtttcatgcatgactctcaatgtggttaatgaaaaggaagataaaaaaaaaaaaggttggccatatttgcagggcatttgctcccaaatgtttcaatcctgttttctttagactttgaaaagggggattgcacgttatctgtcaagaaggcatcaaagcagagaaatccacaaatgtgtagtgtcagatagaattcaagccttcagaaaggactccactcctttggttactaagagaactaggggcttgtatttctaagatgtcactagctggaggcgctgagcaggtaatggtctatgttttcctagactataaaatcctgattatatggtttaataaaataagaatctcagagttctgatggaaaacaagtaaacttcaggtcttagcaggcactagcagaaagcaccagagaaaactgggggagaggttaggactcctgtcccaaagatccccctcaattatcctgccatgttatcagttccctctttacatgttaccaaacatgactactaatttctatttttttccaagactattagatgtattcaaaattcactcttcttacaaggatagagaaaagtgcctatcgatgcttaataacccaacatatatttaatagaagaattaaatcaccttctgcaaaggaccaagaaaagctccatttgatcaattcctttaagacatgaagacttctccttttctaagaatcgccatagtaaaatgcaagctcagcatgacataccccaaggaaaaatgtatctgtcccttctgcttttactacagttccataagggtaataccgagttgttttgcccacatgggggctctggaatcttggctgtgatgcattggtaggatatttgtcaccaaaactgactcagcaatcagttaaatattaaacaaagcactgattagtgttcctgattcatatttgtgctttgtttaacatttaacttccgaattttatacatctattaaacaatattcctcttgacattcgaacactatctgcacaattaataaatcaaaaacttattaaaaattgaaacaattaaaaattcccaaacttataaaccattgtttacaaaattatttaaccacactctccaacacttttaaataaaaccataagtttaatatgtcagacccttttaaatgtttcaaacacctaaaaagtcagcaaaaatgcacacaaaacgtcatactgattgaaaaatatatatgcacacttacctttacactggttacaaaggcatgaagattatgggtatatattggttttaaaaagtacttttatacttattcttatattttctctgttactttcttagagtcaatgcgatcgtttcctaggattagagtatgaagtgatacagtttctcctaagaatacaaatttctttcagaaccaaaagaaaaataatctcaggccagccagctctggggttactgattcttatttgaaactgataaagtgtctcccaacattattgcacttgagcttaaatgtggcctaagaatataaaagtccgtgccttcacattggtatccttttctgagaccagagtgtttcctaaagtgcgcttcatctcctaggagactagggattttttttttttttttttgagacaaagtctcgctctatcacccaggctagagtgcagtgttgtgatctcggctcactgcagcctctgcctcctgggttcaagagattctcatgccaccacgcctggttaattttttgtattttttgtatttgagatggggtctctccatatttcacaggctggtctcaaactcccaggatcaagtgatccacccacctcaacctcccaaactgctgggattacaggcgtgaggcactgcacccggccaagacgaggaatttaaaccctgcagtttgctgtccttacgagcacatttggccaattatccttccatgttatcagttccctctttacatgttaccaagcatgactactaatttctatttttttccaggactattagttgtattcaaaattcactctttccttcttacaaggatagagaaaagtgcctatcgatgcttaataacccaacatatatttaatagaagaaataatatcacccatatataaatctgccattaaaaataatatgaaataaaaccctatcgcatttgccatttacatcaacttttctcttcatagcttcattaggaacttacagctcttcacagactccatgtgttttaattgattatagccatcaatcttatttgatattcaaaatctcagagcttgaccagaggaaacctctttaatctagcttcttagtccttccagaaccaccctgtgatattctagaaagcatccttgctttctggttacaaaagaaacttccaggcttaaaccatttgttttaccctactcaggacaacccttccaaagagcccctgtttctttaagtggagaaaactgttagagacaaagtctggccatttaggggtacaggagagttgtggtgggcattagtactactcctgctgctgctgctgctgctgctgctgtgtccactgttagtgacagaagtgggaaaatatttaagttgagttcacattagtgttcccagtttagcgtgagcattgctccattatgttgttctaatgtaaaaatgtcaaacacatttttctcaatgagatacttaacattttaacccttcatccaagctatatgttacacctcacttttctatagttgtatatttagaaaataaatatttatgaaatacttgatatttctcatcaatccttggtcactcaattgaagggtgtagaagtaaggtcaggttcaccttagtgaggggcctgcatctaaccttatctgaaggggcttatgaatttgggatttattaccttgacagaaagaaatattgagaatgaccccacccatgctttatagcaatcgctctttatagtttatttcatagtgacaagaaggaactcatccatggtgggtttttccctgagtggtctgtatggtcatatcagaactgaaatcatcccttcttgcttctgagcccccgtttccaagtcttgttctttgtttctgtaggtagtaaagtgaattctttaaatccctgccctccatcagctgctaaagcattctgcttccctctgataagattaacagaatgttggctgtggttacgggatgctttgcagtctatgtcttaaaccaagccagccatgttagcatttcctctagtggtggtgttttaggccaattgagaatgtgggtgatattaatattttccaaccagctgataacaggaaagacacttctgcttggagtccactttgagaagagatttattatttaggcagcacaggacacctccattaatcttcccccagcagtgcccatctaccatcaagttcatatactttccccagggttcaaagaagggtataattttagccagcgattagtcaatatttatcaataagaataataacagtaaaattacaatggccaatgtttgaatccctaatgtgtgccaggcacagtacggggccttttgcagctattatatcataaaacccttacaacagccccatgaaatttgcaccatgatttgcttcattttacttttggggaaaccacggatcaagtaactgaagtgatttctctaggactcacagatgagcggtggcagagcctggaattagatatatctgatgttagtgttttgaggaatcactctccccaaaagccatagctcccagacattcttatgtaatttgtctttgctgaggcttgggtattgatgatttaaaagtccccagagaccagatttcatctggtatgctgtgggagtcaagtaacgtccaaggccaagcctgtctgagagaggtttttattagctccaaaattataataacttccacagccttcttccaccaattctgccttccactgaaacagcgctggtgatgtttagaggtatgagtttgggacaattatcaggagaagcattttggtgctattgtcccaccccttctgtcctgagaggttttatctggtctttcagtatttcaaataggtcatgactagattccatgcatccctagaaaacatagcctaaattttaaattaaagtatgaggtggaagaaacagcctttcttcccttttgtttccaaggacagatggagtcaaaagtggaactggggcccgcagagccggatagcttgggcagtacgtgtgtgcacctgcaggctgtggagacaggtatttccatggagctcactcgccctgcctctcatccaggcctgaaaatcataggtaactatgaggcaagaggaacccagggtggtgggaacaccctagggtgatcccaggctggggacctttggactaaaaagatgaaagccaacattccctccccaggaggagatgcaactcctgcactctctagtgaccatcactgggatattgcacagatctgcagtcaccttctaaatccccttaaagtggacctagccatcctctccattttaagaccacatctcctgtctgctacagcccctctcgcttctttttctttaaggatatctggctggttgtattgggttaacatgcaagaagagagtaccaatcactccataacttgggtaatgcatgtcaatggtgatctgtgtggggccgcaaggttccagatggttgggacaactctacaatcagtcacatttgggttggttaaatcccccactcatctttacagctgtatcctgcaagttagtggctgcctgtctctgaacttcaccttccttatggttgtcaaaaatacctccatgggataaaaacgcagcatctgtagattcccaaataggtgcaagtagattcccaaataggtgcaaataggttcattcgttggttcattctgcagtcagggagctttcagtctactggcatgcaagacgcaatgataatgagaatacttcacaatgagtgtgacgtgatgactgatgaatgtgacaaaggagaagtaggatgcacttagacagcctgggggaattgagttgtggccagaagggagagagagtgtccattctccacctcatcactttgctgccaagagaaacaggaatttcttagacaagttctcaggtccctcggtgagactggcagcctaaaaaaggcaccagggagcagggggcactcacatcatgccatccccccacagagcatcccgctggccatctgcatcagcccgacccccacaggatagaagactggcacatccaagttgctccttccacaccctctccccactgaggcctcgtctcctccgccctgtggccaattgaaggtgaactcctaacgtgcattctgcctgggatcccagaggttgtggcagccagatgagtcacctcacaaatacagcacgtgttcctcgggggcggcggtgggaggaaacacgtgaagagctctctctgtgataatagaccatttagagcttcagatggcgaaaacaagctgatcaggtgcaggccctccaggaggctggcaggtgactcccagccagcacgccctccatcgcacgttggggaagctggaaagagcctggtggctgccgggcctccctctggcatcctctctccctccaaggctgtgtgctccccaccttgtctctccttttttcattccattgctctgttctgtttctgtctacccattcgtcttttcttcctcttctctttctgttgccattctctttctcttctcctctcaacatgtccttctctctacccgtttccccctccccttctctctctcctccctctttccctctccctctcttcctttcccaaatctctcttagccaggctccttttcgccctttgcctctcaaaccctcctccacctttccaccctctctctgcgttctgcttctcccttcttccttccgtgtctctggctcacttatctgccctctccacatcttcttccatttgccaccctccctctctgtagccacacccagtgggctcagagctgggtctttcttttttttgttttttcttttttctttttttttttttttgagatggagtttcactcttgttgcccaggctggagtgcagtggcgcaatctccactcactgcaatctctgcctcctagtttcaagcaattctcttgcctcagcctcctgagtagctgcgattacagtcatgcgccaccacgcccggctaattttgtatttttagtagagacgggatttctccatgttggtcaggctagtctcaagctcccgacctcaggtgatctgcctgcctcggcctctcaaagtgccaggattataggtgtaagccaccgcacccagccagatctaggtctttcatccccctacacaaccctggcctggcctgggcctctggtcttgggcctggaagggagtcccatcctccctccctcagctggatttcttaaggataaaacctttgctccttccttcaccacacctctccacatcccaaactcaagcccacagagcccagctctgggcccagggtgtggacggggagggtggctggtggcccagagctgagccctgtgagtcaacagcatgcctagactcacacacagacacatggcccaccttcagggtcatgaggattcataaaccctattctgcgaagtgcctccaggaatcatcaagggagctagggcagctctgagtctccaccaggcccaccctccgcctctcagggctgagcttcacttcccttcccaaaggggccagggagaggggctgctgatgacatgatctcagaggaaggccaaggcctccaggctgcctctgggcctggcacaggaaggaggaggagaaaatagggagcccaaggaaagatcaacccagcccagcccaaggacccccagccccagccccagccccagctgggctcaaactaattgaaaacagactggaaaaggctgcttttgcccttcctctagactcagcatcatcaagactggagggacagagcatttgaatcatcagacgctgggccagacgtcaccccacgcgttttctcattttatcgtcctaagaagcccagaaggtgcgtaaaatggcctgtcccaaacagatgaggacattacctttctcctcttcctcctcctccttcttcttcttcttctttttgcttcatttttctttcattttttcccccagatgttgcatttcagagaggctgagcgtgttgactaaggtcacacagctacaaacatcagggacctgcgaaaaagctctgttccctggtgacaggtgttctgtgatcctaacacagccggaggtggggacaacgtccttgcagtaacaaaggccctgttgctcaactcagtggacatcaggccctgttttcattcattagcaggtcagggattccagtgtcacctgtgccatgtattccagctgatctacctgcaagcctctactccccattttcccagcagcagccgcagacaccacccaactggcagaaatttcaaacaaggggttctgccttgcactccggtgcaagggttgggcacgtggactcacatgtgaccaatcacattgtctttcctgagatcctgcattttgaccagaggaatcaagaacaaaaagtggtggcaactgatttatccttaagaaatccaagtaatgagttcctgctgccaagatttctgggatttccctggctcctgccagtttctggatttggttcttaagcattttctgggtgtgtgagccccatacccttctcatagcttcttcagccagagtcagtttctggtttttgcaatcaaaaataacccaactaagatttgctatcctgcaggcaagagagggccacagcttgatagtcaaggttagccattgtctgggccctgcctgccccagccagctttctttcctccccagcctgtacctgccaccctgagcacaccacactggtacacgcctgtgtacttgtcttttatggtctcactataatttatttaatccctcattaatgaacatttctaagttgaagtataattcatgtattagtcagggttctccagagaaacagaaccaacaggatgtgtgtgtatatatattatacacattattatatattacacacatgcacacacacagacatatctatatatctagagagagaaagagatttcctttaaggaattggcctacatgattgtaggggctggcaaattcaaaatcggcagggcaagtagtcaagggaaattcaaaattggcagggcaagaagcctagggaaaagttgcaggcagaattgtttcttcctgggagagacctcagtctttttccctgaaggccttcagctgactcaatgaagtttacccatattatggagagtaatccactttcttcaaagactcctgctttaaatgttaatttctttgaaaaaattgccttcacagcaacatctagactggtgtttgaccaaacaactgggtactatggcctaggcaagttgacacgcaaaattaaccgacacaattcacataccgtagcataaaatgaacccttctaaagtgcacaattccatgtttttagcatgttcacaaggtcatcatcatcacgatatagtcacggaacttttttttttttttttttaagacagggtctggctgtgtcacccaggctggagtgcagtgaagtgatctcaactcactataacctccacctcctcagttcaagcaatcctcccacctcagcccctcgagtagctggaaccacaggcgcatgccaccaaatccagctaatttttgtattttttgtagagacaggggccatgttacccaggctggtctcgaactcctgggctcaaggtatccacctaccctggcctcccaaagtgctgggattacaggcatgaaccactgcgcacggcccagtcacagtacatttttcttgccccagaaaaaaaaccctgactcctcccagctcctggcaaccaataaacacattggtctgcatgttgttcatgctggttcaccttcctccttgcctccctttgactgcctcataaatttccactcattcctcaagagttagcccttctgaaatatcttccttgatcccacctactagaagcaccctgtcccacctcaaactgagtcaatcactttattttctgtgaacccccaatataagctgatggtgcctcctggaatagcctttagcaaaagatattaaaattgcctaatcaacttgcttctctttctcaccaaaccagcagttcttaaattatgatttcagggcttcttgacacttaccccatatttttaccatttgatgtgcttgtgtttccgggaagagagttcagggtttcatcagatcttcaaaaggatcccaggaagggccaagagccttgagattagggcttctcgaagggcagaggcatgcttcatgagttcccttgtgtccttatgcctggtgcagatgaggtctgctggatgagcctgggtgatgaatgagtagtcacatgtaggaaaagtgtccttccttcaagggttttccatcatcactctctatgaagcagtgaaaaagcaaaacaaagtaacatacggttaagcatcagaggaggaggatagacacataattacatattcatttgttcatctgctcatccattcacaatttagtgtatgcatctacaaggtacaaagcccagtgctcccagcagcgggtgttcagagctccgagaagcaagcaggcaccacatgttggtctcagaaggtagagagagactgtaaagtaaaccaaggaaggctccctgggggagaggccgcatgacatgagcgaagccaagagcaaggactgggactcagccagatggaacagagcccggggaagggtgtcttgagtgtgtgtgctggggggagcatccacgtgagcaaatgccaggcctgcagaggacccagagaagggagagaatttacacacccacagtccctgaagcctggagaggactttttaagattcccggtgacggtgcagagaagctgagccggggcctgactacagtgaggtgtggggtgtaattaccaagccagagtgcagagctgagccaagcaggtaagagtactgaccccgagcccactcgggctctgagcagaaggaagatttcattagtgttagagaggaaggatgtgccttctcccccggaggccagagggcaggagaccagccaggcggggaggctgacccaatggccccggaatggtgatggagcagcctgggaggctgcaggcactgaaggaagaggtaggggacgatgactccatctgtcacctcggcacttaccccaaaagatggaggactgctggcagaaacagacagaaatttcccttgagaaggagaaagccatgctataggcaatcaagatttgcacattgtcagcagagaaggaatgagactgtctggttgccgctagactttggccagggctgtcctgcaggtaagggcctcgtgcaggaggcccctgggcaagggccggcccttctcctctccctcagtgtcctggaaaggccccagggctgccccaacccctgacctctctccttctttctccatattgctagacccccttctcttggtcccctgcctcctcccactggtgtgcacccacaccttcagacagttctgagcagaccacgcaaaatacaactgtgatgttatttgcagcaggcattctggacccagaactgtgcttggtcttgaagttgaaaggtagcaatcactcatactcctctcccatgaacaatttgagaaaaaatggaggctcagggcagaagttaccccctttacaactgacgggagctatcctggggaatgaagcctgaggctaaaacctatgccctatttccagcctcatgaagtaaacttagccactgggtccctagcaaagaaactggagaactgagggtctcccccaggtctgccctccaactgccccaagccccacatgcctgcaggcggccctgggatatctgccatgtgcagggaataatgagcctggcagctgcaagaaggagatgagctccagggtttgagggttaaggacattcaccagtctcccagcacactcatctccaccccaccccagtgaatgagactgagagggctcaaggtgggggcaacaggttctctccattaccttccagccaatacctgcatgtacattgagatactcagtaagccatgagaagcgctgtgtgaccatgactgagttgtttaaactctctgttcatgctcctcccctgcaaagtgaaggcattcaaaatcatctgtattcatggtgaacctactttgttctaaggcctctgggacatccaaagttggataggccatgtccctgacccagctgactgctctcacccttgctttcactgtgtgaaattctcccacattgacgggctgggggtagggcaactacaattgagaagcacaagggagccccccgtggtgatgaaacagttggtatcttgactgtggtgtttacacaaatctatgtgtgtgataaaatgacacagaactacacacatacacacacccataagagtgcatataaaactggttagatccaagcaaggtgtgtggaccatgccaatgtcagttttttgactttgacattgtcctgtggttccctaagatgttaccactgggggaaactgggtgaagggtgcaagggcctctcagtattattatgggaattttctgtgagtctataatcctttcaaaagaaaaggttattaaaaaatctcacatgacttctcactactctgcttataaaatccacactcctcacggagcaccacaggcccgctgtaatctggcctctgtctcctctccaacctctccccaagctccctaggcccagccccatccccttctctctgcaccttgagcacacccagcccactctgtgaggctgtaggccttgctgtttcttttacctcaagttctctcgccccaaatcctaaacacaagtaacttctgtcattcaaatttcacaatcagtctccttttcttgtaaggccttctttctcaggctgatcccttcagccctaatacagttggcccttccactgtgtttagggtgctacatcaccatcacctcttggtttttggctaagatcaagtgtagagtcctgctatcatcagacatgatctgattcgtttgtttgcttacctatcactgtcagtccggacctcccctccctctgagaatgaagcagagaaaatgttatcttggtcaccagtgtatcctggaaactgcaacaggggcaggcacaggcaggagtgcagtgaatatcaatggtagatgaatgaatgaatgaatgaagaatgaatgaagaatgaatgaatgaatgcaccacacaaagtagcattctagcagaagtgaaaacaaggttacctagtgcagactttcccagccaggactcatactatttttaaacacatacacctgcttcggtgatgtactgaaggcctcaggctactctccccgcccacatctcccacccctctaacaggattcaaatctccagtgctcatatttcctcctcatcacttacctagcaaatctggctcacagtataatatcagtcatttatacttcagtctgaattccaggtcagtgccaacttcctccagatatttgtggtttaagcttcatgtgatattacgtcatcttaagggcatttagtaaaggggaagaaggaacatttttggacagaggccttttcctgtgctcatttgtgcctcacaggaagccaagagtaaatgtgcatctagacctacaggggaggtcttggcagttacagcaaactcagggaattttaaatatgccggaaactttccagagccctgagttgcagtcccagctctgtcactgtctctctgtgctttgctaaacagacttcgcccctccgtgggccgtctgtgaaaatagggcccagctcgatggcatataaaggccctctgacttccagtagtaaaactctagaggagcccttgttttctggggagactctttctgagttttcataataatgttgagtagttctcttttcttgctcacgccgacttttctccagttctcggacaccagttctgggtacccaacaattcaatccagttctgacactaactatccagagttagcagaggccccacaggttaaaggcctcgtcccacaaaactgcccccacttcagacaccagtggccagtctcagaccccctgtacttctgaccaaccagctataagtcaaggattcctaagactccttcctcaggtctaataatttgctaaagaagctcacagaactcaggaacacactttacttatgtttactggtttgttttcaaggatgcaactcagaaacagccaaatgaaatgactgaatcaggcaagatatggggttgggggatgaggcatcgagtttctatgccctctccaggcatgcctttctcccagcacttggacgcgttctccaacagggaagctctccaaatcttggtgcttaggggtttttatggaggttcaattacataagcatgattgatcaaattattggccaatggtgactgactcaatctccagcctcttccttctctccagaagttggggatggggctgaaagtctcaagcttccagtcaaggcttggtctttttggtgaccagcccaatcctgaagctatcaaaggctcaccaagagtcacctcactggaacaaaagatgctcctataccctcatcactcgggaaactccaagggttttaggggctttgtgctaggaatgggagacagagaccaaatatctatctatttatttatttatttatttattttttgagacggagtctcactctgtcacccaggctggagtgcagtggcacaacatctgcctcccaggttcaagtgattctcctgcctcagcctcccaagtagctgggactacaggtgcccaccaccatgcctggctaatttttgtatttttagtagagacggggtttcaccatgctggccaggatggtattgattccctgacctcatgatccaaccaccttgacctcccaaagtgctgggattacaggcgtaagccacctcccccggcccctttctatgacaccacagatgggcacagtcagaatcagagcctgaggtgcaggtcaaatcccttagccctccaccagtcccgcccacttggtttctgtggtagaaagttttgtttactatctgtatctgtatcccccaccaaatgcgagctcccccatcccaccctgatgctgaactgaggacactcagggctttgtgtggctctggcagcttgcacaatgggttctcagatgaggtattccatgcccttcttcctggagtagtaagagtcaatgcttttcagttcagcagaaattcatgagatattagaaagcacttcctagatctgcgtagaagttggaataggttgcatatagaagctaggaaggttccatccctggagatctttaggaagatcccattgctctgggtgactcagtcgctcatttcaatcatgaattacaggcattatcgagttaagtcaccatggtggctggacctgctttctccaaagtccctccagctgcaggttggtgagcccatagatggggttagtgaagcattgttggtcagctcaccagggcacccttatgagagtgaagtagaccgtgactcctctgcagttggttaaggaagaggacactgaacaaagtcatgtgttaagagtggtgtttggctggcaaattctgattcatctttcaggaccctgctcaagcatctcctcttttgagaagcctggcctggccctctccccatgccccactcttccttccccaggtttaattaaatgtctcttctcagctggtgtgacctcttggttgattgcaaatagtgcatactccactctctctccacggaactgtgagctttctaagggccagaaccatacccacctcatctctcactgcctccctggtgccatcgcaggacaggtggggcagagcaggggcccggtggctgctggctaaattgttggagggactggctgggagcccatacatcacagacagcagataccccagggactggcagtgtgggaaccaggtgagaagccccagtctcaggtctgcagccttcctcagtctcctcactcagtagccttgattcccagcaaaccacatcaatttctcattgcacaccctgctcaatgctcatctgcatagtgtcctccatccagagcagccctgagctgtgggcacgaatactaatggatcatgcaaatgccagcctagggcaagagtgccctggactgtcaattagctccccccagcaccagctacagtgcccaaccccttcacttgatacaggccagcccaatgcaagaaggagcaacagaaaaagaactcggcttgaaggactgctctagtcaaggtagtgtgttgtggcagcctggaaagggatcttccatgtagagtgagggaagaagagagccagcctggcctctcaggaagaggttcccacaggcactcttgggaggaaaggtggtgctcttgggggcccaggtaataattgctacacgaatgccacggctcttggaactgctgcttcatccttttccctccacctggccatctatgtgccaggccaccagcgtacgtcctgtgttgtcctctaaaccaagaccaaagctcttcacagccactcttctctgacccagtaccaactccatcctgggagggaggatgacaggctccccgtcccctcacctcttcttcccaatactgctgtttcctcccagttctttctcttccctccactgctcccatctgctttccttccttagtggataaaagcattaaatttgaaggcagagagatcgggttcaaacccagactctacagatcactcaagctttgtggcttgggcgaattacaccatgcctctgaacttcagtttgctagtctataaaatggagaaaagagaagtacctgccacagtggcattgtgaggatcattttatgaatagctaagaatttcaggtaactcactctgatgtaccagaaagttactttgcttactgcttcaatcactgaacttaatttctactccaagttcccattcctctcagtggcagagaaccctcaatcagttcaggatgccccatccccagtgttgcctgaatgttttggggtgggcttacggagcatggagcctgaagtgggctctacctctggtgggcagccctaccattcctacagaaaggcaccccaagaggttctgcttcctgtgcattctgtggtcactgtgccattcaggtcgcagctggggcctcccaggctctaggagggtttcctggaccgcaccactgttgggtgcaggggaagattccccttctccttaccggacttgcccaggagaggtaggtcaggaacccctgcctgaaaaagacacacaagtcagtggctgtgcaatgctcctgctacacacagaggtggcaggccttagaggggaaccctaggctgtgttcactctcccaggctccactttggaaaagccagggtctgctctcagctcccacattccgccaaagtctggggtttcagtgccaaacaggccaccaaccctcgaactctgcctgaggtggaggacaagggcaaacccctcttgctcctgccctccaaccagtcacatattcttccaggcctttcatctcaaaatccaagatgtgaccattgtttccgtgccacctctgccacaggtagtgaatgccgcagctcaaatgtgcggcaggttgtgtggtcacaggaaataacagaaggagccccggttaatatctcagttgtatgtggcctcatttttgcaggccctgtcccagagtcagtcctcagcacgagggcagctgagactcttttctcccccattccttcctccttccctcttcctgggtttcttcctttttcaggctccaattgcagcagcagcaatgctgggagcggagatcctgggagcccggagccagctctgacatgttcagcgggccgtgcagggtcaggggcatgctcatcggctcatcactggcatgattactaatcatcaggcagcggcagggttactgttccctcctcccctccctgctcacttcctcagggtcttcaggctgcaggagccgaagagggaaagaccctgcgtgcaccctggcaggctgataatcacagctgcagcccccaggcactaaaaggatgggtgggagcatcatccaccactcaaagggctggggacccttgtccctcccatgtgcatccatctctcctatctctgagtccccagtgaactgctgcctccctagagaaacagtgctagaagtcagtggcaagagcagcaggaggacttggagctacatgcagagtgtgagctccggagtcagaccagctgagttcaaggccagctccaccatctattcactgtgacttcaggaaggttgcttaacctctctgtgccttagctgcctcatctataaaacaggaaacaatgagagtctttccttatggggctattgaaatgattaagtgagatcaggcatgtgatggcacacagtaagaactccataaacagaggtcaccactgctaatgcaattattctatcacctcaggagactaaagcaggggaggaaacaccattgactcctggacatttacccaaggagattatggatccatgttttgcacacactttagaaagacaaggaattctaaccacagcatctgtctccactgcccccgtcatttcagtctcacccgtccaccctcaacctcaccactgtggcccggaaatgcggttgcccagggccactctcaccccacctcagccctgctctgctcaagtctcacttccactccttccagctcccatccctttctacccagctccaccctgatttctccaccatgacctttaccctcctagtctgatctagacccctgatcttgccgagtatctaggactttggtgcctttgaccctcagcagcagaggtagagagggatctcggtgaagtctgggatgttatagtgacttgtttatctaagtgccctgagactgtgagttccctaatgcagggagcatcaacctctgcagagagccccagagccctgctcaggtgtgatgaacaggaggcactcacttgatgccctcacaaagttgtgagtgaatgaatgaatgagtgaatgaatgattgaatgaagattagtgattatgttaatgacctgcctttttcatgagccttgcaacctcccaggtaccacactaaagcacttaaatgcttccactcatttaatcctcatagcaaccctaagacataggcgtaattattgtacctattttatagatgttgaaactgaggatcagtgaagttaaaggcacacagctaagggatgaatggataaaatcctttaccataacctttcctccttaggacaaagtttcttcaccaactgtccaaggctgtgtttcactggggagagtctgaaattctacaccaagcatgagcatgtgttcatgcagcatggtaactctgggggaaaaggttcacaggttttatcagatacttacagtttgttagaacatatttgaatccatccatctaaccacccgtcccctttcaatccacccttctgtccacccccagacagccatttgatcaatattcatgaaatatctgccttgcgccaagcatagtgctggcacccatgaattccctggtctccagaaatatccttccccctctccctgactacccctgcccccgcctcaccacacacacactccttgcaggatctgggtaactgggagggctttaccgccagtgtcccagctgcgtgggtggctgcactctgtctgaactcatctcagctctggtggagactgtggcagcgcagaagcgtgcagggggaatcctcaggcagcgcagccatcaggacatgaagggcagagcctgtgccccggcttccccggcttccgctgcagtctacatcagtcctgctccctccagaacatgatcaaccgggacagatgaggccatgcttgatgcataaggatgcagccagggagagctgcctcccaaacccaagtcctattcaaaggtcttttcttcctcctggggaggtaggggagaaggtccaagcaaagggaactggaaggggaaagtgaggcatggagtttgtgttttctgaatcaggactgtgttccagccagggagaccctgtgtcaggcacttttgtaatcacgatcactttcagcctcaccctgcgacctccaacgacattgctgagattgttctccttgcaaacatgaggaaattgaggggctcaaaggtcaaataacttgcccaaagtcacaaaacaaatccgggactttaagcctgatctgcttgacctgaaactcatatctacttccctgccctctgaagatctatatgtcctatgtcatcacttcactgttcacacaaggtgatacctggcttctccaagcacctgctaccctgaacttactgcaccactctttccttcctagcctgaatgcaatttgcaatgaggagatgatttgattttcttcagccctagacctccagcttcctgagagcaggtactcttgcctcttcttgctcattattgatccatatatttagaatagcgcctggcaggtagatggtgcttaataaatattcattgaataaatgaatgaatgaatgatccaatgagccccaaagcaaataacaataaaggacatttgcagagtgctctacagagagacaagtgctttccctttactttatcttaccccattctcacaacaatcccctgacatgattgggttcatgtttcacagatgaggaggctaacggccaggtgtacataccaggggacatgggactgggttcatatgagctcaggggtaaatgatgacaccctttcccctgccctgaaggatctcagtttgagtatttgtagcacacttaggatgttctgggccaggctgagtggcggtggatgggggcggtggaggtggggtatgcaaagcaggaaactcggcctttgctttctaaaagctcccagtctatttgaggccagacttatgcatgcagaacatttgggaaatggtacaagacagcagcaagcatagtgctgaattgcacataatcaggtgccaactgcattcccttccttaactaatctgagtcttttaataccagatggggaccctgagaatagatttcctatcaaacagatgaagagcaaagatgggagccgagggaaatgctgtggcttactcatttttatacccctgtaacccagcatgatgtctggcccacagcaacaggaatagggcagtccaccttcaataatgggccactctatgtgccaggcacctgctaagggccccacaaacatcatgtcaccaatccctcacagcaacactaccacttactaaaggaattatgaaagtaatccacaagaagctgaaagcagggttcagagatcgtactcatcatgcccacagtctcagagtaaaggggcaagctcagtgtttgaacccaattctagcagcctcccaaattaatgctctcaatctgactctatgctacctctgtgcctggaaggaactactgttgtccataaggatgagaagaaacatggctaagggagcactgagtagggaggaaggaggcagcagggaggaagaaataaattaagaaagaaagagatacaaagaggaagaaaggagagggggagggagggaaagaacagggcttgtgtgttacataaactcagacaagcacatgcatgttttaacaggattcctgcaggtctgacaatctcactccttcctccctgaacaaccttagaggggttgcctaaggagtcctatatagaggcttatggcagaaggaaggccttgcgtccagaactttctgagctcatggattgacactggggttgcgcatcagtctgcttggaatgccttcaaaaaataccccagtctgggtggcttatacaacagaaatctattttctcatggttctgaaaactggaagtccaagatcaaggtgccagcagggttggtgtctggtgaggcctctcaccttgtgttgcaactgccttttccctgtgtgctcacatggtatctttgtgcgtggggggtctttggagtctctccttgtaaggacactaactctatcagatcagggccccacccttatgacctcttttaaccttcattagttccttagaggtcccttcttcaaatacagccatacaggggcttagagcttcaacacagggattttggagggacacaaacattcagtccacaccggggtgcatgagggaggggtcagagctggagaaagtgcatgagctagttcaccttccagagtaaagggagcaacagccactgaagctcaggttggatggggctggcaaggtcgctgtattgagtacatcatgggagggacaacaggacaaatggctcctgcagtcagggtgactgatgggaggcttcttcagcactccctctgcacattcattttgtcactccctctctccccatgcagttctttgctctctgttgcaagttcccaggaggcaggcagagggcctgttatcatcatctttctctcttgcccctcacacttacctgtgttcttctacttagacacattctttgtgagcatctcatgggtgatgttggctgcattgtacagtgggcacgtgcgtatgtgtgtgtatttatctgcaaataatacccatgtcacaaggcgtccgcaggaataaatgagctattgtgcatgtaaatatctggtacatggtagatacatgaatgaatgaatatttgttgaataaataagtgaatgaatgaatcttcacttggcagagcatgtgtcttcctttaaggggcaaggatgatctggtaatcatcagtttctgcttactaactgggtcactgagcaaagaaaagagactcactcattcatttattcagcataggttggctgcacccctgtcagaaaccggaggttaagcagaaagtagagagttaaatcagtatgtaaagcagttaaaacagtccagagggagagacaggcaaggaaaggaacaatgagaaacaaagtaaggagtgctctgataagaagccctgggtgctatggaaaccacaagcagggcaccgactcagggccagggagggatccctggaggagatgacatctgcagtagatattccagggtaagcagcaggtggccagaaggagaaagaggtgaggaacattccaggcaaggggaacagcacgtgcaaaggccctgaaggagaaccacaacacgcatctgagaaatagtgaggggtctgggtggctgagccacaaagggaacaccaggggtcagggaggatttgtagaagaagccacaggccacaaaaaagacctcataattcatgttcaatggtttggattttattttggtgacttcactttatacctactgttcagaggcagccaattgcaaacacgtccagaagcactttgctatttctgatctgcaaaatggagcaagtcatctgtactctgcttcttcagtgggttgtggggaagcagaaatgagaggatgacattctagccttttgtgacctctcaagtgctgtccttatggtcattcaggtaccatgaaaattagcagagccccaagggggaagtagcttggtgctcacccagtggtatccctgacaagttggcaaagacacccagggtggcttaactttctcctcagcaaagagctctcctctgttccctgaatcctggatatcccactgggtcctctagtgaccccaagcttcagcctcgcatgccctcttctcgaacagagaaggcaggagggaagcagggaccagcccctgctccatcttccaggattccaggcctccctggcctggacaagccctgagctggcagttaggagagcagaggttgtgaatctggtgggacccccagcaggtctttctggctcagtgccctcatctgtgagcaggggttccccaggagaccacgacagaggcctggaacccaagttctaatcccacatcctggctgggcaacttcaggcaaatttctaacacaaggtaagcctcaatttctctctggggtaatgatcaggcacctgcttaattcacaggggtttggtgggcatcacgtggacaatgtggttgcacagcagtgggcaatgcaaaggaaaggaagtatgttagtaagtgcccctcccctgttgcacaaaacaggacacatgctgggattgcagaaaagcaataaatgctgcacaggtgaagaaaactattcaaggaccctggccaagtcacaggctacctgtggccctgaggggacagctcatgggttggcattaggggaagcagctctcaaggggcctgtatcctggggattcaactctgtgcctatgtggcattgagcctgtgtgaatgtggtgactgtcatgctgttttgctgtgtgtgcgtctgcatgcctgtgtgtttgtgtgtctctccaccttcgtggggggcaactgtaggtgtattatgagccttgggtctgtctgtgtgtacaatagcaatgtctgtgcggacttaaggacctgcgcccatatgtttgtgggactttctgggcatgcatgcttgtttatgaggccatacatccgggtattctgtgaactgctagcatggtgtgtatctgtgtggcagacagaaaatggctgggtgggattgtagggggcagcttgggcaaaggatcctcagtgtcaatcaaaatgggtctcagtgggaacccaagcagctcagacttgggggaggggaagctcttcctccaccttccagggagcaaaccttgcaattcaacaccacaaggctttgagtccacaggcagggacgcaaactttgcccattgggtgagacgccactcacagaagggaaatggcttcctaaatctaatcattgccccttcaagcactaacaacccgtgcccaggagctgatggctaatgaattattgagctggaaagggagaagaggtagaaccaaggaggaaagaaacagaaaaatgagagagcaggccgggtggggtggctctcgcctgtaatctcagcactttgggaggccaaggcgggtggatcacctgaggtcaggagttcaagcccagccagcccaacatggcgaaaccccgtctctattaaaaaatacaaaaaaatttagctgggcctagtggtgggcgcctgtaatcccagctactccggaggctgaggcaggagaatcgcttgaatctgggaggcagaggttgcagtgagcagagatcgcaccactgcactccagcctgggcaacagagcgagactccgtctcaaaaaaaaaaaaaaaagaaaaagaaaaatgagagtgtaagggcccagaggggctgagggctcctttctcctccccaactccctgtcactagaaggtgggccctgccataggaggattctgcagaaccctcaaggacccgcggagcaggacggcaccttcttcccatgaccacccatttggatgtgtttttcacccctttctgggtggggcagactttccccctccccatgagttcaggcagtgggttaaataagatttcccttgaagtcgaatgaaatcacaatgcaccacacacagggacacacacacacacacacgcacgcacgcacatcacacacacacacacacacacacacacacacacacacacatacacacacacagtctccctggggccaatctactgccccctgaacctcacccatcagccaggtgcctggccccgggtctgtctcttagggttacatgctcccggggctcccgcacataccccggcagatgagggtgcgcaggggtgagggcgcagggctgggcgtcccccgcccccaccgtgcagccctcgcccccgccccgcccctccgtagttgcccgcccgccgccccctccgccgccccctccgccgctccgactctcgccccgagcgctggcagcaggcagcaggcagcaggcgggcgcgctgtggctccgcgccgcgcggtccgggctctgttcattcatgattggtactcggccctccgagacccagcccgagcgcagggaggggagccgagtgtgcggcaggaggggcgggcggacggcggctcccgcaccgcacgcggcgctggctcggcagcctcggccgggcggccgctctggccccgtgtccagtgccaggcaggcttcagggcaccgtcctcggccctgggcgagggaaccgccgggccgggtcctcgcgcggggaagcggttccgaaggctcgcggggagcggctagccctgagtccctgcatgtgcggggctgaagaaggaagccagaagcctcctagcctcgcctccacgcttgctgaataccaagctgcaggcgagctgccgggcgcttttctctcctccaattcagagtagacaaaccacggggatttctttccagggtaggggaggggccgggcccggggtcccaactcgcactcaagtcttcgctgccatgggggccgtcatgggcaccttctcatctctgcaaaccaaacaaaggcgaccctcgaaaggtaagccaccttcttccttttgttcccctgtctgggcttgggggtgctaggcgccgaggtgggctgtgccacctgcctcccttagtccggactctcctctccacgaggagcccggacaggtgcttgtatccaaaggagagagaaatcggcgggagggctggtgtgaacacccagaggagggagccggagtggacgtctgccccagcggcaactggacccctctggggcaccaggtgtcgggactctcctcctggggaaatctctgagagccgaaggaagcggcatgttcacaggtgggggtgaccggattctctggtggaagtgtggtgaagctcttcccattcccatgacagctggcgtttgagcactcagtgagggtgctgccacactcccacactcctcctaggcggctatgccaggtgcagacctgcgagtcccttcatcaggaagagtgctctgtctgcacccccaaaacctctgcaagccaaaaggaatcagctgctgccaggggtaaaactcccaggcctcatgtcctggtggctccgggagtcaggaggagcaaccgtgaagggctggctgcgagctgagcttacatcaaggattaaaaagcataatatcgtggagtctcttctgcctggacgctgttccttcaccacctgtccccagccgaggcatggctgatctcaccatccgtgggagagtcctcaaatgggtccaggtgaagttggaaccagtgtgttgggccctggaggacaatgcaggtctccttaccagcagttcaaaagttagtggttggaataaagagactggaagcagttaggaaacgggaaatgatgggttttgttttgtttaatgttcaaatgtcactacgagtggtaagattttaagcagcttgacacttaaacattcaaattctaccatcagagcccccatcctggatacaggtgggagttaagctcctaccctacaggcctgatagtgagtagaagtgtaatggggtaagggaccccaagtgaacaataagtctcctcttagaacttggttggtctcaccctgtttagaaccacagagatctccataagtaagctgtccttgaaaccccctggaagaaggggtcccagcttctggcccagctcccaggggcatcaggctggctgagccccgaggaaagagatctctgggtgcagatcttaggtgctgaagctgggttggcatttacatcctagaacataggaagaggctttggcccatttgtccagctgagttacatgtcctgctggcaaggaagggactggttgtcctgttaccagtcctgaccagaacaggtctgcaaagctcagcccaaggccttgacattctaagcctcacctctcacagatcctgggatgctgcttgactggggacaattttcagcgccaaatataggtcttctccctcatcatctgtctgaccaccatgcggtctcagaggccaggggactgtggggacaggaaagtcaggggcttgtttttaaatattttcaatgcctgtggctctcctgggagctgggtgtcacagaaagatctcaagccctagagtcaagtggagtctgggtgtgaatcccagctccatcactccctgcctctgggaccttaggaaagtcccccgcacctccctaagcctcagtttttcatccatgaaattcgtatgctacttcccggagggaagggtatgtaggaagtagaggaagggaagactctgcctcatatactgtgttggctgcagccaccagggacccagaggaagttgttgtaaggatgtgagaatcaaatgaatgatgaatagggagctccgtgcatagggctgggaaaagagtaagagctcagacattgctgtctaccatttccttctcctgccccaaacatccaggaattcaccctggatgaattcctgcaggattcccagagtacaaaggtctttgcttctgtctcctcggattctaagaaacagaagagggggtactggcattcagtgtgtccctactgtgtgcttgccataatgctcggtgttttatcaacaactctcatttaaccctcacaacaatgttcgtttgaggctcatagcaggttcggggccaatgggtggactcccaagacaagctatcgaagcactgggcactcagcccttcctgcacaaagcccactggcgtgagttgtccaggggtccagctgcatatgttcccccaggtatttgcccccgaagcacagtcatctcactgccttgcatagtggaatgctaatcagcagaagacccttctatgggaggcagcttggaaacctggaggaagccctggctgaggaggctagtggtcagggagcctatcctggccaggtcacttttccccactggggcctcggtttcttctttgtaaagggagaaacttacattaggcatttcctcaggttccatttggttctcaaattctaatatttttatggttgatgctctcaccagagctgctgctatgatctcagagacgtgaggctcagatctaattagaagcaaccggaagagagcagttgggatttttcaactcaggaatcagtctccctgctgggttcaaattcaggctctgccacttactagctgtatgactaagccttgttttcctcaactataaaacagagatagtagtagttaccatcttaaaatagctgttgtgttgtgtggatttcaaggatcatgcaagtcaagcatttagcacagtctctgctacataagtggtcagcaaatttgaggtactattcaatttatggctctattgtttggggcttccaaatgtccagagtaaggccattttcgaagtaggcagtacatctgagagccttaacagctcatttctggaaaccttatccagccctatccagataactaggaccaaaaaccccagcacacagatgctcgtcccttgcttcaaccctcactgacctctactctgtggcttgtcctgaaaacatcaaagcctgctcaattaaaatcctgaatgccttgataatacaatttagaaacatacatagtttttaaatagggcaaaaactctgcatgattagtgctgcaagaagatatccagcccaacctgggtgttcagggagcgctctctaaaggcaacagaaatctaaagtaatttaagagccatgccactgaataaaaatattcaggttcatttcctgtccttctctctgtttgggatctttgtgtgtctttaattaaaagtaggagagccctgcttttgggattcagcctctgcatcccagtcccagatagaatttctgactctagcagttttgcatgtgcatgacacaccaaggacactgctcctggccttgaatgggtaagtgagacaggctagggcattgaggagaaccagaggaggaccatacaggtgcagctgctgggcttgtcagcggggcaggagaatttagggacaacatcactagaccaaggccatctcaacagagaattgcctagaagcaaataatcccacactacaggggtggctgggttagaaatcctccatgaccgagtgcaagcatgcagaactttctgaaagggctgagcttcggatctccagaatagtcatagcataggtgagctatgactcaaccccatggctatcagatgctttttctaaggccacacggtgagttaatagggtactggttaatatagggccaaacatgggaatgttcccgatagtcccatatttgctcctagatcaatgagcacctcagggaacttatggaagcagagtgtacctgatgagactgggtttagggtttattggtcagggcagcattttcaacctaaagatatgggagagtgacaagagacagacaggcatagagaagcagtagccgtgttgtcacatagtcctgagcccaaggggcaggcctttggcaagtcatttcaccttgtaaatgctagtttctttatctgcaaaaggagaatcctgatgtatagaaatgtttgtgctttggtctttacccatctttgcatctttgcctgtccctttaattctataatgctctcccaccccaccccttgctgccttgtctaatagttaaaattccaccgacattccaagacctcactcagcaatttccatattcaggaagccttctccaagccccagagagaagtgatttctcccatctgaattcccatattcttttaaggtgtacattttcttatgactcacaatcgcgcttggaattagacaatcaacggaggtgttaaccccctttccccaccaccagaggtcagggttcttgggggtaggagctcgtctaactcatccttcacaactctctgcttggttctgtgcacatagtaggtacttaataaaaattttcctagagtaaactataaataatggaatggttggccactctccattatttgctagaattgcagaccctgcaggaaaagttagcttcccaccggaatttcagttaccagccctctgccaggaatgaattctgttgttcggtctgctggctttgaattgactttgtccatgaaatgtaccgaatctgtttaccatttagcaggaaagtgctgagaacagtgattctactcccactccctcataatcacaaaggtatgaggaacccacacccagcaccaggcacagttctggtccctcaatcccagaagaagctcaatggagctcaagataaacagaaagagagagatggaaaagaatggaagacagaggagaaggacttactgcctaaaatcagtgggattgttttgacttggtctctggaaaagggccaaggcttagacctctttgtctgcctggaagggccttgctccatgaatgctttgtaaatctgtaagtgaataagtgagcatatgctttaacaaataagtgaaaagatgaatgattgaatgaatgggggaagcagtaaaggagtgaatgaatgaagcaacaaatgaattatcaactgaatgacagaaagaatgatcgaataaatgaccacatgaatgaatgaatatgtccataaatgaatgaatgatgaagtgccagaacagctataattaacagcctatcttttcacaaagagcattgatagtcatctccccaaagttgaaaaatataaattcagtcaagaagagtcctggtaattttttggatactggtaggtgtatagtgtctttggagaaggtgaggagatgtctctaagttttcactcttttgctgaaacaaaagcagggactgactcacagtgattccccttgtcttcccttatatttcaggttcgttcacccttgcctgggtgagatcagaatctgtatatttatccactcatttatttgttcacttagccagtcccacaattgtccttcagcattgcttccctgcctaagatccactctggcttcctcatcctccctcttcctccatctcctcattcacctggccaactcctacttatctttcaaggcctcattcaatgccaccgctctgggaagcctttcctggcttctgtaggcagagcacatctctgccttctctctttccccatagctgctgctgcttcccttaactacaattctgaacacactatgaggttgtcattatgggtttacacatttatctctctgactagctttcaggcactgagtcttatcccagggcctctgtcaggcctgacactgcatccaggcttgatggatgctggcggcatggaggtaaggatggatgggccagagtgtgcgttcttgatggctctgagcggtgtgagaatgcggcggtgcagatgaggaatccaggtctgctcctggggagaagctctgcaaaattctgcataatggccgtggagctgatgttcccattcatcaggcagggaaggaacagtttttagaaaagagagagagagcctaagagtcctagggccttcagagaaacatctctttaaatgcttccccttcctccgggtagtattttaaataggtcaccttctggaagtagtggtagtcagttgggatattgctagcttcccgtaccccagccatgggagtagtactttggattaaatcttgttattcaaggccagactaaaagcctcattggtgcggtggggggaagtaggaaccacattccactcaaatcaggaagctagaagtaggattgcattatggctatgagcaccgcgttaaaataagagtcttgggattgaactccctttcattggttcatagctgagcctttccaggcctcagtttcctcttctataaaatggggacagtgggccaggtatggtggctcacatctgtaatcccagcagtttggaaggtcaaggtggacagatcacgaggtcaggagttcaagaccagcctggccaatatggtgaaaccccatctctactaaaaatacaaaaattagccgggcatggtggcatgctcctgtaatcccagtcactcaggaggctgaggcaggagaatcgcttgaaccgaggagacggaggttgcagtgagccaagactgcaccattgcactccagcctggatgacagagcgagactccgtctcaaaaaaaataaaaattaaaaaatggggacaatgacagtgtctccctatagggccacgtgagggccaagaaggaattgaacatggtgctgcacaccaggtgagttggcagtgctggctttgctgctgccttttgtcccatctcaggacaggccccttccttctgccttgctccacttggatgatgacggtgttacccttggtaatctccccatccctttgagctgtggcctctgattccagccctctgagatcccgagccaccatatccatggtcactggcattctaagcagtttctctggtgattcctaagggaagctgtcaactttagatggtaaaagcaattcccaacagtgaggtatgaaaatgcaggtcacccgccaggaaggataataatactagctcaaatgactctggcctccacccagtgccaggcaccttgctcggctctttcctgtgttattttattaaccccaaccctggaggacaagatgctattacagttctcattttgcagttgaggaacctgaggctctaaaaagggaagtgccttactaagggtcatagagcttgggaatcgcagagcctggttctggttgatcccagaccctgagcttctaactgccatactaacctcctctcctcctggctttgcctctggaaccttagggacctgagtagaaaaacagtcaaaacgggtgcatggatgttggggagaaggcattcaaggatagactgaagcacctcattagccacacggaacaactgagctacgtgcaggccctgagcaaaatgcttttagccccatcccaaccccgcctccccctagatctgtttccatttcatctgacactgtggaagcctgaatatgaaatgattgggggcagaaggccaattagcaaattcattaataggattaaacatctctcctctgctctaatcatttatgtgaactaaaattttctctctttgttatagccatcattgcctgtcagtgaagatagagtgtttaaatatcttccaagtatgttagaattgcaaacgttcagaaccagggaccaggatcagagttttcacacggtccaggtgggcaaggagatcagtcggtttacaagtggttatcactgctaagaaaaaaacacaagaacttgctagtacatttgcaagtaccttactgctcatctcctttctctccttagccacatgttggcccaaatcacctgcgtatgttatacggttgttatgagcatacactcctggttaggcagacctagaattcaaatcctggctctgcaactcattagctgtgtgacattgagcaggttacctcgcttctgtgaactttcatctctacataatctagaaaatgaaagtattgttgataattccctcccaggttgttatgaggattaaatgcagtcatgcatgtaagatgcagcggtcagcactcagaatgcgctaaaggtaaattgttactatctgggtctactccacttaaagtgtgctcctccaaccaacagcctcagcatcagttgggagcttgttagaaatacagagtcccggccaggcgcggtggctcacgcctgtaatcccagcactttgggaggccgaggctggcggatcatgaggtcaggagatagagaccatcccggctaacacggtgaaaccccgtctctactaaaaatacaaaaaaattagccaggcgtggtggcgggcgcgtgtagtcccagctactcgggaggttgaggcaggagaatggcgtgaacccaggaggtggagcttgcagtgagccgagatcgcgccactgcactccagcctgggcgacagagcgagactccatcttggaaaaaaaaaaaaaacctcaactcagtgagacctacccagtcagaacctgcattttaacaagatcaccagatggtttatatgcccactggagtctgaggaatactggcctaaagtacagattatggaactatgtgtattgtattacacaaaattatatatcaagccagaagaggcttttgctaagacttctgatttaagcctcattttacaaataagaaaatagaatccagagaaggtgagtggtttgcccacaatcacacagctcaagtgttaggcctgacatccgaaccccagccctggtcatctcatataaattgttaagaagtcagatttccagatttgcatttctgcaatcaagcttgtctgtttttctttctctctctttctttttaacaacaaagaagtgcaggatgatgtacgcccattaagttttagtttactcattttaaatgttattccagccaacagagatcctgaatcttgactccaccagccatcatcttagctgtacctccaagttttctgctacctgaagaaatgataaggaggcattctaggtctttatctaagttgcttctaagaacatgggccagaacagggtgcaggacagagccatgtggactgcaactagagacttgcctgcataatggatttcactgataatgttcagaatcccagagcaggatggcagcctggtttacatacagagcctttgtgtgggatttgaagccagaaaatgtgactaaagtaggagtctaaacagacacaggtagggcctggggaatgaaagtcaaatgccttttccagggggtctagtaggacctctctgttggtggggatcccccaaaaaagtaatctttttatttttgtaggagtcctgtaatggtttcattattattctcactttgcagagtaggaaacgtagatgcagggaggttcttgattggctagtgattagtaagcaaggacttgaagtggatctgattgcgaggcactccaccacctgggctcctgcctgcagctggagggcatatccaggacaagcaagcctctgagccccaggaagaggctgagcagttacagctagtttcccaactcccaggaactgaaaatgacagcctcctcttggccccatcagctcctcacccatgccaaccctggacccagagtgagggatgttctggtggagaccatgaagctcccagctgcctgggggaagctggcacatttgcatccgtgtggctgaggctgcactttctctccatctctgggattcgcccatgtatgactctcccagatgtccaaattgtgcactcagcaggggtgtcttcaggaggcttccccacccatcgaaatcagggcagcaaggggctccccttgtcttcttccctctttgcatacatccagccctgggctgattaggactctaagccctgtaggccctgacactaaaataatcaggtcctcccaccactgccccgccctgcctcaccccaccaagggctacacaggcatttcaaaggagaaacagtaaaataagtttaaggaagtctgccaaatttggatttttcccatgttgactactttagtgacttttctgaaataaaatgtgctttcaaaacacaatttttgatgcctctactttgctagtgctttaagcatctcttgagtgtgcctgtgaggtatttcagcattggagttggaaccagacaggaaaaggaaagaaaccgatctgtatcgggcacctgctgcatgccaaggactgtgcaaggtgttgacaaaataacaacagtaacaaacataacatttaaatcgtccttgtgacatttatatagcaatctgtgccaagtaccactctaagcgctttcggtacattaagctaatttaatcctcacaacaaccctatgtggtaggtagtgtgattattcccatgtaacagatgaaatctcacactatgagagacaggcactgatccccctattttatagatgaggaaactgaggcttgggaagaagtgacttgcccaagtgccccgatgcctggtggaagaacagtgttcacaccagctttggccacttccaaagcccttgatgttgacactccaaatgcaggcctcactcatttcctagaagcgccttatgatttgatatgtcctcagggtgcattataagaggagggaggaaaacctgggactacaatgagcattgaatcttgtcctgatcttctcagggaccctctgtcattcccgattgcctattgcatctgttctcacctggtactaccattccctcctccctggtttttcccttgctaagtgaccactctatacgttggtccatatcatgtagcctctgctggaggcaagtctggttcccatctgccttcccctgaagaagaagctgctggaaaattagagttatgttggacacagtctttgtccccaaggaacttctctctggtcataatcattatattaacagcaaacctatagcatgctatgtgctagacactttagcaacttggttttatgtaagccttacagtatccccaggaagtgagcactattactagaccctttccagatgaggacactgaagactagagggcataagcaaatgtccaatgtctcacttctcataagtggaaaagccaggattcgaacccagatggtttgcctccagtgcctgcatgctgaatcactggactaggctggacctgagcatttagaggacattatagattatgtaacactgtggggattcagaggatggagaaagcacctctatctgaggggcaggggctggagaattagagaagatggccgaaagaggcggcattagagctcaacaaaagagctaggggttggcccaggcaagaatgtaggttagtgaagttctaggcagaaggaacaggataagcaaagtcacagaggcaggcaacaagaaggggaaagaaatgaaaactgacagtgatgttttgtatgcttgtgacttggaggatgttaacagaaagaggatgccatcagaagtgggaggcaaggagcagagtcaggctgtccatgttcaggagaatgggacaaggtcctaggaggtagtagacagcaaggatgaggaaagcaccaagcaagtagggatcgagactgtgccctctcagcaccacccttgtccccctaagtgtctccccgtgatcactgcagcttacatttgattcctccttctcctctcccagggaacttactatttgtccccatgatttagcctttgattaccttgaactgttctatcatcattccctgtaaacacgcttgactctccagcaagagtgacctttcctcagagacctggacctttctttcttcccttctcagcatcttcgagcatcccaggacagtactgggcaaaagactggtacttggtgacttgaactgatatttcacagagatgcacaaagacttgggattccttaattagaattcatgcggcagagaaacttgggcatgactttgaggatctcccccacccgccaacagcatattcacaagatacgaacatcaaagattgtggcttggtgtgaaaacatagcacattggaggccattccataacagcttagagctgatgaagagaaaaagatatggtgtgttgggtgaaatagaactgaaggccagtcctagcttaccgtttaggagctgtgtggtttgaagaaattgtttagcccctttctgcatatcagcttcttcatctgttaaacaataacaatcatggtatcaattcattggattgtcatgaggattagtgagataatatgaatgtgtttagtaagctataaggcagtgcatacgtggtggggatcagtattagatgacaataatggtcatagcaataataatgattttgatagtggtggtgatgatgtttgtgatggtggtgtgatggtggtgatggggatggtgttattcgtggtggtaattattatattatggatgtgtgagtctgttttcacactgctgtaaagaactacctgagactgggtaatttatgaagaaaagaggcttaactgactcacagttctacaggctttccaggaggcatggctggggaggcctcaggaaacttacaactgtggcagaaggctaaaggggaagcaggcatattttcacatagtggtaggacagagagagagcaaaggggggtgtgctacatacttttaaacaaccagatttcatgagaactccctcactatcacaagaacagcttgggggaaactgcccccatgatctggtcacctcccaccttgtccctcccccaacattattaactacagttcaacatgggatttgggtgaggacatagaggcaaaccatatcaagggataatattgttgatgatggcagaggtgttggtgacagtaatgacagtaggggcttcatggcaataatgatgatgatgatggaggattacaatattagtggtaatggtgattattatagtataggtgatgttgattataagggtggtggtggtggtgacaatggtgatggtggtagtgatggtgatgatgatgataatagtaatgatggtgatatggtagtatgacagcgatggtggtatggtggtggtggtgatgatagtgacggtggtgatgatggtgatggtgatggtagtagtgatggtggtgattatggaggtggtgatggtgataatggtaatgatggtagtgatggtggtggtggtagtgatgatggtgaagtgatagtgatggtggtggttatggaggtggtgatggtgataatggtaatgatggtagtgatggtggtggtggtagtgatgatggtgaagtgatagtgatggtagtggttatggaggcggtgatggtgataatggtaatgatggtagtgacggtggtggtggtagtgatgatggtgaagtgatagtgatggtggtggttatggaggtggtggtgacgatagtgatggtggtgatgataatagtaatgatggtggtgtggtcataatgatagtgatggtggtggtgtggtggtagtgatagttgtgatgaaaggtggtgatggtggcagtggtgatgatagcagtagggctgatggtggtgacagtggtgattatatagtgatgtaagtagtagtgttgttggaaggatgatagtggtagtggtgtcaacagcactggtgaatttaaggcaatcattccctttgtccaaactatcttctttgactaggctgcacagaaggatttccaacccccagaacttgaattcccccaggtgtatttgtcaaaagtaggaaagaataagacaaatcagcccatgccttcagatttcttctcttattcctggttggtactttcagaatcattttaatgtaagctgctttcttgacatttgcattccagcacgtggcacagtgccatggctggtacatcgtcaagtcttcaataaatatttgtgaaatgaagggatgaacttgcagaaagacacaggctgttctcttggatgaactcatcagagttaaatgtttcatctttgaagataacgcgggggttatcaggcacatcagaatatacctgcattaacactattgccagcatgagcaattcgataacctggcaggttgggaagatttcttggcacctacactgcccctggaagcccccggatgtcagcttggcctggcccttgtacccaccactttgccctcagaggtagggtctgttctactgggattctgtgctaactgatcacagggaacagtggggaaaatggcctctcccaccggctgcttctggagagtccaagcctccctcctcagtgaccttgctgtgcggcaggaatgagaggcacatcctggctctggagatgttcttcttggcagcaagtcctccccaatggcaggagggattacagaagtgatttcaggtgccagtgcctccacagcccacccaccctctgctctaggcaagtcagaggcacctgtagagcctctgttctttgtgtgtggaaaaggaataatctcgcaccagcattataaggttctcatggtttttaggggtgtggcatatagtgagggctccgctaatggcagcagctattaatattggtatcatttattatttccattactagtggagacattgagctgatatatgggtcaataatgatagactagagactttgtgtgtctctttggtggaacatgtgtggcttggattcaccttgaatcccctgattctggcactctggcctgagagtgtcctctgaatgagtcatgtggtgccagcggggttgttgagatagatagatggcctgcaggcatttgggttcaaatgctgttctgctgaataaggaatacgatttggggaccaaacacccttggatttaaatcccagacttgtttttccctggtggtgtggccctagggaagtatttctgctgagccttactgtcttcttgtgtccagtaaggttagtaatattgaccacattggctctttgggaagaggatggaaaataaagtgtaaatggagcgagggagggaatttgtctccgaggcagcacaggacaggaggtaatggaaagaccaaagtggtttttggattagagctgcctgcagcctttatctgtctatggagttgatttattattctcccaaatcttggaacaaagtcaagaaagggaggaaggaagggagagagatgggtaataagagtatggaagaaaatgtaaacatgtagagtgcagacagcggctgcctgcccatagcaagccctccgcagagggagaattaattggctgttgtcatttgtattgttgtgattgttcttattgttgaaagatgtagaagagaaatcaggtagaaagaattcaagcaaagacagggggtgagcgaaagcatgaagaaatgaacagaatctgggctgaatttctttaaggttataaagcactctatgcaatctgaggcaggcagtccccaagcttctagtaccaccctgcgactctacgtgtcaaacaggaggagttccttaaagggtgtttggtgtgtgcatgtgtgtagagggatgaagcatgtatacctctttgtatacatcagacactgtgctgggcactgcccttaaattatctcacttaattgtcacacagtcctatgaagcagatgctgttattgtctcagttttagagacaagaaaactgaagctcagagaaaagaagtgatgaccagcccaaggtcacatagctgctaagtgcagggacagcatcagaacccaggcccgtctgtgcccttaggtctcagagattctacacctactacctagtattagctcaatctgacccttggggaaattaagccccaggaaagctgtttccttcagttgcgcagccaacttgaagcaatggtagactgaatcccagttctgactgccagctccacagtccctccctggggcctcgcacatcattggaactgacaacacaagaatcttccatctccttccttctcttcctccttttcttggctgtcatccaaaactttaggggaatgcattataaaccaacttgagagacagagaaaggctgtaggaagatccaactcaaaaacattttggtgtttgctttacctccgcctgagcgtccctggagataaaccctcctcactctcgcccaccattgctctgctatgtcaatttcagcagccggactctggggctgacatgcattgccccttctcaacccagacaccacttccttcagggaaggctccacataatggtgaagtgcacagactcagaagccgggcagtgctgttcagaacctggttctgcctttctcgggcgtgtggccttggataagtcatctactctctatgagcctcagatccttcgtctgcaaaacagagctaatgcctcccttcttgggttgctgtggggcttaattgagaaggtatatgtgaaatgcctgctccataatagacacccgtttgagaattaacgtttgggttgttacagtgtgagcccatgggtctcaggcaacagacttgataaatacaggttcctctgcaaccacaatcctagtccttagcacaagcatgacactgcctggcatgtgctatccctcccatatccatcagccatggcagacacagatccctcattatgagacttttttattctgagctagaatgtgacctcagaatctttcttaacacaatgcttcaagcagtcactaccagttgaacatagttgacatggaagatagatgaagtttatttgcattctagttctcaccaagtccatgttcactgctccatctgctcagtgcaggctgtctctctgctctgtctcccacctgcttttgtgagtgtatgtttctatgtttgtgtatatgtgtgtttaaactcctcttccagagtgaaagaccatttcagtcttttgtgtgctgatttgtagaaatcattgaactttcagaatcccatttgcaatgtcatgtctgtggctggggatctccaagtaacatcagcttacgtctgggaaggacaaggggaatcaaagttagaagtcaggagagcaaaatccacacacagcatgcaccatcggccacctttaggagtgacacaagagatggtgtttgaatataaatttgaagtctttccaaagatttaacactcctttggctgacaaccataatctcaaggaggtaggcctaggctagagcaattatactttagggtaaccctagctgctataacaaataaaccccaatattgcagtaggctgaaacatagaattgtttttatcattcatataacttcttgatgggccagtagccttcttccatgtagtcactcagggacctagcctccttccatcttgttgctcccccaaccctaaggcatcctctacatctaggtgaaaggggagcagaaaatgtggtctctggcccaggaacaactctagtcttggagaagcacatgatatagtatggagatcacagccaggcctgccaccggcagcaattcagggctgggcaccagatcagctgggtggagtcccagctggccaaggagtctgagcccaggtactatgtggtcatcttgggcatggaacagggcagctcaaggaccagaggtcagctggcagggtccgcaccaagcctatccagggaagccctgccctgatcatggacaaggcctgtgtaatcctgatgtcagctgcttccctcccgaggacagcctgcagcagatggtcagagcctgttgccattaaacatttgagtggttccaccagcatcccgatgagtctgggttcaccaagaaacattattgtaatgtgctccccaggcagctctgcctcagggagagacaatgccaggcatgacaacttcagcattcttgttctgcatggcagttgcatttctcattgtggtttatatgttggtcacatgatctgagctaatgggagtattcgcctgacagatgagtcccttttgctgggtgtgccagcaaaatcaggcttccaagcccccaaggctcactgccagaggctggggaattcgccaaggtaaatgccaccttgtgaggtctttgggacacagccagcagcctccccagggcaccattcctgtctcagcatgaggcttctctggccagcccaatggcatttgggagccacatccacaccccacgggtctgggtctgtttccagctgcactgggacattctggcagattctccctgatctctgtaaggaagagtacagcaggaaggagaggaagcagaaaaaaattccaatgcttagagttttccctctaaagaggacctcctgagccacttctgaacaggacttggaacaaaggaatcttggcgctttgatgatcgtgtctgcagcagttgttgaaatgagtctgacactcgccagtgccttagtaggaattataattacatcaggagaccccaggcaaccaagtaaactgattagctactgctccgagttgatagatttttttctctctaggtcataaatagggctgtgggagatggtggaagcatgctggtgggaacaggtcgagatgggctgtacattcaggaagcccaaccaagtggtgtgggcagctccccctgccccaccctgccaccggaagagacagtctgacaggtgcccaaggtagagttcagttccctcggccagggactgcactcctgatcttgcgtgctgcagagagctgtcctcagagcaggctgagggtggctgaactgctaggcgatgctctgggaagccctccgccaggaaagccgatgctttctgccaggcataattattgcatggataattacacgattcagagcctgctggagaatcctgggctggtgccagagtagaaaggcagggttccggaactgcagccagtggctgattctcagagtcgactttgaaagaagagggtaatcattcctcctcctaagactcctacctggctgggccaggacatggcaaacgtaaagctaagggaggcggggagttgatgagttctctcctccacccactcccttacaggagggggtccccagagttctgacctaatccctcttctttactccctgcacgtgtcacctccctgggacaatccacccctgcccattagcacatatatgcggatgacaccaagtgtctttccagccaggcatctgcaaatgcatgctgggcatctccctcacgtgtctcctccagcccattgcactccagcctgagccattctcctcctaccccagtctgcctctcagtccatattctcttcccagccagacatacctaacctcccagacctccactaggaacccaggagtcctaacctgctagtcctttcccactccctgtgcaccatccgaagccaggtcatgtcagttctacagcagatgtgtcttggctcctgcctgttctcccagcaccaccccccagtcctccggcacagcccaggtctgggctccatggtctgccctggctttcttgtggtggcctcctccctggcctccccaccctcatcccctggggaccagcctcccactgcctccagatccaatgtcttccagtaaatctgtctacacattcccaaggttggagtccttccatggtttccttcactctcagcaccaacttggccccttctgactgtcctgaagacccttcccaagctgccaacgctccagcactgcatcccctgccctgcttgtgacacccaaccctatcagatgccacatgcacttctcccagttgtccaatgtggctttgccaagcctgagcatacatgtgtggaagggaggaatgcaagggtgaatgttctggactctggagctacactgtgtgggtttcaatcttagctctgtcacttgctagctgtgtgacccaggacaagtcacttggcccctctgttattctttcttcccatctataatgtagaaataatagtaataacagaacccatccatggggttgttgggaggattcaatgacatattcatgtaaaagactcagagcatgaccagtgcacagtggccatcttatcaagtgcctgctgcctgtcccaagatggaaacacaaaatgtgaaatccaagtgtgggtggtggaggggtggtatggggcggggcgggaattcagtttaaactagttcatgccttcattttacagagggagaaacaggtcctgagagaggagggaccttacccatggccaccccaggacccagcccagtgttcttggttctgaggcccggctgccctggcatggagcagacagctccctctgggtggtcaagttccctgagttctttgagggctgactagtggtgagagggattcctccccaccaaacccctgactctgagaagtgggttggagcaggagaagaaaagtgtgcaactcagctcagctttccagggtaaaccgatgagaggacatttgacggtggcagcgttaggaggggacttctgcacaaggccggggaaactttgcctaagatttaggccctgggctcagcctgatgcaccccatttactgggtgcctgctctgagaccaggatacgtggaaagaacccacgcctgggagccagctgtcctgggctttggaaatagctgtgtccgtaggtgagaccttgtctctgcaggcctctagcagaggggctaagagcatgcgctctgcaggctgcctgggtcctcacccctactcccgcacttagtagcccttggtgacttaaccttcctgagcctcagttttctcttctgtaaatggaagatcataatgatacctgccccatagagttgtgtggataagcgatagaatctgcattaaagcatttaggtagtgcctgagatttagcaaaggctcaatcaacatttaaaaatggcaagaaccaagcactatcatgcaggtagggcacccatctttgtgcataatccctttgccttccctccctagaatgcagaggaaggaagacctctgtgagaaccctacatacatctttgccaattggcagtttttcctctagttaatttgggagcctgtgacctttaccgccgtgtgattctctgactcagactgcagtgttgcagtgccagccaaacatggtgacaagccccttcccaggcaactgaggacaggcaggagtgttctggaatcttctcctggagtgggagtaagggtgggcagagccatgtgatgctgcactgtccacctggttgaaggaagtaattccagactctgtctctgacatctctattagccaagggtgagggtgttagttcgggtcatgttagctgcgcctcccaccctgcatcctgggcccagaaaccacacccctgtgcagggcttctgtgtcagagtcaccagggaaatgggctgctgaggatgccagcaccaaccaggctgctgtcctggggcgacatgtctgccatcttacaacctcccttccaatattcaccatgtgccagctccagctcagtcactgagcctcacatcgctggaccccactgtgtgctcagggtcatcaggcactttcgcctgtggctgggattgagacctggctcctccaccttgcacttgtgtgacctggccatgctcatgtcaccctcctgggcaccccaataccctcatttgtaaagttcaacctacatgctgtgactgtgaagtgagaaagcagtcagcagtgcttagaacagtgcctggctcctactacacactcaataatgccagctatgttgtcaatatcaactctacgcagtagcccatttctgtagatgaagaaagggaggctacaggaagggaaggcatgtgcctggggtggattcgaactcaggcctgtcgggttccagtctgggcttttctgctctttccaggccatattggaactgccattagagggactcattcattcccatacatgtcaaatatgcactgcacccagattacatccatctttaattgaagacctatccttctgggctttggagatttgctggacttggggagtcaccaatacaactcaggtagtgacatctgggaggagaagactgaggtgtcatcagctgcttcttatccccctgcctttgctcagcctgtccccactgatgggacacctttgcccaacctctcacccataccttttatctgattagctttttttttttttttttttttgagacagaatcgcgctctgttgcccaggctggaatgcagtggcgcgatctcagctcagggcaacctccacctaccaggttccagtgattctcctgcctcagcctcccaagtagctgggattacaggtgcctgccaccacacccggctaatttttgtatttttagtagacatgggctttcaccatgttggccaggctggtcttgaattcctgacctcaggtgatctgcccacttctgcctcccaaagttctgggattacaggtgtgagccaccgcacccggcctgattagttgcttcttcctgtcctttgggacctggtacaggcatcaccttctctgggatgcttcccttgtccctccctcatcacaaggctggcttgggtgacctttctccatgctccaaaactcccttgctcctaagcagccccagcatggagctccaagccatgaagctctaatatcagagtccaagccttatagagcttccagggtctgacacatggcagaagttaaattaaactatgtatttgtttatttgctaacattctgccttattacaaaagagacttgagtcaactaagcaaataaatgtttgcagagctgaattaaactgagacagggtactggcccagtagaaaagtagaaaatacctgggcttgggcatcaggaagacctgggtgagaattctccagacctgtgccttctatggaacattaaaaaggtcactttccctctcaaagcctcagttagctcttcagggcctgcgaacggcaatctattgtgaggacctggtgtgtgagccaagtgcacccatcagccactcacagctgcagcagaaccaggcagttgagtttgacattggccttttaagctagtcacgaataatcagaagacccatggcaggctgtcactagtgattttgcttaggtacaaacttgaatggtgctccttggagttctgatgtgggagagtcactgagctggacgttagcacacacagttacacgctcacaggctcaccccagcatgcatgtctcaaaacaatatattttcctctatttgtccttgggttttcagttacagcaaaagtattttcaaaacaaaacaaaatgcatcatgatacaatctcatatcaagtaacattcatttggggggacgcacttaaattaatagtttcataagcggttgttgtcctgcatttacagacacacgacaattctgaaggggtcatgttatttttcgattatcctttactgcattttatgtgggacatggcatgctgcagtggtgtttgtgagctggaggatttgggagagccttaggaaccctcccaggagcctcaaggattgactgcagtaggagctcaaatgagttttgcctggggcctgccctggaggagacctgcctctcagcagccaatcccacccaggctgctctggaactggaggctctggctcactgggccctgctccccacccacttccctctcgcctctcccattcccttccccagtctgcagcccctttgttcaaggagggagctgcaagcgggtggtctctgggcagctggataactacttctaaagcctcttagaccctggtaatcttcctcctaacaccatcgggtgactgcaaagcactgcaggccagacttcagttctgctgtgtaatttgcaagctgggtgaccttccttatctatagaatgggctctcctgcatggctggcatgaggaataaacaaaatggttgtgtccagtgcctggggcatagcacagctcaaaaaacttagttcatcctcctgagggatcaagaagatacttggaaacaaatgtccaagggcgtaatcttgaaggggcttgtgccaggcatatatggagagaagggttttgtgggatgtcagacttaatagtgccctttactccccacccccgtctctctgttcatagacaggaaatctgtggcctattctgggacctcaaagtgccacagggttaaagataccaagtcagaaatctaaggttctaaatggactttagaccatttttcatttgggaaggaagaattctttaaggggttgtgctggcgctgtctctgtatgcatgtgcagaatgtgcttccagatggggtaatggtctgagtttgaggacagaagtccactccactgcattcaactgttcaatagtcctgggcagtgttattgcatgggagaccatacctaaccccaaagattgccccatagtctctttgtcagataaagcataagtgagcatcccatctttgttagtcagaaccttttcagtttcaaacaacagaaaaccaactcttcctgtttaaaggaagaaaaggggggtttattggttcatgtaataaaatggccagggtaagattaacttcaggcagagctgaatacaggtgctcaaagaaaatgtcgacaagaacctgttgatttctctgtctcagctctgctctcttctgtcttggcttcattctcaggaaatgctctaaccttggggttccaagagtagtcaccagcagccccatatttacagcccaccagctcagcaacctctgtgggaaagagcttctcaatagttccaggaaaagtcccagggctggctcccattggcctagatagggttctgtgttatgctgtgaggtgctggttctggggacggaggagtgttctgccttaacaaccgaatggactgtatttgtggggaggtgtgggaaaccaaggagctcttaccaggagaatggatgttgggccagcagaaacaaaatatgttactgccttcttcaagtacacaggtttctgtaaagcctaacatcacactgaggcaccacttgccccaaactccagcctgaaggattatgaggagttcgagcttgcctttgcagggcgcctgcttcctgttaggactgtgctcattgtacatggaccttcttctgaacctctgagattggttctgttatctttattcccattttacagatagccaaccacaaacttactgggtggagtaacagtgttgcccagagttagagcttataaatggcagagttggagtttggacctatattaaacagtctaacttcacagggcagactcttagccatcaagcaatatggtcttccccgagaatgtctccccacttcacccttccaggcctttcttcttgttggactctagactttaaatgcccttctttttacttcctgctcacttattaaactcttccttgaatgctcctcctcctgatagttttccccaggattaaatctgagcaagacccttttctacaagaccaaggtcaccatgccactgctgactacagctggtgtatttgtttgtcctaacccttggagggcagagactaaatttattgtttaccactctggcacctagtacactgcctggcacagagtaggtgctcatggctcataacatgtttattgattgtttagatggcaacacagataaaatcaaaacatggaaggttgctgagactcaaagacaggattattattgttggtaatgatctgatagctaatgagtattatattaataatagtcaacatgtcaggtactataatagaggctttgcgtaactgctccttttagtcctcccagtaatactatgatgctgatattactcttcccattttgtagataaagaaactgggagtcaaggaggtgaaatggctttcccaaagtcttgcatataatgtatccggactgcaaggatggggccctctggccccctcaacaccctatctgcctctcatacccagggacctgcccacaaggtcagccccttggcaatcttgccaaccttggggctcaaaattcagtttatggcttcccaagatctactggatgctttttctaagtttggagaattcatgacattatgaatcctttttccccaaggtgggtattcaaactcagagttccagccacgcttgcatccagggctcagatagcagagggacctgcctgaggcttgatttagaagggtccacctgaggatgtggatgaagcgtgaattcatttctggcaggggtggcagcagaggcagacagctctgtggaggcagaggtggggaaattctggtgtctccttcctagtgtggaccatcgcgcctgtgttgagcagtggagatagtggggtctttcctgcagaggcctccatggtagggctcaaacattgttctagctggggtggcctccaagcctaataccttgaccctcttcgagattctctgcactgccaaatatcttctaataaattccttctctgcataaaccaactagaatagattctgtagtttacaaccaagaatcctgactgaaaccccctgaagcttgtgggtttaggtatgaccatgtgggaaggcagcatgagctctggactataaagagaatcagttgaggatgtggcagcaaacaggtatactaggggatcaacgaggggaattattatgatgatgggcctttggaaacctctgccttctacagcagtactttgaaactcttgtgcacacagatcacctaaggatgttgttagcatgcaaattctgattcaggagtttggggctgggacctgggatcctgcatttccaatacccttctccacttaagttttgctgatgctggtagtctgaggaccaccaatgaggtggtgaggttccagggacgcttaagcctccagcaaaacatcacacaagacagaagtgcctacttcaattgcatgagataatgagaccaaatcatccccgggcaagcccaccactaacaattattcccatcattggtaacatcctaagtcctaaggtacctggagcttcaaatctcataattagcactcttgttatgccaagcctgctcctaatgaggacactttgataattcgctttgttgaagaaacaggatctgttcctttcccctacagtacagcatgataggagtgtggtttgctatttgtacctgtaactcagcccagggagtgctgacaatgggggagccactgcaggagtcccagcctccccacctcatgccccaccccctgtcctaagccccacccttcccagcaaaggaaagtaggcccctgaagcagttgtcctgtcctctagaatcctctagaatccagctacaaacatccaagtcctgcccccatcttcccgatctaactcacaccatttgtcatagtgacctggcctcagcctctttcaacttcttctctcactgccacacctttgcgtaggcagctctccagcctggaataccctcttatccatccggccaactcctccatgacctctgagatccatgtggaaggctctagaaagccttcctcaaatttcctttgttccaggatttaagctgacctaaatcctagagattagtacttcattttcaaacttttcatttgctcaaagcctacagcaaactcagtccacacacttggctatacaagaaaggttgctttctttgttgttctataactgactttaatttcaacttcaagtccccattcttgccaaggggtagaaatggaatcttggtcaacttaggttcccctccctactctctggggttgcatttccaggccaggcagtttctgctggtgcttttgttccttggtcctcagtcttctttctgtgttgacatccattgacatgtcctcgactcccctcatctcagatcacaggcccatgctgactccaggagtattcttgtattctcttcatctgaacctcaacactttttgagaccacgcatgcatgtgctctctctttctctctctctctaacacttctggaacactcttggacatgaggagatattggtctttctaggatggggtcaactggccctgcctcagatccattggcctgtacatatcttgtagccattgtggtgccatggatcacaggtcacgatgctgtgtggctgcctctgctcttagacctgccccccatgccaccagagggagtgtctgcctccccctgccctggacactcagctggaggggagggtcacagtccctcacagtcccttctccagtgacaagcaacaaactcccagtcttcctttctttctgatcctctcctcctcttcctccttctcctcttcctcctctcccagtccaaggaagttttatgcaaaggccagaggagggaataatgaggtggaggtctctctgaccaagcatgtagccttccggatctgttgtgctttccaggagtccttcaaagctctaagcttttggaattctgcaagctcaggaaattgaaaaccttttctctcacaactgcaggtctttgtctgcagttgtaaaagtctgtttagaaactcaggagacaagcagcatcttctttgttccctgctttctggaggcagtcagcgtggaacaccctgcctgcagtctgactcagggaaagggtcactgagtgtgtgtgtgtgtgttgaggggtggataataagcaaggagaacactcagacagagagctcacagaggggcaccccagcacctccctcacctctatattccccgcctgggcatagtggagggagggttaatgccagccaagtttaacaggcatttctgattcgcggcattgttgttgcgctatcctgcaatcctacgctgcgggtactgtttttatcctgatccttcagctctggaaactaatatagagagctgagtaacttgcttgaggccatgatgccaggatccacggtgcccccaggctgaagagccttaaccactgggctgtaccacctcacaggagggcaggtggcacagtgcctggaacttgggagggtccagcacgtggaactatgctctgtcatttacttactgtgtgtcactggatcagtcactcaacaccgctaagcctcattttccacctcttcaaaagggatctaataaacctgttagcagaaggctgctgtgaacactaaatgaggtggcttaggtgagagctctggtctgaagatgctcacactttgaatctcaagacttgtgtgaaccaatatcagatttctcctattagattgcaattctcagggagtcacattccgtctccaaatgcccatctcctgatccacaaaatgagcacaacatctctgataaacggtaactagatggttccagtgggcagcgggagtgggagggcggttgactgggccagaacctcaaatgtattcctgtgtagtttctcatgcattcattcagtttggcaccagaaggtgcccagactcactttgcagccagtctgtccccatagaggtgataaaggaaaaacatatgcacatttaaacttttaaaagtttatttgaacattcagcgattcacaaacggtatagcacagacagcaagcaactagcactcctctaggaggggccaaacaggatacttttataaagaggttgcagaagcaagacaaagaaaaccattttaatgggttggaatggaaagttcctaattagaggttcattggtggctcctgattggtgcagcttctagtttcaacttactgtttacattggtctgtggtttgtccccataggaacgtaaggtgtcagagccagctactcaggagaatgaggtgaaaggatcacctgagcagggtaggtggaggctgtggtaagcagtgattgcaccactgtactccaacgtgggcaacagagtgagacccttaaaaaaagaaggaagagagggagagggagaaggaggaggaggaggaggaggaggaggagaaggaggagaaggagaagaaggagaaggaggtggcagagctacagaagcacctgttgcccaggatggagtgcagtgatgtgaccacagctcactgcaaccttgatttcctgggctcaagtgattccccccacctcaacctcccaagtagctgggaccacaggcaggcaccaccatgcccagctaatttttttttattttttgtagaaatgggggtctcattatgttccccaggctggtcttgaactcctgggctcaagtgatcctcccaccagagcctctcaaagtgctgggattaccagcatgagctaccataccatgcccggcatagatttttttttttttttaacagaggctacagacaagactgactgcctggcctagagttgaggcccgggagacttgcctcctgtgtgcagcgggctgtgctggttgcctcggtttcccagagtctgatgaacatgtttcctccacaggcagtagctgcttcatttgtttttctcccagttttcatttctcattagctgctaaatcctccccatggctgcagaccctattgtagctgactcagccagtgggcacagcaggggctgggtcccagcgccgtctccgcaacctaggagaggtcaggggcagcagtgcctgcctggctctatctccaagtgtgcctcacccccactgacaggtcagattatccactgtccccagagacgttaggagggaggccgtgtcctccactcccctagctgacacactggaaggacgttctccttgacatctgacttaatgacagtggaaccaagcggggtgcccttgggtgaaggaaaaaggagggaagacttgagccttctttaatgtcaataccctgagcctgaggccacaagcaaaggccagcagcttctgcaggatagcagaagccaggagacagggaactggggagtgtacatttatttgcttctccaacaacaacaacaatatctaggtgtgcagtgagctcccacttctgctgatgtgggactagacaaaagatgagaggggaccaccctcagaggctccctcctgcttggccccaaactctttgtaaatccagcaccccacccccagttgttccccttcaggaatcatcaccctctgaaaacctgcagaaattctcaaatcccagccccctttgcttctcacacttgtagaggtctttccctaagcaaacacctgctttgattattcagggagtgagaattaatatcattgtaaatctaactcaaacataattaagaagttaaatctacttttgagggaaaaagttctgattgctcatctccagaccagataaataagatttcaaatctccaagatctgcagctcggtgtgaactgccctccgcctgtctcagccagaacatcaagtggaaaggggcctgaggaactgcctcctccagccccaccagtgtggagatgcagctcagtcttgccatctgtgaaatgggattgataatacctacatggttgtcttgagtttagctcataaccctttctccgccagaatatcaactccgtaaaggcaggattttgtttgttccccatagtatccccagtgcctcacacatggtaagcatttaataaaaacaaagccatcaatggagatgacgaaacccagagagcagcagtgccttgaccggggtcacacagcaagttagagcagagccctgattgaaaccaagggctcctgggccttaaactaggcgctccttgcattagcctgtggcaggagatgtaggtttgctgtcaatccttccaccagttactactgcctgtgcagccttgtgcatgaccttgctttccctgggcctcagttttcccagcagtagaatgggcttattattagaggagaagaccacatccactttggaaaacgggcagaaccttgtcccaccttcccccaacagctgaccattttctgcccaggctgtggccagaacctgttctctcccatcattaaaatccctctctccttctccaactctttctttctagctccaccctccccaaagaggaaacaaaggaaggcaaacatattcctgttaccagcccaggtctcagtgggccaaggtggagtgaggggagggaagaggctacagtcctcccactctgcccccacacacctgcagagacattaaggaaagcggagctaccctgggctgcctctctgtgatttaacgctctctcactcccacacctgcagtgcaccggagttaaaaatgaccttggcaaacagccttatgtattctctgtctagagcagaggacagagtcaaagaaaacccactcagaagcctggagagcggctgaaagtgggggagggcaggaaaggagggaggcaggatggaagcatgcatctcctgggcattagacttgctggattaaggagtggagagtcaaacatgggtagctctgctcagaaaaattattactgaaggagagattatgctccacaatctcaccagaatgtggctttgcaaagtgaaacgagggttcgttcctctgccagcacgaccaactctcccgggacaccccctcaggtccgtccttgtgccacaggccacctcacttcaggttggtggctcagagaggtagcagctcccatctaaatgtggcttctagaaccttctcttctcctgctgagaaaggattgtgctgagtagtagaagcagctggcagtggagtcccctggcctggttcctacaatcccaactttgacaattgtgtgacctcggacaagtcaccttacccatctaagcacatgttgttttaactgtaaaatgaggaaaatagcattcaactcagggtatgaatgagtggagccatgtggagcaacagttaagggcatggacttgggagtcaggcagccaaggtctgtgattctaggcaagtgatgtcaccactgagcctcagtttctccacctgtcatacaggcaggagtaaatgcctcctcaccccctttgttccttgtacaaacccttgccctggatgttctgtttgtcctcaggaccccctctccactgttggctggggaggctgacctgggaggactctgtgaatgaggcccctgccttccgacttcagctgttcatgacacaggcggagactgcgggcaggaggagagtgacacgaggtgtcaactcccaggctccctccctgagggttatagggcatggctctcttccatagctttctttgctcggccttttgttgatggttttcctcattcatcaaattggggtgctgagggcacccactgcttctgtcccagggcactgccctcttcgtgtgctttcccactctctccctacaccactgtacacagtccttttgttacacggccttccaattccccaatctgagggtgccattgtgtccagctgagaccctgaatgaagcaactgtcccgtctggccacagacctggcacaatttcccttcaggcacttaaagcaggagtaatgaacactgatgagttcagctcagtgctaatccctctacatgtgaaatctcagttcttcagagagccctgggaggaagctactacagcctttcccattttaaagatgagaaaactgaggctctgagaaggtttcacagccagagctaagcctagagcccttaatgactatcctcatgccctctccagtataggcaggaggctactgagtacacgtgcttgaacttccaaggcatgttctcaagtagaagtgtcctcctcacaactgctctgaggcacatgccatcggaaagctgggctaataattaaacaggggtgattttgtcagccccacatggcctgacaaagcagaaacacaatggatggtaaatattctattacgactgttattcccaaccccctttccaatggggtggtgagtaggaagcctccctatgaccagtttcttccccacagtcttgccagctcctgttcttctcatcacaccaggcttgtggccttgattttggaccctgttggaatgagggtcacaagagggtctgtctgtccacacacacagttgttcctcctccttcttccccacctccattcttacccattctcagtccttattccagactcctcccttgcaccagctgtgtccttggcctggggatgcataatgagacccagatgctgcccccaaaactctcagtttatggactgtccatcttgaagagatgaccacaggatgctcaatgctccagcaaagaggaatcctgtggttcaccaaaggcacacaggtctttggcacttagagaaatcatttgtcatatgttcctctaagtgccaaaggcctgtgtgcctgcagtcattcattaattgaaccaatattattcaatgagtccatttctggccactccttctcagctagccttctttatgagattttcctccactgacactccctgaactgctgctagccccagggctctgggctggctttctattcctccttctgggggtgtcattcattctcttggctttaaagaccatccatatgcaatctgcaggtcctatgatcatggcctccagaatctgtctcatttcgtccacatctcatcacctcctgttttctcactagcccaagccaaactcatctctagtctacactattgcagacatttcaggattgcctcattgccagcaaatttgcctcctacaagtcactattaattcatatgtcgggttgtcacttcctggttttacttcaggttttaataagcctgaagggaaacacttgttttcattccccagcatgaaactgggacatttcctctggtccttggagtgaaatccacactcccaaccacagacttcaaggccgcacctgctctgaccctgctgacctcccatctttcaccactggctgtggcttccttgcacttttgcaacaccaagctttttcctgctttcaacccccagacctgcccgtgggttgcaatttttgggcatccggatctcagcaaatgtgcctgctcctcagaaaggccttcctggccgttctgcctgaagaagcccctgtccacatcaagggtcttgcatctcatcaccctgttttattttccccatagcgctcatcccaacctaaagtatcttgtgaacgtgctgctggtctgttatccattgtcctcgctagacttcaagcccccgaagagcagggacctggcctgcctgttcaccattgtctctagcacctagaactcaggcctggtacaggataggtgctcaacaagttgttaaggacaaatgtcaagaagtacctgggggaagtgaggggctgaattggggggaataggttctttggttatggcccaaaaattgctagaagtttaaatgtgtcttctaagcccagctctctgtgttctcaaggtcgcaaatattaagaactcagggtaaataaaaatgtatcctttccagtgcctgcatgcccacactgaaatgagaaaagattttttaaataataataataaaggaacgatctttcaacctgcgtgcgggtctcagcggctccacttgcctgctgtgtggatctgaccagtgcactttcactgcctgggtctgggttcttctgatgtaaagtaaggctcccagtataagctgctttccttctagattccagggaaatcatctcacaaaactcaaatgtgagacaaacaagatttcagggcaaggaaacagactcaggagctttcctgggggcatggctccctcaaagcctacgtcctgtagagacagcagctgctaggcttcttggatagagtgcctgcccccagtgccactcctcactccaccctgcaaaagtctcaaaaggtatgttgaggcacagtaagcaggctgctagagcccagcatacttacagccctgaggttgtcagacaatgagcctcgtgatgagttattgcaccaacagctgttgcccagccctgctatgtggatcttggggacaataatttatccacaattacactggagagcatggtgcttctcaggtaacaggtggaaattcacaagcccaccatgtgatgaagacctgcccttccctgaccacaatgctatgagtaatgactgagaagattgggcagcccatcctcagtaatgcaggatgcactgtggcccatgtctgaggcatctgaaatatcagaaactccagtgggcttaccatggtcccactcctgccataatggttgccttacagtggctttttcttccaaaccaacttgccttcaactgcagaaggtgaggtccccaaaacaccagtaggccataggatagtgtgcggccggtagaataagaacctcagacacttcccacttcccctggtagagaaggtcttagtggccacaccgaaaggtaggtggaggctaacagatctaaggctgcccagtgtgccatttctgcactggatatgaaatgtgccctctctgagccctctctctgcctcagcgatctcatctatagaatgggggtatagagatagacaatctcatatgtgatcttaggcaagttcagatctcacagtttccaaacttcagtttctccagctatgaagtatgagcttgataatcttggctgtgtgactttggacaaggcccttccactctctgagccttggtttcccatctataaaatgggccaatggtaggggtgggaaaaggatgacctctgaggtcccttccatacagctgcctctgattcttcattgcaagtgacccagtgttccatatgacccatagccatctgtctgtcctttgtgccaggcctgaagcattccttttggactggtcatttctcaccgtcaccccctggagtctgccccaatcatttctcagtccttctgactgtgaagtgtctgtctgaactcataatcagcttttagctggtcccaaacagtgagtgctaccagctccattaatcccactgacagggatttatctttctcagctgaatgaatgatgctcccagccttgccccagaaatgtgggctgggctattcaacacttgtcaccagcaagctcttttcctgaggctgcatactccagccacccaggtgactgagtactttgtcatcttcttctcagagcagtggcagaaccacaaagcaaactcccacccatgacccacccacccaccttctgacctagtttggatgctccaagccataatgataaagtaatgttgtgaagagggaaagaggtttgcagtcagacagcctgaacccaggttctgccatgtacaggctgaagcttggcaagcctctgcacctctctgaggtccatttgcacctctctgaggtccatttgcacatctacaaaaatgcgataacacctacctagcagagttcttaggagatccagataacaaattgaaaacatgccagataatgcctggcacattttagaagcttgagatctactactggttctcttccagttctcccatcgtagtaatatcatctacagagcaagatggggaaaatgctcactgccagatcccattctaaagaggtatctccatctacagatttattgcacccgggctcctagccatacgcccaaaagtcaaactgaacaacagtaataatatttattcagccatgtcacactgaactgaggacctgacttaagcaacaattcagatctgccaacatttactaagcacctactatgtggcaggccgcgtcgtgaccccctggagagagaaagatggattggaaagtgtagcatcaaaattaacagcttggtttggaagtcagacacacctcaggtgaagatatggattgagtcataaactccccatgtggcactgggcaggttcatcacttgaactctctagacctcagcttttaaatctaaaatgtcccatagagttgctacaaagattacatgagatatacacttagcaaagtgcctggctcacagtaattgtcagaaacagaaagtgtcgagactcaaccctgcatggaaaagaaaataggacacacatactatcttagtccattcaggttgctataatagaataccttagattgggtaaagtagtctccccttatccacaggggatatattccaagaccccccgttggcacctgaaatcacagatagtgccaaaccctatatgtactatgtttttcctatacttatatacctatgataaaggctaatttataaattaggcatggtaggagattaacaacaataactaataataaaatagaacaattaccacaatatagtataataaaagttatgtgaatgtggcatctctctcgttcactcgctcaaaatatcttactgtattgtacttacttattttcaaactgcaagtggccatgggtaactgaaactacgggaagtgaaactgctgattggggggactactgtaatttactataatttataaataacagaaatgtattgcaaagtccaaggtcagtgcacaagcaaattcaatgtctggtgagggccagttcttcatagatggtgccttctagctatgtcctcacatagaagaagggacaaagaagctctgttaggcctcttttgtaagggtactgatcccattcatgagggccctgccttcgtgacctaatcaccccgcagatgctccacctctcaacaccactgcaatgagtattaagtttcaacatatgaatactgggggacatgagcgttcacgcctatgtaaatactacacagaaagatgtttatcaggtaaaagaaagtagacacggacagtcctcatttttctaagaataattggtaccagtacaaataccacttaaagagaaacttcttaaaacaaatgttgactatttactgtgatagtgaaggaaaaaggttggagtagggccaaatcttgaaaaaataaaattgaaagcacaaaaataagtcttttttattgtctagtaacaaaatgtaggttttagtgtcaaatgagttaattttttccattaaaaataggaattaccaagtgttgactttgggggaggcatggcacattttttagacaaaatcctatcttagcacagtctaacagttttgattttgtttgactttcacagcacaataaataaagagggtcatttggggcaaatatttccaagctttatccattttcccataggcctcttccaatcgttagaagataacatttttctcctttgaagcacctgacaactttgtcacttttctcttcttcggttgctaactagtttaactctgccagtttctcatttgcctgtagttaaatgtgaatggaaaagttatccaacaatacttttgctatttttatgaaatcctgaatctgtttaaagatttgcacttttcctcttcatcaatttcctttgaatttccattacatcatcagacatttacaacaaccaacaagccgaaggaaaccaatagatctaggttaaatgagtaaggctagaaaccagcgttaatgggaggtaaaacttaagcgtgcataaaacgtttaagtgaccggctcattcgtaagtatttttgtgttatgaagatttttacttctctatcaaaccttgtaacctcagagaattgaataatgacacttagttgtcaaattcaagataaccgacaagagaccgggcgtggtggctcacacctgtaataccagcactttgggaggccgaggccagcgaatcacctgaggtcaggagttctagaccagcctaaccatcatggcggaaacccaatttctactaaaaataataataataataataaaataactgacaagaatttctaaagtagttcagaatagaaagcttactaagttgattcatttaatggttacccttgatattttaacatgtactattacatgttaacatgtacccactaaatgtctagatctcattgatacttcatttaactcctgaacaataatagcttttcagtgtttggactctggttacctccttcctgatgcataggctactgttcatcattttagttctatcttgttacttttagtcatttatatttactatacttacagacactgttgggtttatttttagcaccttcctatttgtttttctatttgtactatctcttctttcttcctttatttcttcattcctgtcttttcaaaaattaagtaaatagttttattattgtatttttttccttatattggcttcttgtttcacattcctgaattttgtgcagtggttaccctagaagttttaatatatatatttagtttattatagtgtatttttaagttaagacttttacttcttcctgaacaatgcaagaactttacaacagttaaactcctgtacccacttctttctttttgtgctgttgttaaacattttacttctgcatagttataaatctgataagacattattgtcattttaaacagccaatattcttttatactaacccaaatatctctcctttgtagtgtttttcattccttcttgcaattttgtgtttctggattgaataattttccttcagcctgaagattcttatttggtatgtcctttagtgtcagtgtgatggcactaaatttttgctgattttcagcatttgtgtgtctgaaaatgtctttattttgtttcatttttgcaggattttttgctgtgtatataacacaagagtggcagtgttcttttcctcttactttagcattttaaagatttttctagagtccatcagtgtttgttgaaaaatccaccttattggtgcttccttgaaggtaatgtcttttttctttgttactgcttttgagaacttctctttacctttgttttcggcattttgactatgatatgtgtagttatgattttctttgtgtttaactttttggagggcttggtgggcttcttgaatcaatgagttggtttctctcatcaattttcggaaactcttgatcattgtctttccaaattttgcttctgcccagtttctcttcttgccttctgggactccaattatgtgtatgttagacctttgataatgccccatgtgttactcatactgttgtcttttaatgttcctttctcttttctctctggttttaattggaattttacctattgttctgtctttaagtcactgaccctatagtctgctatgtccagtctgctgtaaacccatatagtaagtttgtactattttattgattccaagtaactattaacagatactagatttgagaaggctatatgtttttgttcattttgcccatctttttctctattctctttaacagaataaccatagtcaaagtcctgtctgatgaatacaatagctgggtcatctatggatctgtttttattgttagctttctttttctctttgctttgcttcttttcttttctcttcttgctttttcacatgcctcataattttgaccataagctggacattgtatgtaaaagaactgtggaggtttcagctgatacattccaccagagcagcttccccctttcctctgttggagagtcagggtgaaggctgatgacctcagtctagtcagaaatttaagaggattgcagtttgagaaagactgaatcgaccacctctggcttttcccatttccttgtgtggtcttcatggctttggctgggagcctagctagtctctgtctcctcagccctaaaagcctgaagagattcagtcctgctctttagaagttttgagcttttctggctatcttcaaaatctggcaaatatcttgaggggaaaaacagggatttatgtcaggccctttctctctctcatggaatgttgtctcctaagtcccgtgagtttagcagaaatttcattccaaccttccatcctcatttcccagccacctgagctgcatagagcacttagcagtgtcctatgcgttaaagccaacagtcacttggcttcttatatttcaggcttctcttgtttccaatccatcatgccagccctgcacaactgccaaaagtgctgcttggtttctgctttctccagtagacaacctctgcttgggccaatgccagtcctcaacccacgtccagaatcagcagttgcccacagggaagaaaactgtcaggagttatcagcctacagaggacccactttgtcctcatttccacagctttctgatgtcttcaaattttctatttttgcggcttttctttttttttcttaatagttgttgcagtaggggagtcagcctgccacaatctactacatcttacctggaagcaataccttatcttgttatttttaagtcaacaaattagacattattattattaatatatacagcaatatttagagtcactcgcacataaatattaatttagagttaatcacatatttgctttgtattcctttttgaatctctgactttctatctgtgctaattttccttctgactaagccacatcttttagaatttcctctgtgaggacctgttttatttattcaaacataaaaaatttgtttgctctcattcttgaaatgtaatttcactaagtattcatttacagttggtcaattgtttcctcttgacacatggaaaatatcattcctctgcctctggctttcattgttattgttgagaagacagatgttagcctaattgctatttatttgtagatggtctaacttttctctctaactacttttaatatttctccgtcacaggttgtgatgttactttcatcttctggaattgttcttccacatcttatcatcgtcttccattatttccatctttgtctctctagcttgttttatttataactatctaagagtttactaattgtctccttagttctttgctccatctatatctgtccattgtgacttaaaatttcctttttttaacttttattttaagtttaggggtacatgtgcaggatgtgcaggtttgttgcataggtaaatatgtgtcatgggggtttgttgaacagattatttcatcatccacatattaagcttagtatccattagttatttttcctgatcctctccctcctcccaccctctggtgggccccagtatgcattgttcccatctatgtgtccttgtgttctcatcatttagctcacacttataagtgagaacatgtggtattcagttttctgctcctgtgttagtttgctaaggataatggcctccagctccatccatgttcctgcaaaggacataatcccctttttaatggctgcatagcatttcatggtgtatatatacctcattttctttatcctgtctattgctgatggacatttaggttgattccatatctctgctattgtgaatagtgctacaatgaacatacgcgtgcagctgtctttataatagaataatttccattcttttaggtatatacccagtagtgggatttctgggtcgaatagtatttctgtctctaggtttttgagaaatctccacgctgtcttccacaatgtttgaactaatttacactcccaccaacagtataacatcgctcctttttctgcacaacctcgccagcatctgttattttttgactttttaatagtagccattctaactggtgtgagatggtatctcattgtggttttgatttgcatttctcacttaaaattttgaactaatgtatttttcatttctagatgctctatatggttatttttcaaatctgctaagacatttttatagtgtcttattacttgctgaaatgttcaaacctcttttatttcattaagcatataaattttgccatctcattttctgtgctaataaaaattctaatatcggaagctttaataatcagattctgctatctctttttcctgcaagccttatctcacagtaccttgttttcttgtgtgttttacaattgttgacagtgaatattctttagaactttatccttgataattattagaggaatgaattaaaatttcacttctccggaaagtactgtgtttgcaccttttaataactcaagagaggtaacaacccaagttcattttcaattaaaattttcatttgaggtttttcagaccacaaacccatgtgagagctcacatatggttacaaattcttgaagaaaatgaggctccttccttccccatccaccttcctagtaccaaagtcaggacagacaggttttctgtgttagttcacttctcattcacctttgtattaaaggtctagctctttgaggttcaagttttatgttgggacctcttcccacttggtagggcctgggttttacctactgggtttctaagcatattttgtggttaacatcagaggccaggagactcatcagtgtataattaattcttgtataactaattatttaaaggcagtggacctattcactagcaccctgctttcggagtcactgaattcatgtttgccctcagctaaagccatcctgaacctctttagatgggagaaccctgatgctggtacctgtagcatgggggctggggctggagaagccaagtagtacactagggacctcacggtcactgtgagggatgggggtctctgcttggcttctgaacacccaaaagtaagctcttctgccttcactccatgtccactggagcctgggatcctctcataagaagctatatttactctaatgaaaaaaaatctcacctgggctgaaaaagcgtatgctatacatgagccttggttaacctaaactttcatccagagtttcaaggattaaattcctaagttctttttaaagcaaagagaagttagttccagtcctaggccatgataatgctcttggctgagaaaacctccttcgtttttttaaaatatggattctgagggtgcaagtgcagtttcgttatatggaagtattgcacagtgatgaagccatggcttttagtgtacccatcatccatatagtgtacattgtacccaacaggtaattcaccatccctcaacccccctcctctgttttaaggaactggcatttatgcaactaattgataaaattatcatctgtctcttaaccagattaatagtataattaaggaaatctgggatgatgatagcaggtttactgttgatgaaaccattgaacacttgatttaacccattaacagtgtttctgaaagtatgttccttgaaacactagaccatgaaaagtcctttatgttgaaatatgcttaagaaatattatatgcttgaaacttctcttggaaactcacgaagtatattagacattaaaggctctaagaaatcctgcaataaagaagcctatttaattttatttgactcggtgttttcaaattatgtgtgaccacagaaatagaaggaacttggaggagtaataattcattttttgggtagaattcactactgtcacagatatttgtatgctgtcaatgaacatttaaatgtggattatagagaaagtaagatttattcaacaaatatttgctgaaagtccactatgtgcttaccactttgagtatacatcggtgaataaaaaagatatagttctgtctcatggagcttgtaggagcattggactgtcgtggaggcattaagaaagaagtagcaagtgcctagaatccagctgcccctcaaattgttggatcacagccgtggaacaggccccagagctgggaagttgactgggcagttggctgttgtatccagcctgggagatgcaaaatttattgacataactgtacccctcaagaggaccataaagaagaccaagcagaaacacacttggttctggaacagaaaaaagtttatctaggaaaggaagtttaggaaagactgttagataagaaactgggtggtttttaaggcttgcagaatctcttattgatctgagaattcctcccaaaacaatccctctaaaagtgcctgattcataatccagtgaatgttaacaggaatgacgatgatgattatgatggtgatgatgatggcaatgatgatgatggtgatgatgatggtgatgacaatgatggtgatgatgatggtgatgatgatggcaatgatgatgatggtgataatgatgatggtgatgacaatgatggtgatgatgatggtgatgatgatggcaatgatgatgatgatggtgatgacaatgatggtgatgatgatggtgatgacaatgatggtaacagtgatgatgacaatgacaatactggtgatgatgatggtgatgacaatgatggtaacagtgatgatgataatgacagtactgatgatgatgatgatggtgatgatgatgacaataatggtgatgacaaggttgatgataatggtggtgatggtgatattggtgatggcaatgatgatagagtttaatctgcaactccttcccttcactcaatgctatggccaattggccaccaagaactgtgagtctacttcataagtaactaactcttaagctcatcctttaatttctttggaacagggcttaacctttctcaacagccccctcatctcatttaccttctttcagtgtgtgttcttccaatctgtctccacactgtgccaatgtaagcttcctaaagtttaagtctgggtacaggcgcactcactcactccgtgcacttttacacttttatgccttttttgtgttcttctctacttgtgttttctccttcttgtcttttagcaagacatgtactcatccttcagggtccagctcaatggtgagagcctctctggggctttggctgatctcaccctggaatgcactgcaatgttcctttgcctaggttcctgcaatgctttctccatttatctgtataaccctcaccacttctaagattacgttattatctgagtctgtggtgagggaacataccacatctgacctacggttcattgccagccccctcccagagtggaacactgaaggcacatgggcaactgttgcaaacgtgcagggtaaatgcacccccatggagtgacagctatgcagaccagagcccccttctcccaggttctgtgttgcccacacctttcttgacagtcctgggccagggcttccccaggtttggaatccagatgagtctgaaagcaaatgtcattctctttccttcaccacacagtagcatttgttcttgccaaggtagctgtgtgtgtgtgtgtgtgcatgtgtgtgtgtgcttgagtgactgtgagtggttgtgagagtgtggatgagagtgtgtatgtgtggcgtgtgactgtgtatatgagtgcatgtgtttgagtgtgtatatgcgtgtgtgtgtatgtgtaggtgtatgaatgtgagtgtgtgtatgttcaagtatgtgtgtgaatgtgagtatgtgatgtttgagtgtacgtgttagtgcatgtgtgagactgtgtgtttgagtgtgtgtgtgtatatgaatgtgtacgagtgtgtgagtgtgtgtatgtatgagtacacgtatgaatgtgagtgtgcatgtgtgtctgagtgtgtgtatgtgtttgagtgtgtgagcgtgtgttgtgtgcgtatgtgtgtgtgagtgtgagagagaatgtgtgtgtgtgtgtgttcatgccgatgttcacgatgggctggagggaggaccagtcccctactgcgtagatcgaggatgctgcctttacccagtcttcatgaagttataaaaattacagccatttgtcacaggtctctcaacacagcactgggccctgggaggaccaggccacatctcttggcgtctgaaataaatgaactcatttattcacacattgaggccacacatgtttgttgcaagtctgtggccaggcacagggctgggagctggggaataaagagctgacccaaacagcagaaccagtttgcgttttcatggaattcatgatccgctgctctgacagtgggcatgggtcagacaatgaccaagtaaacagatcagtaagatcatttggagaaacgagaagggatccaaaggaaagaaagcaggaggccacgaggaggggagtgtggaggagtgaggggctgctttaaattcagaaatccttgaagactgtctaaggaggtggcgtttgtgttcgggcttccataacaggtagggggaagatggaaggctgctccagaccagtcagggagaaggggagtgagggtggttgtggttggaccacaggaaatgcaggaaatgaaagggagggtggtaggaaaggcaagggctagaccgcacagggcctttggggccagcgaaggaagtggattctatcctgagtgcaactggaggccactagaagggcttacgcaggactgacaggctccgattgatgcttcccaagttcagccgtgctgcagggcaggaactgtaggaggagatagcgtggcccagaaaggcagtcaggagctgtccaggccagctgacgctgacgatgagtggggcccagagcttagactccctgagactcagccctcctctcccgcaggaccccagcagccagccttggagggctcccaaagaatgacatcaccctcagctcccagctgcttgatatgcagggaattcctcccaaggctatgcagaggcctcaggcttcagcagcaagctgcggcccgtgcctgggggagagaggaggggaaaatcgtaaccccagcagcacctcctcccgtgacctagactctgggccagacaccacaggcattttctggataatcctcacaactgccccatgagggacacctctgtcgaatcataaaatcctgaacagggaaggatgcctggagatcatgtgacctgtacccctgtgtcgaaacctgtgtattcctggttcttgtttatttattcatcatatccttaaataacacccttactacttttcaatcacttgaccaatattaattttcatagccacttcagaaggtcagaactatcattattcccatttcatggatgaggaaaactgaggcccagaaaggcaaagtaacttctccaaggtagcactggccatcatttacatctaggcagactgacccagaatccatgttcttctaggctgtacatgataccacctgctctcggttgttcatgagctggcacagtggaaagagctctcctcagcgggctggagcatctcttgtacgcccagaggtgtgggtgagctgttctgtggcacaattgtcatcctggggtctgcgacggtaagactcacctcagaggaagggctggcctttcattcctagctgcaattccttacaagtaagaaggagagggcctcaaacaggaaacctggggtgaagaggtgaacctcagatgcctatcttgtttaaccttctgtctccaggcttagcacagtgcctggtacagaggaagtcctcagtaacattgttgagtgaacggatggatagatgtgtgtggacccgggttcatccttcacatgagaaagtccgtgagatgtttacatccaactcaatatctagcacatacaggtggacaaggcagaaaggcaatgtcatggctcttgccctcacactctagggcctagactggtgtgacaatgtccatgcttacatgtcctgtctaaggaaagcagctcccgttggtcatgcctgtggaaatgtggccctgtatggccagctcttctgatttttcataagaacctggatggacagatgccatgcaaagtttttttttttaattttttaaaaatcgtgtgtatcccaaagaaaatattatctaagggtgaaatccagcccagggggcactagtttgagatgccaggtctgggatcagtagcaggtggcccagaatggggactgggttggtgaagactaagaagaatgagaagctccctggagcctccgagaggaaggtacattttgcatgccagcttatccggattcgagacttgctcgatgtttattttctggttgtcactccaggattttagttaagtcttgtctaacattgcagccaggctcagccattctgtaggaggattaaaggatgggactgtgtataaaattgggccaggatggcaagcgagggagcagctcttgaggccagaagagtgggggaagatggcttgatgacagacggaatctcaggcacctgaagagtcttagaagccagatttggggctgagccgcccttccccaagtggagattcaccagccatggccagactcgaggatgtgagatttatttttcttaagatagcaaatgtctttgcaggcatgcttcccagttgggaaattctttttatgctccatgtaatccgtctgccagagcctcctttgactctgtttatcggttctcttcctgtatgtgtcatgctctccttccctctctcctcttctccccttctcgtcaccacccctttgctctgcaccacccagagcctgttaggaagaaaggggggatacactcatcctggctccatttagggtgggcttttaatccagacatgtcgctgacaccagcatttgcaccaggtatttaattagaccaggaagtcccaggggatttgagaagctggctggcgaggaatgggctctatctccatatcttattttgacaagcactgtaattatccctcattgctggcaggcggagcagaatcacgttcgttcccagccccatcttctcagaacaagagtactcaggctcctggttgctccaccactaaacaactgcctgtctcagttccccagcgagaccgagactgagctcagccattactcaggagatcgcaggcgggcgctcagcctactttttgacagcatcgtggaggtgatttcagagcgcttgctgcatgcacatgggaaatagcttccaaggaggatctttgggggcagaaggaatgaggtgggcaccatgccctccaaaaagacagaagttacccctccaggagccagcatgaatggagcacctaccatgtgcccatttggtattgaatttaatcttctcaatagcactgccaggtcagtgttatcattccatattaccaatagggaaactgaggctgtaagtgaggaagctgcagagtcagttgcagtggcctcagaattccgaccaagagctagctggccccacggtttcttcccttcctactttacagcattgtggctcagggagagcacacatgccctcatgctctgccccaaacaatttgtgggtgctggaaagttctggccatgtcaggagcaagtgctttctcccttgctgtgctgcccaaaacttctttaaggaggttaccctcatctgtcaaacagggatgtccctgtctgtcccacagagtcttcatgaaatgaactgagatggcatattttaaagccctgggaaaaccgaggcagcctcgggaatggtgacgtatctggttattgagactgtcttataatttggggcgtgaaaacctagggctacagggacacaaggtaatgagaggaaattgccaaggaaagcgaatgcaaaggaaacaccacccaagcccagcctggcttccaggtaccctctgaaccagcctcctgccccactgtgggccagaatagaccagcctgctaggaaaacctttggcccactgcaacaatgacaatcacaacaactcaaccgtttagtgaacacaaaatatgtacgaggcacgggattatgcacaggaaccacgtccgtacatttcattctcaagatcctatgaagtaggtgttattatccctatttgatggatgagcaagctgtggttcattaaaccacatcccccatgtcaaacagcaaacaaggggtgaggccagttggtcttgacagtttgtcaaaatcgctgtgctagaaaaccaccctccttactggttgtgttccaggggttcccaaactcaagttcttcttggaggagctgcaagaaatgatttgagggtgatagcaaggaagaatgcatctgagatgccaggctcaggagattcctggagtcctgcactgtgtgccctttggcccagaaggcccttgtaagcacctttaggtgttgtctgcatttcccttccctttctggtcagggaccccagctctctctgcatggattctcctctccaggaggtggggggtgggagccgatgtcaacagggaagaggggcagaggaacaaggacagggatggggagaggaagaaagaaggaggtgggatgtggcagctgggcccggaagcaggctagagccagctgcacagctctgacaatctaaagtgtctcttccgatggtctccattcagccccatctgcagatagctcattttgtgaatgaggcctgggtgtttgttccagaaccttagctgtgattaggaaagacaggagcacttgggaggccccaccttcaatgcaccagagtatttctagaccctcattctgcagtcagctctagctgccacatcagggaattcttgctggtctgtagcctggattccaattgtggatgtggcctgttaaaactttcctgggtaggacagtgtgggcgttctgccttaggagtcagacaggcctgagtttatatcccaccatttccatatgctggctgtgtgaccttgaacaggtcccttagcctccctcagcagtggagtggaagattaagtgcacagactctgaagctaagccttctcccatgctccagtcccagctctgccacttactaactgtgtggccttggcaaagtgacccaacacccctgggcctctcttctcagctgcaatacagggctaatacaggcatgcatcttatggagttgtcaaaaggatgaaacaaattcatgcatttaaaggacttggcacatggtgagtgctcagacatgttagccagtatccaggcatggtggctattttctggaataaatatggataaactgagacaactttctctcctgaagatgggtccattgcgaagtcatctcaaagaggtgtggcctggagaagtggttccagtacctcatgccttcttccccttccctccttctctcctgcctccccctgcattcttcatgtgcctcctgctgtaagcatttgctgagcctcctgctgtgtcccaagctctgtgcttggggtcaaccacccagaaatgaatcgtgtgggtcccatcctctccaagacaaacagttagaggatggtcagatagtgccagtggagagcagggaaggcctcgtggacaacatcctatttgagccacatgaccatcagggaagagcatttctaggcagaggaagcagtttgtacaaaggccctgaggagagaacaagcttgagaaataggaagagtgcccgagtgtctggagtggagggacagggagaagatgggtaggaatgaggttgagaagtagctagaggtcaaatcatagagagctttgaagccacagtgagaaatgtgggcttactttgagttttctagcataaggttgttctgaagattaaatgacaggagacaggtagagtgcttggaacagcatctggcgcattgctgggccttaaataattgttacttttattatggtggcacttatttccatattcagccctgaggctggctgtggtctactaggaaattattggcattctggtttaggagagaggacttgacgggatttgggtgacaagtctcagttctgcccttccctggcctagccaagctcccttccttccctgagtttctataaaatggcagcatcacattcccctccccaggtaatgtgacaatgaactttaatgtaaagtgccacccacgatcaaggaatctcatcatttaaactgcttttgccatctaaggtcagaaggcttaaactgagcccgtaattacatcaagtgcctgtaatcctagctacatagaaggccgaggtgagtggatggcttgagcccaaaagttcaagaccagcctgagcaacatagtgagacccagtctccaaaagtaaataatttaagagaataaaaaattaattttttaaagaaggtttaaactggttgtgacctaaggaaacaatttcttccagccgcatcattgaacaggtgggacaccaagctcccttgtagataaagatcgaggtggaatgggagtggacactgactccatctaagatcatggaagcgctctcacagtgaccctactgggctctctggaagctgcatcccagcagctgtgcagcccctgggaccagccaggagtgacctgggtgctgccgttcaacccacctgtacatttcccaaaaagaggcagccaagtgctgattcagggaatttaaactttaatggtcccccggtctattattatgttttaatgaactggaaaagcacaaacagaaatccttaagagcatcagccgtgacacagaaatctaatacaataaaacaaagtgcttataaaccccagagttgtttaaaacccagaaattgccaattgacatatgggactatatcttcttagcccctagtaaactgagtggcttcaaacaagtccctatcacctcccagggcctcagtttcttcacctgtgaaataagaggatcaaaaaaagataatgttctctctgttctcttccaaccgaggcaggcatctcaagtatttcttagtcagttctactctaggctacacagtatctgtatctggcagctgtatgaactactgttgaaaatcctcttcccaatcccagtttcaacatcactcctcaaggcagcatccaccttcactctagactgaattaattcctctgtcttaccacctaaactcctctagaaaacttgatagaggtaaagataaatgcattttttcaaaaattctacttttctagtcccaaggcattgtgtatatcattcttatgtaagttatcacaataaacccataattagttacttccatttatgtcaaatcgcctacaaagcagaaacatgtattattcatttttggcttcctccccagtatctagcatacgaactgtttgcaaacatgcccagttcttcaaactttgtaacttcatgccttttctatctactacttgggatgggcccaccctccctttgtcctctaagcacactcctattcatccttcaaagtccagcacaaaaatcccctcctctgttaaacttcaactgctccaggctgagtcttatgtttgggtccttcatacgtacccctcttctattgtttggggtattgtgtgctgtgggatctgtttactctcagttctcccctctaggctgggttccttgaaaaacaccctctggacatttcacctctacatcctctgcattcttggccaggctctgagagggcattggtaaatgttaactgcctggcaatggtgatgctgttaacctgatgtgtcaggggtctgaataaagctgcctcaaggtaggcagatgcccacaaccaagcaagaactcaaagctgcaggctcctcagcctgaaccttagacagcgtcttggtcaccatttcaacaccttgaccacatttctcactctcccaaatttcctcctgcttattcctcatccacatacataaggctgtgtctcccaggggaaattcaactacttggtaattatcctgcttcttaagtttggggctaggggattcatagatgatgttcagtattatgctgtgcaatgtagatgcttcctaaaccttctcaggagctaccactgagtggcacctggggacctctcaggaagagccagttttctgggcagtgtggggcaggacagagctcattaaaccagcctaccacctgtcttccagctcctcctctcagcctctgggcttccagcagaaagcacacgagagcattcttgttggttttcttatgacttgagccagcgagacgtacatgcccagcacctgttacctgggctggctcttggctgagagcatacatgcattgggtcaggtttcagatctgctggaggaacacagccagaatgtcttgacaggcagccctggcaaagccccagaaaatataagatctgagtcttatgatggactctgtgaccttgagcctctcacctcgtgaccttgggcatctcatgttctctccacaggtctcggttctggactccttcatgggagctgtcatgcccctgtcacacagcagtgttgtgcccccggggatcagggaccaggatggtcctttcttggtggtgaagggggcattttgcatattccagagattcaagtttccagacctatctagaaagaaacatttgagtttacaggttggcgcttctcagcctctgtctctcttcctctctgttcatctccctctgtcccctctatgtatgtttgtgtctctttctgtctcctctgcctttctttgtcatgtctttctgcttctgtcctatactgtctctcacctccaccctggttccccccgccccagatgctcttctctctgtggggttttttcttcccctccatttccttctcctctcccactccttcctccccagattctccctcactacaggcttctctctaatctctctctaactgcctattcttctcacaagaaggagtcccctctggggcccagaggccaggcaaggcattgtggacaaggagggcatccgtgccatccaacgggcaggagcccagcctcctggctggtgcgtggctgtgctgtgggtttgtttccacttaccaaagggcatctgtaattaatgtgggcagtgataaaggagctggagatgtgtttatgctccttcgagggctgagatgaaacacccataacatttaatgtggcgcactgacatttaaatgtcaattagaaagtccccgctctgcttggctggcccctgcatcctcagatgagaccgccctcctccctgccttgccagccctgctgggaccaccagctcacaaaagacagtggccacacagcaaccgtgactgaagagtgtgcagggtccaaagaggctaaagtggctttaagagcactccggagggggaggactcttggaacagagaaaggaggaggatggtgccaggccaccaccaaaggcacgtggaagggggctgggcaaatggtgaaggagcatgtgggagacaagtttagaggtagcgttggcttcctcctctcttccctcagtacctacagggcagaatctagagcttgtttgtgccttggcccttaggcgctatgtttctgcctctgtggttgatcaccctccattagaccaagggcttcttgagaccaggttcccatctcttcatcacacaggacgcctatgcacacacggtgcctggcacacagtaggtacacaaggtagtctattcagttcaatacagtatatattcgttgagttcccactgcgtggtgggcattatcctaggaactgaggctacaacaatgattgggactgagacctgcccccacagagtgtacagatgctcttcaaattaccatggggctacctcctgagaaacccattgtaaatcaaaaatacagaaatcaaaaacgcatttagtacccccagttaatccatcataaagtcaataaattgtaaattgaaccattctaagtccagatgctccttaacatacaatgaggttatgtctcaataaacccatcataaagtcaaaaaatctgaagtcagaccgtcgtaagtcagggatcatctgcgttacatttttaaagacagacagaaaaatagatatgtggcaaatgtttagatggaagcaaagaaaagaggcagccggcccaccctggatgacaagaaagcttcttggaggaagtcaaatagagctgagacccaaagaataaatgtgcatttgcaagacagagaggcagagggaatactggacagagggcccagcacaagtgtggagccaggagggagcctaggagtgcacaggggttggtggcaatgggcacagcagcttccttgtgaaatctgagctcagagaccacatgactgcatggggttctgcaaccagcacgtgagctctgtgagggcaagggcctcatctgtcttgtccactgctgtgttcccagagttggggaaagtgcttgatgtgtagcaggcactcgacaaacatttattggatgagtaaatgaatgctgtcttcactggcctctcctcccttgtccagttcccaaagctcagtgggtccccgcaaatgcatttattttgcaaaagcctttcccaaagcctggcatccaatgggtgcctcatttcctcatcccctgcacgccgtctctcagtccctgagctgctgtgcccacgacatgctccattttctcataaaagcccttccaacaaggggcacatttgcatttcaagtttcctggaattggagtacagagaaatctgacttccagagcccagggctctaagctgcagctggagaactgaaacacagcaagcaggacacctgcccagaataaggttcaggccctggaatatcacatgggacccatgctcctgtagctgtctgcagtctcgagccccaaggcagtagaacaggtgttcatcttctcctgcactctggaaatggagtccagggcctgagctactgagtttgtagactgcaactttggtagcaagaggcatttctcctcctcacctccacccacacacagatctagttcccctcgtacgctgccctttcagtcttggacactgcagaagacctgctaggagagcctaagaaacccaaagccttcccacctgccatccaccaactatcatttactcacccccactcctccagagtgcagatgactatttcacttactgatttggcaggcgctgctgctcctcaccttggttggagtagagtttaccctgcccagccctgcaggcccagtggtaaagggaaggaggctagtgattattccgactttggatcaatcagttgctcagtttattggaattacatcccagtggctgctattgatggaactgctggactcgggcccacaatcctcatgccagttttataacactgacatcacctgctcacacacagggcttcctctcccatcctgtccccatacctcactctgtagcctgagatttctaaggtgggggatctgcactgggtgtttggcataaatgatgtaagagatttcctttgtattgctctcagctacatcttacctttgtgtaagaatgcaaagtcataagcacagtttacaattgcaatgggaggtatgtgctagttttaaggtgttttgtttttttttttgtttgtttgtttgtttgagacagtttcactcttgttgcccaggctggagtgcaatggcacaatcttggctcactacaacctctgcctcccaggttcaaacgattctcctgcctcagcctcccaagtagcttggattacaggcatgtgcccccacacctggctaattttgtatttttagtagagacagggtttctccatgttggtcaggctggtttccaactcctgaccttgtgatcagcccgcctgagcctcccaaagtgctgggattacaagcgtgagccactgcatcaggcgttttaagtttctaccatttggggcatattcaggaagattcctatcccaacacaccccttccttctgcttttataaacacacagagtccccaaccaccctacgtcctctttcctccataaccacgtcacagtgcactgtaaacacattacgaaccagctatgcaataacaatctgctgaatctcagagatgcagaaagaaatcactgggccttctattgatacattcttatgttatcatttttaatttctataattatgtttttaaggtacattgtgtatcagcacagcagcagatgctaataatatattaaaaactgtactcgtgttctgggagtgttcacaaattatagcttcacactattctcatcttctcccgcctctgctcagatgtccttgaaacatctctaaggatcctggaaggcaaactgactacaacacttatttgcacagcacagcatctttcctatgacacgtcttttggtttttccaatcatcaaaagcaagaggtagcaggagaccgagctgttaggcactgaccgtggcattgcctccagggtgaattgcgggggcacaggaaaaacagctcagattcctagcttttccccaccttcctgatctactgaaccacactttctccagggatgtggcccgtgatctatattttaagaaaacacctcaaataacttcccagccaggtgtgtgcaccacagtgctgggacgtggtattgttcttgccatgggaggtgggagattcttgtccatccttcacccagaagcctgcatgtggtttgtcaatttttttttattttatgaaactttttttctgtttacactcttgcagaacaaacagacaaattatatagctgatgtcacatccctttgaaaaatctatcaggtttcatccattcattcaacaattgtttttaccagttacactttttttttcatttgccatatacagaaactgaggctcagtgagactgagagatttgtttctgacttagcttgtaagaaagagattcaggaactcaacctaggttacctggccccaagtcctgtgcccttttaattttacttccgtacattttaatgaaatggctgcgagaccagagctctgtgtgtgaacaagttgtgcctttcaaccttcctttatctccccttctctttccccaccaccaagagcaggctgatgagaaaattaacattcaggacacgttctgctcccttctgattcccacagagagaacacagcctctgcctgccaattagtgacgttcagatctctattagagatggggacagctagttccagttatgcaaatgcccttgtctgagagtagccatgggccagcagcatgccagtctcacctctccccatggagtcaccatggatgtgacttgcacctcccgtgttgctttaaccaataatcaaatcagtatctatttatataagcactggccaaggtactgcaggaagctcagggacagattttatttcagcctaaaggaacttacactgagtagagagtgtggccagggaaagggcagatctttcaaagacactctgttcttctctaaacactcacagtttctatttattacccaaaaaaatacataaggaaaaatacctaacatttgttaagtacctactatgtgccaggcactgttagacactttatacacattatctcattcaagtccattaattttatataagaagcaatatgctatttggttcaaggcatgtgttttaagtaggaaaaactaggatttttaaaactaggattttaatcctgccactttctccatgtgggacttcttgacctcagttattcatctgcgaaatggaaggaaacaatgtctgtttgccaggaatattttcagaagcaattagataaggtatttaaatccaagcacctcatcttcatatgacacagcatagtgttaagatgcctaatatgtagggaaatgacaaaaatggacaaatgcaggatattattagcaacaatgcaaaaatatctgtatatggatgaagagtggaagaggacaattatgggggaaacttgttgtcttttaatttctgaactatctgtattattattattattttagatggagtctcactctgtctcctaggctggagtgcaatggttcaatctcagctcactgcaacctctgcctcccgggttcaagcgattctcccgcctcagcctcccgggttcaagcgattctcccgcctcagcctcccgagtagctgggattacaggcacctgccatcatgcatgactaatttttggttttttgtctgtttggttgtttgtttgtgtgtttgttttgtagagacagggtttcattgtgttggctaggctggtcttgagctcctgatctcaggtgatccacccgcctcagcctcccaaagtgctgggattacaggcgttagccaccgcgcccggccaactatccgtattattatgtattttcatttaagcttttaaaggaaaatggaaacactgcattaaactgagcctcagagaaattcagtgacttgtccaaggtcatacaaggactggagggaccaaggcaggatctatccattttcaatgcccatgctttcccccacacaccatgccaccacatgtccctcaggaaacaggtctgcaatgattcaggagacctcgtagtctacattgatagatgtaaacagcattggtttctgtcttagagagtgggccagtgaggaaggcatggatcaaagcaaaaagaaaagccaaggagggggaggatggagattaaacaggtccctggttgtcaggggcaaaactgttaatgacggtggagcaccatgaaattaatgacccacccaaagcacctgagaaattgaactggttattaaaatgcaaatcataaaccaggaaaaggaggaaaacaagcacgaggaattaggaagaaggaagatatggcatggagtaccacgaacagaaagtctgtggccagcacctggatattcagagaaagagtgtgatttaggcttcagaagggcaggggtctgtagcttagggactgggcagagctgttacctagaaaagctagaaacagaaatgcataaatcccagttgtccctgacagtgggatacagtcagggcctgaagtgcaggggaaggccatcttaggtcagaggcagtggttcttggcatacagtggttttccccctaagaatgttaggcaatatttggtgacatgtttaatgagcacaaccaggttaagtatctactcactgctaatctctggtgagcagggagaccaggggtgctgctaagcatcctacaaggcctggggacctccccaccaactacagttatccagtccaaaatgccatagtgtcgctggggagaaaccctgatctaaggatgagtgagaaggtggatacaggaggtgaggaggtcagaagtcagaccaaacatcagatgggaagctaggaggaaaagaggtcagaaaaggagttatgaaccaaaggacaaaaggaagttaagtagtcagtcaggagatgaggatcatagaggagatcaggcaaagagaagtccagaggtggaaaaaagcttcagagctcagacgggctgggctctaacaatcatcacagaagcagcaaagatcaagaagcaatggggaaggacagttgaggctagcgccagggggaagggccattggtgaggagcctttctgatcagaagttggatggagaacaccatggtggatgtggatggaggtcaaagtgatgatgttctggaaagcagtttaaacaaaacaaggggcctgcgtgctttactaccagaggccatctgttaatggatgatgggaaatgccactcttggcccccacagtcaggagcaggtcaccttcaactgggcacagcaacacgtcccactgcaggcaggcacaaaagcagaggctcattaaagagctgccctgggcccaggctacatccttggcaaaggatgagatttgcacccaaggtcaggatggctcgggtgtgtggagcacgggctacggagccaggtcaatggagttctaaatccctgatcagcaaccttctacagatgtggcctttgataggtcactgcctctctctgaagctcagtttcctcacctataaaaatgggatcgataacagaggttacatctgtgtggatcacctaaactgtagaggattttgcaaatgtgttgttgtggttgccattcttattgctggaacataattccctcattagtatttctgagtgctctggtgcatatctgctgcagcagaatccttcatgcatccagcaaacatttcctgggcatgtagtatgtcccagacactgtgctgaacactaagattacatggaggaatagagattaatttctgttctttgtttactaagctcctaggggctgaaaggcatcttaaagtccataaacttcctcctgatgcttaagtaccctccacaacatcccacttatgtgtcctgggcttgcacacttctggtgctgatgagctcaccgcctcctgagacaggtgattccttctacagaccactcagactatgagaaagttcatgccgggtgcagtggctcacacctgtaatcccagcactttgggaggccgaggcgggtggatcacctgaggtcagagtttgagactagcctggcgaacatggtgaaacccgtttctactaaaaaaaaaaaaaaaaaaaaaaaaattagccaagcatggtggcgggcacctgtaatcccagctacttgggaggctgaggcaggagaatcacttggacctgagaggtggaggttgcagtgagccaagatcacaccactgcactcccgcctggttgacagaatgcgactccatctcaaaaaagaaaagacaaaagaaagttaatatatacctgtattgagctgaaattctggttctggccctttctctgcggctacccaggcttgtgttttcatctcccacattacctcctattagggactttaatggatgacatattgtcacccagcctcctctgctggatcgggatagctttccatccagacaaagaattttcatgactgagtgaccatccccaggatgggctttggtgtctctcttccctcagaaagtgggaagctccaagtgctgccccctgaaacccttttccagtaaccatggcctccaggggtcctggggtgatctcagaaaggtagacagacctctttagcagtaacctggaatattttgctaccttcctgaaatctagagaacagagcaactttgcaagcttcttcaaaggagcccgttctgacccaggtcgatggagctcccaaaatctgcacccccaccccccgctgctgtgtgcaacaggagaggggctttcccggaccagcttttccagaaacatgaattctttttgacacttggcaaacatttggggaccctctcagacctcactctgggcaggcccgaactgtcttttccatgccagagggcagtccaggttcctatcagagttatttgaataatcttcccaacacctctgagctgcagtttcttcatgtgtcaaatacagataacaatagtacttcactcataggattggtggacaaagtcagtgaggtaccaggtggaaaaagaggtagaacaagctgggctttgcggcatgccaccgtagtcctagctactcgggaggctgaggtaggaggattgcttgagcctggaagttcaaggctgcagggagctatgatcacaccaatgccctccagcctgggagacagaacgaagccctgtctctaattttttttttttaaagaggttgaaaggtgtctggcacttagtaagccttcaccctagttagctttgctaggattatgatttccatccagacaaagaagttgccctcagtgacgttctagcagagtcatcaaaattgggttaaaaggaagcaatttagcatggagcgagcctaaaaatgcaccaaagtaatgaaaagagcaaagcatctagacatttgatatctggctgtttttccctaggaccattgtcatggatggggataggagagccatctaaggtccctgcccatctgcaacactctcctgtttctgctccgatgctctacgatgtcgtacgtggcagagccagcccagcgtggacttcagctctcccagtaactggctgagtgatattagaaaagtcactgagcctctattttctataaaattaagaaaaatcacactcccttataaaatccttagggaaattaaagatccttgggaaaatagatctcttacaggcatatcttggatacctgatcaatgatagctgctatagtcttcttctgatcatgcttttcataataatcatcttaatcattactggcattcaaagccatgaagcacctgggagaaggagaagctgatctgtccatgcctgtctcctttggaaaatgcacgctgttacacttccccacatgttcaaattcatactctctcccccacccccttttttgagtgcccccaataggcacttgagaaggctgaagctgggattgtaaactgccagatctcctgccttgctctcaccccttgttccaaatcttatcaaatattaaaagctgtgaaatagaggcaggttttaaatcattttaatcacagcattcctcagcctgctcaaaagggctcaaaggaatcgattcagaagtggtaattatgactgtggccccgtgccaggcggcgggtcagcattggagcaccagcgacagacggccggcactgactggggagggctcctcccaggtggggacaccgaacaggagatgcctcctgggaggaaataaagctaagtcatcccaggctgggtatcaggttttaaaattcataaccaagtcaactgaaaatcagcttacctttattaagtcccccactaagtgccagatgcttttagcctcatttaaccctcagataactcctggaggtatgtgtcattatcctgatttataagtgaggaaactgaggctaaaaaatgataagtagtgtcccaaagccaatcaaaaagtagctcaactagatctatccagcttggaagcctgcaatttgttctctgtgttttggtcacgctcagattctgaggactgctgcaaaaatgttgaaggaggtgctacccacaggtcccctgctgtccttctccagcctccaccatctgcccggtcctcactcactttcctccctcttcccccacattgtcttttggactctggttgactcttgctgtcctctggctactgggattcatccatgcacattagaacccagttaggtcactaaccctttgaccatcacagcccagctgtcatatccctccctagactcatctcttccctggccctttcacctccatgctgtatactccagcaagacttagcttcctccagttcctccagcacctttctctcctgccttcttgcctgtgcgcaggcttttccccaactggagcaacttgctctgtctccacctccaggtctcagttgaaacatcacttcttcctggaaagactgctgactcctaggtatttttcccctaatttataccaccgtggccagggcttttctgctatgacggcacccagcacttggttggggttacttgtttgaattgttgggattccttttactggccagactggaggaggacagagagcacgtccatctgactcaccacagtccagggctaagcagggttgccggtacatggcaggcactcagtagacaatggctgagtgagttatgtcaataatgggaccgtgcttaaatgtggacatttctgggggctcagggaataggtcattctgtgggccagacaaagcatgcaagtgagcagagctggcccttcgcctacaaaataccgaagaatattcttcaatatcacaagaaagtatcttttccatcatttttcttgaaaaatgcatccctcctgatctatctttcatttcctcacatttaatagagatgtgaatacagagaactatatctctactataagacaaatagcaccctacgcacagtaatgacagcccaagtagtctacttgtaggaacaatgaaaggaagtgatgggggctggggtgaatggaggtgcaccgagcctgtctaaagaggctgctgcttctcaacctcagcctggtattgcccaaggaaatgtgaaccagtgcagccagatttcctgacttcaagaggagctggaaatcgactgtatgcgtaatgtcccaatttttaagagctgcctcaattgaacacgcacaggcacaaacaaaaacaaaataaacaagccaaatgcaacatctgctgagaggttttggttcttggattgcaacctctgcacacattttcccactaaataaagaaaagctccttgcagatggaccccggtgggacctccaatacccggaatgcaccgaatggctgggatttgtgtggccccaaaaccctcccttcttgcgctcacagtgctttcttgaagcttcagcaaaccccagcgccaaaggaaaaatatttataacctgactaggcagcgcttaaaagatcaaggcatacgtggtgtgcagaaatcactcgcacattgttcctgtttcctctctgccataggatcaaatgcttccagtttcaatgattaatcgcctctcagttttcaccacaagttgtacaatgttattgactgaaacagaaatattcatttcaggactctgctgctggaacaaacacaagctctggggcggggctgatgatgactgatggcacaggttgctgcacatgtttctgtgctatcggattcaaaccacccctgagactgctctctttacagatgggactcagggaagctcaaacaactatccaacaacaatcatttagtgtgactttattaatggccactatccatggaatgtttactctattccggatacggtgccaggaacattacctataccatctcatttaagcctcataacacccactgttatatttgggaaggagccttggcagtaacattttatacttgaaataactgaggcagagaagcccaaggctgctaagcagcagagcagaggggccagtccccagcccagagctcccacctcggctctggcattgctctcctatgcaagaccctgacacagacacacacagtcttttccaagctggctgggcaaggaacaatttcttttgcagaaactcgagttactacaaggcttctgtggacagtctagggtaatattggtactttaattatgcacctggtgtgttatctatccttgggagttgggaaaggtgatgctctggcggtctggggaaatctgccctctgaaattcgagcactcttgaatctcttgcctggggcccaattgagcatggttgctctccaggaatgtcccagggcagtgcctctctaactcaaatcctgggagatattctccagcgtctatgaattctccaggtaacctctttacaaaatttaaaatttttcatcaaataataatcatgtaaacatcaatttactattttaggttgtctgttttaatcaccttataaccatctatgttgggggtccacaaactacagcctgtgaactaaatcagcttccaacctgttattctaaggtctactactgaagaatggcttcatggtcttaacccattgagaaaaaaaaaatcaaaagaaaaataatatttcatgacacttgaaaagtatatgaagtttaaatttcagtgtccataaataaagttgtattgagacagcagttctcattcatctgtagctgcctttgcaaaaaagacagtggagttgagtcattggaacagagaccttatggcccatagagccataaatatttactatatgggccaagacagaaagttggacaattcctgacctatgcaatgtgatgttagtggcttatgtttgtgcttccagctgagttgggtactctgtctgttgtggttttgttcaagttcttggattgcaacctctgcataaattttcctgctaaatagagaaaaactccttgcagagggacccaagtgggacccccgatacccagaatgcaccaaatagctgggttttttacttttattgccatagggctaatgagaaaaataaaaatagaggaggactcaggcacttagaacatttgcagctacagaaagcagtaagtcctcacattattgtctacaggttctttgatattgcaactttattaagtgaaaagacatataaagaaaccaatttgaccagaagctaattgaaagaaatgagttaagttccttgggcatatttctgggcacaaaaacatcaccaaacttctaaataaagacccaaaacacttgtaacactaagcattaaaataaatatgagctatacatgcatttaagaaagattaagcaaaacaagtcagataattatttacccaagtttggtgaattagcgagtgccagcagtcatagtggtggtctgttggatcaaggaataaatgtttgaaagcaaaagttgtcaggagcacctcctcctaccacacagttcaaaaacaattacagatatggcaggctcgccaagcacttccataccacatggtttattgccttgcatttgtacgattatcttctgctttacaaatttttattttacaattacttttattcattgactgattcattttccaatccacttattccagttcagggtcacaggtggttggagcccatcccagcagctcagggtgccaggaaggaacccaccctggccaggacgccatcccatggcagggcacactcacacacacctacatactcacactgggaccacaccagttcacttcacatgcacagctctgggacgtgggaggaaactggagtccctggagaacacccgtgcagacatgggggaaacgtgccgattccacacagacagtggctctgccagggtttgttgtttgtttgtttgtttttcatcaatgttatatgaagcaacagtattcgaagacctgctgtacagctttccagcagttccaggaaaaaagagccctgggagacttaagccatcacagtacaaggcagtagaggcagggtgaaatagaatggaaaaaaaaaatgtgaacccacactgcagtcatactggaagcagcaatcccatttcaaccaaacaacctcacattaaactaatgttgttaatttgaagtttattggttttgcagtcgtatttgtgtttaatttggaaatttgtttcagttttatagctgaataagagctaaaaagcataaggattttatacctaagttttatgtctgtacatattaagtaacattatggtaaagtcaacacttactgaaaatgtcccctttaatagggcatatgttacttaagtttaagcaggaaaaatgggtttaagaaataccaattgtattatatctttaaatatgtgtgagctgttcaaagttgccacctggcagaaaattcaatctcagttacatagggaagttcctacccctttctaggaaagggtcttgttaaataagaattctaagcttaagttggagacaggttcttgggttggggcagtgatcattttttaatcttgcttgtatgcctacactgcttttgtgtgtgctgatctgtccatcctttaggctgtgctctgcagaatggctcaaaatcacccctcacttagtcctcccacttgcttcctttgtaccccctcagcccactttgcttcttcctctttcctggacaaagggagcacagttgttctcaacgggcctttagaagcaaaattctggcttgactttccaatgtgggagtgggagaggactgctaaaaataattggtctttcttcttagcaattcaccttattacaactgttaggtggaaaacttttttttcgttttactgaaaagtttaacccaggcactgaagagttagattgtatggacctcttttaatcatctgctgagttctccaatgtatcagttagctattgctgtgtaacaaatcaccccaaacgcaatgctctacaacaataaaaatcatttattctgctcactgcctgcagtttattcaggcattggatgagacagcttcttcctgctccatgtggagtcagctgggtacttgaactgggacatggatgatctactttcaagatggcttattctcagggctgccaaatggataccggctatcagttgaaagctataagcaggggcactctgcataagcatggctcatctctacaaaagctcctccccagtctccttgtttgggcctcacagtgtatggtaacctcagggcagtcagaatgtgacaactaaagacttcaggagtaagtattccaggaagcaagatataagctatgtggccttctaagacctagcctcagaggtcacatagtgtaacctctatcacaccctattggtagatattgtaacagaagcccacccagtttcacagatggggacatagactccatttcttaataggtaactggccagagttgtaaaagagcatgtgggatggaagatattgttgcaagcatctttagcaaatacaactggacatacccaatgcaagcacaggattgatcctccactctgcccccataccccatgatttattagccactcggacaagtgacttcaactctccaagcctctgtctcctccactaaagtggggacaaatgagtattacaaatgagaccattaaataagataatacattttaaaaattaacctggtacctgtcacaaagtacatgcctaacaaatgtttgcttctgtctcacttcctcaatttcatctcagtcaacctggactgactcaaaatggcattcttcttggctgccccctttgaagtatttctgctgagaaaatagtttctgtgtatttgtaaatttacaggttgaacatagatcattattcaagcattgctggtcgattcgtcttttcaaaggcgggagctgctggctgtgggaagggacccagcaggggtctcttgcaaccctgctctatgggtgggggaaatctggacctccctctggtggggttgattgaagtgaagggtcaccatatgtctttcccaagagggtgactgacttcctgctttggtcccagtttccctgagattttcctgaaagcccttccggctagcccagttgggagtgttagtacatcagatcccatgctttggtgaaaaatgtaaacacagacctgatttttcattttaaatgaagccaagcatattgctcccagcagatgccgagtgactcaatctgtcctctcggttctgaagggaactgaagaacaacatggtaaaataaagcaaacagcacatttattggttgataaaatgctgttttagtctaccctggcattatatggtgattgctatgtggcgaacatctgttattaaatccagacttctgttgcctggatacattgagtcaaaagctggagcggatgagaaatccatttatgcgtctgttgcgtgtgaatgtcagagctcatatgatgcctttgtcttcattctaactgaatcttttaatatggaccgtctcacttgttaattctgactcaggggcaataatgttttcatttgattaaaaaaggttaaagaaacaaagaaacagtgttttctcaggtgctctaagtaattctgttaatgaattttcggagacagcgtgtgaatttgaaaagagtaggactttttaaagagttcatactatgaacccaataattcagatcctagggccttatcctaaggacataatagaaatgagcacatttataagaacaaagatgttcaatgaagtgttacttacaacagcaaaaaaacttgaaagtcacctaaatgtttgtaagtcaagagcttcattgatattgactgcaaagtccatgttattccatgtgacgaattttttaatcaatcacctcttgatggattttaaattttttacaattttttgctatcctaaaaaaaatgtgtcaatgaacaactttgaactaccctgactaccactttaggatagattgctagacgtggaattactaggacaaagcctatgttataatattcactcagtcaacaaacatgtcttgagtgcccactatgtggtaggcaggctttgctctaaacctcagaggccccgtggcagatgaaaggctctcaccttcacggagacaacagagtgagaaggggggaaagaaaactagaggaatctagtagacagtagcagatgctgaggagactgagaacagtggaaaggctacacacagggatctctgagtgccatggttcagagatcattgaatgaggtgagattcaaagagtctgagaaagtgcctgatagaagaggatggttggctctggagggacagaagtggagggtgggagtgggggaactggccttgcctgagtgtatccaaagagcaaatctttctcactgggctgactgacctcgagaacaggcctatggcccttgtgtttcttcactgccatcagaaagactgtgcacatgaggagatggaagggactctcaaaagagagaggggatcatcagggatgagatccgtggagaatcaccgcagagctggcagcgtttatctaagaatgtggcattgggaaaagtggtgcaggctacattccaggcgataaggaccaagcaatgaaataacaaataagtcatcttaaagttaaaggagatggacaatagacaaacaaatatgtttcaaaacatgataaatgctatggaagaaataaagagggttggagagagggttctacttagatagcctgatcagggagaatctctctgaaaagaggatgttttggctaacatatgaatataacatatgaatattgggaaagagacagtcatgaagagagattgggagcgtaagattccaggcagaaggaatagcaagagggagggccctgaggtgggaacaatcttgatatgcttgagggacagaaagaaagccatgactggagcatagggagttatctggaaaatggcaggagtaagtgtatcagtcagcaattgtcactgtaatgctgtgtaacaaaccatccaaacctcaatggcatagtagaggtagctgagtcaggactagaacccaggcatgattctcttcaaatttttctctttccatccatattcactaccttcctatgtacaatccactttctcttaaagtcacagcagcctcagaatgtattacatacataagaactagtcctacatctagatgtaatggctttcaaacctttatgagcataggaaacacctgttgagctggtttagaatatagcatttagggccttgcctccagatagtctgatttcacagaaacctgcattttaaaaaaatcaccccaaatagttatgatgaaggtgatctatgtacgacacttagagaatcagtgatggaaaattcaccaagaacagccacaggcaggccagaagaatggccctgcccctctacttttaggattaagcagaagctggccctagatctcaccagttaccagtgatcttgggcatttttagcatcatgtgcattgcttcactgtgataccatcttgctggcacagccatggaaagccatgagttaatgcatctccccatgtaacaaacctcccctaggactctggtccacacctatctctgctagattctctggcattgcaagaaattcttcagactgccccaagagattcgttccaatctaggggctccttatccccagctcagagctggatttggctcttgcttggaggcgggaagccctgctgggccagggcttagaggggctcacaagaaatcaaagcaagcattctccgcctctctcctacagccctgcatgcatcttctctgatcccttgcctgagtggggggtggcattccaaaagctcattactggcttacatactttgccttaaatcagctcttaaatgccctgggatgaacagccctaaataggaaagaaaaaaaaaaaacaagtttcttgcaagttcacagatatgcttggtgctttctgtcaggctagggtgtagccttctctgttctaaatttgattttctgagtctttaaggaaaaatggctactggtcccctggacgctgattgcttcagcatctgaatctgctccatcacttctacctccacccactggtccacgtccagtgggtagaggtaaaggggatggagatatcatttatcttcaaaggataaaactgctctgagagatctttgctttcttagaaacactgctggaaagttgtttctttagactacattaacagaagtaccatctctaggaagacaaggtggtaataactaacatcaaatgagcagttcctatgtaccctgtacatgtcttagccaacttcatccttgtaacaaacctggaaggcaggcactgttatcactcttattcccaggtgaaccagttgaggttccaagaagtcttttgtgcaaggtcatgcagagttgaggcccccaagtcggtagacttcaggagccagaccctcaaccccctcactgcctcccgcctcatgctgcactgagcagaccatacccggatggtcatgttcaggttggctatcaatgcagaccacgctgggcatattcaggggacggatactcagaactatataacataaggaatagaggaaggactggaggatgtattaacatgaagaaaaggtagactcatggcaggagatgagcagggtaaagaggtgcaagacataaaaagccaatttcatatacatgaagatttatcaagagccagaaggccctctatgggtccaagagttacaaggcctaatgaggtgaattaatgccagcatataaggaaaagcttttgaatactcagaagtgtccaaaaaggggtcaggctgccttggaaagtagtaagctctccatcagaggcttggcaacttcttattagggatggtatgagtatctcaagtacagatacagatgacccaaataaccactgaggcacttctgaccccaagtataagagattctattgtaacgcacaggagtccatctcaagcagcacactgagccatctccttgataaacctaaaggtaggtattattcctcccagatgctgtcttcttagcctgggatgcaaaagccataggatcacttcacgtccaacccccatcaggtgatctgtcatgaatcacaagttattggagccagatggaactacagagctaaaagatacatgaagacaccgaggcctgcagacagggactaactttccaaggtcacagagctaacaagtgtcagagtcaggctagacccaggactcacaagttgagctcacaattagttccacttcctacaccacctggatcatgagtgtcaagaatgaaggacctttggcagtcttctcatccagcagtgacaaacaggatgcacttcatgtgccagcttttaattcattggtcatggtttcctgaagtgctgttgtccagaaatattctgaggccatatctggatccagtggacatgagtgaatcatttatgatgtctgctttggacacaggtggggaagtgacaacctgtgtaccaagggtttggcagccttgagctaatccatcttaatgactttctgcacatgctgcctggaagtgatattaatattgcaaaagagattataatgtgtgataacgttgtagtacctcacttattaaaataattcaaggatccatctttgatggttaaacccactgtctatgtctgtttgtgttcctacaaaggagaacccaaggctgagtaatttgtaaagaagaggtttatttggctcacagttctacagactgtcaagaagcatggatccagtgtctgcatctggtgtggacctcaggctgcttccattcatggcagaaagtgaagaggagctggatgtgcagagatcacatggcaagaaaggaagcaagggagagggggagatgccaggctcttttaaacaaccagctcttgggggaactctcttaggactaatagagtgagaactcacttcttacctggacaatggcaccaaaccatttatggagaatccacccctgtgacccaaacacctcccatgaggccccacccccaacactgaggatcaaatttcaacagatgagatgaggaggatcaaatatccaaactatagcacccacctaacgaatgcaaaagatgtgcagtgaccttaagccccaacaatatagagcagatgacagttgatatgtagatagtttgaatgacagtttaaggtagcaggttggcaggtggctccaccatatacttgttgagtagtcctgagcaggtgtttctctgagatcctttggctggtctgtaaaatgagagataatgactctctcacaaggttgccatgagaaatagagaaaataccaagtactcagcatagcctaacatttagcagttgctcaataaatgataggaagtattggctttataatattgcatctacccccttctctctatgttagaacctttccaggcatttaaaaggtgagcagcaaaggccacccataaatgtgctgctagagagcacataggtcaccaatctcagactattggtctgaggcagatttttggagtctcttattcccgaagagatccagggacctgctttgcaggtgactgagaagaccaaggccaggagggaaggccaaaaagctccaagcagatcacttatctgtataacacttttcaccttccagtccttcttcatggagtttcccaaagtacacacccacagtcctacaaattggggaagagccagaggcaataaatgtgtgggagcagtcagctgagaactggatgttgaaggattgtacattttcttgaattacatgggagcaaactgcctcctgagcctgctgtacccaaatttatcaaagcacaaagcatttttaaagaccatttaataaactgattaaatgtatttgacaacggagctagaaagccagtcaattcatgtcttcatcactcctgagaagttgcctacacgataaaaatggaagttctctgaatctgtgggtgggagggctttcactctcctaatggaggagggaaaaccagggcatgctgggaggccgtcccagcccatcttcctgacatcgctgcttttcctgtactgtgctaagtgcagagaaggtccagcgccctgcctgtttttcacttgcattcttgtctccagactttctttctctccccacccttctcatgaccactagcatctaagtttatcgcttcctctctgttacctctgtatcctccaagtacatgatatacctctacagctcatctgccaatgctgcaaagtttacttatttataaccttcccagtgccttgtgtatattagatgcaggagtaagatgttgtgatcgagatcgtggtggtgatgatgatgatggggagggagaggaagaggagggggagaagattaggcaagaatgtaaaagccctcatgggtcttggaaatcacagcatctaagttctctccttcctctcccctccttcccctggtttagagatgctttagctagcctaagggcagaatagcctgcctcttcatttgttcttcaaaatccattgtttggggcacaaaatgatcttcagagtttaggctcttgaggctcaataaacttaaaatcttttctcagctttcctgttagatcacccacccccgaggcaatgaatgctgctgagctgatggaaaaagggcggtgagaaactccagaaatattttccggcagtgtttcttctttatctctgtcccccagtagctcagtgaggtaaagataatcatcagtttttaattttttatgttattattgtggctgcataacagttgtacatatttatggggttcatgtgatactttgataccagcatgtaatgtgtaatgatcacatcaggtcgttattttaacactgaggatatggatgctcagaatggacattggcctcactgaggtaatgcaggggtaaatggaggcactggatggggctggaacccccatctgtctgactcaactacctgaagatggaatatgggttgtgctaactaaattaatgagtagaggctgcctgaggcgctgccttgagaacagttctgaggctgcatctgaacttggtgagaaaagaagtgctgtgatctattagtaatgtctgccatgggcactggacctgggagcagccacgggagccatgccatgatccccagactccgtgcttcttagaaattctgattgttgtttgttcaatagataaatgaatgcagaaactgcttccttaatgtaggcttagagaaggggattggagtaggaagcaagagaggcagctcctgggcctgttcatggtgtgtcgggaggccaggctggacagtaagagataagaacggcaggggagattgagaccagaacttggaaaagcttacaatgccaaactaggaagcctgagggtcgtgaaaggtttgggctcagaggaataagtaagaaaagctgcatttaacaccaggaatctggcagggacacgtagagtcaaggagacagaaagaccagcttggagagtggttgagtctgcacgaggcgtggaggggtgcccagcccccggcagaggcaggtcacagtgacaaggacagaaagcctggagggacaactccggggacttagtggctggcagaggggactcttttccccagtgactcatatgctcctttttttctagctgaatttcagttttattttcagctccaatcagtggcaatagaggaatccgtgtgctttatttctcctgctccacattcctccccacagtctcccagaggctaacattctcccatcctccaaagagaagaaatccacagcccagagcagagcaggcctggtggcttcatgacagtcatcagtgtggccccatctactagtgctctccaagtccagcaatgtgttaaccctttacaggcattatcccatgtaacccctaacagccctaggaagtagacactactagtacctataattcacaggtaagaaaactgaggttcagaaaggcaaagtaactggttgagggtcacacagctaagaagtcgcaaagccagagtcgaaaatattcaaaaccaaaaagaaaaaaaagaaaaaaaaatctgagttgaaagcttgctctcttaacgatatagctctggcccaattaagctataaaatgtcacaggtagcagtgtccttagagaacacctaagctgagaactccctcatttttcagagggggggatctgagggtcagtgaggagatctgttttgtccagggtcatcagtgagttaggggatgagccgggacttgaaccctacagtggaagaaatgtgagccacagaacttaccatgttgcttgttgacttcctctggcacattccactgtattttccccgaagcctctccccagcctctcagccccactcctcgtggctccactccctattactcagaggtgttcagctccacccactagtctcccagcatggcagtttctgcccattacaggcctacaatacctgcgagcctgtcagccccctgcctcccacctctcaccccccgccccggaaatggttctgttgttaccggaccaatcagggcacccagcagcgtctagaacttggggctgataatggcatcgtgaatagaggaaattagagctgaatgcattcacagtgaatattcctcccagggcagacggggccattcgctgagtggcacatgacagatgttcacatggaacccagtcgcagggccaccttcactcctttcaccagcacggctgtctcccagccctggccgtgctttagagcactctgcatccccaaccctggccctccaagccctgcaggagccagtggttctgcatgtctcctctagtacctctcaagcacatggccttggccctgaagagcgtagtggttgatcgcacagcctttggggttagatgtatctgcttccaagtcccaaccttctgcctcactgctgggcaggccgggcaacatgcctgaatctcagtgcccccatctgtaaaatggggataattaatacccaccccacagtggtcatgtgaattcaatgtgattatgagtgtaaagagtttgtccccatgcctggtatacagcaggtgttcaataaacgatggctattatgatcatcgattgctctctgtcacctgtgtatcctccaaatgcatgactggcctctgcaattcatctgcctcaaagtttacttctttgtaaccttcccagtaccttgcatatattaggtgcaggattaaggtgttgtgattgagatgatggtgacgatgatgatgaagatgctgatggggatgcagaggagggggagaagattaggcaagaatgtaaaagccctcatgggtcttagaaatcacaagagggcaatttgttgcagcagaaattgaattacctttggagttatacagatgtgctgaaatttactgtcagcaacaggaaactcacacaccctgccgggtccatgccacattgttctgtgtggctggggaaagttacctcatctctctgagtctgggtctcagtccctcatcttctccagggctgttgttaggagtgaatgaagccatgctcacaaagtgcttagcacagtacttggcctagtgggtgttcgattcacagtggatattgctgttgctactcttgtcagtatatttctgatctccccaacttacagatcaccactccccttgagagcagagttgtacacttcattgtgtgtgcttctggagggcagggatggaacatccattcatttagtcaacaactgtggattgagcagtgtctctatgcctgccactgtgctcagctctgaccacacagcagtgaacagaatagatgagctctctctgtcctcatggagctcacagcccagtggggaagacagatatataggcaacaagtttttaattgcaagtaaaggtgccagccccaaaaaacaccaagtcacaggatacagaacaatgtgggatggaccgggcagggtgtatgagtttcctgttgctgctgtaacaaattatcacaaattcagtggcttaaaactaataaaaatgggccgggtgcagtggctcatgcctgtaatcccagcactttgagaggccaaggtaggcagatcacctgaggtcaggagttcaagactagcctggccaacatggtgaaaccctgtctctacaaaaatagaaaaattagccgggtgtgactgcaggcacctatagtcctagctactccaagaggctgaggtgggagaatggcttcaaaccatgaggtggaggttgcagtgagccgagattgtgccattgcactccagcctgggcaacagagcgagactctgtctcaaaaaaaaaaaaaaaaaaaaaaaaagctaatataaatgtattatcttgcagttctggaggtcagaagtccaaaatgagtcttatgggactcaaatcaaggtgttgtagtgctgtgttccttccgggggctccaggggaaagtgtttccttgcctgttacagcttctggaggccactcacattccttgtctcacggccccttcctccatgtcctaagcacatccctccaatctctgcttctgtcatcacatggccttcctctgaccctgagcctctgcctccttctgagaaagacccttgtgattacatcaggttcacctggataattcaggataatctcttcatctcaaaatccttaagttgatcacatctgcaaaatctctcttaccatgtaaggtaacatattcacagcttctggggattaggacatgcatccctagggaaccatgattcaacctagcatgggggaacccactacaggcaggtgttgtccttgccatcgccagctcagtgcttggcacagtagaggccatggatattcattcagagagagcatgcactgaggcaagcctgacctcaagatcaagacaggaaattggctttcatgggttaaggacctgttactttgctcatcaatgtatccttaatcatcagaggtcagatctgctggagagtgcaatctttcagtttccaaaagtaagactggatgccttagaacttaaagtcagggaggtacccaagaaagcaatcatagactgagtccccatgcagtgcactttctcggatggacaatttctctgttctgacagtcactgttgactccatttctcagatgagggaccgaggcacagagaggtgcagtcagtcacctgaggccacacagtcaggaagtggaaatccatggaaactcatcatcagctgcctcgcatcagggccagtgctctttatctccaccccacacattataaagccactcagctttacactcaagggaacttcctatttccctactggattatatgtataatttgtagtattgcaagatttgaacagaagcgagcagcagcttgtagttgtgtgtgtcactcactcctgcctgtggggatgccacgtgattgtttaaagggttggaatcaggagaaaggcaggctcagagcaggaccaagagagagcccacccctcgcctccccaaatccttcagcttcctgaagtgtggctgctgggtagcagctcccccagggaagaaaatataagatattcccaagggaccctggaagctttatcccaaggcttcacatgtgtaggctgtttcctgtgattcggtctggctgtcaatgatctaagattgagagccaaggtcagtgaggggggaaaagggacatgtagtgcaggggttcagcatccaggcctaggacttagactgaggctctttaccctcctctgtttcttgctgatggccttaggcaagtcgcttcccctctctgaccctcagtttttccctctgatgaaatgggtgtaataattgtgcctacctcttcagggttgctgtgggataaaatgagctcatacttacttcttttttttttttttttttttgagacagagtctcgctctgtagcccaggctggagtgcagtggcgcgatctcggctcactgcaagctccacctcctgggttcacaccattctcctgcctcagcctcccaagtagctgggactacaggtgctgccaccatacctggctaactttttttgtatttttagtagagacggggtttcaccatgttagccagtatggtctcgatctcctgacctcttgatccacccgcctcggcctcccaaagtgctgggattacaggcgtgaggcaccgcacccagccagcgagctcatactttcatgttagcattagcatagttcctgacaataagaaccaaatacgtggtatctgctattttctgttttaattaggtattcagagtctatgttaaattaattaacatatatacttatggaacacctactcagtgccaggtattgttgtagatgccaggagtacagcagggaataaaacaacatccctgtcctcgacacaaacacacaagtaaatagagaaggtcagagataaatgctgtgcaggaaaacaaagcaaagtgagggatggagagtgcggaaggttggggcacttttgtttcagatgagtgtcagggaagcccccttggaggaggcactgtaagggcacagactcgaatgaaaggagtatgtgaaggtgcttaaattgtttctgtttggtttggtgtggtgtgatgtggtgtggtgtggtgtggtgtggtgtggtgtggtgtggtgtggtgtggtgtggtgtgatgtgatgtggtgtgcggtgcggtgcggtgcggtgtggtgtggtatgggttgaggctggccttaggagcctgttggccttccaggccagtcctgaagcccagcccagagcaccagactctgcagtcagtcagtggagggcccacatctcagccaatgcatggctttgggtggtgacttcatctcccctagtgttcctttccccctctgcaaaatgggaatggggatggctcagaactcccagcgggagttaggaggaataatgtataggaagtatgagcagagtgcctggcctggagcatagcgcatggccgatcataggtaagtgctggtgttgattttattggacacaagtttggaaactcagagcctgcagggatggccttgaaggtaaagaagaggtagttgggagttttacacttcccaggacctaccctcagagagacaggggtcattccagagtatctggatacccagtttgggccaaagatacttccagccagggcactcgtcaaccaccttgatatttgcccaacacagctcctctgaggagagcttgaggtctgggggccccatgctgctgattaaactgatggctgggaggcaggtaaagcaagagtggagaagtgagtctggaggtggaaatgagatctccaaggaggggatggctgactgaggctgacacgtttctatccaaccggtagaggatttgcagttggactctgctttatggcttggtgatggtcagtgttggggcaggcactaggtcagagggtgatgggaggggtgagggaggttccagtctcacgctaggctgcctgcaccttcagcctcagctacctcaccacctaactggggaggattaactataactctgaccattcctgggactgtctccatttcaaacaatcagatcccctgccagactgtattagtcagagcagtgcaaatgctgtaacaaacagccccaagtgtctgtggctgaaaccatgacagtttacttctcgttgccatggcagccagtgcagctcagagtggatgggcatgtctgcatctgcatgcatgcaggctccttccatcctgaagctccccatcctcgcccttacactgctggctgggaaagggagcctggaggaagcctcaggtttgtatggggcaggcctggaagtgaggtgcaccacctccactcctatcccctgggccagaacttgggcatctgaccacacagacttcccttggaaggagaagagaacaaggacactgtgcacctttgtcaagccaaccaccatgcccatggagcatctactatgtgcagagatgtcagctcctccagacaatgttctctgtcattttccatctgttcaagctgagtcagaggtgtgtacatgtgcaaatgcgaacaatccaggctcacttcctgcttccctgagtcctaggctaacctctagcacagcacagatcacaagagtgatgactgcctgaccgtgtgtccttcctcccagtagagtttgagccacatggaggcaggggccacagcctgtattctcaggacttggacagcggtggaagctctacttagcttgctgaagaggaaaggggaaagaaaggagagtgaattggcacttgtcgagatctcccagttcgttttttaaaaattgtggtaaaatatatgtaacagaaaatttaccatcttaaccattttggagtgcgcagttcagtaccaccaagtaccttcacgttgttggacaaacttcaccaccatctgtctctagaatgttcttcatcttgcaaaaccaaaactctgtacccattaaacgactccccattccctcttcccccagctcctagcaactaccattctattttctatctctacaaatttgactactctaggtacctcgtataattggaatcaacagtatttgtaccctggcttatttcatttagcataatgtcctcagactttattcatgttgttgcatgtgtcagaatttccttcctttgtaaagctgaataatttttcattataagtatataccacactttgtttatccattcacttgtcgatggaaatttgggttgcatccacctttttttgctattgtgcataatgctgctatacacatggctgtgcaaatatctaatattagtccctgctttcagttcttttggatatgtatccagaagcagaattcttggatcatatggtaatcctatttttaattcttttaggaactgccatattgttttccacagcagctgcagcattttacattcctaccagcagtgcacaagagttccaatttctccatatcctcaccaacacttgttattttctgttgctgctgtttgtttttttattaatagtcatcctaatgggtgtgaagttgtttctcattgtggtttgctttgcaggttttgatttgtagattttcctgatgattagtgatgggtgcatcttttcatgttcttactgaccttttatatatctttcttggagaaatgtctgttaactctactcatacttttgtaaatagtattcccaatccttctaactccccaatgaggtggatattagtatgttcgtgttacagtaaagccaactaaaccttagaaagactaggttaattatccaaggtcacacagctagaaaatgacacagcttgtattgaaacatcagtttttctctttccaaacctaacgcacatttcatgaaacctacattattgcaccataacatcatgttgatttacttatctgctctcctgcctgtcccatctactacataaattgagtgtggtttgaaatcagagactacttctcatctttggcacagtggcagccatggatcagaatctcttacatgctggataagtggatgcaagctcaaggccacacctaaagtccccaggtgacttgatcacttgagttagctgctggaaacctgggcttcctcttctgcaaaatggggagagaaaataaattctcagtggattgtttagaagatttgagcaaagacctctgcaaagtgctaagcatgtggctagcatgtggcaggtgctgcctaaatagtagaaattaacactgccatgcttataagctccggacaaacacaagaagcccgaaacataatctgtgccttctgcttgcattcctcctagttggggatgtaaaatagcccagctacaatcaaagaagaaaatcaaagtcagcacagactatggatatgcttctatatgtgtagattatttccagactcattcggaagaatctggacatactggttgcctcagaggtcaagaaaattggctcatttacttctgtaacttaatttcgactctctatgcttttacatagttggaatttgccatgcacatatactacatttaaaagagcgtgtacgcgagaataatgtggtcaggtggcctgatccacaggtgggtgggagagacaacagagacagtcttctgaccccatctggcttctacctgccaaccccatgtattctggagactctccacacctcctggcatgaagcagaatccctctcagggggtcacctcacctccttccagaaatgtttaacagaaagaacctaccattggctttctccatccccagcacctaatagagatatcacggagaggggagcatttgtaatttactttggaggggtgtgtggaggccgagtaacaccgccttccatctcagtgacaacaaactcattcttcactataattaaaatgtcactttgataaataattccatcagcccccttccacctatgaatagcttcttgctataattgttcacattctgctgaattagaagtattcaagggagaatttaagaggtatttaggcaacaaagataaatcgggtgtgttttccaccctcccacaatccctcattaagcgagacatcatccccggctgggcagggcggggctggggggcctcatccctgtgttctcagtcactctctccctgagtggagggagccggaggggttgccacagcagcgtggacctcaggaaggggctggagtttggggatacatgtttgggggccttcccttcccagctattactgtagaaaaagaagaggatgcctgaggtggtgggaagaacgtaggctctagcttcaggtgagcttggaaaagtcagtgaacatttatggacctctgttgtataacagaatacaagatataattcttcattcaatcttgtgtcaagagcttgagtcaagatataattcttggaagagacatctgacattgagggtcccccctcccatgttatgggactcaagtcttccaaaggatgactttccctaggagacacagctagagattggcaaccccaggacctttgaatattcaacaatacccagtagggtatgaagcaccgtaggagttccgtgactattcccatcttccctcatttttgttggtacctcttccttcctgataaatcacatctgctgggaataatccaataataggatgcacagagccagccacagtgtgttggacacctcaggaagtgtcccatcttgggtatgtctgtcctcaccttgggtagaaagagatggtatttgactctttccccaccagaagaggggtatggccatgtggttacaagagcagcacttcatagtatgaaagccagggttccaagacaactactcccagtgtggggctggcatgttagtgactctaactacagtttctttttttttattattgtttgagacagagtctcgctctgccacccaggctggagtgcagtggcacagtctcggctcactgcaacatccgcctcccaggttcaagcaattctcctgcctcagcctcctgagtagctgggattacagctgcccaccaccacacccaactagtttttgtatttttagtagagatgggttttcaccatgttggccaggctgctcttgatctcctgacctcaggtgatccaccccactctgcctcccaaagtgctgggattacaggcatgagccactgcacccagcctaactacagtttctttatctgtaaattggaaataacaatagtcccactgatgagttatggaaagtagggccttccacggtgtctgcatgtggcaaacattacccatagctcctgttgggtttctcgtgaggagtgtaacagtttggccatgcagttttaaatgccacatgagcggctaggtgggagggagtaccgggccaatccaactcagtcaacacaggtcccccacaccatttcctctgtggcaggtataagagtcaaggcccacttcaaggccaccaaagtccaagcatctccccagtcctagcttccccagagagtcctgaatgacaggtattcattggttgtgatggggcttgtctggggttggggactgggggtgaggagtggggtggggtttaaaaatggagggcagcggtaccagtgaaggggaagcagtgataaaacccatttgagtttctgctctgaagcagagtccattaggatgacggctccttggaccagggagctgcgtctgaggggctgtgcccagttccatcagtggtgggattgggagtggtccatgaaaataactcacatgcatgtgtggctggctgaagaagcagagaagcctgcatgggcagccaatccccatgctgagcgctttgcttggaatggctctgataaagaagcccatgatgctggaaggaagggctccctgcaggaccctctgggatgattccctgcccatctccaggaccaccctccagaatatggtctaggatggccttgagtgcgtaggtttcagaatgtgggaagaaggggcaaggagaaaaaaacaagcacctattgatcacctgtgttagctcattcaatctttctaacatctctgcaggttaaatattctatcccattttacagagggcaagctaaaactgagagatctaagatgattttgccaaggttacactgctagcaaatggttagatttgaacccaagactctaactccaaagagccaagctctttacagtggatcagtccatcatctctttacattttacaagtttgtgtcatggttttagacaatatgtttgacatgcaagacgctctgctaaccttaatgaaggtgtgcatgtgagatgcatgtgggagtcagtgtctcgggtggtgagcttcatccagactcatttcaaactagcttgcacagcagagcttccagcaatgcaaatgccaggttactcgaggctccctctaagatgcagggactcaaaaagttgtttctgaagctccagggcctttataacggggcttcgaaagcagcagaaagaaacagcacacaaagtgtttgtttattctcttgtattcaagaaagagccaataattcaaacaactaattctagaagaatagaattcccccagtccccaccttaatacaggcaggctcacctgtccattggtaagtcagcacatttctctgtgaacactgatgccctgtgcccatcacacccatagtatcaactgtcaggacagctgccagatgaaagtgctgtcatcatgggcagctgcctcttggaccaggagctaagggagaaactccttccttagagacccacgccagactgcagtgttgtttgagagacctgagtctctcagggatgtgttctggagatctgcgagcaggactgtatccatgaatcaggactctgtcttaagccacagtagggaagaggaatggcacaatagaggaaacaccaccccacgtagcatggagccatggagagagcatgagtttagaagccaggagcgccagctctgccagctactggccaaaccactgggggccagtgcctcggccatctgtgaacagacactgctggataatgatctcaaagctctcatcctgtctaacaccatccagtttgagacctgcttaatcagtggggttctgggaggccagagctggagctatgatcagggctaaaatgcatacagaaagcacagatgctagaagccaaatggaggttgtccagggggtccccaaccatgggactggaagcagatgtcaaaatcaaggatcagagcttctgggaagcagacacagcaagggaacatgagtagtgtgagctcacgctgagtgagcactggctgtgcaccagtattgaataggtattaactcccttcagctgcacaattatgctgtaggtgagttttaccttgggaaaccaaggcacagaatttaagtaacatattgaagctcatgcagctgctaacagggaaggccagggtctgaacccagctgatccggctccagcatccgagctctgaaccactggtctatcctgcctctgttaggacttggtccaatgtcatcatcctagaaggaacatttaggcccgcacggtgggtggctggttcaatccagtttaaaggccaggagcaggacagtgacttgcagctgcagcaatcctatgactcaaaccaaagcagctgtgacaaataaagggactgactctcattctcccgtgctagggaaggatgagctatcaggccttgttgcaggctgagtcagtcatcccacaaaccacctaagtgaaacctcttcactgagccttatttcctgagcgctctccctttatctgtgcttgcaaagaggcgtctccctccatgccagccaacccacccacccccgcacacacataccacctctggctggaactgacgaccatgggttttagaaatgagataaatctgggagatgaatgtattcatgagcccataaaggggtcatgaatcactggccccaattactgccttcaatcctgacaggatgaattccctcaagcagattctccttgtcagacaacacgggaggcagtgtcatggctgatctagagccacagataacatcattattccataccaggctggtttcggtttcccaagccacctccacttgatttacagctcacttctgatgctggagagagagataaatatatatatatatatatatatatatatatatatatatatatatatgaaagaaagaaagaaaagagagagagagaaagacacaaaggggaagctttcatgccaagtggaaacaagacaaaataaatgcaccgaatccgatttcaaaagctgtttgaaaactctgtccggaattgctggaaagggccccagcatccacaggaaatgtatccctgccaagccctgtgctactgaactctgtggcccccactcctgcctcccggtgacttgtttagaactacttcagatcggaacaaatcacagccaactgcagtcgctgtctctagcccttcaatcactcctaatcagaccgtgtattttagcaacagaatcttccctggctgaggagctcattcatctgccttccaccagctcgacaccctttgaatgggagatgaggggaagccacctgcttctctggcagccaagggaagctgggaggaggcaggaattgccagccctccctctctgatagatcaccagtgggagtccagaccagcaggaaccaggaaaggaggtggcaggtcagagagaaggcactgaaaagggtcatctgagtccatgtttggtgaatgcccaccttgagctggacacctggctgtggtccctggagttggatagcctgggttcaaattctttaactaccattttctggccaacccattctctgtgtgccccggacaaggtacctaccctgtgagtatagaagcaaacccccagaaaaaagcaagtggaaaaagcaaagaaccaggacatgggtggactcgagtcctagagaggctcaggaaacttttatccaaagacacagaggagctggttgcagaggagagcttaaactcacacagagaggggaggcctgggaggtgtcaacaagttatcttctcacttcagaagggccctctcgagaacagggatttcccctgctctgcaagggaccagtggacagaagtcagcagaggccatgtaggggcaggagcttcctgtcatcatagatgccaaagctgaagcaggatactgaatgcaaacaggccctgaggccatctgatgtgctcgttcccatagccccgctgtgtgtgtgtgcgcgtgtgtgtgtgtgtgtgtgtgtgtgtgtgtgtgtgtgtttggtggggtgggaggggaggcagaagaggaagagagggcagagagccaaagactgaggccccggcccataagtaaggcagtttgcagatctcaatatcctgtgcagacccacaggctgccgtggggttgagggctgctggtgtcttaaccagaggcagagactggaaggagcaccagatagaactgactcactcctccttcctctaccacatttcttctctgaaaatttgccattaatcacaggtgacgatggaatcagcaattaacatgagctaaaacaaactactaggcatacagtagcgctcaataagtgctagctattatgattacaatggagggaaaagttgtcaccgcagcacaccgtgcatccctttttggtctggggcctctcatccagacacaggtaagaagactcctcactccccgaggaatcgcgtgcaatgtcatgatggcatctgatttagttttcccacatctcaaatgagatcagggcaactagtcttactcaacccttcagacttacataccctgtgtatcaaggaatgagtctcccatcattggagacaatcaagtagagcctttctggtggaggagaaggaagtagacaagtggagctcagaggtgccctcccaccccgagattccatgatgctcaggactgtggaatgagcacgggagtgtgatggacctaggggtggggaagagcgagaagttcccgtgcaatggacctaggggtggggaagagcgagaagtcagaacactggcagaagaggaagaaaccagacaacctggaagccaagcagatgagtttcacctgcatatcctctcctcttcccccttcctccagcgttgacttatgggaggtatttcagtgaggacaaaagaggacttagtcaaacaagcacttattgaaagaaaatatattctacacagcacttccgtccttttaaagtgattcactccctttccactgcctattctgtttaggagaaaagtggagcttcttagcttggtgcccaaggtcctcatcaatcctaagatgacatttattgagagcacatgatgtgccaggcattgttacaggcaccagctcattcaagccatataaagacaaccctgtggtgtaggttctctcagggtcaccccttcagatgaagaaactgaagcccagaaaggtcaattaacttgctcagggccacacagctagttagtagtagagctgggacctgaactcaggtaactggtccttacgctactgttcttaatcccgtacttaagtcgaccagccctgccctgccttggctccagcctcaccttaagtttctcaccacctggagtttttggccaatgccacacggaatgaccagcatttctctgaacacatcatgctgtatttagcgtccaggctttagcacagctgttccctgtgcctggaattctcttccttttttgtttttttctcacccaaaaccagcttgtcctttaagatccagcttaatgttctcctactcttgggagccttttttggtgcccccaaccccatcaggccacgtagcacctggtagcaccaggtagcaccccatcctctgtgtgcccacgcctacctcctctctacctcacccaccctggacagaccctcacaccacacttctcacattacattgaaactgatgactgccttgtcatcttctccctggagcatgtcattcatggctgtctcctaagggcctagcttggtccctgcattcagtaggcaggtactatttgcaggggcaggacagcaaatggttagagcttaagctctgcatccaaaagggcctggattcagatctccactcagccatgtgttagctgtgcgaccctgggcaagctagcccgctgctcctcacactccacggtcgctgtgaggtgtaatgagatcgcacatataaattgattagtgcagggtctggaatgcagcaagcagatggccaatgaatgtttggcaacactgcacttcagaatcgggctctacctagacagacttcatatcaaattccagctctcccacttaccagctgtgtgaccttgaacaagtcacttagcctctctgagtttaattcctcctctataaaatgggcttcatatttttaaaatggcaaagattctaaagattacaaacacaacacctgcgtcgcttccctctgtgtacagagcagcgttgttgcagtttgcgcgctaaggctgtagactgggctgcagtgccttttaaatacaccagctcctggtttggagctaatgggacacatgccggggacggctgggagtcacagcggtgtagaggagaatatggcttcaagaaaatgacatttggaagtaattatgggagcaatggatcggaaccacagtcagctgccagctatccccagagacatcacaggagaaggaggcagaagctggaacatcatccgggagctggactagaacgtcccgggaaacttcagcctggcttctgctttgtcccgaaaacccagggctccagctccagggctctgtcttagaatgaggcagtttatctgttcagggcttctcttagtttttaatcccaataggacacatgttgtattaaaaagccatgcgagacggaagaaggaaattgaatgaaatttgagggcaggtaggagcagagacaataaataattcagcagtgaaggaagcagaaaaaagattgcactcatttcgcccttcaacaattatactaaacacctgctctgggccacagaagggccagatcccattcctgtgctcaggaagcccacaggccggcagggagaggctggttggaatgtgtgctttgcactgtaacggaggcatcgagcatggtaagggactggcggtggctgctgcctgcggacgtcgagcaggggcctttgaagaggcaggacctgtctggagtcttacctgggccttggccctggcaatggggaatggagcaggcagcaggggacagatgctgccagaaaccgagatggtgccggaggactgggctgagtctgggtcaaatgacaccgccccaggctctctgccctctggggtgaggcaggaggctgcctctgtgtgtgattcagagaccctagaatcccagtggccatcaccccacagcacatgccaacctttctgtgataactttctcttgtggaactgtgaaagtgtaagaccagctcctgtatagtgcatggccatcctttgctttggggacagtaagtcagtcaacacatacttataaatggggtcctgggccgtggcactgatctggtcctcccaccttgcctcacactgcccttcccactcaccacttccctcctctgcatcttagccgcaagggactttcagaccaagcagacctggaatcaaatcccaccgctgggcctcaatgccagtggagacaggaacagctgatccctggagccctcaggaggaagaggacgggatgcctggcttggctgctggtctggggcaggtgcccagttacagcagttggaaaaatcctcagtgttggaaggaaatttggaagtgagcatctacctgcctgccgtgcagtttgtgacttttaagatggttgacagaacattcccaaaggaccacagcggtgaccactgttctcgtttccctttggtggctcactcactcagtgctggacacagtggtcctgacaagacagtgctgtggcttccatgaacctaggacagggatagactcaaggactaagaacaaaccaggaagaagcatcaccacaggctccttgccagtcacctcatctcaccctcctggccctggcggatgggtctccatatttacaggggccagatgaaaaaaccagaggagccaggaaaaggagcttccccttcccaagggcgcaaggtgaggtgccagtcatgagatgcaagccctgagctttctgattccactgcatgtggtcccaaggttcggcgccgcatcacacagttagtgagcacactctcctcccctggccccgagtgagccagctggatggcagatcagaaagagaagtcccgggtgcccccaacatggctagctccttccaggaccaggggctaggccccagctaaggctggtgcacacagcagggcagggggcgaaggagtgggatcccacccagggatcccacccaccccaaacctgctttcggacatctttccaatgcataatgtgcagatgaggccctttgataaggaccaaatccctttccgttgcttggcaacctggctcacaagtcatagcagggaagtaatttacaggaattcaaagtgtcgctggaggttctgctgagctgaattgctgcaaagaggaacctcaatggtccaaatcacacctctggcggggaggaggggctgaaggaaaagcttccacttccgtcacttgagagtacagagccctgagctcagactcagcgatcgttttccattaacggatttactggttccatgttgagctcctgctgtgtggcaggccctgtgctgggagccagggacacagtgacaaacgagacagatgccaaccccggatgcacagagctcaaagagacagaggagtaaacagggctacacatgtgacaagataggctgtgcacaggggtctgagcaggacccttggggcaggaggaggcagtggagggatgggagggtagggacgcagtggtgaccagctagccagatagagaacagagggtgtcccagcacagggccacacaagcaaaggcagaggtggggagagaagagcctgccacactctcagatcaccatgtggttgggccagggccccagctgaggctgaggacacatggagcccagatccggcagggccttgaatgccaagtcagaaagcatctgaaatttagtctacagatgatgtgggttattgacagccaggacagggaatgacatttgtgtttcaggaaaaccactgtcttcactgttagggggtagattcagggagaaacaggaggtggaggggaagaaactgtgagtaaaggagtctctggggtacaggtgaagtttctgtgaaactggagaagaaaactgttgaggcaagagttgacaaaacttgaagtaggatggagaggaagggacaagttcccctggcatggtgacggcccggtggtgggaaccagggaagaggaggggctttgcaggtgtctgacttgcccaacaggtggcgccatttaccaagatgggaagggccggggagaagggagggttccattctagggaaatctcaggtcctcgctattaggattctttcggttgccagtgactgaaacccagctgaaatggacttgggaacatactggttcatgacatctggtggaggtgaggtcagggtgcactggagccctggcagcccactctgatgccagagcccatggggacagcggtgtatgttggacacagtagtccttcaagggcggggatcggaggaacagaagaaaggaacagcagatgccccactgaggctgagcagaacatttaggatccttggccccatctcattgtgccctttgctgtggctcatctcacacttgcagggagaagccaatggatctctgtgaatggcgaggctttgtatgcataaatgtgggccattttgtccccaagaatccctgggggtgaggaagccacagaaaattgaggtcctattccctgctcactcctggtatgtagtggaagctggagagcctttgtccaggcactgacagcaggaggtttcatgcagagctgctcagggcatttcccagatctgtcccacccctgggaactggctcagtggccttgccccaccagaagactgggaactgcacccaagacaggttcagcccccccaggagaggacctgctggtgtgcgtgtccacacacagcacagaagcaaggaagatctggcaaacaaccttcaacaaaaaagaggccatttgcactggccacctgtgctgcttctttcctgagcagacttggttctgagccagggggtctccctctttccctcctccagctcaggaaaggactcaggcacatgtccacccaacctgcaggagagtgtggcacagcagtgaaaggcctgggcttcgcaggccaacttgggtttgatttttggctctgtgtcacaggcctcatgagatgtgctcacctcttagctccctcatttcagaatggggatgagaatctgccatgcccctgcccaccagccacctgcccaccctcccttatcatgtgccccgacctcccatgggtgctgctcatctgagtccctctgtcctcactatgacggctggtctgggaacccctctggccctactctgcttcaagaccatttagcctctgctcctgcttccttattttcttgctatttcccagctgcaatttctttgcaagacagggaaaggattggatatactcagcccatcttaatttttttactgtgggaaaatacacataacataaaatgtactattttaaccattttaaaggatgcaattcagtggcattaattacattcacaacggcatgcagccatcaccactatctggttccagaactttctcatcacctcagatggaagccccgtattcactaagaagccactccccattcccacctcccccaactcctggcaaccaccaatctgctttctgtttctgtggatttgcctattctggatatttcatttaaaggcatcgtgcaatatgtggccttttgtgcctggcttctttctctcagcaccatgttttagggtctatctacgttgtagcatgggtcagtacttcaaccctgttcttttttttttttttttttttttgagatggagtatccctctgttgctcaggctgaagtgcagtggcacgacctcagctccctgtaacctctgccccctgggttcaagtcattctcctgcctcagcctcccatgtagctgggattacaggcacgtaccaccacacctggctaagttttgtatttttagtagcgacggggttttgccatgttggccaggctggttttgaactcctgacctcaggtgatctgcccacctcggcctctcaaagtggtgggattacaggcgtgagccaccacgcctggccacttcatccctttttatggctgagtaacattccattgtgtggatataccacacggttttgtttattcatcagttgatgaacctttggattgtctcacattttgaccattgtgaatcatgctgctataaatattcatgtacaagtttttatttgaacacttgtctctaattctttggggtatatacccaggagtggaatcgttggctcatatggtaactctgtgtttaacttattgagaaactgcccaacagttttccataacagctgcaccattgtacgatccctcaagcaaggtgcaagggtatcagtttccccacatcctcatcaatgttcttgtttttatggtccttccagtgggtgtgaggctctttttactttttaatcaccaggcagagatctctcaaccaactataaaatgattaaatgactgatagcctttgtgatcaatcagactggctggagaacaggaagatgagaggagcctggagtccctgacccagaaggtggccatctcaaatgttttttccatcttccagggctgtggactgggcagtttgggacccgggaggggcaggccgtgagacctgtctagtgcacatgtgcgacctcatccgatcctcatagtaacacttactaaaattcttaaccattaccccaccagtctatgtccacacggccacgctcacagccgtccctgcagtgtcccaggcccactctcacttgttctttgcagaacctcatgatgaatgcagcatccactgtttccttcttctgctgctctggttcccctccaccgaagcactactttgtccaagaaactgctccttcccaccaggcagcgccctaggctggggccaaactagccagtatcaaccacaggcttctgtcccctggcctgagatcagattcttagctgcacagctgcccctgagagttcctttccccaggatgtgttctcaagcgggcaatgcctcaagcctcctgttgaggctagaggaaggaccacctcctgttcaccagcatgcacagactagacaggacggctccgtctgtcgcgcttctgttggtctctcatgcccaagggtgtggctctgggatcagcctgccctggttcggatctacttaattgtcactgtcactttcagctcgttatttagcctccagtgcttccattttctcaggggtgtagtgggatgatgaaaacaattcccgtttcgtagagtagtgatgaagagtaaatgagctaatcccagtaaaaagctttaactcctgagccacagtaagtgctcagtttatctaagcatcattatcaaacataaacaatcatttacagagtgatgaccaccgtatgctccaaacccagggctgggggcctttcctacttctacagtgacccttagaggtgagcagtctagcccccactttagggataatgtgacgaggtgctgagaggtcatgatctcccagcagtgagtgacagagcctgaggtgaaccccaaatctgtctgactctaaagttcatgctcattccaatcatggcaaagaaaatgcagtgtcttctcacgaagggttcatccctgcctcctcagtggctgtttcaaggagggccctttggtttgcccagatagactattcacactgaaagtgacaatggagaaactggccaggacactccaaggtcacagagaggtttgtggaggtgagatgagggtctcagccggcggggagggattccggagggcagcgatccctaaggtggagccttccagccacaggatgtgtgacgagaaagttttccctcttctcccctcacagcccgcaacaaaatctacatggcttgccaatattcttggagaatgaatttggggggctgtatttgtttcccatgactgctacaacaaattaccacaaactgagtgggtttaaaacaatagacatttattctctcactgccctgaaggctagaaggtccagatcaaggagtgaggacagaagaaggtaggcactagaacttgacccagaagcctgtgacacacacacaccccacatccttctccagccccccattatctgtctcctaggaacaaggacaccactacattcattccagaaaagaccccttttgtctgccagccatcctcagagccgaaaagcaaacctttgctgctgagagctgctgatagaagagcaggaagcacagttaaaggggaacaggctcccaactctggggcagcagatcttttgggcttcatgtcatagtattgtaaagacaattgccaaagtcagacaagatcagttgtgtgatcttggcaattcactttgtttctctgagcctcagtttactcacccataaaatggggagaaccacgtctacctgactgactcgtgatgaagatgaaattaacacaaagacaaggctgggcgcagtggctcacgccagtaatcccagcactttgggaggccgaggcatgtggatcatctgaggtcaggagtttgagaccagcctggccaacatggtaaaaccccgtctctactaaaaatacaaaaattggccaggtgtggtgatgggcaccagtaatcccagcgactcgggaggctgaggtaggagaatcgcttgaacccgggaggcagaggttgcagtgagctgagatgcactccagcctgggcgacagggtgaaactgtctcaaaaaaaaaaaaaaattaatgcaaagacaaaattagtgtgggaaaaccctttgctcagagaaatgatggccacaaagtcatattactccccccttactctgtaaaatctcctttgctagaggaagagttaaaagtccaagtgggaagcacagtcccgggcggaggcagggaaggctatcctggctctgagtcgggctctgtctacctggattttgtgcctccacgttccctttcatcactctccaacagggagatgtctgtctcccctcagtgtgatagtaatataatggggcctcctggtgctcctcagaatcacgtgctctgggcaggaaaaaggtgcaattctcctgcagaatgtacacagcaaagactggaaacgagaaaactgtcttccccagggtggcttcctaacaaatataatgagaaggcgcttcctctcttcctttcagtcacatggggaggtcaacagagagcaatgactgtcctgaggctatttatttattttttgcctgataataattataataatcacttgcatttattgagttgtctgtgtcaggcaccgggctaggcacttcactgcatgagttatcgcaagcaatctttccaaagggattaggaagcaggagttattttacagatgaggaaactcatgcatagagaggttgagtgtgacgctcatgttagcctaacatgaggatccaagagcttatccatttactcagactttttgattattttttgtgcaatttcacagacttttggtgatgcataaaatttttttagagtactagtttgggcctggcatggcagctcactcctgtaatctcagcactttgggaggctaaagcagcagaatcacttgaggccaggagttcaagaccagcctgggcaacatagcgagacctcactaaaaataaaacaaaaaataaaaataatacaaaaaattagccaagcatggtggcacactcctgtagtcccaactacttgggagactgaggcaggaagatgtcttaagcccagaaattcgaggttgcagtgagctataatcacaccactgcactccagcctggatgacagaacaagatcctgtctctaaaaacaaacaaacaaataaacaaatactactttgctcattcatttaagtcagtaaattgtgacaaatggaaaaatgcaagaaaaaaaaggaagctggacataaagctagaatggaaaatgcatgagctcttgctggggtgggtcctaatttggcttttagcttcctagcagcccttgcaaagaagaaaacaagatctgttaggtaaatctctatagcagtggttcccaagacatggtctcctgaccagcagtatcagcactacctgggaacctgttagattgtccctctccaccctcgaatctgggagtcaggcccaggcatctggtttaacgagccccctaggtgatgatgatacatgctgaggagtacgaaccacttatgttagaataaatacacaccagcttctaacattgatatcgcagagaaatttctgcatgacacagtgagctattatattgaccaaatccccattataaacaccatcatgtacttaataggcctttttcttaacttcctacttagcatacactcatgaaaccttctcaaggcacagcttaatgaaattagttccagaggcaccaagctatgtcacccagacacacagcatgatgggctggtttcatgctcatgcacacttctgagtagtgaaagcctggagaatatcccagcattgctgttagaagccaggactctggagccaggctgacccaaatttgaatcttaggtgcacctttcattaactgagtgaccttggccaattcccttaattccctccctctgcctcagtttcttcatgtataagaggaaaatgactattttatgtattccatggagttgctgtaaaaattcaatgggctaacagaccgtatgcttagtatggtgcttagtatgctaatgagtccttataaatgttcccacgattatgaactgctagagtgtgtttcctgtaggtaaacctccaagccatcaaacctatgtccatgtctcctgccaccatctgtcctggatgattattgttcagatgcatattccaaacttactgagtacctagtatgtgcggggttctttcacttatatcatttgcctttaaacagctctgcactgtagttattattacccattttctgcatcaggaaactgagttccccccaaaatgaactgacttttcaaaagtcacacaggtattaagtgccaaagccaggatttgattccaggccttctggcttgacagtggcactcaaattcatcaagtgtttcttgaggatcttgcagatattttctcatattgcaattctagtctctgattttttagccccagctgggcaggaaggaagcaggtgcatcagtttttagaactagagcaggacagatgcttagaatgtatctggttcaagcccctagtttatagctgtgagagtccaggctacaagagggacttggcttgccctggacccaaagagctaagcagaacaaatactcacatttggtgctgctcatttctctcccctgggccccacagcatcttcgaaaggtgaggtcaattcccatgaaaagtaccacactacgaagtgcagccaaggtccagaggggtatggcagagagcttagggttaattgattagagcaggaaaaggtcagaagatgtggaatcatccacatagcccttgcaaggaggtatcacatacatccactcagggtcgaagacacagacagcatgtgtctctctagccttccctctctcctggagtccatagccttggctgcctgccaggaacccggcacacccacctcccaacacctcccaagcccactccaccttcctcaaagggtaacctcttcctgacctaatcgttttcagaggaaagagcaggaactttggagtcaggcctggtttcctaatcatcatattggtcaaagcaagtcacacagccaagcccacaggcagtggggctgggaaggacagagagagaagggagaatcgctactgaatgacagtctaccacacctattgtgcaaagtgctggaagggaggatttgttcattcattctgttaatatatattaactgaacacgagccaggcactggcctaggtgctgaatatgcagcagtgaatgaaatagacagaagtacttttcctcctggagttcatgttcaagtgaataatggccccacacctcgattaatccacaagcacttaactgtctaccctgtcaggtttccatatgtgccagacacatcatgtccacaagagattctctgcaaccagcgagctcatggcccacggggaaaccagacagacagacacccaatgacaacattgaaggcttgcacgcacgaggggccagaaaacaccccacatggagtgggtcccactctaggccactctcccatcccttcccttttccaaatttcctccctagccacatgccttggtttccagggccagccagctgtgcaaaatgcctagcaagctctcagcaggcccctgctgggcacagcacagagaaattaagtgcaattagcgtaactaagccatcaccagtaagaggcacttgctctcctggcggctccctttcggagactaatggggatgactagagaggaggatccagagcctatggctgaaacctcatcaacagcttgggagagtgacagccagccagtcttctgcccgcaggctgaagaggcagtgcttcccagggtgagccagaggtcaggaatcagaaggcctccccagagctcgctcccattttcctgagtctaggaagatggagtaaattggtttaatggagtggagtcccgttgtcatggtggcaggaggagaacagacggatcgccctgctccagcctgacaatgtgaggctgggcttttagcaaatgtggccggctgtaattcagagaactcaatttgacccatgctgtatcttctttcagataatggccgtgtgtcctgcccttcccccaagtggggcaggctagaaacctctagtggactcctcaccccctcccaagacccagtcaatctatagggcccgctggttccttcccccaggtctctcctctctccctggattgtggcaatagcctcctgaaggttcctctgcgccccagggctaagtcctggtcccatccgctcttcacatacacacacccagcatagcacatttttctagaactcacacctgaacgtgcctctcctctgttgaagacatccccagaagctgatccctttgttcccaatgcccttccaccctgtctccacctggcatatgcctgtgtttccctgaaattccagcttaaatctctctccatgtttggccttctctgcctcttgctggattcctcatctcgcctcccaccggttttgcatggatccctgccactacctgtgtgtgtccatcgctccatccattgagcctgtgaggggaaagcctatttaattcattgtcacatcccttccctggagacagagtaaaatagctaataattagacaaaacattaattgagtgcttattttatgtcaagtgtgatttgaggactttatatgcactaatttatttagcttcccaaaactccattaataggtactattaatgccccctacttgaaagattaagcaacagaggcatgaaaataataaagtgatatgtccaaaactacacagctaataagtgagagagccaagatttgaacctgaaggagatgggagggagagaaatagttggggagaccacagggaaaggaggaagaagagaagggaagaaaaggaggcggggagggccgggagctggaaatgtacctttgtattttaagtcattgagatttgggggttgttactgtcacagatcctagcctgttcttactaataaaataaataactaaatttataaagaagtgtcagaaaaaaaggtcatattagaccacgaaggatgacaaagagcttcttaaaaagggaactcaaggcccaaacatgggtattgttgtgtcatgtgaatccttcacaggggccacttggtgtctgtgtggctggctctttgtggccctggagagggaacaagcatgaatgcatcagtggcttccagcctgaacagaataagttcaacaagagatggccccagctccggtgtctactggggaggtgatgaagtgaagtgttcaattcctgcatagccaccaacaagtccctggaaacacaattgttgaggatgtgtccctcggggaggcatggttcatctggctgtgtcacaaagcagatgggaacagctggcgaggaaggactgcctgtcctgggaattgccctaatcatcttcctaaatattgccgcagccaggaggaaagcctgattccctgcagatggggccattgacaggatgctactggtccgggttgggagaaaaggaatgctgtaaacacagtcagcccattcggcaggcagtggaagctgtctgaggcttcagggccccctcctcactaggggctataattcatgcagtttcttatctgccagatggccaggaggacacatgcattccagtggtgccatcttctaagtgttggcagcttgccagtgatctcaacttcattttcatcattgccttttgagactttttgttcttaatcaccccaaccaaccatgaaattttaataccagaaatatattctctgtttacatactttatgcaaaatctgttttttaaacgtaaaaaggggattttttcacacgtgcattcccacaagaaccaattctctcccccgttgagaatgcctgttgtacactaaaccttcagataaccattttctgcaatcagccctatcagatttggagggagagaagcaactcaccaggaaacaaatgctctttgcattgttttgtctcttcccagaagcctcccatccaccttcagctggagttgagctttctaacatcactgcattcctgcacatccacattaccatctttatgtatttgattcctccttgagggcaaggcctgtttctctgttgtttacaccccctctcagtgcgtgctgtaaggtaggagcttcacagatggttaaagcaaaacagaacatgggccgggtgcagtgactcactcctgttgtctcagcactttgggaggccaaggcgggtgaatcacctgaggtcaggagttcaaggccaacctggccaaatggcgaaaccccatctttactaaaaatacaaaaaatagctgggcgtggtggtaggcgcctgtaatcccagctactcgggaggctgaggcaggagaatcacttgaacccgggaggtggagtttgcagtgcgccaagatcgcgccactgcactccagcctgggcgacagagtgggattccatctcaaaaatcaaaaaacaaaaaaaggaaaaaacagaacatgaaagccactttcccacagcctgggcacgtagctactgtggtgaatcacctttcctggcagagcacactcaggaaccgtcagctccaaaagcaccaaacagtttcattaagaccgtggctccttcgcagaagcacacggaacgcagactgacaagcctgtgataacattttaatggcctgagttcagttcccaataaaatacttaagtttctgcaatcatggagctggcattttcattaatactcctgattaattgtctgtcctaggaaaaggctcatcaccgtcacaatcccgatcttgctagttccttgcagggagaatcccagcagcctgggcttttccaccaggttaaagctggcaaagggcaaggaagactccctggcacctggtaccctccacttgccatggtaacagaggattacaggctctaagcccagctgctgtccttgcattcagacctcaccactcatacactgggacctggaactacttaaattgcctcagtttctttatgtgtcaaatggcgtttgacacataaagcactaatactaatagtacttacataataaggttgttgtaaggattaattgagttggtacaagtaatgtcctggcacgcatctggcacatagtgagtgcttcctataataaacagtagctgggtttgttgttgttttactattatttttcctccagaaaggcgagagttgcatcagccttggaagaggcaggactgagatgtttgggaacaagaccactttcacagggggcagccttttgagaaatgtcatgtctacttgatagggctttaaatatggagtagtgggaatctgcacatttggattcaaatcctggcttttccaatggctgatgatggaacccttataggctcaaatcactcacttctctgagcctccccaaaaattgagaataacagtttttattccatagggtagttttgagaattggtaagatgatcataaatgtagaagggcctggtactcataactgttttcttcatttatttatttagtcaacaatgttttctgagcacctaccctgggccaggcacactgaggtgggccttgggattcatcagggatcaaagggaaaaggcatcccatctccgtggagcttcacatcatcgtagttaaggtggataatgactgtctcgacagataggacagtggccaggacacaggccttcagtctggagcatgcttctcattttgaaataatttcttgttcagagtcaggttggaaggaaggccttgcaggggctgggtaaggatggcggcatctctgcgttcacgtctgtgtgctcaccatgagagcccacctctctctggcccaagtttccttctgtaatgtgaaagaggtggggttccatgctctcctcttcagcatcctccttagatactcaatctggcactcatcagtttcggaccctccatgctgccccaaaggaagccacactgcaccttcatccagtttcttaaacctgcatgttctctcttgcctctagaccttcgcccaggctattccatctgcctggaacatgcttccatacacctgccttcacttggctaactcctacttctgccttgtgccactgcttggattgaatgtcctctggaattcagccttcctggatgtccctgagctgggctagggtcccctctgcccacctctgctctttgattttccctgttcatcaccccagttatgacactgagttgtaactgggatttctaatctgtcgcctccaccaagcagcacactctttctggccagggtccatgtcttatttgtcttggtatctctagggcccagaatctggtacctagtgaatgtgtaacaaatattttctctgagctaaaataggaacacagggtccctgcaatgaagaccccaggtctggaggggaagacaaggtagcattacaagataacaggccttccctgcaaagcgtcagcactcagactggggcattgtggacaagaagggtggagaggagagaaggcatgaaggcatcccagatagggacacagcagaaacaaagacaaaaaggccggataagcaagatctctttgagccggcaggttaagatgggtagtggaaagctggaccactgtcaggttttgacccctccagacaatgcaccgtgatcttctggcttccatatgtccctggctgctgctgcctgctgcccactgagggacctcaccctccagactctaagtgatcttaagccaccagccttacaaattacagcagacagagggggtccaggcccttctagagatagtgttcacagcactttcccaaagctggttctgctcaattccctaaaagatctcctgcaatggggcctccagggtcctaaaagcaccatctgctcttaaagagtctcactgctcattagcatatcaaaggctctgaaatgtcctgcaggaaaaaactctgggctaacttttgtagccctgttccccaaactaaattgaatgaaggattctttttttatgacccacctacagttctgcagagatcctccagggaatgcagatctaacccattctctgtgcagtgaatggcagagaaaattaaagtgattgcatctattgcacacttacttttccttcgaggtaggtgagagagtaaataagatgcaggagagaattacaaccggagatataaaacagttgtcttacagggaatagtctgtttgcccagggaggaggttttcagaatacaaagtaccatttcttctccacgacatccccaggggagaaaggaaagtgaaagaagccctccaaccgaccactggagatgggagcatttctgctggtttcatttacataagtgtccttggcaatttgtcccaatttgtctcattataaatgatgtaaacatccgggcgtaatcacagacaaaatgggatggtttaaatgctgcctgattaaaaaccctgggttggctgcaatgacttgcaggcatgctaacggcttccctgcaagggactttggtttcaaagttctgagagctcaggagggtccctaggtctagttgcaaagtcatgtcccccatgactctgcaactctccacatagagcctagcaagaatgcatcatcttctctatatctcttataaggagggaaggaagaaagggagggaaggagggagggggagagggagggagaaaggaaagaagaaaagaaaggaaagaaggaaggaaggaagggagggagggaggaaaggaggaaggaagggagggagggagggaggaaaggagggaggagggagggagggagggagggagggagctaactgacattttcccctttgccatctgattggcatgaagggcaatgtaactgaggagtctggggaccaaagtgaatcctagtaatgtcactcacttaatatgtgtgattttttagaccaatcacatcatttggccaagcctcagtttcctagtctgtcaaatgggaatgatgatttgacatctggtgtgtctctcactactgttgagacattatataatgagagcatagccctttataaagacagggtttctgtcctctttcttacttcattctttccttctcttctttccttctaatagaaggtatagagaagacagcacattcctactgagctctatatggagagctgcagtcatgggggacactgtctagatctggggaccctcccaagctctcagagctttggaaggaaggtccctgcagggaaactgtgtgtgtttcttcaacagtgtatcctcagtgcctagcacatggtaagtgttccataaacagctgttgaagagacggatggataactgaatgaatggatgcttccatgggcaatgacacactaatctgaaaagccctgtatcaatgaaagaatcacttaatagtttaacttttccctcatccttcagaacacagatggcatgccatcttcccttcaaatctcttcccagtgccccacacagaagaggcacacttggacactggtgtctgatggacccaagttcacagcctgtctctggtcatcaggtatcatgaccttgggcaagaagcttaactctctgagcctcagtttccccttctgtcccccagggaaaatgagtcctgcccctcctaagggaggtatgagatgtaagaccccgaaggacacaaaggtttgccaggagccttcaggtaggaggcaggtaaggaggtctgctagattggaatgagtttctggaaggccccaaggagctcaaaatcagacctggggtgaaggtgtcttgaccaaaatgagacccatcaaagaagcctggatgaaggtgcccacagcatccatcagtgccaaaaacagaaacactttagcccaggatacaaggaacattttaaagcaacagagataagagatagttagaactcaggcctcctggctcttgctgttcttggcccataattagttgttatgggaccttaataaacttcttgccttcttggtacctttgccaaacaatctgatgaggagaatattgagtcatggtgccagggaaaattagcatattctgcaaattcctggcactgttaacactggattctgtccacctttagaaatcctcagatcactatgtcagcatcccccaatcacagctctccaacttcaaggagggttgaggggtctgaagaaggagagagaggcaacagagccagaaacccttcagaagatgccaagagcaaggtttggacccatagtccaccacttactaacttcaagagtgttatgagctacaaacttctcagtctccgttgactcatctcaaaaatggaagtaaaattatttaccatgcaatatgttgtcaaaatgcattgggtttagttcatagcaggtgctcaaagaatatcagttccacttcccttgtccctagagagccttgtagtggatgttgatgtgtcttccaacacatgcaccaacctttccctgtcctgtagcagttgagatggaatcatcccactcccagctccaggaataggctctgatgggcttgaacccagcagcttaattccattggttctctaggccttcatcattagtacaggaaaggcacttgacctaaattagttcgataagatttaagctcagaaatctggtttgttggatggagaaagagatgctttctttctctctggaaggagtttattgcaaaagtaagggctggggctgctacagccattgtgctaccatgagggaactagccatgataacaaaacttgcctggggaggggctacgcatcacagaaaatgatgccaaagtcctgctcaaactgtgcctgatgcctgcctgatctatggacttcttagttccatgtaatggattctctctatttttaaagccgtatcaggttgaatttttggagaaataaaacaaaaagcatcttgactaatttaaaaaatcttctttgggtattcaaccctcctaaactcacccccaaatccactgggagcatgtcaagatttttgtgagccgatttaggagatgcaaattcatttgccttaattggatctccaggaaatgacttctgccccctcttaaatcatttaaagctcaaagaggcatgagggccctccccaaggatgcaggtatcctcttgactgacagcctgtatgctctgcttccaggatccttccatctcctccctttactgagggagtctgctatgtgttagaggtgtccatcactggtcacactgggaagctgtggcagggaagctggagaaaaagcaagataggccccagaaagaacaccaactccagactcagggagactcaggccagaatcctagctcaacttcttccaagctcccaaagtcacactcttttctctgagcctcgattttcccatctgcaaaatggggatactaagggtcacctagctgggctgccctggagattccaagacattaggcatagaaacagtctggcctagaccctgtaggccagtaggcatttgatcaatggcagctgtggttgagatttttatcatcattatggctgcccttcctgctttccagggctagtgtagatctaagattataggggctgcaacgttcctcagtggagcagatgcagcaaggtagtaagagagggcattctcacttgtccccacagagtgtggtgtgggggagatctgtgagcaccccagcagccatgagggtcagcacttgaatctctgcaggtcagtcatactcctctttattatttttatttttatttatgtattgatttattgctctgtcacccaggctggagtgcactggcaccatcatagctcactgcagccttaaactcctgggctcaagtgactcccacttcagcctcccaagtagctagagccacaggcacatgccaccacgcctagctaatttttcaattttttgtagagacagggtctcactgtgttgcccaggctggtttcaaattcctaggcttgagtgatcctcccgccttggactcccaaagtgctgggattacaactgtgagccactgcacctggccttattcccttctttttatcagttttcaaagccatcagtatgcagagcactaggcccagaaatgagaggagaagagagatggaacgacgaagaccaaaacctctgtcctcaagctgctcataagccagtatagagacgtgtggagtctgctgtcctgagttccagtcccagttccccttgcaagcagccgtgtgacttgcagcaagtcattgaatccctttgagcctcactttccttgtctagaaaacaacaaaactggaaataatactgcttcccttccagtttgtcaaggatgaaggtgctttgcacggtccctggagcaaaatgtgttctcaatcaagattccgtctgtggtgggtggagccgcgtccttcccaaattcatattcactcagaaccttcaaatgtgacctttttcagaaatagcatctttgcaagtttaattcagttatgggtctcaagatgaaatcatcttggatttggggtctatccgaaatccagtgactgatgtccttataaaaagaagggatacaggccggggccagtagctcacgcctgtaatcccagcactttgggaggctgaggcaggcagatcacttgaggttaggagttcaagaccagcctggccaacatggtgaaaccccgtctctactaaaaatacaaaaattagctgggtgtggtggtgagcacccataatcccagctactcgggaggctgaggcaagagaattgcttgaacccaggaggcagaggttgcagtgagccgagatcgcgccactgcactccagcctaggtgacaagcgtgagactctgtctcaaaaaaaaaaaaaaaaagagtggatacagagaggcagtgaagaaggctgtgtgcaaagacaggcagaggttagtgggatgcagcgcgaggctaaggagtgtctggggccaccagaagccagggaagcctaggaagggttttcctagagcctttggagggagcacagccctgctgacaccctgacttcagactcccagcctccagagctgggaagggataagtagctgttgctttaaaccagtggtccccaacccttttggcaccagaaaccggttttggttcagtggaagacaatttttccacggacagggtgtgtggggtgggagatggtttcaggatgaaactgttccgcctctgatcatcaggcattagcattagttagattctcataaggagtgagcaacctagatccttcgcatgcgcagttcgcaatagggttcatgctcctatgagaacctaatgcggcggctgatctgacaggagcggagctcaggcggtaatgcttgctcgccagctcacctgctgtgcagccggggtcctaacaggccacagacccatccgtggcccaggggattggcgacccctgtctttttttttttcttttttttgagatggagtttcgctcttgttgcccaggctggagtgcaatggcacgatctcgactcttcaacctccgcctcctgggttcaagccattctcctccctcagcctcccaagtagctgggattacaggcacccgccaccatacctggctaatttttgtatttttagtagagatggggtttctccatgttggtcaggctggtcttgaactcccgacctcaagtgatccgcccacctcagcctcccaaagtgctgggattacaggcgtgagccaccacgacctgcccggggacccctgtcttaaaccaccccagcctgtgatactttgttatggtgaccctaagaggcaaatacaccctcctttccccaacctctcccctcagacgaaaccgatgcgaaaagtgcttcatgaagtttcaggtaaagaagtctgggacgaaaagggatagtgaggatggcgggaggggctgaactccaaatgggcttatcaaggctctgcaaaatggcgtgacggcgctgcccccttctggtggcctgaagactaacgcacatgatgtcaagtgcggggcccaagtactcaggaaaaggttctcatttggacactgggaggtcttacattgggggccctgagcctccagcccttccaaatctattctcagcaggagctcagccacacctgtgtcccagaactgaggccaggcccagccttcactccacgcccagccagccccaaggaaccgactccctgaggctctatgctccctgcctccagtggccccgtgtctgggaaatagtggccctggcctgatgccctgacctgggcaatccatcccctggtcctctcagctcccgggcccaggttttctgggctactttaaccagggcaaactcattcctcgagtacaaaataaaagattcgaacagcataatcaaataggtcatacccataaatcaacacatttgagcacctattttgttgttctttcactaatccaaaccatatttattgagcatctactatgtgccattctccagtagccattctaggtgcaggggatacagcagagaccttgaaaaaaggaacagtctctgatcttgctgagcttagagtcaagtggaggtgaggaggaaggaaatgaattaacaactaagtgaagcagaaggtaaccaattgattgactgacgaaggggtacaaacaacaaacaccttcctttctccaaactctatctttaactgtattctctcgttttccttcctctccattttacaatcattttacaacatctctggctattctcctatatttctgatcacttcggttctcatcacaataataatttcagttttcaagcattggaaagtcccatccaattaaaatgtcaatctcacacgcagtttaaacgtttcgcctgcccgtgagctcagacctgtcttggtgcctcagttcttgtgtggaggggaggagaggagaggggaggggaggagaggaaaggagaccggggaggtggggggggagaggggaggggaggagaggggaggggagtgggggagaaggggagaaaagcgcagctggcttcctcactctcctttccttcctcaccatccttaccctggcccagggcaggaggaggattggcagagtagaggcagggtcttctgtcttagctgggcctgttggtgactttctgttggccaacatgggctgactggaatgttctccagcatggcacatggtcatccagatgcaggctcttccctggggcactatagcagagagggctctcttccagtctattgcagatggatgccctcgtgagctgagttttgatgaacatcccatgtccccagccaccccattcagagcctctttctactctggtcctctggtcccagcagcagccctctgggtactgaggggagggcatctcacccaagccccttaaacctgctcaccttcttcagagcccacgtggccgcaggaaagtcacaaacccttgtgctcccacagggcacacgtgtgcacacgtgtgcagctaccttctctctagttggtacctgaggctgcctcctggattttccagtctctgtgttcccagacaaccccaagccccaagaatacaagagctctgtcaccaagcatcgggcctgtggctgcactacacgtctgcagctcaggacccctggctgcggcgtaagctaccagcatccccttctcatgggcaccctcatctccggctccccatcgctgggctgtgacctgcgggggcgcccctctatggaagggaaggagaaaaattcacagtgctatctactcctctgaatgcactcccaccaatttccttggaaatttctagctttcactgacatatctgggatggggcggtggtcacaaaatcaatcccactttccctcggctagtcttacaagcacccaacagctctattcagaatacagggctgcccagctacttcccattcattatccccaggttgcaagctttagtcaaaacccagaggcagcagggtgtctggttccacctgctgttaggatgatttcaggagtgcaaagtgttagaaacgcggtaaaacatgatgcttagagattaagtgggatggggactgggcagatgatgctgctttggacccagcgagtgaggtgagactgcgacaagacagagccactgagcagtgacctgggggatgggcattgcaggcaaggcagaaccccaagtgggaacaacctcactgggcttagcaaaactaaagaggcccaaagtatactgagcgatgaggtgagtggcgtgggataaggttggagaggaggctggaaccagaccctgcagggccttgcaggtgatgggaaggagtttggaaggtgctggaaggtttgaagcagaggagggatatgatcatgcctgtagctgctatgtagaacaactgtatgcatgccaggcctgtgccacgcatgctctaatcattactggctttaacccttgcactaacgttgtcatgcaggtaggagcatctgcacccagcaaatggaaactgaagctcaggaatattcagtcacttgtccaaggctccccagctgttaggtgctaaggctggattcaatccaggacttgcagactccagtatcttggcttttctaacgagagtgtgctagctttctaatgggggtggggaaggcagtctgcccccctcccatggcaccgtgagcaggtgtcactgctccagccagtacgcctggacaccgactaggaaggagtatgtgctactaggagggatggtctgggctgactctttgaagttgacaaggagttgcataatcccagctaataattatgctggaccaggggcagagacattactccaagggtgaccaggtgtggagaagaggctgctgactccggggccccaggacctggcccccaggtctcattgcccgagtgctgccccagaaggagtagaagctggagctgtccgggccacagccgaggctgggtgaatgctgcagtgaggctgccgcacaagttgcgtgttgtgacatttgtcttctggaggggattgggatgggctacttcagcatttaaaaacccctactaggtctgagaaatcccctcagcttatgagcctgggtgggcagcaggccttctcaagaagcccagaaggccagatgctcacttcccaggctctcttgcggctgagctgagagcaggcacctgaggcctggcaagtgtgacagctggtgacacagacagacagggacagggagatgggactgtgcctgcagcggtagccctggccggtgttcagtggggccagcatccgtgtctttcctgggggccagtgggggccgtggctctgacgatgcatccctcccccacgttttttctcttcttgtcttggactttgcagggagcactctgcttttgggaacaggagctgggtctctggccattctccgcagcccctcaccattcactcagtggctctcaaaaaatagaacctggggcaaagctgttcttggccccaaacaacatgaggaaaaataaataaataatgtacctggtaactgagagagttccctctgcatcttgggctctttcaatgagatgtcctctgcctgcagcaagccccaagggcttccctcaccaggaccagcaccctggtttgcctgaccccacacctgccaatgccggggcaagaatgtcccaggctgccctggttcccagagctgatgcttcccacagtgcccagctgtgctggcatggagctaaggacagggccagtcccaagaaaacaacaaggctccagggccaccggccactgctcaggaccctggctgaccccacagatgcggagtgcctgagatggctcatgggtgacccccaggcatctggcaaaggtcacaatggctgtttggcttgaagacagcccttgcaagatctgttttgagccaacctgtggcatttagccctccctgggtgacaaataaaaaggctgaggcttgtaggagccaaggtgggagtccccatctacccccaccctctcagcccaccagggcccagactggggaactgctcctgcttcgagggacagggctgaagaggagaggggcttggggctccccttgatcccaaagctccagggaccccaaagaaacgtatcagcagcatgagaatatcgggtgacctctctctctagtaaatgtcaaaacttttaaccaaaatgccttcatcccccagcgccaggcctgagctaatctcataggtgtcaggactgggagcctggacccctcttccttctgctcctgctttgcagagaagtgagtggggaattcccgcctctgggaattcagagacgaagtgacagagacagcattggaagataagaatgcagccaaagaggtcttcagggtagcgtgtggcctgggcgctgagactattgggcctagcaacttctcaagcagtctattaaccacagccggtagccagcttttccccgcccttctcccaggcacacacagccacctccatcaccaaaggtcaggcgaaccacctcccatggctacccccagcctgacttgctttatagaaatcatggcatctcatcctcacaacagcccacactcacagtgaatcttggccattatgacaactggggacactgaggctcggagtggtggaaattctcagaatcacataacaataagtgttaaagtcagaatttcaacttcatctctctaactccaaagggcgtgtgtgtgtgtgtgcgtttctggccataatcatattgtgccctacaagccccagtgaggaatctgctaggaacactggtttggggaaaaaatgtaataaaatatgtgatccagaaggcggccttggtacctgtcataaaccgcagcatggggtactcactatgcctggggtctgggctctgaaggcatgattgaatgatctcactgcaggcctggttgtcctgcgaagacacccgtcaatacatgaatattgacacacaacgctgcagtgcacgcgcttctggcaggggagctgctgcactcgagggcagctcaaggttaatttgcagggttcatgtttggagtttctgagcaagtgttgcagctttggcccccagccccctgaggggagctctggccgtgcatgagggtcagacagaaaatctcctttcctccatccaggcctgcagtctgcagcactgaggtcagcgctggccacaagcccaccctgtgcctcgtcagccccactgagcctctccatctatcatgccacaggctgaccctgaaatgcaaaatcattctgtcctcccgccctccactcccacctcgcacatctatggatttgctgttcagaaaacatctgttccctccttcgcccctgacatacgcatcgatctcatgctagcccagctgcctaagctcaccactctgggagacagactctcagtcctcatcagacagagatgtagggggctgtaagggacggggtgcaggtagggcctgaggattccgacaaggtgagccatgggcaggggcattgttcatgcagggacctcctggccaaggtcctacgtcaaggttagaaggaaagagtaaatgatcggataggctaagacagcaactcagcaggccaagggactcctcccccaggacctgctccacccttagaggggtcccggacagccaagccctgatggagttggtcagcaaccaaccagccctggggccaaggcctgcagaagcagagaggaggggtctcaggcaggccagaggtgctagctgggatgcctgggtcccccaccccaccccagcacactgtcctttctccaggtgctcagttagattgagctgggtcccatcttgggcctttgctggtccctccctagaaagtctgccccctccccctgcagggtggcatcagcattcaggcctggccctgacgccctcctctctgggccaccttcacctccacaaccccggcaccagcacccatccccaccacatccccagcacgcagcatctagtaagggcaccaaatgcatgcccagacatatgagtgaaatgaattaaccctgaacctgaaaaagggcaaccaccacacaagattctctagaaacaatgtgaattgtgcagaaggaaattaaccctactccatccagcccatcctaaggcagggacttggacctgttcctcttgatggggctggggctgaggcgggcaaggcaggcaagtgctgaacagttggcaacattgcccatcccgtctccctgcaccaggctgggcctggggtgagggggtgggggccggggtagctgggctcctccagcaaagagcaggactgagtccctggtgactattaggtaaaaggtccctgacaattttgaggggccagatgccaactcgagggatacagagaagatctaggcacagtctttccccaccatgtcagacaaaaaggttagatacaggacctgatatgttataaaactcaatcaatatttacttagtgaataaatggacggatggatggatggatgcattaggcagccaagtgggcagcaccgatgacttaatgtactgagtgctccgactccagcaacatgcattcattgttcctactgtgtgccagtgaacaagagcaatgaactcaatgacttctgcccagggtgggccagggaaccagggaagactctccaaaaaggcagcatttgggctgggacgtacagatgagtagggggtcgagtgtgtcgttatgtcgctggagcccagaggcgtccatcaggacttgggggagggcagatgaaagggccttactgcctaacttggagccactgtatgtttcaaaacaaaggagagagaggatcctgggaaagagaaagggtactctaggcagaggatgtgaatgggcacagcacaggtgagaacatcaagaccaggggtcagggaatctactggtaaacaattgtaccccaagggagcaatcacagcctctccatccacagggaaatgcctggtggggaggaatgggaggaaagaaacagattgcatgactgtgtcttgaaggtctaattccagagtacagcatcacccctatcttccaggtccagaaactgaggctcagagggagactttctgatgagtgcagcgtgcagataagagcatctccaaagctacctccttccccagtcacaccagggcataagcaactgataacagctgtcagcacgggacagtggagggaacactaggttaggaataagggtacgaggcttgagtacagattgtcaatgactcagtgtgtgaacttggtcaggtgactccaaccagatgacttccttctctgagcttctgttccctcctctatgaatggggacaatcactcagcttcacaaaacaatggctgcgaaattgcctggtacaagagagagaacttccagtgtgtaggggctgttgtcctaactgcccagccccctagataggtagttatgtcatctgtgaaatgggtgttagaattcctacctcccaggacagctgtgggcagaaaaccaaagaatgtgtgtgagagcccaagcaccatgcctggcacatagtaggtgctcaggaaaggctgagggtgcagctgctgtccacacacatggtaccactgccccaggaaggggcttcaggaaccaagagcaattctgagcactggtgactggactctgccattctccatttcaaacgctttttgaaagcagctccagacccaagcaggagagcaggaggcaaaagaaacgcaggggctttcccgaatggaattttagaaacacacagaattgtctcctgcacagaagggaagctgtcttccacagcacagagccaccaggccccagactgctggcttatgtatttgtcattgctcatcatgaatggatgccaggaaagtctctttgtgatgggggcacaacccctcaaatctcctcccctccagatgccatccactggagctgagactcccaggtcccctagggcttctctcccaggggcctctgggctccccaaggccacgtgctgcccccactagagacctgggccagtcctgaccaggggaaagagtagcgccgacaacagccccagatggtatgtgcactggcacatactggcagctgccttcatgacagcaagccataggtccaaatcccgccccttcacagggacattcccaactggtcaggggtggacctccccttcccggctgtctttggtgtccaggacgatttgccacagacagggggagctaaaggggcccacgcttgaggccgctcagctctgagtcctcgccggccacagaggaccttcgtgcctgtcctctgtcctcctgcccagtccccaggccaggctcagctggagttggggagcagaaaaacacgcatctgaatcaaggctctcggagcctttgcttctgcctccaagaggcgagggaaaatgaatacccaggcgagcgagcaagagagaccctcagaaaaccccagatgcccctggaatcaagccctgtcccaccaacgccacgtggattgacaggctattagtcttcctgtaattaggattctcgcctcaaatcttgtatctttttcccccagaagattctcctccagccttcaccactgccccctggcgcttccttgcaaggcttttgaagaatcctttgcagagaagcagcctcctttggcaggggctgcagagcactctgcctccctaggccagggcgaaccaacagaggcgggagatgaggaggagcagcgcggctctgctgcgtggccctgggcaagcaccacaacctctctgggccgtttgcacattcttaccgccagggatgtgggcggtaaatgaaagagaccagcacaaaccagtgtcagctcccttcctcgattcctaaaatgtgatgcccaaagatgggccagcctcctgctgtgccttctctggggggacatttaataagtggaagagccctggctctgagtcaggctagaatcccagttctgcacttaaccagctgtgtgacctcaggcaagcaacctggcctctctgaacctgagtttcttcatctgtaagtgggaacgctaatgctgtgctgagggttccatgggacaaccatgtaaaagcacccagcacgcacccagcaggcagcaggtcctgcacagcgttccctcgcgtgggggtgggttggggcttgagcacgggttgaacctggaagaggccatttccctcccttctccccgaggaataattgtgaattcctgggtctcagaggaaacatccgctttggtggtcagaaaggacatcctcctttgagcagggggagagcagagggaagggggttgcgagggtcacgccttccccaggcattctcggggtctctccagcaaggatggaggcggccaggggcttgggcggtgtggggcgccacctggcgtccagaagaggtaagacaggcggagcgggaccctccgaagtgggaggaggacgctggtcaggggaggaggggaccgcgagagcgagagcggacattctaccaaacacatggacaacacagaagatgaggaaaatgagcagggcagctagtcataggagcaaattttaaaaattaagtgactgaggtagtcagggggcctcactgagaagtggcttggagtaagacctgaagttggggactggatatgcagatgtctgggaggagagcttttcaggaagaagaatcagccagtgcagaggcctatggcagacccaagcaggaggcaaaagaaacgcagaggctttccaggatggaaaatgaagaatcagccagtgcagaggaatgtgcctggatgtgttccaggaatgtttcagaatgagctaaaaggccagggacagagaactaagaggagaggagaggtcagagagatggcggtgggcggaaggagggggcggggcggaggagggggcgagggggcgggggggcggagggggggacggaggggggggcggggggcggggcggaggggggatggggcggggcggggtgtggctgtgcgtctggataagggttgtggcttttatgctgcacgagaaggagagccattggagagcttggggcagaaacaagagctgatgacattttaatccctctggctgctgtgctggggtagactgtcagggccaagggcagagtgtgaaaagcgcccaagaggcttctacaagaatctagtgggagatgctgcggctctggccaggttagtggcagtgccagtggtgagagggatgtggttctgcgggtgttgtgaaaatggagccagcgggatttgttgacagaccaaagttgaggtgagacagagactccggaatgactgcagggttattggtctgagcagggttattggtctgagcagataaccagatggagtcaccactaacttagatggagaaggctggtagagtgaggaaatatcgggaacttatgttcggacttgttaagtttgagatggctgggagatatctaagtggagagggcaaggaataaaatgcttcctaaactccagcatccattcagtcccctggagagcttgttaaaccggatggatgggtgccacgcccacccctgcacccctgagttgcaataggcccaaaatgattcaataggcccaacatggggcccaaggttctacatttccaacagcttcccaagtgatgccaatgctgccagactgagaaccacacttcgagtagcaccaaagtaggcaactggatgtttgaggctggcattcaaaagagagatcctggcaagagatagaattttggagtcattggcacggaaatccacaaaacgacatgagctctcccagggagtgtgtgtgtgtaaagagggaagaaaagagcattgagtcccgagccccaggctcttcaatggtaagaggttggcagattaggaaggaccagcaaagactgggatgggaaaccactgaagcaagaggaaggccaggcagatgtgtcctgaaagccaaaaagagaaaggtcatcattaatatgatacattttgcaatttgtttatatgtaagaggagattaatagctcatagcattcccaggcattgctgttaggaattgcagctccaggctggcaacccttaaatcacaaactagattgtcaagaggactgcctggaattccagctctgtaagtaatatgctgtgtggcctcagccaggtcacttcacctctctgggcttctcttgcttccatatataaatgtaataagaaaatcttttatttattatttatttatttatttttgagacagagactcgctttgtcacccaggctggagggcagtggtgcgatctccactcaccgcaatctccgccttccgggctaaggcaattcttgtgcctcaacctcctgactagctgaaattacaggcacccaccaccacacccagctaatttttgtatttttagtagagacggggtttcatcttgttggccaggcttgtctcaaacacctgacctcaagtgatctgcctgcctcggcctcccaaagtgttgagattacaggagtgagccatcacgcccggccaagaagaccttttaaagtagatgttctaagagtctctttcagttctgaatctctttgttatcttacatgttaccccctcagagatgccttccctcactcccctgtccaaggtagctctccacccaagtcagcagtcatcacagaaccatcacaacctgaagccctgtgcatgttgctgtttatttcctgtttacatcacaacctgaagccctgtgcatgtagctgtatactaaccctagagttagtatagcttagttaaactttcatttattgctaaaggtttatcactgctgtctctatcagcctccctgcactgtaagggacaagggggcaggtccagtttctgtcttgtttcaggttttgtctccagccaagataagtatctttgcaaggctctgtttttattctgaaaggaaattaggagctattggagggtatggagtggaaggggacagtcttctgccttggatgtataaaagggatgctgggccacgctgatgggctagaccatggcaggcagagaaaacaggcaggaggccaggcaggggctgccagtgcccagacacaggccgggaggtgcaggtggcagtggcaggcagtggccaggccctgggtatattttgaaggtcaagccaacaggacttgccagtgggctgggtatgggcatgagacaggcaagttctcccagatgtgactccgatgtgacattttggagactccctcaacacccacctggggaagacagaccagttgggaggaaatatctggagtctcattttattaattctgagagtttgttgtattagacagtgaagcggaaatgtcaggaagtcagctggaaataggagtctggagttggggggaaagcctagccagagacaggaattgtggcgtcattggcgtagagacagcgtttaaagctgtgacgctagatgggttcaccaggggaatgagagtcgaaagagaagagcagagcagagctgagccctgaggggggcagaaaggcacacagggacagtggaggcaggaggcagaaggcagagggtggcgggccaacagctctgaaggtcagtgctctatcacaggggggtggccgaggaggggcccgaggctggaaccaggaggcactatcccaggcctgccttctcatgccagcagcagtgatctatcctcaaggagaatattgattgagcacctactgcatgcagagacctcatcaatggctcaatcaatatgacacggccacgcttcctgatccgagccctctgagcaggtattttccatcctggacttatccctgtttctcaggagagggatggacccaagagacaaatagttcccccaagatcgcacagcaagccagtgtaaaacaagcatagaaaccagcttttagggggctcaaggtgggggtcagaaaatgaggtgagagcaagcatttactgagcacctcctgtaaatatctcctacatacgaagtgctctacccacattactgaccacccaataaaggcaggtcctgtaattcccaatttgcagatggataagcagaggcttaggggtgtgaaacaacctcctcaaggtcatggcttctaagtggtggagccaggcctgcaaaccaggctgtctgaatccaaaatccacctccaagtccacagtgggttggccccacccccaacccatccccatcaccaacaggacggtggtcagagtccactgaatgaaagcatgcgtgcattcaaaatagacagccaatcagcagccttccatcagaaatgtcatctttatgacaacagcatcgattccaggcgtaccctgcatatgtgaaccaagggggatggtggattgtcctttccaagcacttcccagccccttagagtcccacaggcccagaaccacggcccttgacaccctctacccacccctgctcccccttctcctcagaccccgagtgtctggccaggctttctcactgggaagtggccactccatccaaatgaccaccgcacccctcctcaccagcttccctgcttctgccctggcccccactctttgagtccattcttcaaccagcagacaaaggggtgctgtacacgcctctgcacagaacccctccaatgccttctgtctcaactcagagcaaagggcagcagctagcacactccaaacactcccacccacacctcagctcctccctctgtccctctgctctattccctcagatctgacggctccatcccataaacgtggcacacacacacctgcctcaaggcctttgctcaggctgttcccactgcctggagcactcttcctgcagacacccacgaggctcattttcctttagtgaggctttcctggccgcctcttccagataacaactctcctctccttccctgccctcctgctcctcctgttcgcgctacataacagactctgtggggccttggtttatgtatttccttctctcccctactgaaatacatgtgagcgatgctggggcaggccgactagaagaagcagactatctgcttcttctccacccttagaatggtgctgggcccagaagaggcatgcagtcgatatttgctgaataaatgaatgtcagataaagtggtgtggggactccaggggaaagatttgtcattctccaccctcccagttcagcttaaagcagagaagtgagaggtgcccaaaaaggggtgtgtctggggggtggggggtggggatgttccaagatctccaaggcctggattttaagcaaggtttgagatgccagcaagagggcctggcattgccagattgatagtctgcatttcagagaaggacaaccccacctctgaccttagcccaagcctcaacagcctgctcaaggagatccacccttagtaggaggaggcagccaggccaggttccagtccctgccaccgcttgccaggtgtgtcttgggcagcagttgcctttgctcggtggtcttcagctttgccccctgccaggcacgtgctggcctcctgcctgcatcgtagctcatggagtcctctcagtcacctctgtatgccctgcagcatccccagttctcagtgagaagagtgtgctctgaaagttaagtaacttacccaaggtcacacaaggtctgagtctcaaatgcatacaatttgaccccatagtctaaggtcttgaccgcaatggaataagaaattattttaccattctgagtggcagtctctgaagactacagcaataattgatgcctctcagggggataggtgtgtcacttacaggtgatagtgaggttgtcctcagcctccctgctcttcgttagacctccctcctcctctctacccgggccaagcgtccaaggcaaccctgtgtgttgcattgctcttgggggcagccagtcccccacataaagtggtgtcttccttcagctcctaacaagtcatgtggccattgcccacactacaacgacagaggaagcctcaggggaaccctcctcctctcccgaatctccgggcttcctgcatccctgggaggcaatgtccattaattccagctatgaccagcagagggcagcagcagcctggggaagacccagaggcccaggcctaggggagaggccggtgtctccaccctaggagccccaattcctccgcagcaggagcagacacacaaagaggagggcgagcaagggtcctccggggcggaacacctctgccgcacctgcagcagccttgctctatttcttcacaagcttccccatgacactgacccaaggctgtctggccactacagctgctgatgatgattagcaataataataataataaacgaaatgccttctgcttagatcatctttaatttcccctccagaatgacattcgactctgcttagagttacaggcagcccagcaattactgagcgcaaataccgtgttcacccgcctcacctcatccacgcccccacaacacccagccctgagactggctccacgatcacctccactttataaaataagatatcaaactctgaacagaacggacgtctcaaaaaatgggcatattacatttaaaccctcaatctgttgggtatttgagtgaaatggacatacctccagggagtcggtggcgagggccggctctgaggacttcctgggttgggatcctggctctgcaggactgcgtgaccttggtgagttacttcatccctccaaacgcgctgttctccttcatagaatggagatgaccacagggccagattcataaggttgttccttgtaatacaggtgaatatccatacccagcaactgctggaccacctgtggtttcaaggataatttccctcccacgtccccgtggcccttggaaccttcctctcctcctgtctccccctgcccccatcactttgtaattgaaaagtcatgattgctctcccaggtgtagcactgctcacaggtcagattgcctgctctgacgtagtgactcagttggatgcggttcagctgtgtatgatcaactccctccccctgacaaaaacattattttgcatcacagagaagttgatttctttcacacataaaagaaggcaaaaagtggtgcctaaagggctggtacagcagcttcaagaaatcaggaagaacctgggctccttctgccttcttgttctgccaatatcaccccatggctgccacttcatggcccaagtggaaccatggagcaccacccttcagacccataggtgacaacagcctgctctgtgagagtggcagtggcttccagagagacttaggaagtagaatcaacaggacttggtgacagatttgccacagagctggggaacagggaggtccaacggtgactcccaaggagctgatgtgagaaccagagctgctgtgaatattgttcccaactcctgagacagggacagtggtcccgtggctaggaagtggtaggcagtagagagtcacaatgcacattagtatatcaacattgtgagtagggcacgcagggaagaaacctgttcaacccagccccgtgctagaaagacatcagcagggcctgcaaaagccctgattaaatctcacaagtttgcacctggagccgccatcttgaattgcaggtgaatatcagcctttggtttgggctgtgtgccccagatgatggtggtcccaaattacataggccaatatccagagctgggttaaaatgaagcatttcgaggaaaaaaatgcaatgaaatttgtttaaccggtacttcaggcttttgagcacagaacagcgtccatccctccaaacacacactgaggatatacacttagccaggagggaacataaggaggggtggacaagccatgtttactaaaatctctcagtgtgtgccaggcatgttcatgtatattcaggaagaagtgtcagtatttaagatcctcggcccttgcccgagtccccaacacgccttcttgtctggagaactgtaaatcttggaaacatcttgcaaggggggacacctcacagaaggcaggcttggcatgggataaacagaatcgactcctctgcttccttctgatgcacagtgaatgggcaggtggaagcatcgttgcttaaagaggaaccaaaactccaccccagagctgctaattccttttggcttgcagttatgcagagggctaaaaaatccaacgaatcacaaatcccctggttgctaagtagaaagaatatgttttggctgctgctgttcccttccccaaggaaaagattcaagcagaggcggtccccacctctcaacacagaaagcaacatctctgattgcctctagacacaccttcatgctcgtggcactttgggaccctctgcccgctggcttatgggcatggcttccccatcactctgggtccttgggaagagcctctttcccagaccccacctctgtgcctcatcacatttctcccaggctattgacttgttcaaggttaaggtatgaagagagtcatgcagcagccctacctggctctgctctgctgggggaagccttttcagagcctgcctcttcctcagcatgaggggctgctcgggcccagtcccagaggccatgctggtcccaggggaaggtggccgtcatccccatctgtgttttctcttgcaggtaagtcatgctccagcagtcgggagggttgtgtgatgacacacttggcagtttgggagcaaaagccgccacagtaagacacaattgattcattgcctctcaaccctctgctggggtggactttcatgcgtggacttctgtccccaaagaggcttctctgggtctggaaagggccctagccttggttgggggaggcaaaggggtggcggcttccaggtaccatctggccaggaaccggctccattgtctgtgcatgtagcttgcactgggctgcctgctccaagggaggcatctccccacgatctacgacattggcttcaaagagctgctcctggcagcttcgaatggctgagacctactggcatgggatggaggagtgcagggagcttcccgggacctcgctagtcctgcctggatgctcagaaggccctcgtcctcggtggcatgcagcctcggccatttccaaactcacggcatctcacccagccatgtcacccacccccggctctgtcgcccttcccatcacctttctcccacccatcacctcacatcaaggtttcagccagcgggaaccaggtttagactccaattacctgtgcgtgtgggaggttggattgtgacatctttggagggccgggcttctgaagcgacatttgatttctggtactgaaatgtcaaagggtcctgaggcacccgctagggcagcacgcggagcatccacctgcgtgcgcatcctgggctctctctgggccacttggtgctggggacatgccgggagctggtggtcagccctcctcctgcctcctcagtgctgcatcttcaccttctgcagctgcctaccagaagcagggggacctggaaggcaaaggagagggagttggcatgtagtgagcaccgactgtgcacacagtgccagcaaggagcttcacactcatctccagcgtcacagctgcccagtggctgtggaagccgatggactgggccctctcccagtacacaatcattagagggtctcagttcactgagtaactgtgggagcagcacggtgcctccatcagcccccagttctgctttcgaaacatcgtcaccatcgccaaagcaaagcctcagacctgcaggccagcgctcccatgccccatagccgggagtaaaggacagatgcggggaatctggaaggagattcacttcaagcaccatcccactctatttgttaaacttgtgctcctgtgaaaactgcttgtgtctgcatcaaacccagctagggagggctgagggctaagggtaaacctgggagagttgaattccagtgctgtgattaaaaccaatattccacataatgcaatgtaacttgctcacatcgtcccatgtaatctttaaagccacagcccttttgcaattgggattattatctccattttacactggaggaaactgaggctctaagaggtgaaatgattcacccagttaggaagtgatgagtccagatgtggtagactgaataatggccctcacaatggaacctgtgagtgttcccttagatgacaaagggcctttgcagatgtgattaaattcaggatcctgagattgggagacattatcctagattatccaggtgggttctaaatgtcatcagaagtgtcttcataagaggaagacagagattttgctacagaagagggggaaacatgatgatgagtcagaggctggagtgacacctggaaggggccatgagccaaggcgtccaggtggctggaagccagaaaaaggccaggaaatgggttttctctgtgagcttccccaggaaaccagcctggccaacaccttgactttagcccagtgcaactgactccacatttctggctccagaactgtaagagaatacatttgtgttttgttaagctagcaaatttgcagtaatttatgacagcgctatgagaaaccaaaacaccaggattatgccccaaggatcctgatgccctccctcctctctgctctgcagtgtgctggagctcacagggctctgctgctgggagttagtatctagtccaacactttacccactcaccccccaagctaagggactcctgaaatcagggaccagatgcataataggtgcccaggaagtgagactcgccttccccagattaagaataaagaagacaaactatccacggctgctgtgagcctctcatcagacctcagcttctagggcagggtccctgcctgtctccagtatgtggcctctgtgtcttcttcgccctccatccccacagtgggacgagaagtcatcaggaaggcaggggatctgcaggcagccatcagggctctaattgcagctggctgggggaccatgggtcagggctgccaccccctggctctgtgccttcacctgtgtaacgaatggggcactcacagcccctctcaagtggtcctggggatgaagtgagaaggtgacatatacaagtgagttatacacgttcctgttctgtcactcaccagtgctcactgggtgggtcactgaactcccctcagcgtttccttctccatctgtaaaccaccagtgcaaacctttcccagatagtgctgacccgaagcaggaaccagtgcccctctgccctcagtaagtctgccagcagaggaagcccatagagggtcttgggaaatgaagccaacagagtcaagagggtcagatgatgagggacttcaagtgccaccttcatcccattctttctgcaaatattcaccacacacctacgtgacctcaggctctgtgtcaggtcctggggatgtaatggtgtccatgaagaaacaaggtccctgccctcatagagtggcctgacatatgcccgaggcagtcagcagccgagtgcgggagactcttgagcagagattgagtgtgttgatatctgtaggcatcagcctggctttgctgagtgagctatatcagagtggaggaggccagaggcaaagtccagactccactggatcctggattgaggggagaaggggctgggcggaggagcagcctgagcacctgcatctcactccaactgggtgctgatttgtccccatggccccagcacccaggcaggtcaccaagtaagctcaagacaaaaatgatgagtgactcaacagtgtctggggacaagggagggagagaagaactcaaaatgactgaggtttccagctaccagaaaaatggaaggaccttgaaacaaatgggccatcagcaggggacactggctggaagcccagagtccagtcagctctgtaaggcccccagaataggcatttgacttcaagtcacaggcatttcagcaaaagcctctttgctacagtgattatggtgaagcagatgcccacagctgagatgggcaactctcaggcctccagtggggacagagaatccctgggccccaacatagcttggcctgaagatctgagtcaggcatccaacctcttctgctcagctctttcaggaagatgtgtatactggcctctcttgccgcaagggtccaccaccttccttatgtgtgacctaaggcttctagtgctggctcagtggctaatttgagcataagcacccttgttggtaaaatgaaggataggtgtagatcagcatttcccaaagtgtgtgcttctcagaaaattaggtccctggttgtctgtagaggttacttaacaaagagactctgtagttatgttagaaataaatcttatgattaccaggattagtctctttaaagcttgtctaggtgggtcacaaatccgcctcagtcaggctttaaatggggaacagggtttaaattggatttaaacatttaaaaaccatgctaacaagaaccaaaagaaagtgagagtagctacattgatttcagacagagcagacttaaggaacattgttagggataaggatggatattacataataacaaaggtgtcaatactccaagaaaacataacaatccttaatgtgtgtgcacctaacaaccgagggtcaacatacagaagacaaaaaatgatataaatgcaaggaggaatacatcagtcaactgttacacttggaggccttaacacccctctaccagaaatggacagatccagcaggcagaaagtcagtcaaggcatagctgaactcaatgacactatcaattaactggatgtaattgacatctgtaggctactcatccaacaagagcagatatcgtatttttctcaaacccacatgggacgttcaccaagataggccacattctgagtcattaaacatacttaacaaaagcaaaataataaaaatcatacaatgtctgctctcaaagcacaatggaatcaaactaaaaatcaataacaaggagatagcaagaaaatcccaaaatacttggagattaaacaacactcctaaataacataggtcaaaaaagaaatcttgagaaattaaaaaaaaatactctgaatcaactacagatcacacaaacatcaaaacaataataaaggaatattatgaacacctctatgcccacaaatttgacaacttacatgaaatgaaccaattctttaaagtaaataatctgccaaaattcgcacaagaagaaatagataatcttaatagccctatgtctattacagaaattgaatcaataacatcctttcgaaacagaaagcaccaggctcagataggctgattggtgaattctaacaaatatttaaggaagaaaatgtatcaattctctacaatctcttctagaagataggaacaaaggaaatatttcctaactcattctatgaggccaatattaccctaataccaaaaccagacaaagacatcagaaaagaaaactacagactaatatctctcatgaacatagatgcaaaaattctcaacaaagtatttgcaaattgagtccaacaacgtataaaaagaattataagccatgaccaagtgagatttatcccagttatgcaaggctggtccaacatttgaaaatcagttaatgtaacccatcacatcaacaggctaaagaagaaaaatcatataatcatataaacagatgtggaaaaagcatttgacaaaatctaacccccagttgtgattaaaactctcaaaaaacaaggaatagaggggaattttctcaccttgataaagaacatctacaaaaatcctccagctaacatcatacttaatggtgagaaactagaagctttcctactaaggtacaaggcaaggatgtcccctctcactcctccttttcaacatcatattggaagtcctaggtaatgcaatgagacaacaaaaggaaataaaaggtatacacatagggaagggaaaaataaagctgtttttgtttccagatgacatgattatctgtatagaaaattgaaaagaatcaacaacaaaaacaaaaacctcatgtaactaataagctattatactgaggttgcaggataaggttaatatacaaaagtcgatcactttcctatataccagcaatgaacaagtagaatatgaaatttaaaacacactaccatttacattggtaaggtatatcccaaaatgaaatacttataatctaaataagtataaatcaaataacatatgtacaagatctatatgaagaaaactacaaaactctgatgaaagaaatcgaagaagagccaaataaatgaagagtattccatgtttgtggataggaaaccttggtattgtcaggttatcagttctttccaacttcatctatagattaaatgcaatcccagccaaaattattggttattagcaactattaacaaattattttatggatatcaacaaagtgattttaaagtttacagagagaggcaaagactcagaatagtcaatttaatactgaagaagaagaaaaaagttggaggattgacacaacctgattcaagactaactctaaagccatgataataaagacactgtggtatgggtgaaaaatagacaagtagatcaatggaacagaacagaaagcccagaaatagacccacatgaatagagttgactgatctttgacaaaggaacagaggcaatacagaggagcaaagacagttttttcaacaaacagtgctagaacaactggccatccacattaaaaaaaaaaaagagtccacacacaaaccttgcacccttcacaataattaactaaaaatgggtaatagatctaaatataagacacaaaactataaaactcctagaatataacatggaatcatatctagaagatcctgagtatggcagtgactttctagatataacaccaaaggcacaatctgtgaaagaaataattgagaagttggaattcattaaaatttaaacctctgccctgtaaaaggcaatgttaagagaatgagaaaataagccacagactgggaaaaaatatttgaaaaaatatatatctgataaaggactgttattcaaagcatacaaagaactcttaaaaatcaataattagaaaattaaaaatctgattcaaaaataagcagaagacccgaacagacatttcaccaaggaagatatacagatggcaagtaagcatgtgaaaaaatgctccacatatgtcattagggaattgctaattaaaacaatgatgagatgccactacagaactcatagaatggccaatatccaaaacacttaacaacacaaaatgtaggtgagaatgtggagaaacaggaactctcatcagtgcttcgtgggactgtgcaaaacagtacagctgctttggaagacagtttggcagtttcttacaaaactaaacagacccttaccataagattcatcagtcatgccctttggtattcacccaagtgaaccaaaaacttgtgttcacacaaaaaactgcatgtggatgtttacagcagctttattcataattgacaaaacttgtaggccaccaagatgtccttcagtgagcgaatggttaaataaatgatggtgcatcctggcagtagaatattactcaagactaaaaagaaatgagctatcaagccagtagaaggcatggaggaaccgtaagtgcacattactaagtgaaaaaagccaatcatgcttccaaccatgtaacattatggaaaaaagcaaaactatggggacagtaaaaagatggctggtttccagggttgtggggaggaagggatgattaggtggagcacaaaggatttttagggcattgaaacagttctgtatgctactacaatggtagacatatgtcgtaattcatttgtcaaaacacagagaatgtaccaggagtgaaccctaatgtaaactatggactctgggtgatagtgatgtgtcattgtagattcctcagttattacaaatgcatcatcctggtgtgggatgttgatggtgggggaagctgtgcatgtgcgggagtagggagtatatgggaactcttctacttcccacttaattttgcagtgagcctaaaactactctaaaaaataaagtttattaatcaacaaagaacacagtgagctgcaacttcataaccagtagattgacaagaattaagaaatttaataaagaattgattagaatatggagcaacaggaactcttacacattactgatggaaaagaaaattggtatacctactttgtaaatagtttggaaatgcctagaaaagttgaatatgaccccaaaatgacctaataatgccactattaagtattgaccctaaaaaattattgttgaacgcattttttaagagataaatgcaaaaacatttgttgcagtatcatttcaacagcaaaaactggaatcaatttaaacagctctcagtggttgaatgaataaactcattttatgcaaaatgaaaataaaaatagatatgggaacaagatttactatcaagtggttttctcaactttcctctcttcttaagaatattttattttgcctgccatcaaaacttttgttccagggcatccatggtccattgtttagtttctgcactgaacaaaggctcttgatgaaggagtgagtgggagctgaaatccagccatgctctgctccccaagccatgcatttgggtgcaggctctgtctctacccagagagaggaggcatcttttacttcagatattgatgtcatctattccccaaatccagtgcttacaagtctggatctgccctgtgggaagtatttttcaaattcatctactcagcctgagcatcattttctaactcacacaaaggcattttttagattagtaggagcactgacctgttcaccacccagcctatccatcctggtacaatcctgttgtaaccaagcaggtacccaggcctttttaatgcagcagagaaataggaagtgaggcaggagggaggcaaggtgatgtcttgtcttttctttgtcatgaaaaggtcaggaaagggacagatagagtgaaagaagattggaaaataagccagagaggctcggttgttcttcataacaaaaagaagttgggggtaagtaagagaaagagccaggaaagagagccagaaaagtcccaaaggaggggtgccctggggagccctcttgtgctttatagcatgagtggctcctgtgcagttgggagaaggaagaacatcagaggggagagaaaagggaattttaagaaatattgctaagcgttatagattagataccctttaatgtaaatattcaaattcctttttataaaaaaagatatattgaaatataattgaaatacaaaaaaattgtacatattaaacatatctgattttattagtctggacatatagccagacctatgaaatcaccacaatcaagatatgaatataactatcaccccccaaagtttcttcatgtcctttttaatcccaccttccatccctcccaccctgccatcccccacctcaggtaacactgatctgcttcccgtcagtagagagtagtttgcattttctacagttttatctaaatcagccacgcagtatgcattcttgtctggcttcttttattctgcattattctgggactcattcacgttgtgtaactgaatacttcattcctttttattgctaagtagtattgtagtatttctttgtatggatataccacagtaggcttattcattcatctatttatagacaattccaacttttgactattacaaataaagctactatgccattcacatacaaatctttacgtggaaatgctttcattcctcttgggcaaatacctaggggtggaattgctggatcacatgatggatgaaaccttaactttttaagaaattgcgaatttaggattttccaaagtagatgtagcattttatacccaccagctctccattaataaattggatttcatcaaaaatttaaacttctgctccaaaagacactcttaacaaagggaaaaagcaagccacaatatgagaggaaatatttgcaaagcatctgataaaacatgtggatctaaaatatgcaaggagaataacaactctattttccactaaggaatgaatgactgtacaaggaccacattctaattaggagcttctgaacccaaaggaatttcagataaggggaaatttaggcccaaagccaggagaaggggtgagtagggcttgatctctgcctctgaagggcagagggcgtggactattcttggctcttaggggacagctagagaaatgtgggtctcatggcgacaactctggactccattggaagaaccttctaacagtcagggctcccagagataaactagacaagtcaccaagagaggcagtgggtacccctcacaggaggggtgcaaatcaaagccaaggcttggagtggaccatattaaatccatttcttatcctgtgattcttagagtcctatctgtatcaggggaaggcaggtgggttctagaactttctaaatgtgtccctgtgggtttttccttctccagctacacacaaacttgggcctaataagaagtctatggcattaacccagcaggaatgcttaatgcttatatctgacctcaaaccaagactgtctccacagtgaacaaccccgtcctgtcccctgggcgtctccttagcaaatgccatcagtcaatggtgcagccatcttggagcccttgccatctataatcttctaccgccacccccccagctgattgttttctttgtatgtctccttcctggacattacttattctttacttttaaatatttgcttccgtaaaaaaacaaatgaatgcctcggacagatttataaagaacattcctggagaggcgggtggattaattattcagcatcctctccctttgtaactatttattgtctcatatgcatttatatggtacctatcactgcagatctcgctccatgctggagacataatttccagtgactgactacttgtctaagatatatatcgtattgcaatactattttatttctgactgtaagggcacgtgccactgttgggtaattgtgttcatgtttttaaatgtgaaaaataatcaaatataacttgaaagagattgtacagtaattcaaggggatattaaaccaccaggaagttactcggcaaataaataggcgtttgtggctgtcacgctgagcaatgaggagctggctggctgtgggggagggggagacagagagaggaagacaaagaggagagtgcagtgtgagtgcctggttgccaggttagttgtgttgggggaaaggagcttctaatggccaagaatagaagacctgaagttggctagtgcgtggctagtgcctgtaatcccagcactgtgggaggccaaggtggatgattcgcttgagcccaggagttcaagactagcctgggcaacatggaaaaaccccgtctctactaaaaatacaaaaagttagccaagtgtgatgacacatgcttatagtttcagctactcgggaggctgaggtgggaggatagcttgagcccaggaggcagaggttgcagtgagcccagattgaaccactgcactccagcctgggcaacagattgagaccctattaaaaaaaaaaaaaaaaaaggaaggaaggaaggaaggagaaaagaaaaaagaaaagaaaagaaaagaaaagaaaaatgacctgaagtcactggatttccttcgaggtagccagaaacagaggaaagggggcattgcccacttagggtaaaaagtagagcaccgaattgtggaaggctgcaggttttcatgtgtgcttgcccaagtgatgttccatgtcaggctctagggtccctgcagggacagagagggactaacatttacttacatgcctatagtatgtcaggcatatacttgtgcctttatatatatcagctctgtttttgtcattaaaacatccctgtagaaagataggcactgctgtcccattttacagatggggaaacccaagctctgagtggttcagcaaaccctgggtgcatacccccaccttgcccctgcaaaaccaacaaaaaaacgaaggccctgccttcctggagctgacatttaggttgattctgaaagtcagtaggcccagattttcactcttcatttttcttgtttggaatgagagagcacacagctgggtcgggggaaggagcgagggtctaggcctgcatccactcaccccaaaggaaaggagtaggggaccagtctgctggacatgcagacagcgattggagaaaagtcagcccagctatgaaccccattcctttcagtatgagccaagagggatggcatctgtcagagttgctggatttgggattttgcatcttgccaagtgtccatgaggaattggggaaactctccccctggctggactgaggcttcagcaagcattgttgctgcccagtggtgatcagctcagtgtccttggaaaagagcagaaagtggtatcacgaacatatcttctcctttgcttccttctcctcactcttcatcatcatcatcatcatcatcatcaaatatggatctgtgaggctacctctggggttgaaacttggttttgggcaaaatttgtgatgttctctctgcccaatccagcctcaggctacaaatgaatgtaaaaatctctaatttagtgccaagtaacagaaaacagctctacttatcttaagccaaaaagagggacttctcagaggcatactaatggaggatggcaagagggcctcacgtggaaccagggcctggagcggcacagcattcaggaagctcagtctccttctctctctctctctcatctctgcttgtttccctttacctgtagacatgctatcatttttccaatatccatggcagaatgtggccaccagtaactccaggtgtataacagaagcctggcctcccaggagagggtgacttgatgcccttagctccagccttccactcccaccctgggccaagcaactggtggccaggaggagctcatattgcaggaatattgaaattttcactaaaatcatttgaatcgaggaggacatttcctagaaaaaagggtgctagtctgacaagcccacagtggtccccttcatctggcaattcatcttctgcaaaggtcacaccatccttttcgctttccaacctctgcaccagtgcccaagtctgtcactccctcctctcattctgaaacatcctctgcactccattcaccagtgccaagccttgcccttcttcagggttcaactttgtcccaccttctctgagaaggctgccctggtccctgcaaccgctatgagctgccttttctgagctcttctgctgtggaggatccatgccattgacctaggcacccgttttccacatattgagcattgctgagcacctattctgtgccaggcactgtgcttcagggccatgggggatgctccaagcggtaaaatgcaaccaaagccccgaaggagctcacattctagtcatgtccacaaagaggtaataaatccataaattgtatgtactattctagtcacaataaaattgtgtcgtactgtaatgctgggtatccattttaaaacggggggcatcggctgaatctgggtcattacagtaggaaatgcatatatataatcatttactcatgaatattaatgtatttaatgagggtaaaagatattacttaaagcaaagtattcgttccagctactgttggatttgttcattactgtttcccatgcagatattacctgtgatttacctgcatatcaagcatctggaagtagctcaaatccacctgtgggtaaattaggttagccatttgttggcaaaaattacagtgttaactaatttccagggtatgcttgcagtcagtagtttcatacttaggtacatgacttgcattcacatcatctggttaatggtgtgaacagagattttctttatggtttttggaatacagtaagataatgttaagctaacgtaagtctgttaacagtacctggttctgaactgtatttataaggtgtatcataaaaccattactttggagtttgccaatcttaaattcagaacaattcaaaaatgagccagaatctagtttgcatcattaccacttataaaaataaggatctgtaagttggctggataaaatatattacaaaataatgacttaagtggctctggagccagcacaaaagataaaaattgggtatactcaaaattaccttcaaaatatcttaagtcattcttaaaatacatgtaaatatgccaactcaaaatacatccaacaaaactaatatttttcccaatttgttggaagaaatttctctttctttagttgtgcattagatgaggaagtcagagtgcattaatattcggggccctgttgtataaaaatgacagattttcaatgtatgctaatatgcaggtcacactcggcccagtgagatgcttgcctagaggaggcacgtggaagccaaggccaaggaaggcataattcactctggagaacttctttagctggcaaagctcagtttctccccggatcccattttgctctggttgaattcgcatgcaccaaaccaagaccaaagagtttatgatgtggttcccgccaccgttggccaatagcaatttctaggcccaccttcaccaaggcaggtcctagatgtgttgctaggcatttggagtttactgagatctgcaaagctgacttcttccccagtttcaggtggttcaggctgttcttgcctctccttggtgtgtcagagtagaggagaaatgactttcagtgctgggaccataaccctgtttccactccacttctgacttgcactgtgggctgagaattgacattctgcttggggaaattttgttcccccaaccgtagcaaagtttaattaccatgttcccgctgtggggggaaatcctattcaagaaaccagcctctctcaaatcaatcagtcatcttgctcattgaccaatggttcggccacccggcaagaaattagaaaaatctatgcataggagaaagctttccaacagccctggaaaggccttgggccccaaagggctagtatgaggttgaggtgggggagagcaagagaggacaaaacaggctgggtactgaccttcctcgtactccatggctcagaactctgacctcttgccaacctgccttccgcaagcagcgagagtagcacggctctgaggggcatggccagggaggatgtgacctctaagtgctccaagtcactgggaaccctgttctaataataggcaaagcttcagttgatggagtgcctatatgggcccagccctgtgaacagcttcctctcagttttcccagaatgaagctcagtgcacacactaagtgtgcaagaaacacacaagaattaattgcaattttaagtccttgtgacaatcccaggcctgcatctgcagggagttttatgaaggctgtttatagaattgcgggaggggttaagagaaagacaagagagtgtgaaatgccccagaactagtagcaggaagctactaccatccctgagcctgaaggacagaacccagagagacagacctgtgctgtaggtcagggccccccagtgtgagcctcagctgccgctgccagtccccaactcaacaggagagagctggacaataaagaccctgtgagcacccacaacttcccattggctgcatcctgttagaatctagaggtcatgggagcctgggagaggccacccatgaagatcagcttccaggggcagagagcagagtggacatggaggggcaaatggggaccgtccagcacagtcaccatctcatagacattttcctccacctcctacctcgagtagccagtagggttccagccggactgtggagcatcatcccaacaactgcatggctgcttcccactgtccctttaacagcgcacatgggagggagccacaggtcagcaaggcccttggctcccgctgtggccctcacccatgcccatccccacccgtccccatgctcagcacatcagcttcactctggctgaccatgtgcacagacatgactcagtaagtctgtcttttcttttcttttttctttctttctttttttttttttttttgagactgagcctcactctgttgcccaggctggagtgcagtggcatgatctcagctcactgcaacctccacctcccgggttcaagcaattctcctgcctcagcctcctgagtagctggaactacaggcatgagccaccatgcctggctaatttttgtatttttagtagagatggggtttcaccatgttggccacgctggtcttgaactcctgacctcaggtgatctgagcacctcgatctcccaaagtcctgggattacaggtgtgagtcaccatgcccagccaactcagtaagtcttttgaatgtgagcggaggcccccactcagcatttccaagacctgggaaatgagggtgaggagggggccaagagctctgatttcaagtcccagccctgccacccattccttagggcaggcacccaccaccgccttggctcaggcctcagtttccatctggaaggtgctggctgccttgatgggcctctatgggccctccagctctgtggctccatgtcaaatgcccctgaccacccttgagattaaccctttcccaaggatagacagcttcccccatcattctagatccctcacacttccccagctcctacggaaataacctatcccatcccctaagatctgcaactgttgagggtaagtttttggttaaaaagagtgagacagactttggcgctagtgcaaaacaagctgctgctgtaagagtgcatgtgtgtacctgcagactggtgcaatcagatgaccttcccaccaggctgcacagcactggatgtcctcacagtcactcagccactcagcaaactttgactgcacagcaacccatgccagacctgctgctggactccaggcatgttgagaaatgaatataatacccaggctatggcctcaaaaccttcaaaacccagggcaggacacagacagggacacagatgtgatacctgctgggatacagtcctcatgaggctctctaagaggtatctaagcagggacctagagggaggaggtattacctgagttgaacctaatggaaaggcattgcaggcagagggatcagtataagcaaatactcagaccaaaaacaatggcatgggggactccaccaaagaagtaaaagagaatagggtgctacatggtgtctcagtcccttttctgttgcttagaacactgaaactaggcaatttataaagaaaaggaatttatttcttatggttatggaggcttggaagtcccaggttgagggagcacatctggtgagcccttcttgctgggggcaggtactccctgcatagtcccaaagcagcataaggcatcatatggtgagggggctgagtgcactagctcaggtttctcctaaaaacccaccagtcccactccccaaataatccattaattcattcacccacaaatttattaacctcttaaaggtcctacctcgcaatactgccacattggagattgagtttcaacatgagtttttgaggggaaaagtattcaaactatagctcacagagatcgcttttcctagagatggcagatgaattttggaggtagagggagaggggcagatcacacagatctcatagtgtgtacaaacctgcccttcctgccggtggtgggcagctgaggaagggtctgtctcatgaaccattaaggctgcagagtctagcacagcatccaggccacagcaaaagcatgagacatacttggtgagtgagcaagagaatggaagaagaaatcaatggagccaaatgactccaccagatttgcatttgagacggtcactgcaagactgcaccagtcccaaattcccaagacagcaatgttttccacgatgggtctgaacatgtaaccattctcaggttcctgttgggggtttgggagcctagaaactgagacagcctcacagctgacagatcacgagcagccatctaagtcgacgtttccaaagtcatggggcctatggtttgtgagcttatttaggttgtccccgggcccagcatcaaaagcattgagacacgtactgagggactcttttcctagcctctcagtcctgactgctcaaggaccaagtggtacttcttgcctgcgttcctttaatgcttgcctaatatgagctagtcttctctgatcacttttttttttaatccaaagtaggtgggcattgtcccaagagcctttggaaagcagctgcctctcactaggacttcacagcatcattttgctttgctctctttgtggttaaaattaccttccattcgtggtgggtgtatgtcaggatccccacaagaaacagagggacacccaaattagggacatacttcagagggactaatgacaaaggcatgggtgggagtagaggggaatacaagggagacttcaagaatcttggcctttattataaatgcaatgtatgtccactatggaaaatttggggaaaaaagcaaactagaaagaagaaaaaccacattgcctgaattcctactgcatggagagaagcatcataaacaccttttggaggagtctcttcttcctttctccctttctccttctttgtatagagaggtctttcctgaggacttcccagaatcttgcagatccaaaatcttaagaatttgcagaggcagtgaggagttaacatgcacagctcagggaatattctgctttttatctggaaccaggctcggaacaagactccttgcttttctgtcctgtgttttcatcttctctcagaaccctaactttgagataagatctttgactattattaggcgggtgcaaaagtaattgtagtttttggcattatttttaatagaactgcttctgtgtcctcagatctccatcgttcatctcctgataagtccctgaaaatttcctggccccttggagctccttccaggagtagaatgatcacaagagctgccatgtattgcttattctggcctatttccttaggcacattagcccatctaaccgtttccatggcccacagaggtgggaggagcatgaagaaaaatgcaaggaaataagctcatctcaaggtatctctggctcccaaagaacataggacattaccaacttgaagttagcttctcaggaaactaagacccagctgcttttcaaatcctcaaaatattagtatgaattatagatatagttatagccttcagaacttctggcacagcccaaaactgttggctgtaaaaccatgtttcctaaattcaatcatgtttctcattgatttccattttgaaattggaagtctttgccctcaagatataataaaaaccataccaaagaaaatggaaaacttttcccccttaatatttaaaggagaatgatttttataaaaaaaaaaaaaaacattcatttgtctacttaaagtaaatcacagtgcagtgccagtctgggtttggagcataacactttttttgatttatggtttctgccaggagacacccagctaatgatatttgttcctatgtccttctctgactagctgggtggcagctaaagagctagggtgaggggagaccagaactccaggcctgtcccatgttcctgtctcacccatatgtggatttcaaccctgggcttagtgtctgcctctagcgacatgggaagagagggatgggtcctctccttcttcttgtcaaatggcccccagagtcccaccaaggtggagctccaggctcctgaccagcggggctccccaaccctcctgctgtgcccagtctatccctccttccacgcccagcagagctcagcagacttgcccttggccactcttgtgccttcactgctgtgtgtcctggacaggagccagcgtgggcttgctgatcacagagaaagctcacgtggcaaaagaaccagtgagattaacaagtcgaggtttgggatatatcttagagatggagccaatggggcctgcagaggatttccctggggactggaagggtgaggaaggagaatgctctcagatgacacctaggtggctgatgtgatagaatgggcattttctggaagatctgttcaggggcatttggtgagacagaaatcaagggtttggcttgggacctgatatgtttgatcaccctgtcagccacccaggtggagaggttgaggagatggctgatggcatgggtctggagctcaaaggagaggctgggtgaggcttgagttacacatttgagggcatccatgatgtgaagcacatgggggggcccacacaggggtctgtgtgttcccctgtggtgtgtgtggggacacgtgagtatgtgtttctgcgtgtacattgacatgcatgactcagaatgtcacatccatcacaatttcctgtctgaccttggctgaggtatgtctgagttttaatggcctgtaaaatgagggggtgatattagatggcatctgagacccttgccaactccacaattctaggagttggggaatcccaaagatgctgccatccctggtttgtttgggtgaacaggaacagagaagtcttaagaccacaagcagtgaggttagatgcgagttctgcacctcccctggggccttcagcagctgcattcttggcccagcagaggacttgcctgatctccaggatagcaaaggagctgaggccaaaaagacacatgggctactgctcacccagccccatattatacccttttcatcgctgcaattcaacataaaatcatatcattcacacctacccactcatgcattcattcagcacatgctcatttttgaaccggcaaatatatattagatatcgatgctgtgctgaatgccacagattgcaacaggaatcagacgccaacctgtcccggaggagctcacacatctttccaaaaccaatttctacttcttgggtcccctctcaatgtgtacaacatagagctttccttgcaaggctcgagcacaacgcagcagtcactccttgtctccaggcctggctgtagacacaatggaggctcctccttgccatctgcactccagtcaggggaggacaccaatccactaccaaatgaccatagccagcatttactgaatgtagacacactgtaggtagcagatttcaggcacccaatccaggtattgcaggaaggtagcttctatttttctataactgaacttgacttctttcttgggtcctcattctgctgggcatggatattttagttttagtttatttggggtaagctcagccagtgcaaagagtttgcagtctaggtagggtgttctttcccttctcttcccactagagaatttataaggtgccctggcactgttgagggaggagctacccgggggaggaatgaccctccgtcactgaaggctgtgctggaatcacatttcctctgtctccagccctgagtccaccaaagcatccatttcttccaggtttaaccacaaggcctttccaagactgcccaggtctccgctcatccttctccaggagatgctaatctctcggagaatctcctctccaatctgaggactggggcctttcctgccttcctgccaccaaacaggcctggagtggaggagagccagaagccttgccacctccccaggctacatccaggaagaggcaccaagcccacttgtcctgaatctcaaagcctacttaagagcttaggttctgttgtcacaagatcatgggcacaagccctcgcctggttctagagagagtggggtcagaaacactctcagcatttgagtctctttctcctcctctgtctatcctcctttccctctggcccagagaatcttcctccactccctggagaaaaacctatcccacacaccctcacatattcttcaagatctattggttaaggcatccaacttattgcttaagcatttcaaggactggactttggaaagccaagaatctgagttgcaaagtcttccttaaaactcaaaaactgggctcataggtgctcttctctttttcttggcatttgcctaaaagccaccctgaggacacctaggagaggccacctcaccacttcttgaaccaggcatgggggatggggaagaagacactggggaaaagctctgagtggtacttcagatcatcctgcctcaggtgttggttctgatcctctcaacgactcccaagggaatatgtcagctccattttgcagactgaaacccgagtctcggaatgacttgtccatggtcacacagttgctaaacatctgagccagagtgaaactctggggtatttgactttaaagtcccagcctttaaatcatcccacacttgcttattccaacttggacttgccggagtcccatagacagaggctactctcccaccgtgctgaagctggtgcatgccatgtttcagtaagagaaaggagggtgcctgggcttcgtctccacccaggtgcctctcccccagcagctgcaccaggccagctgagggggattttagcccgaatccagggtttctcctacagaagacaaggagtttgggcactgccagaattagaagaacagaaagaaaatgttctggatttctcatcaaatgcccctagcctgagaaatataactaaattcacccttaggtcatcttacaatctgtcctgccccagtgttccccactcagggaactgctccacccacatcctggtccccaaaccagaggcctgggagtcacccttgacatttcctcccctacacccctaatcaatcaaatcctgtttatcctgccctctgagagtctgcaccgaaatctctctcctctccttcccacctaccatggcccagcagctttaccatcatgtctcacggatctctgcaccgctcccaactggcctgtgcgttcactcctgccccctcctccagccctgtgtacactcccttccaccatcctttctatactctcctcaatcctatctgcaccctccttcaaccctgtctgtactctcctccaatcctgtccacacactccaaacaaagtcatatttccaagacaaatttgaccatgccactttctcccacagctctccaccacctccaggatcccatcctcagtgttagccagacactcccaaggccttgtgatctgccctgcctatgtctccagcctcatcctgcaactccccctacactctgtgttctggccatcaaaccaatgggctcctcttcctgcacccccatccactcttgcacatcctgcactctatgtctgaacagctcggtttctcttcttttcttctggcacatgtctgctctacctgcaggtcatcttagatgtcacttctcctaggaaggctttcctaacctccaaaacaggctcagttcccctcttcaattctcactgagcctcctccctagcatttccctctctgcattataattcctccctgtgcaagtgctcatctccccactgcactataagatctaggagggtagagtctgggtcccattcgtttctgtaccctcagtatttagtagagatggggtttcaccatgttgcccaggctggtctcgaactccagagctcaggcaatccacccgcttcagcctttcaaagtgctaggattacaggcatgagccaccactcccggccctctgcattcttctatttaaaactatttattgagatctactattggctagatttcggggatgaaaaaggcagacaaggcgccctgccctcaaggggttttcagtttagtggggagcaaagcaaaaagacaaacaaacagttaaatataacatctagtagtgataaatactccaaagaaaactaaagcaggggccagagagcatgggggcattgatgttttagacaaggtggtaaagggaggtctctctacagaggtggtatttcagcagcagcccgagcactcagtaggtccatggtaaaatttagttgactcccgaactaactgagtgtctcactcagtgaaagcctctaatccattttgctagaagtctttccctgtagctcattttgttccaagtcacaagcatcaggcttggaagacctgtgtgggagagtaattaacctaatacacagcgcggggaatggaagcccgaacccccagaagccttttctgcaaaaggaccagggcttgggtaataaaatggggctttcattctcattaatggggcaattgatttaaagaacagacccagtggcttattgatcagtgttaatcattagaaaatgctgacttaatgaatctaactgccatgaggcccctgtgggatttgggaaggccagttagatacaataactttgtccccttccagtccagcagacagatttatttacagaaatctggattttttttttctggaaaaaaagtcaaagagtcactgggggttaagccatttctccagctgatctgagagatcatcccaagcctttgtaatacgcctgtctctcctgccatgctctgttcctatctagcttttcaaaacaaactcttcattttagaatagttttaaattatagttagagaaaaacttcaaagatagtaagagagttcccatatcctgcacacctggtgagccccattggtaacagcttaggttaacactgtcaccactaatggacaaatgttgcaatattattatttgctcaagtccatacttaactcagacttccttagtttttacctgaagtcctttttctagttcaggatcccacattccatttcgtaggcatgtctccttagactcttcttggctgtgacagtttcttaggcttccctctgttttgataaccttgacaatattaaggagatattgggcagatgactgtagaatgtccctcaactgggtcttatctgaagtttttctgatgattgcactggggtttggggaggaagagcacagaggtaaagtaccattcacatcacatcatttgaagagtgcatgttatcaacacgacctatcactgctgatggtgacctcgatcacctggctaagattgtgtttgtcaggtttctctgctgtgaagtcattttcctccctcccctcttacacactgggctctttggaaggaagtcactgtgtgcaactcacactgaaggagtgggaagttagagatcctccttgagcgtgggccatcttcatgaattattgggaattattctgcataagagatttgtttatattaatatgagctcatggatatttatgttgacactttgggttataatccaatagtattttacttcttttcttgctcaaattactccacctttgggtactggggctcttgcagttggctcctatgtccccgtcattgaggggtttgggttttgtgtgtgtttgcgtgtgtgtgtgtttgagcacttctttactgttggcaccaaaagatgcttaggcttgctttgagcatctcctgccctggccctggagccactccaaggaacctccaagaacgcctgattccttttattactggctcctattataattttcataatgggctgtcattttgttttgtctggttttgtttataattataagggtaagtcagctcattgcataaaatatagcaaagatataaaagaataagaatgaaaataagtatcccaaataatccaagcagcaaagaaatccagcgttaacattttggggtattttcatctggtctttttgctagttgctggctcttaagaagtctgtgctttcattcttgatctctgccagaccaagggatatcatgggccctggtttacctccctgtcccagcatctgtggttggagcagcttccatttggccatcctcaggtggtctgctcgctgggcccctgcccacttctccctccagcagaccgcaggccaagaggccaggagccagggtgtgtcctccagcagactctgaggaagtgaatacatcactgttctgtgacttccaacgtgatagttggcctcattttcctcttctttacgaagtaaatgcgataatatatacaaagtgctcagagaaaggcctggtaagaaacaggtattttaaaaagtaaaaactgtcggctgggcgtggtggctcacgcctataatcccaacactttgagaggccgaggtgggcggatcacgaggtcaggagtttgaaaccggcctgaccaatgttggagaaaccccttctctattaaaaatataaaataagctgggcggggtggcaggcacctgtaatcccagctacccgggaggctgaggcaggagaattgcttgaacctgggaggcagaagttgcagtgagccaagatcgtgccattgcactccagcctgagcaacaagagtgaaactccgtctcaaaaaaaaaaaaaagtaaaaactgtcattattataaccataattactattagcaatctgaagaaacacatatctaatgatagaagttcaggcatagtgtggcaggcaggcccctgggagggatgaatttgcacaagcaaactgccttctccatggagacctaatgaaattcatccggtccttcttgagagtttgactgagttgggaactgtgtctccaccagaccagcaaatggaagagaagtttcctggggctctagctgaagagtgtgtactgaggggcagtattgcattgtggttgagaacatgggctctagagccaggctgctcaggttcaatgcccagctccatcacttacctgctgggcagcagcctgagttatttaaacctcactaggcacaatgtaaggataacaatattgactatcccataaggttgctggggatgccaaataagttcacaaatggaagaactttacacagtacctagcacagagtaagcagccaattaatattactcgagttactgtttttattacttcatcattcgggactcttccggttgcaagtacaaggaaagccaacccagaatcacttaaacaaaagggaatttattggctcatgtaactgaacttcaacattttacagaatctcattggctccaatgggctcatacgtccatccccaaaccaatcacagtgactgagggattatccaaggatcacactggccactttcacaggttttatccctaaaggaaatcacaggtaatagatgtggggctgcagaaatgcaacatgcacttttccttgaaactgcatcccttttccctgaagatgaagcttgaaagaactctaagaggttaagcatggagctgatgggcaagccacaggcagaaagagtagctgtgcagccaggctcctggccagggagggcagataaggaggggaggcaaagtttggtaaacaggaagctaatctatgggcaagaatcattttcttcagcatcctgacctctcctaaaatgttctccactggtccctgctaggacaaaggaattaccaccagactagagtcaggagtcctgggctggttctgctgtatgacacaggacaggtggcttgcctggtctgggccacagcctcctcccctgttgatgagcatgttggttgttccagcaccatgtcagccctagaaatctctgaattcttgaccagatcagtaattgctctcttgcgtttacttttccttcaaataaagagattggcatacaggggaggagcccagtacagacggcatgcttggctcaggttccagaacccagaaaccagacaagagttgggaaaccatgatggtggaggagggtgtgccactccttactagtgcctaatctcttcgagacactaatgtttcagtattatccacagattctgatgccaggcagcccagatgactggggtcagttattagcatgcttcctggaggtggttcccaggtgcaggctacctgcagtctggctggatgggccctgcaccacacttgcttctgggaagctggttttggggttgccacaatctctgaaagaatcactaggccaccctctgagtgggtccttctgtaggaattatggataaaattgttccactagtcttaccttcttggggaacccttcctggattcccaggctgggctgggtgtccctgcagcctagccccacagccctcctgcttctctttctcatcacagtcttgttatctctaccaactgtaggcctgccccactgatggtgtgaataaagggactgggtctctctagcacctagcatagatctgatacatagtgggtgatctctattgaatgaacgatgaatgaatgaatgaatgaatacatttagataattcagattactctttctagctcagcagtgtaaagcaggaagacatgctgtcaatatgatttagggcaagttttcaaatctctctggacctcagttttacctcttgaaaaataaatataataatttgtccttacttcatgagactattttgaagattaaatgagataatgtatacactactactcactgtccttacttgaatattcctaggtccttggtgctacattaggctacatagaatgtatttaaagtaatagagtggtatttaataaatattcattttctttccccagaactaccttaaattaatttgttgaaaggacagatggatggatggttgatggaagtagcaggcttccagcagcaggggatggagtgagtgtgtggataccgctggatcagcagaaggttataccattttagagtaactatctcggacttcggagagttcctgggtatgaaggtttggctttaattaaagtctcagcacagtgttaaatgccattttattttaggtcataattaacactaatgagatgagtggattacaaagagcacacattttgagaaagtgaaaaacaacatctgagcttggtggtttccattttcgcttttccccctcccatgctctgttcaattaaaagttttgagaaaatattacaaccatactccttgtctttgtggtaatgaagcatattaatttgaatgtgatgaatacaatattccactgacttttttattcccttatctacaaaagtttaaaataatggaccaattaaaccaggagagaagaatgcagggtttgcctggggatccaattcagcaaccagagaactgaaagaacaaaattttttgacggagtctgggccagacttcatcccttacctatagctgacaaacagtaagtcaaattgggcagatgtggaccagcgcagaacacatactatattgaggatcgaaaggccaggttccagaccgtcctctaatattttcttagtgaatatttgttggatgaatgcatggatgggtggatgaatagatggatggatggacagatggacggagagagagatggatgaatggattgttggatgaagttgaaagatgaaggtagatgacctcccatggtctgattcttcctaaggtagcaaattaagcctaggatgggctgacctaacccttccaaggacttagaagtcagggcaagaacttacagggaagggttcagttctctgacctcactaccctagaggcataaactataaattatagagttggcctgagctcagtttccctgggagctctgctctaaagcagagccccttgaccctgcaccaatttggttaacccgagtaaggctgagcttcccccagcaggagctcctgctttggaagagaacatcctgggccaggcgcagtggctcacgcctgtaatcccagcactttgggaggctgaagcgggtggaccgcctgagctcaggagttcaagaccaccctgggcaacatggtgaaaccccatctctactaaaatacaaaaatttagccaggtgtggtgatgcagcacacctgcagtcccagctactcaggagactgaggcaggagaattgcttgagcctgggaggtggaggttgcagtgagctgagatcacaccactgcactccagcctgggcgacagagtgagactctgtctcaaaaaacaaaaaaaaaaataaaaaaaaaagaagaggacatctggagcaggcctgtgaacctgacacatggtccaggtgtctccctgaggacttctggaagtctccccacctctctgtggtcctttaggcattaacaccaccttgtcactgtgtcttctgaggcagtctggaagttcataccccacaatctctgtgtaccttgtcccccattctgttctctgcattgcagatggtttaaaacacacacacatacacgcgcaaaatgttgttccttttcttaaaacccattgtggccaggctagacaaatccttaacacggtctacaatattctgcatggcatggcccctgggtgcctcccaacctgatctgtcacacaccacctccacctttgcctgttccctgggccctagcactaacctttggttcattcctagacaccttttcagcacttaggcccccacagccctcagaacctttacacttgctgtctcttttgctttaaatgttcttgccccacctaccacctagttaatgccttttcctccttcagctcttagttgaagcatcacttcctcaaggagggcagccctgatgaaactcattatgcaaactccagcctgggttgggccttatctttatgctgtcatggccctgagtattcttcctttatggcaccaatcacggcttatatgatatacttatgctattatttgagttatgtctgtctcccccagtatgccactagtattagaatcattgatttttaatcattgtatccctagtgcttagcacagagcctggctcataatagatgcttaataaatatttgttgaataaatgaatgagtgaatgaataaatgcctcattcaagagctttggctctttctgtactactacattacttctattttttagctcttaattctcaaagcactttctttgtgctgggcttatgctgggagcttagacagtaaagcttagatggtaaactacagttgctctcaagcagttcacaatgtaacaaaaaagagacacaaatacacagtgacaatacagtgtgtcgagtgctacaatagatggaggggtgcagttttatggatgtggagaagaaatccttctattcctcactggaggcttcactaaggagatattccctaagctgcttctggaaggaaaaggtattggccaagaaaataagggtggaggcagaatttcaggtgaaaggaccagcatatgcaaaggctcagagggcagagcctggcactggaaacaaaatgcaagtcacttcgtggactgagacctggatgaggacatggggctatgagagatgaggctggggagggagacaggggccagatcacagaggcctttcaatgacagcaacatatggcagctgcagagacagcatggaagggactggcatggtgagacctgtgatatggagaactccctctcgaaggggttcagaaaagagatgtccatatttcaagtgaaggacttcctcccctggagaaactgaggctctgccccagggctgtccatcagactccttcccagaatccaaacgcttccaaaggatgttcagtgtggctgaccttgcttattcattgtggggagaattaatttcagggtggagaattttaaaaaaatataagattaagcagtgtaatcagctgctgctgagagttgcaaatgcaataaataataatagcattgagagctgtttttaataactcaccagtgtaatttagcctcggcttcttagagcatatttaaaatatgtcatagtgtgtctaatggcaaatgcctcattgccagcctctgaagacaaatgtcttcccaggagggaggggggcagaaaatagaggagaaattggaggatttgattgcaaacagggtgtaggaaggcaagcattgttcattctgacaccactaattcaaaatctgtgatctttgcctaggcaataggttttagttggtttgtcttcaagggtgaaacagatggatagcaataatatggtaaaggagatatttataatttgtaagagaagaggttgttttcagaatctatagaatcaccattttcatgcagtccatattctaattacagatcatcctggactatctattatagcaggtccccaggcaactgatatcttgacaacatttgttttacttagttgagttactaaatattcatgataccatgaaaatgtgttatttaaaagtgttcgatgaattctgagttttagtaattcatatgtgctgtccccgcccaaccccgattagtctaaactggtgagatggggctaggagtcctcccctcttgggtaacagacttgacacagttaaagtgagacaaactttggagtcagacagacctgagttcaaattctagttctaccacttactagctgtgaccttttgcagcttaaacactgaggctctattcccgatctgttaagtgagagtggtgatgatgacgaccatgacagctaatatttatggatcgcctattgtgttatctccaacacaacgatacagtgacgtaggtctaccatggttcctgtttcacagatgaggaaacttgaagcttagcgagctcaagtaactttcctgaggcacagggctagtgaataaccactctgggacctagtatctgttctagctggtttcaaagcctatgctgttaagtgggctctgatactatcttgtacagttgggggaagatttgagaagacatgtgtaaggtatagttcctggtatgtaattaggactttataaatatctcttatatggaaggactgaatgtatcttcctgggctgtgtcctcgcagggagatataacatctatgtcactctcaacgctttattaatgtccctgtcactctatacccttgtccaagttactccacaccctccaaagcctcaagtttttaatctgtaaaatggtggtgggcggaggtggggagtgagcgctcttacacatactactaggttgggggtaaattagtaaaacaactttgggaaacaatttggcaagacttagtaaaaggtgcatagatcctgtgacacagcagttttattcctgggataaatgctaaagcaggttgtctccatctctgcactactgacatcctgggacagatatttcattgtgatgggggctgttctgggcattgtaggggatttagcagcatacctggcaatttattcccaagaggaaagcaatgaggaaggaaggaaggaaggaaggaaggaaggaaggaaggaaggaaggaaggaagggagggagggagggagggagggagggaaggagggaaatatttaatagttaagttacatccacaggtttgattataaatgtgtgtattgaattggaatttctgttgaaattctgatcccttctagacaaagaaggtaaaaattgaaacatgtcaatggatatctaaatatcattactcactggctttatttgcaaatggctttccattgacaacagttacattttgttcaaagcaacaaatgattggcgctgacaatccacaggaacatggtgcagtcattaatgaatgtgctcattattcctccctgccgggaggcatcgactcccgttctccagcctgttttaagcagacagacctacatctgcacctgtcagcttggaaccctagtaggggagggggatgctgatgtgatggagaatgaagaatgggccctgcaggctgacattttgggagagtaggttctgaaatttatcccaaaggacatggaatcctggaagcagggttcaagatcctcccaaaattgatctcccaggatgcttggaatgattgttccgagggttttgtaaaatgccaggggaaaaccaggaagcttctctccagttgtcttgcctccttcctctccagtctccatggagctgactttgagaattaactcctgagggacagagaccctgggatggagagccagccctgctggattccacaaggtgctgcttaaagcacaacacctcttcccaatgacaggttctgaaagaaggccttgtagctagatgcacagagggttttgttttgtttttttttttttaacctttcagcatctgtctaaaattgctctgggctgggtacagtggctcccacctgtaatcccaacactttgagagctgaggcaggaggatcgcttgagcccaggcgttctagaccagcctgggcaatatagtgagatctctatgtctagaatgttttttaattagctgggcttgctgcctgcacctgtaattccagctacttgggaggctaaggtggggggatcactcgagcccagggggctgaggctgcagtgaaccatgattacaccactgaactccagcctgggcaacagagtgagaccctgtctcaaaaaatatatatatataaataaataaataaaaataaatggccaggtgcagtagttcatgcctgtaatcctggcactttgggaggccaaggcaggcggatcacgaggtcaggagatcaagaccaccctggccaacacggtgaaaccctgtctctcctaaaaaatacaaaaatattagccgggcatggtggcacgcacctgtagtcccagctactcaggaggctgaggcaggggaatcacttgaacccaggaggcggaggttgcagtgagccgagattgtgccactgcactccagcctggcaacagagcaagcccccatctctaaaataaaataaattgctctgtaagttgacaccactaaaaacatcattagtagttgtaataattaagataaaggagaaaactgtgcagagcccagcacagtgcctgctccatggaaaatcctaatgacatttagtttccctctctttgcccccattttcttatctataaaacagaaataatgctgtatcctaactcaaaagttgattatggagagtggcatagtattgtttcaacaaatatttattgagaaactgcaacacgcaaatagatgtaaaaggttgaacagaactttgcaaattaaaaatcctaaaggacattttagaccttatgaacttcctaataggtaagactttttaatctatctgcagtgtccaacaggtgcaagagcttgggcggactgtgaatatctaagaaaagagagagagcagaaaggagggaggaagatgaaagaaggaagggaggaagatgaaagaaggaagggaggaagaagggagggagggagcgagggaggcgggggagggagagaagggggaggtagggagggaaagaaggaaggaaaggaaaggaaaggaaaggaaaggaaaggaaaggaaaggaaaggattacaggtgggagggagggaggaagggagatatcattattattgtgcaattgttatcattatataactaatttaaacaaacccatcctgtgcccacaaaagggcaccaagataaaggctaagataaagaacacacgaatcattttcccattttcgtcagtgatgggaatggtaatgattttctctctgaaccataaccatcttgcagttaaataattgctttctgatagaatcaggagctctgagatggtgctctgaggagttctttcatttctttcgcaccttttaaagaaaagaaaacttcaagtgcaattattggcattattttaataccgactgcagcagaacattctggaaaatgaggcccctatcaaattagtttttccaaatgaggtttagacagtaccttaccaggagaaccactcagaaagcccccatggcagcagcaagccctgttgagtcaagggcacatggatgtcacactgcacatgtgttttcagataactaagtgaactgctccgatcttgtgggtcattgcaccacggggcctctccatttacttcaggttacacagcaacaagcaagctgagagcagcagaagtagctagctaaaattgcatttgattttgtgactgctagaggccaatactcaagtgaagtttaagcaaaaacaaatcatactcagctgaaaacatttgcctggaagaaagatctgtggctggagaattggagttcatgcacccagcaatttccagaggaagtctgattcccctacctgaagtaacactccttcctctccccagatccagatctccagactatacgtactcaatatatgacttgtccatggggcccagctgagcattattgcctctagcttatggttaataataacagtaataattatactaatattattctttctatgcataattactaattcatcttaatctcacaactctatgaagtacatactgtgaatgtctctgttttacaggtgagaaaacttaggcacagagaagttaagtaactcatcatagtcacagagctaagtaggaggcagagttaagagtcaatgtaggcttctgacccagagattgtgctctggacctctgtgccacactcccacttactgggtatcagggactgtgctgagcagtttatggcatcatctcattttgttattgtaacaaccctatgctatgggtatcagtattattcccaggtaaggaaactggctccttttggagcttgagtgacttatcgtggtcacacatctagtaagtggcagagataaaattgaaacccagagctaaaattgtttggcaaaaacttggcatttgtgattgtgaccatcttggtttccaagacgcctgggggactctgcagaccatggccagtattcatttgtcaagatgcaaggacctaaactggaatccagtcttttatgatgtctggatcataacaaaagtcaggtatctgctccatgaggccagctaatccccccacaaccccacatccccctgacacacatcatcctcacctagagaaaccttttcacaaataatcaaacctttgtttctttaaggcaaatggacctaaggggaaaaaaaaatgcctgtcagtattgataaggaattgaagaggaccaacaatgtgaagattcttggccaaaaaaataaaatagtaatttgggacaaatttagtaagagaaatatcagaatctatgcaggctcacatctccaatacaaacatattcaccttacactctatatggaaatagtaaagagcaatttgtgaaatagattccatgagtgccccaattagggcaaacatttctcatcaaatgaaggatggaacttcaataaagatttcaaagctggttacatgtagagagatttgtgaagaaaccttgtagctctgatggaactgggatgtgagaagaaggcaggttttctgataaacaattcctgtatctttcacaaatgccaaatcacagactcagcttgggacatatgaggacagcacagactttggaggcaggtagattttgggttgtcacgcagacacccactactatgagacctggatttccttctgacgttattggggataagaagtggcacctcaccatttctaggaaatagtaggtaagtctttctggttgccactgaggtgactcacctgagacacagttgctcctaaagttcaaggttaggagacaatccagaaggggagctgtctgtgaagtcagaattcttggaagaatgtaagtctttacacagtaacagcaaagcagacagtgggaaccactactctgccttcttgcatcattctttcctagaaataccagaaagcagtgagggattaagtctaattcctggcacctgaccttatatctaacagatgctcagtattacctgttgatgggacctcactgggaatgttttgtgtgcagtacaaaagggcaatagatgaaactttgggacgggagcccaggaaaatggctgagaggagagcttatgcctagcttatgcatgagcttgcaaaaagggagaatacacgggagggaagatcagcaacagcatgagttttataaggcagagagttgttgggaaggaagcagcagggagaggggaaggagtaagtagaaacctagaagagatacagctaagataagccaagagaacaaagtattgacttaccagaaacatggaagtcttcctgcttctaatttagttccgcatatctggatatgtgaatgcctaaaatcccattaagcccagtgggttaattattacacttgctagggccccagaggagaggaaacacagtaagtcagaaaaacctctgggcaggtgaatttctcaggttttcttctgggcagatgggatctggaatggtagcgtggcatcctggtaattcagagacagtggggagggtgaagaaacactgatgtgtagcatttctgtggtgtcaacaccctaccatggctgatttcaagctgacaaaggtttagcaactgccttgctgatttcctgaaaatttaacaattagttttcatgagatgcagtgggctgaccccaggacatcactgcctacacgccaatgagaatggagattgacacaaagaacagagtggagagacacagagcagggaagacaagattttcccgagtctcaatccaatatgtagactatgtctcccttttcacaaagaaggaaggggaggagagaccagcattcacattcagttattgttgttttaaatccattacgcacatacataggagaaaatttcagcaacagtcaccctctgaacccagttcctcagttctctccagaggcaactaaaatgctcaattattagtgtatccttttggaaatattttatgtatatgacagtgtgtgtgtgtgtgtgtgtgtgtgtgtgtgtgtgttcctttccaatattaaaataatattaacattggtaatagtggtactaaacaacttagggtgttttttttttcatttaatagtatatttttagtatctttccaggaaaagatacatggatgtgccacattatttttaatggctcacatggtactccttttatgtatgcactataatttatggaaccagttttctcaccgatgagcatgtaagttctttcagtcttttactgttataaacgaatgatgcaatgaatatccttgtacatatatatttgtgcgcatatgtaggtatccttacaagtggaatttctgaataaatggatatatacaatttatttatgaatttaccttcctacaagtgattcaagagagtgtctttgctccacagtgttgtcaatatagtgtattctcaaaatctgacaccaatatgtgtgaagtgcctgctctgttcccacactttacacaggttctcttatttgcgttaagtttatttaagaagaggaaactgggcctcatggagatctaggaacttgcccaaggacaggtctctgtgactctaagagtgcaatcttcccttttccccatgtcaagcacctttccccaccaggctcactgctgacaatccagtgtacgaagaagggaaattacccccacagagcccaaaagtttaggacatgccgacagcatcactcttttgcctcctcattctctctttcatttccagaacatttgctcactcagtgctgcccagtgatacttagccagcctgattacccatctaataatttctgatactaatataaaaccttcccaaagacaaatataactgagacgcactccagcttaccatagctttcctggtggtacagtttccagggacatttcactgtgtcaaagcagggaccacatatgttccagaccagcttgttgggtttttcactgggaagtgaagacaaattgttgtccctttgaaaaagcatctttcatctctccatctatctgcgatctaaagcaatggggctctttctgtatgtctttcaaatggtctacactgacacacgttttctctgagctgccgagagaatatgccatgagatgttgccagtgatggttacactcagctagcagaagattagggactggttaaacctttggagaaattgccttgggaaaagaggaaataaaagcaaatattactatgaaacatagagattaccaggtaggaggaggagagaggtggagggaggggtaggagtggaaggaagggagggaggcagaaagaggaaggcagactggtggaaaataaaccgtgcactttagaacagcaggaagggaggcttggaagcctggttttctggctttgaatgaccgcctagcgcttgccggtgcgccagggtgctgtgaggatgtgggcagagggcgagtccgaagggctccagacactgggaatagtggtggtcgtgtgctcctccctgaaacttttgcactacctcggactgattgacttgtcagacggtaagcgaaccctggagcttccccgttttctgtgaatgtgtttttgtggcttcggttgctgtgacagtcgtttcgaaaatgcacggaaatgagggcggagacccgagagatttgaaaaagccgggctgaaacagcgtggtattggtccccgcctccccagtcgcgccccagtgctgcgctgtccgtcgtgctgaaatgtggtgcgcctggggagtgcgggagccaggaagttagggtctcctgctccggccctatgagcatgtgagtcttgatggattattagctatgggtgaggccagcacaacacatcacaattctctctgaagctgtctggtaactacgtatattgttgatggaagccagtgacttttaaaagccattatgttgattaacttttttaaagaagtttaggagattatatggaggtaaaaacctttgtaaaatgctaatcacagtgtctgacaattagaacacatttaataaatgtcagtttctttgctcaacccttataagaacccttattccaaagccacctcctcagctctgacttcagctccattccttagtgagaatggggttataaatccaggttaacccgattgtttaggattagaaagtgatttggtttccaacgttgaaggagttcaagaaacaaagagttttatttttcctccttatgagatattgttccaaatagaacacagtttgtctagatgatttttgtcacttaaaattaggctccaggaaagattccaaatttcatgagcaattgggctcataaaacaagatcaaactccaatagtgtatatccaaagtatgtataatgtgtattcggtgtatattcttccaccactgcatggtgtagacagaatttctcttccaaggggcaccacatgacaaaaccgtacataataatgaaatgcatttgtagacaaaggactagctaaaataccaactgaaagtgggaagaccagaaactgaagtgtaagatgaggtaagccctggagtaagagtcaagaaatccactttctatccataatctgtctcggtttaatgttggtcaagtcattttttaaaaaattctaggtcttggtttccttatgatgactttagatctctgttccttggaattctagagtgatccaaaggtttctttgaattcagttttgtgggttgagacgggcagccagactgtgagtccctcagctctgcttcaaccagaacagctccactttactgttcagcatgttagccctgtatgtaaggatgttttttagctttagctaaaatttagtgactctatgaccctaaggccctgcttccctgagattttgaaagctgaagcacattcggaaaactttttcttccttaaaaatcacctgaaatctgacaatctggaagactagttctgtctgctccagcccttggtcccttagatgtgcttttctgaagatccaaactcaacctgccagtcaatataccaactgagcagagcccctgttctccaccagatttcaagagaacatgttccattcctgttcagagcttcagagcagcttccgctaagattgcacattaatgcaacagcgtcctattttctttgtttctttttttttttttttttttttttttgatgagacagggtttcaccatgttggccaggctggtctcaaactcctgacctcaggtcatccacctgccttggcctcccaaagtgctgggattacaggcgtgagccaccgcatctggccaagcttcctactttcttataaggctaaagttgcagtagaaatattcccctgctcttcctttccatatcataagtatccatcttccttcccctgctttaacttctcatgattgcagtttttgttttattacaataaaggatatcaatcattcatctaatgttatagcaatgaggggatttaaggtgaaaggtagagaacatatgttgagaactgtttctggaaactctaggtgaagaaaaagaagggaattaacatttattcaacacctacaatgtgccaggtacagtgctaagtgcctttatatacatgagttaatataaacctcaaaataatgctctaaggaaaacattttaaataatgctgaagttaaatatcatgattccttttatataaggaagaagacagatttagagaagttaaataaaatttccaaaaatgcagcaatagcaaggtggaggtatttgtctctaaaatttcaccctctgttctgtacaccaagtacctcagcaagtaatccagttccagatgggatctgcagtctgccattaagtctttaccacacataggctcttatgctagagcccttaccatatggtccaaaatgccatttttaatgtgtatttgatatggagactctgttcacaatttgagtactaaagagagaataccacctcctagtagatacaccaggaccaatgtaatgctgtcattctaaggagagcagtggaacatctccaaagaacccatctgtagtcttccttcggcccttgatcttattcctattttatttttaaggtttttttttttttcttcgagactaaatctcactctatcacccaagctggagtgcagtggcatgatatcagttcattgcaacctctgcctcccggactcaagcgattctcctcactcagcatcccaagtatctgggactacaggcatacaccactatgcccagctagtgtatgtgtgtgtgtgtgtgtgtgtgtgtgtgtgtgtgtgtgtgttagtagagacagggtttcaccatgttgcccagggtggtcttgaactccagagctcaggcgatccacctgccgaggcctcccaaagtgctgggattacaggcatgagccacagcgcctggccaatcttttagggataattttagaacagtatacagatattgagccaagagtcaaaagagctgggttgcaattctggttgtgccatttatcagttgtgtgaggtgggacaagtctctttttctccctagctttctctttcctcatttataaaataaagaaatgagaatgatagttgtattaatttctgaggactgccagaacaaattactacaaactgggtggcttaaaacaacaaacatttattctcacatagttcaggaggctagcagtttgaaatcaagttcttgacaaactcccctagagtctaaagtctctagagaaggattcctccttgcctcttccagcttttggtagctccagtgttctttggcttgtggcagcatcactccaatctcagcctctagtttgtggtaatgtattatgacagtcttaggaaaataatacatcagtatttggaaatgtttcttcatttgccacaatatgatatcaaataaaatacatccacttaaaagttcaggtatggatacacccattgatttggaatgctagtgaatgtaaaggcttaggtcaacttctctctgcagttccaaggaggatgagaaatagcagccttgacctcccaccagcgggagtttccctccttcatccctggtcactggccacacaaggacctggcatctcccagtaaatgtgttcctctgcaacctgagccacaaacctctctctcttttatctctttcctctttctaccttcatatttggttggctatttttagttcttctgcagatatagttacactttaaatgacacacagcctttaattacttacatgttgacttgaagcaatgtctgttgctcaccttcttggaaatatcagaagacaagaacacttttacttcctcctccttctcccatccttctctctgtctacttaatctgtttatcatattctcatttttacaccatcaaggtttataatgctcccagaacatacctccttcaaggtaaatgggaatggtaacctttggcctctccttgcccataaggacaacccagtctcctgctctgcgtgggttcccaatttggccctaagacttttctgtttgtatgatcagcaaaaggacatcaaatactttccatcctccaatgagcagaacacattctgtggtcagaagccttctcattacttctgatctcaaagggacatccagagttgcccaaacccaggccaaccacccttccatttagccacagcctgaagatcccaactatgatcaacaaataagactgactccagatcccactctgccaactgcctacctaatacccagactcttgcagctgagagagtctcttctaaaatccagcccaaaaggcacactagatgtgaggaccagaatatcttgtattttgtagtctattatagcaagcataataaacttatttgtttgagaccgagtctcactctgtcgcccaggctgaagtacagtggcacgatctcagctcactgaaacctctgcctcccgggtttaagcgattctactgcctcagcctcctgagtagctgggattacaggcatgtgccaccgtgcctggctaatttttgtatttttagttgagacatggcttccccatgttgaccaggctagcctcgaactcctgacctcaggtgatccacccacctcggcctcccaaagtgctgggattacaggtgtgagccactgcccagccgataaactttaaaattactttttctattccatatcatagattctgggaggaaacaaggcccaatttgagtaaaagcaactgcatttagctggcttgaacttcttcagagaaagaacaacataaaatattcagctcatctgattttttaatgacatttcctttttatttatattcaattacacaagtaatacatgaacagattctcccttttttaaaccatcccttattctacagatcaggtgaaagtacttgttgctggcctgtacttcccatccccacttttgtccccaggacaaagtactatcaggatactagcattcagagtgagcagattcctagtactgacataaggaggatcaccatctaatttttaaattttaaaaaatgaacacaaagtctattagaggaatgaaatgaacctgctttgtaggtacataatatttctctctccagagagaaaggaggagagcacacataagataggaagatgagagctacaataaatgagagaagagagaaactgtcagaaatagcagggcagaaagagggaaagaggtgagaatgagagagagggggagggaggaacagaggaagatgcgaacaaggagagtcactcagttctgaggcaagcacttgattctccgtggttcatttgggtatccaagtaagttatttcctataatcattggcctttaggagtctgcttagctaattaacagtttgcaaattgccaattgttttttgtcccgcattctccagagactttacactgcaaaggcagaccacagcagcccaccttacacttgagttgtggccaaagcaccatccccaccagacaaagccagccccacagctgaccccggcctgtgagtgtctgaaaactggctgtaaagaacattctgtctagttacttcctcagtaaactctggggctgggcactggaggttttctgaaaggaagtgtttggtgtctcacacagccatgtgcttagtatattccatgcagcactccactgagccagtgcccttgaaatgagcaagcactgcagccatcctcctttatttccctcaaggcaatatccaaggattaaaaagtcagagccgtctgcagattcctcctctctaccttgccctgcactttttgtgcccttcctcttccccctctccagccccaaacctctctcctgatccacggtactcctcctgggatgtccactggggctgatcctcccccattctccccctgagttccctgctgttaatctgtctccagcaaaattaacctagcctatgtcccatgccctctggactctggctgctcgtcaatcactcttaaaaatccggtttctccttaggcaatcattttgttttgattttatgtgtaaaaaaacctgagtaaattttttttttttttgagatggagtcttgctctgttgctcaggctagagtacagtggcatgatttctgctcactgcaacctccgcctcccgggttcaagcgattctcctgcctcagcctcttgagtagctgggactacaggtgcccaccaccatgcctggctaatttttgtatttttggtagagacagggtttcatcatactggccaggctggtctcaaactcctgaccttgtgatccacgcacttcggcctcccaaagtaatcactgctgggattacagaagtgagccaccgtgcctggccaaacctaagtaaatgttttaaaattatactactaacatagcatacaggctttagactgttggttgcttttaagtttgcttactttaaaagctagagagaagatggttgaggtgatcttgtctccttcagtattcactctgagccatgcctcctgaggaagtttgctttaggggaggcattgctatgttatacactctacgatgcaccagcccttgcctcagaaggcaaggtttgaaccccaacactgtcttttgcaaactgttaccttaggaaatagattttatctccttaactcactttttacatttgcaaaatgggtaaattgtgactacctcacatggatgtcatgagatgaaatgtaagaatgtgtgtccctggcatatagtaaccactttcgccaaagactgagttatccaactacagacagagaacagctggtggcctaatcaaagggagatacaaaataacaatgccaagactggaaaaggaagttcatcttaggatttccaagagaaaaagaaatatgactgtattataataggtatatttattaagctcttaccatgtgccaagcaaagttctttatatacatgatatacttcatatacattatttcatttagtcctcatggctaccaggtgagcaccattattttcccattttacagatgaggcacagagaagttaagccacttacctaggaagggcagtcctagttaagaagctgggattcaaatccaagaggctggattccagacctcaggctctattatgagaagtacctaaatagagattggtttaaccaaagcctgagtcccaactaagggcaagactgtgacacagaggtcactaatcagaatgaaagattgagccagagttgagttgttggaatgtattttggtacatttaggttgttttaagtatatcaatctccattccactcaatggttgagttcagtttcaagttttccaaatgctttatgggaaagtcatatttttctcccattgcagcagggatgccagcgcagccatgcttctcaaccaccaagtagaagcaaagccaaactgacccaagaagatgaacagagggaatccagggagttccaacttgggttcacagctgcaattctcaaaggatggactaagccatgtcacccctccagataacacagtcatattaatagtgaccttttggaggcctccctaaacagcaggtgaagtcccaaaatcattagattattcctggcctcaattgtggcccagagggagagccctaagatttttccatgggaacaaagatctaaattctgggactatctgggccatgtccaccctgcaccatttactacaaaatgggctgatcctatggaagcacactacctgtgttgtggtcatatagatcatcacctggcttctccagggctaaccagttagcatggaaatgggacacccaagaacaagaggatagaaagaagggaagggtggaaagaaggaaggaagaaagggtgggagggagggaagagtggtagttttggaaggaaggagggaatcagagctaaagataatacatgatatgagtcagtgttcaatgtccctgaagattaggggaatcaagctttgcttccaggagaattaacacaggagagccaacagagatgtggaaatttaggaagtcagaggagacattctttcattcattcattcgttcattcattcacttgctcatttttacatgaattgactctagaacagatgctggagatacaaagatgcatgagacttgcccccatcctcaacagtcattcacagtctaatcagaaagagagccttgcatttggaatacaatatggagtaataatacctctgtgttcagcctgcacaaaatactctgtatgcatggtcatatgtcccttgaaacaactttatgaggaagatactactatagtctccatttgacagataaggaaactgaggcttagggaggtcaaataacttgcccaagtaaaacaactagtaagtagctgaaccacaaaacagagattcatgcagaaagctgtacaacagaagaaaccaggactacatctgcctcaaaggaaccagagaaggcttccaaagaaggcagcattttaaatgggttttgaaggatgtatagcagctatagaggcagagaagaggaaaaaagtcatttcaaacagaaagaacaggttgtgcattcaaaggtgaattgagaggagagaaaagcatgttcaggaaaagacaagacatttgtggccctgggagctgagatatgccctcgggaaggctggagatgatgtcaaagacgaagattggacaataatgcccatcaggccaggagccccctttctggattcgctgcttccactcttgtgtagaatgatctttttaaaatgttcatcaaatcaggcccccctcttattaaacatttcaaaggttttctgttctacttaaaacctaaaacccttcttttgtatgcaaggcctgaacagcctgcctttatcctgtagacaaaggggagatgggaggaggagctaactcacaaagacagtggttatgtctgctctactcacacacatccctactgccccgcacggtgcccagcacatagtaggtcctcagtagggtgttgaatgaatgaacaaatcactgatgaatgacggccctaagcagggatttttctccaaagcttcctcacaccttggaatgcatttgggggcccaacacaaaggtttccaacttcaacagcaaaaactccacctcccacacaatgtagagttacttcttgctcatttccagtgggtttctgtctttctccacagcctgactccttctcaaaatctctctattcccttccaaatatacattctaaatatttacagaagcttgttattctcctcagagctggcctagagttctcctgatatttcaaagaatttccaagaatagggaaatctcctgatatttcagagaatatcccaagaatagataaagttccatctgacaaatagatgctcagtaaaatctggtgagtgaatggattaatgcaaaaactaattatcatgctgttcatggcaagggatatgataattttttcaagtccaactctggggcaccctcacttccacgtcacatgattaggaaaagggcccaggtggcattcagtagacatagactaagcctcaaccccagccctcaggcacatcagtgccctctctaggctctctctcaccaactttagaattgaattacatcagttgtttccagatggtgatctgcagaattcctttaaagaccacctgtgggatttgagggaggaaaactacactctcccaatctccctctttaacccaagcatctgattgctttcatctgttttacatacttagcttctgtgcacaacttcctttgattaaagagttccttgcctttatagtagtggatgatatctaaggatgatgtaaaatactgggtgttagctaaggttttaccaaacttaaagcctttatgcttcataattccactttattgatgtaggaagacaaatgatagacttactttcaaggtggatagaagggatgcgacctagccaaggctacagcatttctctatggcaccactgccatgacaaccatcagtttgaatgccttatgggtgcatcctatgggttatgcactggccccaagccataacccctaggactctagagccagcagcaaacacaaaacactgaattaataatgagtgagatctctgttcccatagctgccacaggctaaataagttgagggggtattgtaaaacccaagatgagatcactgagcctctggtatcaaaaaggtgtatttcacagaatgtttagttggacgagagcttgaagagcatggaaacgatctggtatcattctggtcaaagaccagaatttagaccccagttctgccatttgctgactaatgactttgggcaaaatacttaactttcctgagagttagtttcctcatctataaagtggggtaatataacccaccttgcaggatactggtaggattagttgaaataaattgtaggagaacatttggctcagtgctaagcctatataaatactccacaagggcacagagagggaatgacttgcctaggatctcctcctggaaatcacacaacaattccactagtatcatgtggcccacaggcagctggtgggcacaaccacactggttcagcattgccatggtccaagaggcttctggtgcccagggaaccagcagggtcccctgagcgttcctcctcagctcccaacacttccctccaggcaccagtatgcagggcaaggtcctggagggggcgccgaaacaccactcgagatcctcactctcaggaattcaatatagaaaacacattaagacctgtttacatggaactgctgtttataattattgttccctatgggatattccccactgcttcctccaatcctcttttaaactgctcaactaatagagttttcctggcttccccagggagacattcacagatgctaatagagacataattcaaaaattgcttgatatacatgccctcaattttccccaagaaccacctaagtaaagagccccagacatgcaacacattcattggccagatgcaatttaacatgcgtgggattaaatatacaggctactacagccaggttgtcatcaagcagcagcaggcatggcattttatcctaaggtaccaccacggccaaatgcaacaggaaagaagcaggctgctgggtgggacccctggaagatcccctcctctgtaatttccactgcaagcttttcccaggccttttcaggcaaagcggggagttttgaaaataaatcccccaggcttggagaagcaaagaatcaatgctaagcagctccggaaataatagcttccatctctctgatatataaagaggataaggaaggcagaaagaaggggcatgatattatgagattgcaacaatacattgcaacattacattaaagaattacagaaagcaagatctagcttcagatgccagttcatgcacttactccctgtgtgaccctgggaatcacttaagctgtctgagacttagcttgtctaatgacaaactggggatactaatatcacctcccaggattgttgggaaggtaaatggagattgacaaatgtgaacacacttagtatgtctttacatagtaggtattcaataaactcttctatatatcttctctttctgaaaatctgaatatggggagcatggatatgcttatatgttggttaaacaaatgcatgaatgttgagcaaatcagaaaatactaaaattagaagactaaaaggagtaaactaggaccgattaaaagaagtttgccttccccaaaactcataaacttaatgaaacttgctatctccagaggaaattaatataaatttaaaatagcataggtttgagatgactttagcggagtttctggagaatagatccatcactggttaataaactaaaaatatagagagaactgcccaaggttacacgagtagaaatttggtgtccccaccactcctttttattgcagagggaattgacattcagggaatggaaatgcccagcccagaattggggatgtggtctgggaacccaggtctcccatcccactccctcgccctctcaccccctcccgctggtcagtgttctttgtcctctgctggcatccctggggacgggccagcccccatccccccgacacacacacattgtcccttcaagatggagccaggctgacaccacgtagaatgacctggaagcccccactcagtctaccagtcctccctcctcacacaggaatagatgggagggaaatgaaataagctgccatctgctgtgcatcctctgtgtgccatgctctgggtacccatctaatcctcgtgaagaccctgagaagtgagtgttcttcacagactaggcaacaccagaaggcaggtgaagaacgtacagaagctacagagtgcacaggtgacaggtatgagagccaagccattcaaactccctgggtataggacccagctcttcccacgtctctgcctttaccgaatcaaacacctgagcacggaagaccctccatcaacatgaactgctttgaattgacatgaacaagcttcaatcaaactataaatgctgaaatttttcaattatagaaagtatttgaaagatcccataaattcccctgtcatatcacgtgagctgcatttactgcagcagacactttttatctcgggcttggaggaaggattagcaagaagaaagtggagggggtctgaggaagggctggcagcctagaggaggacagcagcaagaagcaggctggaggcagttctgtgctgccggccttcatgggtgtggcctttggacagcaccttagcaggaatgtggtggagagcagccccattcactccagaggagagcctcaaactcttcaggcagatctagcctaggtagaatcttggcctggcccctccgggatgacaggtgccattgcccaagaatggggaaaaggctgaagtgctccagccaaagaccccaatttatcttcaggacaattttcactggaaaccttgcctcaccactgcccactttttcagaagtaattagaatgctaatctataagaaagatgactattaaaaataaattaataatagataatacattttggcttacaattttgaataatatagccatcccatcttaaagtaaaaattcatatatttttaataagcctgagacatgttttccaatgaaccacagatggttcatttttattatcctataaagagacattatgggcaagtgttttttaaaatggtaaaacagaaccttagagcagctctcttttgaagatctctaagcactttctaagcatcaggacccccttctgtcatcacagagactgaaatgaggagatggtctctgtcaccccctcactcaccagtgagccccagaccttcatccctgatcagatggaagcagtgtggcatgattacagttcatatttcaactctgccactcaatgactaatagccaagcactaataatgcagaaaatgtaaatttaaaaaataatcttcctgagattggttatgaaatgcactcaacacagcaccatccacagagaggttctttttaattgctcttttctttcctctcgacacccagaatcacaaagcatgcctgaaagcgtcacacatatatgtctgtgaccataacatggcattgcacatgcaaaggaaataaataggtgttacccatgtgacaaaggtccatgagctctgtccgcaaaaagctgttgagtttaaagaacaaataattctgaaaaatcttccaggagatgaaatttgtagaactcaagggcagtaaactagctgctttccaaggacttgtcatagctttattgacttacaatagccaaagataagtcagtattaatcaaacccattctctagaaaaacctcatcatcactggggccagggcagagaagtgtgacacagctctctccagcttccccacttcacagcatggttccaccatccacccaattgctaaagcctggatagtcttccttgtcacctcccgatccccttctctaacacccatcccccggccacccaacatcagcaagtctggtggtttctctctgtcacagagattcaagatcttcccctcatctgtctgtttcaaagttaacatcatctctcatccagacagttgcaacactctcctagcaggtccttctgcatctattttttaattaaatttttaaagataaaaacattcctctaaatagaatctgctccagaacccagattaaaaaagaacgagaagggggaaagaagattagggcatcccagaagctccctatttgccccatttgattcattactccccaaaggtaactgctatcctgacttctagcaacactggttaatttccgttgattttgcactgtatattcatccgtgctgttggacactgtcatacttgattcattcacattgctgtgtaacatttcattgtgtgactattttaacatccattttactgttgaacacttgggtaaacttctgctttgaggctattataaacttgacacttctgcttcccattgctttaaagataagagcccaagtccttgtcagacaggtgaatggtccacacagttagcatcctaggctgggcgcggtagctcacgcctgtaatcccagcactttgggaggccaaggcgggtggatcatgaggtcaggagatcgagaccatcctggccaacatgatgaaaccccgtctctactaaaaatacaaaaattagccaggtgtggtggcatgcgcctgtaatcccagctacttggaaggctgaggcaggagaattgttcgaaccagggattcgaaggttgcagtgagccgagattgcaccactacactccagcctgggacagagcaagactctgtctcaaaaaaaaaaaaaaaagccaggctttttctcatctcataatctttgcgcatgctgttccctcttcctgaaactgctttcctaccacttctcacctttatgcttcacctcgtagtgttcatagactctccttccttcctaacttaaaagaggctccttctggtttttccttcatacacttccctcactcttttccttcactgcactaaagatgatttctaattgcatagtcattgatgccagtatttgtttattgtgtcattcctgctgaacagaggatgggcctgacttatttgggaccatgttgctgatgcctggacctaagcctggcacagagtaggagctcaacaaatttgttaaatgagtggctgaatggccatactctcaaaggacccacagtctaggagagacagaagaatctttgtctttttgtcttgcagtgggatggaagctgcagggaggggtcttgtcacattgatactgtctggggaagacagaaaaacttcagtttcagaggaggtagcccttgaaacgagatttgagagagggcagcacattgtacaactccatgggcaccatgcacattgtagtccagataaacagagccccttggagatatgtgaggcatgggatagactcagagaaacccaggaaataaccccttcaggcatctgacatgcaaagatgtggaagtgtcaaccaggaagtcatgttgggggaacagcaagtatttacagaaagtgactgtgtgtgtctgtgtaggagggtgactttgtataggagagataaaacctgtgagctaatcaaggagaagatcataaaagaccttcataaagagcatggcctttttcctgcaagcagtgaggagccattgaaggctttagcataaggacagtcagatgtacttccctagaatgcacatttccttctgctccagaacttctgcacaggaggctcctaaaagctctccccatcctccctgtacacgtagaatctgcctctgtctctctttctctctcctcctcctcctccatctcctcctcctcctcctctccctctctctcgctgtctcacacacacatacacacacactccttccttcctatctagtcagattccactccttgggatttcaggcccaccgtcactcctcagggaagcctgccctgaatgcctgcactacaccagggcccctttcccctgcccccatcccagagcaccaaatagctttcccttgcagcacttctcacagctgtcattttatgtttgtgtctgtgattcttaggttaagtccctcatgcaccaaatcataagatctgggaacaaggaccacacctgtcctgttcatcactgtaatcatcacactgcctgccaaagtgccttgcacatattagatacttagtagttatgtgttccatgaatgactctttaagagatcttctagctgttcttgcaaagaacccattggtaaggttgaacctacaggctgatactttgcactagtctcaggaagagatggtgagtacatgaaattgagtcccccagaggttaatgcccagtgccccagctaggaaacgtccaaggaggcaatttgaaccccatctgtctggctgcagagcctagccctctaatgcattcaggggtcctagctcctcgaggatgccactgtgccgtgaacttctttctgaccctcatggctcccagcacagcatccacactcagaagtgcaagatgaatgtttgcagataatgaacataaagctctcaggaaccctcatctcctgagaatctgctttggcccccacagcaggtctgggtgtggaccttccccaatggccttgggaaattatcaacatctccccattagctgttgcaatattaaattgtgtgactggaaatgaatgaataatcccatgggcaagtgagggagaccaagcagcagggatttaataacaagtcctgccctttctccaagcagaaggtcttcctaattaaatattaaaaatctatccatacaagcaagagcgaaaaattgcattttcagcagtgcagctttgagatgctgcctcagaagacccaagagctgtgggaatgccctctccaggacctagaagagggggccagaaaaccgccatgtggtaagcactgccgggtacccgggtatcacaggccttgccacattcaatcctcatggggacaatgagacaggggttagatcacagccactgtctaaatgagcaaactgaggcttagagagggttagtgacttacccaaggccaccaggtatcaagtggcaaagttgggatcttaacccagttctatgtggctataaagttcatggaatagaatgctgcagttaagaacatgggctttggcatcaagcagacctgtatttgagccccacctctgctgtttattaactgtggccctgggcagatgaccttacatccttaagtctctagttctttgtctttaaaagggtggcagaatgtacctcactggttttaggaaggtcacatgagatagtgcacatgaagccctaggcatgggaaaattcttctaaaatgtcagctgccattctgatcactgcaagacccccacccccaatactcccaattgtaccaccccaccccactcaccagtgtctcagaaatgcctcctccagaaggaaggcatcctgtctaacccactgcttctagccaagctgtctttcttcagaaggtagaaaaagattgttagtcattgtttaatctttattgagtatataccgccacaccaattgcactgccattcattatctcatttaaatctgacaagagccttgtaaagtagggattattcccaccatttcccagatgttgaaactgaaattgataaacacgacatgttgccatggctacatgaagatctccaagccggaggatctccaccctcacctgcctagcttcccagacctctctgcagaaaagggactgacccccaagacagccctggcctctgggctccaccccttccacatccatcccagggccgctgaggactgaagagttctccacgtttgccctttaaagtgacttaaaaataatctttatgaatttcttcatatacaaaatttgtacttactcattgcagcaaatttagaaaatacacataagcaaaaaagaacgtaacagccatccataaccctaactctcagagatcaccactattaaaatgtttattatctaagagagagatgatatagacaaagatgagacagattgacacagagaagatgggtacatgatagatattttctgttttataacccttgctttttcttgcacttctaggaatttttctgagaactaatctgaaatctgcacagggtccccacgtctcggatcctcatcccattgcctcccaccttcttgaactttgcttcaataattatcacacctcctttgcatgtttaatcttcccccttttaatgacaactaccaagacctgtttcctagtgcagggtcatgaggtaactaaaataagaattaaattgctctgtgaaaaaaaaaaaaaaaaaaaaaagttttacagtcccaggagattttctccagccttatcatattgttgataccatagggtcagttctgaagctgagcccaactcagccctaagctttctaaaggggaattgccaggtcccctggtattccagctgaaacctcaaacatcctaaattgtaggctctattaactaataaggagaaacacacttccttccccttcccatgacttgtagggagtctagggtctcaggcctatgtcacaggccctcgattgccatgagtcagcaaggagaggaaggacacgaagccagcaggcagagagctggccccacagagccatcctccgtgaagccccagcaaacgggagggaccaagtttgtttcagttttcctaaaaataacaagactgtattttctttgctgttggctgtccctaaaactgttaacatgggttcccagcctggcacaatgtggtccatgcctgcctcccacatacctgcctcccacccctctgggccttgttcccttcatcccagcctccagacacacctgcctcctgtcatctctagagcaggcttatcttgttctcctgtgggctccttgtagaggatgttccctctgcccagaacgctctccctcactcatcacctgttggtccccttctcctccttccaggctctgtgtcaaggccaccacagagaagccttgcggttatgtttagttcttcctgcctaagttcgcatggtaacccatacctttcctccatcataatttgctcaactgtaatcaaacattatttttaaaaaatcattccagcctgggaaacagtgagaaacccatctctacaaaataaaaaataaaaattagcttggcattgtggcatctgcccgtggtccctgctactcaggaggctgagatgaaaggatcacttgagcctgggaggttggggctgtggtaagccgtgattgccccattgcactccattctaggcaacagagtgagaccctgtctcaaaaaaaatattattcatttaatatctgttgccaccacaggactgatccctctgtgagggcagagattgttcatgcatggaattgtgatttataagcactggctctggagccaggttgcctgagcacggagccagctgtgccctgcgggacacctgtggcacacttcactcctgggacacctgggacacgcacacaatagaaatgttcacattttactaggcaatgccagtcacatagtcctacctaatttcaaaagggtaaaaggtacacccaacacgcatcaggaaggaggaggaccagaaattgttggtgacaagcacaaatgaccaccccaatataatattttgtttggaaggcattttattccacaaaaacaacattacaataaacacaacaacaaaacactggttgcagtagaaccaactttccagacctatctgcacagcacaaccattatcccactcaaaatgtcatgtttttacccaaaacattaaaattttaaaagcaattcaaacccatagcttaaaaaatgttccaaccagtaataaaaggaaaagtgtgcctcctcctcccaacttccctaccccacaatcgcaagatattatccttataggcgaaaagggtttcaggatttgagatgcaggctgggaggtctgagaagacttcctatagaagacatgacttcaaactctttcttgtatgtgagatttaattttcaaagactcctctgatccaacttaagctttatggtaaatcaccttgggacttaaatgatgagaagcactgctatctcacagtgagaaattcagaagggctgggagttccaagtcagagctctgatctggaaagttccatcaaagcgtcactccaggcttagcggttgccacccaccactcgtcagactaaacagcctcagagccctgtgacctgctaatgtattcacaaactaactcagctaattaatcccagctcattcatcctctcaaactatgcaagtcttccagctggccctccggcttgctgccctggctaatggagtgttacgtggactctctgtaggttgcaccttactcgcagccaagcaaaggcactcattaagaagctgagccccagggctcccccatgagtggggaggaaactcatgagtgccttctatatgccagcgctctatctgcaggggttcttttgatagcagcagactgagagatgatgttactgtcccctttttcctgttgttggcaactgagactcagaggatggaagtgacttgctcaggtccaccacctcttcagctgtggagctgcgacaggagcctttgtttgacttcaaagctcaccatcactcctctctcactgatgctcaagtgggctatcacctcgcctttcctgagccttccttcgctatcctaaaacagcgcctcccgaaatcaccactaaagaacttattcatgtaaccaaacaccagcggttcccctaaaaacctatggaaataaaaattaaaaataaaaacagtgcctcccatgacccatgtctctccagtcccataactctgctctatttccattcacagctccatccccacctttatgtcttttgttcactgctttatccccagtgcctagaagagtgcttggcacctagtagacactcagtaagtatttgtcgaatgagttaataaggttgtgaaaagaacgttagattactggaaggattcatctgagtttaattctgctatgctgggaatccagtgtgcggccttggatgaagccagttccctccctgggccccagtagccacatctgtacatttagagggcaggagaaaagccacacgctctgtgacttatacaacttgttgcccagagtggaggctgctttgatgctcagaaaaaagaaacaaacatggaaatgctaaatgggtggcagagagcttgagggaggaaggagatggggagggtactcttgaaactgtttggtgtcttccctcctgccccctcagtaccaattgtcaagtacagaaagtgaaggagacttgtattagtggaatttggtccctgacttgttatagagacacaattacaaagacacaagagtgggcccagcagagacccttagggtggtcccttgaggttccaaagcatctgcccatcaagcagatgatgtgattagtctctgtgaccccaaggatgcctcctgaaattgctgattcaatttctcctaataaaataggaacaataattagctaataagaaatcaacaattaaagctatgagagaattaagtgagatcatgtaagcaaagtacatgtcacagtgctctgcaaataggcagtgctcagaagtgtcaccttttctctttcttctctgagcctccgtcttctcttcggtaaaatgagaataatattatgcatacctcacaggggttaagcaatgtgaaagtactctgtaaagtataaggctgaaatgtactgggctcagaacctataggtctgttccattctcgacacacgtgatattagcagcacggtacatttaaggacacggcttgattctttaatcacagggcatcctgtcttctccacattgcttgggaccccaaaaaatgaagttctgtcatgtctctagaccaccaccaaacacataaaagtcacttaggaaaacatggtaggaggcagaggaaaggaattgttgaacagggattgcagattcaggtatataaacgagtgatgatgactctaacaacagctcttggtcttagtgttggaaatgtaatagggagtagtggggactgcggtttaattgttgccgtgtgggaatgtgggcctggcatggccataatttcagatttctaaaggaaagccaaaagttcatatttttatgtgaaataaatgttgataaagttcacacttaaatgaagtgaaacagaccagggctggtggtttatacctgtaattccagtgctttaagaggccgaggcaggaggatcacttgaggccaggagttcaaggctagtctgggcaacacagtgagaccccatctctaccaaaaaaaaattaatttaaaaaataaaagaagtgaaacaacagtaccctgtgggctgccagattgtgatttctgaactaaactgtcagattacaaagttacccgctaaattagccaaatactttccagatattccctgggccactgtctcgggactcttaatatattttccaattagttccttttagtgctacatacacacttttagcaaataatgagcacttactagtcactttctatgtgcaaagcagatattagacatcacagagggagtgagataccgaaaacaaaaataaaacaaaaataagcacaagacacaatctccgcctaccccacccttgaatatgaaaactgtgacacccaaaggtagattttgatacctgctgggtgattgctagagataataagtgctttgggaatttggacagagagagcttttttttgcagtggtctgagagagctgcccagaggagatggcacttacgccatgttttaagggtggataggattagtgccagatgatcacatgctctggtagacaggggtctgtgcaccagtagattctggggctattgcagaggactcatgacagggattagtctctgtgaccccaaggatgcctcctgaaattgctgattcaatttctcctaataaaataggaacaataattagctaataagaaatcaacaattaaagctatgagagaattaagtgagatcatgtaagcaaagtacatgtcacagtgctctgcaaataggcagtgctcagaagtgtcaccttttctctttcttctctgagcctccgtcttctcttcggtaaaatgagaataatattatgcatacctcacaggggttaagcaatgtgaaagtactctgtaaagtataaggctgaaatgtactgggctcagaattggggaatcgtctggaaaggtagaccagggccctagcgtggactcttcagcgccagcaggaaaatctaggctctgtcttgaaggttcctcagcaggaaggtggggggttgttgtggggtgaatctgatggaaagggattcctcctcctcctcctgctttctccagggtgaggaatctaggcactagccctggggcccctccaggtcccactcttcacctcttgttttttatttctcctgccatacaaccttctttttatttaaaatagatttaagcaggatagagccccctcccccaccatcaaggctgtttccttgtaggtggggggatgccttcatggtaatgatgtagaccctgagacaatatagagaggcagcagggcttggaaacaggcagtatttcctctttttatgatggtttcattttacatttttattggcctttcactgattgctcccgggctctctggcaggatgtgagatgcgctgacatttatagaaatcaatacattaataaatcacgaagttcataatgtctgatttgcttctaaatgagacagaactattatcgccataaagttgcacataaaatatgcccaattgtgatgtattgtgtagtctaatcaaaggcatttgagtgaataacctttccccaaaagaaggaaacaatcaaagctgaataacttcattaataattcaaggtgtgtctgccaaggcttcatttattaagtgcacagttaagaggcttcagagctgaatcctggagaggatagcaccttgccatcttctccctgcctctgggcaggcggatatacattctcagatgaactgactgcactccttgcatctggaagttcatgttccagtggagggtaatgcccagttgacttcttcagctaagagatggcccgtaacagtgctcatggactgtccggattcttaagggcagaggagccagagccaggaaatgtccttagtggccatcagttgttatgtctgttcactaatgttccaggccctatgcttctggtgtccaccacccacagaccccctgttctgttccacggactgagatgatcaacagtctttcatccagagggttgtgtttgctggtggccattacctttaacataaaacgatcatatttactttatcctattcatgtccaacctcaactgacaattgagttgtgtctctgacaataaatagcagaaaaaggaaatcttcctatactgaagagaaacacaattaattaactagatccatcaggaaaggtacaatcatgattgagacagtgtttaacagatgtgactattggattctgttgttgagaatgacccttaaaatcacagtcaaaatatacgacaagatggaaataacatttttgagcacctactatgcatgtagagcatcttacataccttatctcacttagatttacagctgcaaggtgggtatgattctagcttgaattagtctaataaccatatacctcctaggggcagtgagatgattagatcaattctaaaactattaccatgctctctgagctcaccaagacaggcagttaatacaaggatacattaataccgaatccagcaaaagctcacatggccagcttccattatgttcctatttgtgattattctgtatcaagcacagaaatgtatgttcacacgaacaacaaagaaggggtttattagtgtggattacagggcctaagcctaccctctgaaactggttttggagtctttagcacgcttgtttgggacagttaaacatgtgccagctattctaaaacagtagcagtaatgtgatagagctgggtcataccgtgcttcccaaagtatgatcacttcatttcaacaacttcacactaacagcctgaactgggctgtgaagggaatatttagaccaaggaaactggaaaactgtatcaatcaggcttttccaccctccccaagagccagttgtcagatatctaccagcctaccaacgctagctctctaatcagaaaccatcacttagcaagttcccaaattatctgcagagcaatgaactcctcttcttcagaaagcaggctgaaagatacactgttcacatcttagcctgacctggacccagtgagtttccatcagtgagaaaattctgtgctaacttgagataatactattcttgtggcaattttacttttcctttgagcgattccttcaacctctctctgccccttcatttttccgtcttaaaactaaaagtgccctttctccctggacactcctcatttgcaatgaattgtcatttcagctcctcagtcaagaggagtaatgaaatcccacccgtgttaatcctcttatatcccgcagaaatattgtagacccactcaccctaggcaacatgccctctctcttcaacacaggtcatcaattgttcatttactggctatctccatgtactggaacttcagggtggtgtccagctgggttcaaaggagaaacagtgggaagtttctccactgccacctgaattagatgagaaagagttgtctactgaaatacactagctggtggcaggattgggacgtcatttgactaattgcctcctagagctgcagagactgctggaactacctaagtaaatcatcaaaaaaaaaaaaaaaaaaaatcatcccagggcactttttccagacaaaaaggtccacttaaaacatcctctagagatctgtgcctgaagctgagctgctgcaatgaaactgacatttctgccttgcagcctggccatgggcttagctggactaaaatgctgctgcagtggtgagggcacgtgagagtccctaatgtacatggccttgctccttgtcctgacacatcttttagggctgctgctttctctagtgctggaatctagataattcctttcccagccgtttgtttcttcaatcttggaaaatatctggatgaatgtaacactgtcacacacaaacagaattatgacttacgtcacattctatgtcgtgattttgtggacttttaataattgcattacatttgtgaccattaatttccaccatcgccctgctcctgagaatctgtaagggacatttgacactcctctccccacccacctcaacatttgtgctgacctgaaggtcacattaaaaacatacccatttggagagaaagatctgtctactgaaatacactaaatattgaagaatttccaagtcatttgatcttgaaaactccatctaatggaagcagaaacactcaaaggtttttttttttggactccctttttcaggacactttcaggactgaggtatataaatgaatgagaaatgtataaattcaatttcacttaaaaggagcaggaggggtttcaagattaagagaacaaatgcttgaagcaaaacatgatttgagttttattgaaccgagaagactgaaaaaaatacgtggaacactcagaaaatctttatcaaggctcagctgagcactcctggggctcattgttaagtttataaaactcagagctgatgagttgtgtgcactgtgtgggtctgagtgggcttatgactcccctccaagcctggctgtaagaatctaagacttaaagctgaaggaccaaatgggactttccgtcccatcccctctctgctccatgcaagcaccaacgtggatttttgcccctaattatattagggaacgctgtcaatcaaaaagatgatgttaaactcatccagaacaaaccaaaccatgtttaaggggaagaaaagattacatcttcaaatgccagcatgccatcattaatacaatgtctaatgtagtcaatatagttcaggcaacattgaaaatgaaccactgcaaatactaggaatacaatttcaagaggaagcacaacattctgtgtttctatgcacacagtcctgtaaattatttgcagctcaagtatgtcatgttcttttaaattttcccctgggtacagcttgaacaacttcctacaagtgttgatatgtcatattctcattatcatttagttcaaaattaccatgatttaattaccatgaggttgcttttttgatacatgagttacttagaaattgaattaggctaggcatggtggctcccacctataatcctagcactttggaaggccaaggcaggaggattgcttgagtttgaggccagtctaggcaatatagtgagacctcatctccacaaaaaagtacaaaaaaactagccaggcatggtgacacatgcctatagttccagctactcaagaggctgaggtgggaggattgcttgagcctgggaggcagaggttgcagtgagtggagatcacaccagtgcacttcatcctggatgacatagcgagaccctgtctcaaaaaaagaaaaaaagaaattgaactatattgcttgatttccaaatgtttttgaggattttctaattttcttttggctattgatatgttgcttaattcaactctggacaaaaacagtctataacttcaattctttaaagttttttgagattgactttatggcccaggaaatggtcacttttggtaaatattctatgtgcacttgaaaaaatttatagtattttatgattgctgagtacagagctccatacgtctcaatgagacaagtttcttaattatgttgctcagatcttctatacccctattgatttttttgtctgtttatcagctgctgaaagaggtatttttaaattactccaattatgactgtgaatttattatttttccttttaattctatcagtctttgctttatttgtattttgaagctacattattagtacatattaatttagaattgttttatcttcctagcagatgggcccttttacataagaattctctatctctagcaaagttacttgccttaacatctactttagctgatgtaaacatagctgtgccagtgtttcttgatttgtgtttgcatggtatatccttttccatcattttacttttattttctgtgcccttatgcttacaagcagcatttaatcagggtttggtttatatctgatgatttctatcttgtattgtagattttctattttttaatttttcagtggttttactctgatgttcttataagtggttttctttgtgtttatcttgcttggggtttgtagtgctccttcactctgtgacttgatatatttcactcatttttttaaaatgttcatttattagctctttaaatatcgcttcattatcattatttatctctttcttttctgagactccaattatacatatgttcaaacttttcatcgcgtctcatatgtctcttatgcaagcttatctgtgattccattctttttttttctttttttgagatggaatctcactttgttgcccagcctggagtgcagtagcacaatctcggctcactgcagcctccaccccttgggctcaagtgattctcctgcctcagcctcccaagcagctgggactacaggcgcgcaccaccatgcccagctaattttcatatttttagtagagacgggatttccccatgttggccaggttggtctcgaactcctgacctcaagtgatcccccgcctaggcctcccaaagtgctgggattacaggcatgagccactgtgcctggactgtgatttcattcttttctctcttgtgcatctgtctgtgcatttttctattgacttatctaccaagtcacttattatctcttaatctgtgtcaaacccacttttaaattggtctgtttaattgttaatttggataacatatttttcaattctacaatttttgattgactttttgtatatattctggttctctggtggaattatctagctttttgtatattttcttgaacaaatgttcaccattattttaaagcccagatatgattaatccaattatctagatcagctgtggatctattactgtattctattttttctcttagtcttgtctcttaatatgcctgacagatttttactgaagggtgcacattggaataaaaaatgtgttacctatctggttgagtcttcagcttcagaaaggtaatagagcaaaggcagataaatccaaacagggactgagctgttttcatgcaggctgccttggtagctctccaaagccttcaaaaatgatgagatttttttttaaatcctttttatccagttgttctcaagggattccacccctgcataggagagctcaccattcctgggatcttcagcttctatgcctttgcatatgctcttcccttgttccctcattcttcaacactcaactgaattatcacctcccttgaagccttctctgacatcccttctagtcccatgccacccaggaggcactaagagcttcctcccctcagctcccagttcttaaacatgtcaacactgttttgaaatgatttgccaatgaaaaattctagaccagcaaccaacaacatccttcccaaaggtgtgttatatatggtacatgctgtatgtgctaaacaccaaattcattgataacagctaagaaccaggaaacaaaccatcgttaattatggcatctcttgaaaaatctaaagatctggactcactgggcttaaatgactgcatgataacaactggttgagtaacaactgtttccctttcatggagcagttactctccagttctcagttcctaccactctctatagttgtacactcatcatctgtcctcatctgaattacctgccaatgactactggcatttgagtttctaatccatggtctatgtgtatgcctcctcaccagtgtgagaactcatgtaaacaggtattatgtcttttcatctctctcctaatacctaagacattcctggcacaccagagcatgtcaatgcttctaaacatatctatattaaaatgctaccaaagcattcagggtagtgaaactattctgcgtaatgctgtaacagtggatacatgacgtcatgcatttgtcaaaacccacagaactgtacaacacaaagcatgaactctaatgtaaactatgggctttagttaatatctacatatcaataccggttcatcaactggaacagatataccacaccagtgcaagatgtgaataataggagaaactgtgagggcggaatatacacaaactctctatattttctgtgcaatttttctgtaacctgaaacagctctaaaaataaagtatatttataaaaaataaataaatacaaatgccacctcaccagaaggatcaaaggggcaactaaatccagcaaagtaagtgtctcacgtggaatacaggtcaggaaatgagtgaaaacactccaatggatgcccacctatacgatcactttgaagagcagcaggaaaataagcctctgctgtctgggttgcagattgggggacaggagagaaactaatacacactcaagatggtggctgagctgccttacacactcgtggccaggggtgcttgcaagacaggcggaagttcaaataagagcctacagaggaaatccaggccaaccacaaaatagacccacaaaggccagcaggagagtatctagtggagctccctgggaccttggactcacccagctccactgtgccatggataattttccaggtctggtattttgtcttgtattttatattctgcataatgggggacttggccggcatccactctgccacacatcctaatgggctaaccctcttctgcaactacccttttctttttctgcatctggttactaatcaagcttaatgggggaagaaagaatcaaaaacttgtagactgtaagctccaagagaacagagaacagagctgttttattcactgacttgtacctagtagatacttcattgacagttattgggtggagtgagcaaacaaataatcctacaagatatgcagtttccaatcacaaagaagcagagagggggaatgggggcctcctgattgtggagggtatcttataagcctctcctcagtcaaacatgcgagtgtttccaaggacccatccaacattgcacatctctgccatgtgccatcccatctctgcaggctgcatgactgcatggctgagggcatgttcaatgagcccctgtgggagccatgggcactgggaggcaacccactgctcttgcctgttctgaccatgggaaaaggacagggagctcagctccagctctgctactgagaggctcttcgcatatgtcaagctggacgacgtggacaccctcagagcggcctctctccattgacaataaaagtgtgttttgcttttcgatgaatcgatttggtaaaatgttttctcactctttcctagacatcgcctggtggtattaccagtatcagagaggtaaaaaacagtttaaactaacctgactttggtcacatgacttgcaaaggcagagcttcttaatcaagctcatgttttgtaattagtcttctcatgcaccagctttctgtgtcctttgttaacaagccccacatatatagaaacagttggaaatgttcttttagagacaagttacaggaaaagctttgctccccgtaagaaatggttacgttttccttttacagacatttgtaaaaactcagagcccatttgcagctcaagtgtagtaattgcttcaaacaaatggcctggatttctgtgttctctttttctccatggtcttcacctcctaatctaatcaacatatactgaggcagtttttcttattactttatctctttttatttcatatttatttcctataatcagcttcaagtcctttgtgcaacaaagtggcatgtgtttaaataaacagtgaggagtaggctatgtggtttgtaggtgggagggtaagtaggtatagatcaaaaaccaaaaactcaatgcctattgcacagggcaagcagcataaatgaattctgtgagccaggggtgaacaacaggacatcctagaggctgtggctgcccagaggggacagccggtgttcagctctagcaggctgctgaagtgtctgaatttgagaccaaaattgtcagataatcccattttccaagacaaatcagacatccagatttgtacatggatctctcatctttaaacatggacaactaattccaaaataattaagatacattttacaggtcaaacaagacctatctttgggccacactcaagccgaggatcactattttgtaacctcaaagctagacggatggccgggtgcagtggctcatgtctgtaatctcagcactttggaaggccaaggtgggcagatcacctgaggtcagaaacttgagaccagcctggctaacgtggtgaaaacccgtttctactaaaaataaaaaaaaattagccgggcatggtggggcacacctgtaatcccagctactcaggaggctgaggcaggagaattgcttgaacccgggaggtggaggttgcagtgagccgagatcacaccattgcactccagcttgggcaacaagagcaaaaatccatcttaaaaaaaaaaaaaagctagatgggtaagtataaagtccaaatcagagacaccatgagggaggcactattggccagtccagggaggagatggtcatggtcacggtcctgagcctgacagaggggtcacctcactggcgagaagacccaaggtgtgagtcctcccactgctcacagtccaggtctaactggtacacaagcacacagcttcgtaggagcatgtgtgctgcaaggctggctacaagcgagtttgcaatttgtgcttgaggaaagcagaatccactgtggggacatgtggaaaccagatatgatgaaaggggcctggactggctggattctaggtccagatatgtcacccattgctcaacgacttaggactcagacaaagccagttagtgagaaggtttagaagagatctcctatgctagaatagcttagcattggctggatgtgtttaacagatacagaaacccactgaaagtacagtcatgctctgcataatgacgtttccatcagcaacacaacatacacaattgtggtcccataagattataacagagctaaaaaattcctattgcccagtgacttcttgaggttcctgaccctgtgtgggctcaggctaacgtgtgtggttgtgtcttcatttgtaattttaaaaaaagggttttaaaagaaaagaaatgaaaataaaaaatttttaaatagagaaaaagcttataaaataagaaaataaagaaaaatatttttgtacagctaggcagtgtgaattttaagctaagcgttatcacaaaagagtccaaaagtttgaaaaaaaaccaaatagtttgtaaaataaagttagagtaagctaaggttaatttcttattgaaaaaaaaatttattaatttagtatagccctaagcataaagtatgtataaagcctacctcatgtttagtaatatcccaggccttcacactcactcaccatcactcactgactcacccagagcaacttccagtcctgtaacttccattcatggtaagtgccctaatagttgtaccattttttattttttacaccttagttttattgtaccttctctaaatttagtatgtttggacacacaaatacttaaaatacttaccattgtgttacaattgcctacagtattcagtacaataacacactgtacaggtttatagcctaggagcaaaaggccataccatacagcctaggtgtgtagcagggctaccccatctaggtttgcgtgagtatactccacgatgttcacacgatgacaaaactgcctaacaacacatttctcagagcgtatccctgttgttaagcgacacatgactgaataagcaaatgtgcagtgattgtgcattttttttcctgagagagtctaaacccctcattccacactcagaagagtctatgatcccaaaacattaaggatcacttaatcaaaatcatctactattcaatctgagaatttcctgtgtagcatcctctagagttggtgattccatctctctttgcccctagtgataggtattcatcactgtgtgaggcactcacagttagaaaatcacttcttaatatcacatgcgcagggcaatggtcccctcactcccttcacacgtaaggttatggaacaacaggcatgagaacgctgaatggcttaaaagtactttacaaacaaaaggtgctctaatttattcttgttatgtcattattgccatagtattacatctcaagttaatttttatctcaaccattcaaacttaagtctgacttagtaactagctcatcattattttttataacaaagtaatgactagcaacatctggcatcagactttgaacaaacctcagaaggaactgtcaaggaggctccccacgggttcacgctcttctctcctcctgcacacagggaacagggccattctccttcctttactgggactacctgggcttcatccagggaatccccaggtggcaacaggagggtggtgaaaaccgctgcccgtcacctgtaaagtttcctgtgaatgtgtctacagcggccagcaccacaaggcatacaaagaaagggaagggagagctgatgtgagagcggcagcgtgggcactcctgtgaggttgccacagctgtagacaagttaaatcagtgcagttcaatcaaaagtcatgacccatgagcgtcacaaccagcacgagtctacaaaggaatacattaaaactaagaccagagcacagctcacattagtgagggatgggatcatttcatggagtttttgtttcaaaatatttcattaacatttcacttatatacatgtgtgtatactgggttgtgatttaaattacaattcttactataaaatacagcaaaagaaagaagaaacaaagagagggccactggtttacctaacatccacaggcaggctacttcccagcatcttgagccccaaagaagtaaatttccttccacaaccgatgttaccacagcctgacacttagccaatgatgaaaacgaaaaacaaaacaaaagcttggcagtcagtatccaaatatgcagatactacagaatctgtttgatgtagaagttgatcctgctacccagacagcaaacaactcatttattaataaagtccagttcctccttaatgaagtgggtttaatagttgatatctcaataattacttagtgcattttttatgaaggtgatgggaaacaagtgctgtttcttgagtcggaaagagtctctcaagctcccacaaagaaatttcccgagcttgtgaggaattcagtcacaggaagatcaaggaattaagtgtactgcaaaaaacccttcatgcttctggctaagataaatctaacagtgtactggatgtcttcaagaatacctcatttactcaaaaaatacaatattcccattttctttatttgcattttaatgtgatttttgcttcatctcctttcttcactcaagccacctgggccgtacccagggaattcctaaggggcaaaaggagggatgtgaaaacctctgcagccccttcggaagtttcttgtgaatatatgcacagataaacagatgtgcattttaaaaataaaaatgcttttagatctaatgctaggagattcaaaccaacaattaatttctctgttaaaatgggttaaaatagatgtaaaatattaatatgtatataagcattctgaattagacttatgtgaatttttctccttttctttctttctttttgagaataagccctttcatttacgtagaaatgcttcagcgtttagataattgctacttatcttgttagctacaaacacaaccataattaaaggctctgtaagaattatgaattctggggaaattggccacttgtctctgtggcgtaaacagtatctaatttataacaaatcatctgccttagtcccagcaggataaggtgatatgtattgcccagcacatgagaaagatggcaattaggaattgttaccaagttacgggagcctcacacgaacatccatcacctttggggatatgtacaagatacaaacttaatttgatggattccttttgtattgggatcaaagtctcaaaagggaaagtgacaatttcagggaaaatctggtgcaatgagaccaacactgatgagagaaatgcacacaatttaatacacctgctcacctgatgtggcaactcagcctgtgcttgctgtgggttgccacaggatgagacatggtctgtgcatattcccagcagccacccatctcatcactattcttgccagcccagatttacagttgttcaatagatggatttggtaatatctgcatgacaacaacaggcagagaaggttagatggcaattgattcttgattggtgtaagtttatagaacacattctggcagggcccaaaggaaatcactcacctacccctctgtgatggtaaaacgttgaaaattccacggacttggaccttgtgatccttcagtggaagatgggcagattccttgctttaattgacagacactttctaaataactaatgcaatcttatattacattatagtccataagggagacatacttaaactactacttacaacaactgtttttagagcctttcaaatggtttgtacaaagtagctcccatttaagatattttcctagtatttaaggctatctagtagacattacaaaacaatacgctgtaaatacattcagatttttatcagtaatacttaacatgccgtaatttgaactttctgctaaatcatgctatccattcctagttggccccaatggtgagagtttactgtttctttaaataattttgtttccctttgctgtctagaggtgtttatcattctgcttacttgcctgtgtctctggaatattcagaaggttccatgggaaacaatttgaatatgcaaagaagttatttttaaagcaaggaaaatgttttcatatggatttattttgagcacttctgcctttgcctccactgggaacatgtttctctccaacgccgaagccccctccctgtgtggtgtttgacgcagaggctgacagggcagggaagtggggttcaagataggaaggccattggcagtgtgaccccagcccacagtcctagatcccaggtcgtgacaccactcttttgacagcccagattgttacctaacaagaatgactcccaagctcaaccattccaatgccatctcctctggttccagataagattgaagatgagctggagatgaccatggtttgccatcggcccgagggactggagcagctcgaggcccagaccaacttcaccaagagggagctgcaggtcctttatcgaggcttcaaaaatgtaagacccgtgcacgctctgaaggcctggggggggttcccacgtgaggctacactctccccaatgccaagggagctcataaggcgtttcccatatgtgaggctgtacaaggaaggccagctctataaagggggcatgagagggagatcacctggctagaaaggaaggctccaggcgaggatggagcaacctcaggagacagtaaacggccaactgcccagaaatttcacagggtggcacatcctcaaggaattcaccctggcccagggtcaagccttagcccttaacataatcataccttccaacctggtggtgcccccacaataatgggatttggccctgctgacttatgctaaccaggctcaccgagactgatgtgtaagccgaatgtcggtgtattaatttaccttgggaaatggaactgacagtggaaacagacactcctctcccttcgctgggacccgctctccttggaagccacatggaagccaggttacaatcaaaagtggagtcagaggacgggagttccttgtttagttgttactttaaatacattaatgtgttcctgcagtctcaggccagtttgagagctctcagatacaatcctggatattaatttattttttaagtttaactctcagagtgcaatcttattcccaaatcctggagtggtgtggagtggggtgggctacagcgacatgcacctggtcaccctccctccaggtgcagtctgtaggtagagctgagctgggtcagttccaaactgaccacagcctcaatgttctccaaactgctgacccacagggattccagcccctcctgggagttatctgacaggtgctgggatgcctcttccttccacactagccttgactgcacatgccaagtgcccagtttcctaccattagggcttctttccttcgatggcagcattagcagtgggcagccgagttggagaaggatcctgtgggaaagttttccaggcaggcactgggctcagagggaacagcatccagaaaagagaagaaatctacactgcttggcatctaccatggactcaataccacctaacataggttcataagatacccttggggaagttattgttacccccattttacaggtaaggatattgaggatcagagactggcttggccaaagtcacaaagcttagtattggctgagccaggatttaaacccaggtttttctgatcttaaagccccaaatctctccacctcacagtgcccattctctgacaatgtctcatcattttgcaaagcagctccagtcctgagatggcactacttgggagaagtggaaatgcacaggtccctgtccctggggatcatgaggaaccccagacaccaaggctgggcccagtcttctcctagtgctggccctcaaatgcctcccgctgactctctccccttcccacaggagtgccccagtggtgtggtcaacgaagacacattcaagcagatctatgctcagtttttccctcatggaggtgagtctgaccttgaaatctatcttgcccagctccctctctggtaagcagccttcccttcctccaagtcctctcttccttgccatttgcttccttctcgaggaagagacaaactcagggcaggacacctccctcatcgtgagaggtgggagtctccaaagctttagcaggaaagaactctgaaaatgaacccaccctggaaggggaagaagggctgataatgcaacatcacaacgtctcagaacagctctagaaagcaggtattataatcccagatggagtaactgagtttcggggaagataagcagtgtactcaagattgcacagctggtgagtagcaaaccaggattagattccataagggtctgaaacaggttttgccatgctggcaccaccattgtgcagggcacttttgaatcttttccttaaaatagctgagacaagctggaattttgtaaaagaacttcagtaaataccgaagactataaaaataaactaattgaaaaagaggcaggaaacataaagttgtgcttattaagccagtttacaagtgtgccaggcccacaacagctgctctgttgccctgcccgactcctgtgggaaccagctgtgtccccatgggcctgggaccacatcggtgactcctcctgtggcctccatgtgtcacatgccactttgcatcctgtcaccaagagctgtctcctgcaagacatcttccctggatcctgacaaaatgcaaatccaagtattccaaacacttcttgggccctgtttctcatgggcctttttggcagcagacagatgccttccttggtgtgtggggcccctacccagatcaggtgggggaggcagttttgtcccatgcaggccccagaattgcagtttgctgagttccactgagccactgtttattgagttctcactgtatgccaggcacagctgtagtttaaaatactttttaaaaaatttcaagagataggtcttgctacatcccattgtagagaggtaggaaagggaagctcagagaggtcgtgcttgatgcccacagtcacatagcttatgtagtacagcggcatccaagttcaggtctctctactctggagtgagtgctcatcccaggcattcatggccgttcagaagaacattgtcatgcagtcactgtgccattcatacaccaacgactccatgcatagacaggcaggagaatggttttctcatgatggctagagggaggggcaagggctcatctcactttttgctagatctaacttcacacccaaacccaaagagttgagtcaatgggccccactccataattttctcctttccatcaccctagcatcactctcctctctttcttgtcgaagccctgccttgtttggaaggttctccctgtgtggaattcctgcccccatcacctgccctccttttctgccttgtagatgccagcacgtatgcccattacctcttcaatgccttcgacaccactcagacaggctccgtgaagttcgaggtacgctcatctggggtccactctaggggtcctctggttctgcatcacctccccctctaaatctcaaggcattgggggaaggtctggaccatcaaaagctctcagtcagaccaaagacatgtttatccatttgtaagcatttcctaaagatggggaaaagcagcagcaactttccctggcctgcaggaactcagggactcaggggactaataacaacagtgtatgagcttccgggcacactgcttcccagtggcagcccctgtacttagggctttgtatgtattaattcatttactccaattcccacaataaccctatagggtagggttttattattgattacctttttacagaagaggagagtaaggcaaagagagatagagtagttttcccaaggtcaaagagcacataaatgataaaggatggatttgaatgtaggcagaatgaccctcaatacagactgttcctacagtccacgtcctcagccactagaccatacggccactgggatgatagacagaccactgcagccatggataaggcaaaaacagggctggctgtgttgatctgtgtctctcagagctccattcttcctcaagggggcaccttgcaaaaaaaaacaaaaaaatggggcagggtagggaactgaaggcaggagctcttcacagagcatagccacatcctccaggcagacaagaggacgcaggaggcaccattctgtgagagtatcacagtctgacccaaagacacagcttcacactgtctgatggcttgatggttaatgtcactctgccttttccccttctcaggactttgtaaccgctctgtcgattttattgagaggaactgtccacgagaaactaaggtggacatttaatttgtatgacatcaacaaggacggatacataaacaaagaggtaagtgagctggggccaggggtgtgagagggctccagtgaaggtaactaacccaacagaaaacagccccaggcatgaggatagcactgtctgaatgaggcaggctctgctttggggctaacagagctggtccctggcaaaataaagaaggcctccctcattgccctaccctgccctgttcccaagcgcccagaaaggattaaacagattcattctcactgggtcacctagattcagtagatattacacagtggataaaaatgacttgtttcagtgtgaagagttactcttccctagggaacctgcatttgggaaggttaggagccacaagtcaaagctaaaagttgaaatggtggaattgtaggcagcacctagaatagaaaagaaagatttttaaggaagaggaacctacaattgggtcatattggccttaaactattttgcctattaatacaaccgccaagggggtaatggaaggtacagctgtctttacagaaattatcacaaataatttctgaatcttcactgctttgcacttttagaacctcagaggacatgtctctagccagtgaaataccctcaggtctatctcaaaactcactttggtatccactgtatcctggtatctcagtggaagctggaaattggcatcctgtaacactccacttgctgagctcctgtgtgccaggcacggtgcctggaggtatagatatcagcaccaatcttcacctcaacccggcaagcttctctctgtaagctcagagagtttatccaactttcattcctcattcatttagtcatgtttttaattaacacagatttgaaggcttattaggtgttctaggtgctggaggtaaagaggtgaacaatcagactaggccccacactggagcagcatagagagatggacaataaacaggccaaaaaggaatcagcaggtagaagatattttggcagggaaggttagcaaaggcctctccaaggaggtgtcgtcatactggaaccagttatacaaaaagccaggaaaagtgttccaggcagaaggaacagccactagagaggctttgaggcaagatagagcttcatgtgtttcaaaaacagaaaggcttcagatggctgcagatgaaggtatgaagctgaagactagtgcaggatgagcctgacaggtcagcagagtcagatggtggagggctagggtaaggggcccatccatattcccctgggaagctcttagatgaacatgttttttgaaagacacaaaaggcaaaaacagacttaaaaagaatcagaaaatctgactagctctgtattatttagagaaattatattcacagttaaaaaccattcccaaataaaattataggcccagatggtggactggtgaattctaatatcaatcctacaaaaaaattttagaaaatagaggaggatggaacatttcccagcttgttttataagtccaatagtaccctgatacccaaaccaaagaaaaaaaggtcttatgaaaggaaacaactacaaaacagtctccctcgtgagcacagataaaaaagctttcactaaatattagcaaattgaattcagcaatatataaaaaggatgatacaatacaactatgtgagttttattctaggaaggcaaggttggtttaacattcaaaaaccaatcaatataattcactatatttaaagaaaccaaagggatatagactggaaaggaagaattaacactgtctttatttgtacatggtataattgtattaatagaaaaccctaagagtctacaaataaactgctaaaaataataagtgaatttaacaaagtgaagacatgagttctatttacaaaaatcatttataattctacatccaacaagcaaccagaaaattaaattaagaaaaatagcatcaaaaagcacaaaatactttgagaaaaattcaacaaaacaggtgcaagactcatacactgaaaactataaaatattgctgaaataaagtaaagaactaaataaacacagagataaatcatgctcatgggttggaaggcccaatatagttaagatgtggattctccaaatttgatttatagatttagtgtgatctcaatcaaaatcccagcaggtattttgtagcagttgatatgggaatgcaaaaaacctaaaataaccaaaacatctgaaaaagaacaaagttgaaggactaaacctaccttacttcaagacttaatgaaaatgtgcagtagtcaagatggtagggaattggcataaggatagacatatagatcaatggatcaaaatagagagtcaaaaaaactaaaagtagagctaccatatgatccaacaatcccactgctggctatataccccatgtaaaggaaaccagtatatcaaagagatatctgcactcccatgttttttgcagatctgttcataatagccaagatttggaagcaacctaagtgtccatcaacagatgaatggataaagaaaatctggtacttatacacaatggagtacttctgccataaaatagaatgagatttaatcatctacaacgtggatggaattggaggtcattacattaagtgaaatgaaccaggcacagaaagacaaacatcccatgttctctcttatttgttggatctaaaaatcaaaacaatatgaagatagagggcagaaggacggttaccagaggctgggaaggatagtaggggggctgtgggggaagttaggatagtcaatgggtacaaaaaaaatagaatgaatgaataaggcctggtatttggtagcacaacaaggtgactgtagtcaataatttaattgaacattttaactaaaagagtgtaattggtttgtttgtaacacaaaggataaatgcttgaagggatggatacccatttttcatgatgtggttattacacattgtatgcctgtatcaaaacttgtcatgtaccccataaatatatacacctactatgtgcccacaaaaattaaaaataaaaaataaatattttttaaaaatagagatagacccacccatatgtcaatgcaacagatgccaaaaagatcaaaggggaaagaaccgtgttttcacagctgtatatccatttggaaacaaaaatggacattaaccttaacctcatgccaaacataaacatcaacttggaatggattatagacttaaatattaaaacaaaagctgttttcttaaggaatacataggagaaacattcttacaactttggagtaggaaaggataaggaatcatttcttaaagtagataaatttgactttatcaaagttaaaaattttgtgctttagaagacacctttaagaaaatggaaatgcaagccatggacttggaaaaaatgtttgcaaattatataccagatatataaagataccaggataccaaaccaatataaagactggcatccaaaatatataagggacatttataatttaatacaaagataaacaacttcatataaaataggcaaaagatttgatgagatatttaagaaaagaagatatatgaatggccagtaaacccatgaaaggttgctctatatcactggtcttcaaagaaatgcaaattataactataatgaaatacaattgcacagaatggccacaattaaaaagactgataataccaagcattggcaaagatgtggagcaatagaaactctcatagatagctggcagaaatgtaaatggtacaaacacgttgggaaacattttggcatctttgataaagctcagcacacacttaacatacaacccagaaatcccattccagtcaggcatggtggcttacgcctataatcccagtactttgggaggctgaggcaggcggatcacttgagctcaggtgttcaagaccagactgggcaacatggcgagacactgtctctactaaaaatacaaaaaaaaaaaaaaaaaaagccagacatggtggtaagcacctgtggtcccagctactagggaggctgaggtgggagaattgcttaaccctggggagtggaggttgcagtgagctgagattgcaccactgcactccagcctgggtgacagagcaagaccctgtctcaaaaaaagaaaaaaagaagaagaaaagaagtcccactcctggatatttacccccaaaagaaaaatatgtaattccataaagacttgtacaaagatgttcatagcagctttattcatagtaatctcaaaacttaaatgacccaaatgtctgtcaacaggacaatgggtaaatacatcatagtctgttcatccaatggaatattactcagcagtaaaaaggaatgttatagttgcatgcagcaatgtgtatgaagctcataaacctcatgctgagtaaatgaagccagacgcaaatgagtttacactgttttactccatttacatgagattttagaaaatacaaactaatctatagtaacagaaattagatctgtggttgcctggtgtcaaagcttgagaggcactcactgcgaagaagtgtgaagggatgtcttttggttgtgaaaatgttctatatcttgagtgtggtggaggttacatgggtggatacatttgtcaacattcatcaaacagtacacttaaaatgggtgaatttgttataagtaaattatgctccaataaatttgatttatttgttgaaaaacttggtgtaagggggaagtgcctaaccaatagaagacactcaaaaaatgtgttgaaggaaaaaaatcctgtgaaataaagcaggtaagagaaaataagaactcaatatcatccaaaatatagattacaaatcctaaatgagataataggaaattaatcccagtgctctgtttaaaggctcatacctgtaatcccaacactttgggagactgaggcaggaggatgggttgagcccaggagttcaagaccagcctggtcaacatagggagagcctgtctcttcaaaacaaaaatttaaaaattacctgggtgtagtggcacgtgcctgtgctcccagctactccagaggctgaggcaggaggatagcttgagcccaggagttcaagcctgccctgagccataatcactgcaccacactccagcctgggcaacagaacaagacccttcctcaaaaaagcaataaaataaaataaagaaatgcacatgactaacatagggtttattccaggaatgcaggaatagcccagtagcagagaaagcctattaaataatttatcacattaatatatcaaaagatcaaaccatttgatgctaaaatcacatttgatataatttaccatttattcataataattttcaggattcaattaattaggaataaaatacttcttcagcataatagaaaataccccagcctggtacacagcttcatactttatggtaacacgcggagattctcactgaagaaaagatgaggcaagaaaagatgatgaagaaaagatgaggcaagaaaagatgatgtctgcacactgtcagacatcaccactgtttaacatttcctgaaagctcttcaaacacagtgaaacagaaaaggaaatgcgatctaaataggaaaaattacaacattccttgttaatgacatgattttctatctgagaaaaaagacagcaagaaaatcaacttaaaacaactagaacttttaaaaagctggcaaagtgactggtaataaaatacatatgcaaaaagaaattgtgtagccaatatatcagttgtgactagctagaaaattgtaatacaaatattctcattgtgatcacaataaaatttaaagcacatgggcatttttaaatatccataatttagatgaagagaaagaaaattttgataagtagagaaacataccatcttctgaaaggatgtatattataaagatagcaatattataatgacagcaattcttctctaattaaatttattttattttgaatcaaaatggaagtgttatttgggaaggaaatttggcacaattgttataaagttacattggaagattaatcagatgaaaatagcaaagataattttcaaaaagaagaaaaatggtgggatttgttctaccagatactgaaatatattataaagctgaaactattaaaatattataatatcagagaaggaacaggtagatcaatggaacaaaatagaaatcccaggtacaaataccatcttggttcataataaagggagcatattgaatagagaggtaatgaatcattaaatgattcttggaaaactggttaactattttggcaataagtaagtaaatattcttactcggtaccataaacacaaaatcactatagatatgtacagttgctttttaactaaaaaagaactaaaaatcatatgtgaatatctgatcaaagaatggaaaaagcataaaatcaaagttagaaacaattttttaaattattgatggctttacactgtaaatattttaaaattctgcatatcaaaaaataccataaacaaagttgaaaagtaagtgacaaacttgtttttaaaaatctgcaatttatgatgacagaaaggattgatattcctcagtagacattcatcttaacaaaggcaagagtcatattcatcgtgcttatctttgtatttctttgacacaatatctagcacatggtagatgcgtaaaaatacctttaaataaattaaaaatctattaagatattttaacaatttaataaatctacacgaatatataaagagctctcacaatccagtcagaaataggtgaacacaatgagcaaagcagatgaaaaaatagttcatgggaaaataaataaaaatagtcaatacatatattagagacctcactaagaaagtaatgtatatctttaaaaacaatgaattatcacttatctattaaattgcaaaggttttgtaaagtctttgttgaaggttggtggaaagtggtttttcatacatagttgctgaaagtgttctgataataaactttctaaaaggtatttgaggaatatgtatcaaaagcattgaaagttatgcatcccattctccttataaaaccacaccttggtatatgtcccaaggaaataaagaatagacacaaagacttaaaagcaagaagagtcttcaggtaatagtgccccagaatgtgatagccatgatatccactaacagcagatttgtaaaatgaattacagtaaatacatataatggaatagccagtggccacttaaaatcatgaaagagtaatataaaataaacattagtatgatatattaaatttttaaatatattacattttaaattgataaagtggtatgtatgatatctcaattttataaacaactaaatgcttatatacacatgcaaatatatgatactctaaaatattcaaatactaccttgcaaaacatataaagaaaaaaatacagaaataggatttagttggtcttcaactttggttcactcattattccatcactgaataaacttactagtgcctactccctttttgtaatttgcaaactaggcagaattctccccattaatctatcagacctctctggagggcagagttaataaagtaccccttaaaagaaaaagaaagtgtggataagtagcttctcagaaaagatagcaggatcttcccctggcaatcatttggagataacctcatccaagttgtaggctatgaaaatcctgagagagcaacaaaattgctctttctgtgattaaaaaaaaatatcagacaggaaaagcatcaatggccatgtagatgtgaagggcttgtaaagcacacatttaaaaataaacacatggatagagacatctatttcctcgttctatctgttgagggcacctcagagcaatgacatccctgtagcagtgagcatactagtacctagactttgatttctaaataccattcttcgataaacagaaccagtcttcttgaagaatagttgattctaagattgggaaagagaaaatacaagatgagcctggagtactttattatgctgaaggtataaaagtgcttaaaaaaaaaaaactgcaggagtcaacctgaaggagttcccaatagtcagaatgaaagcaatttgagcaaaattaaaaattattaagtactggattataacctgtaaaatatggtaaatgcccacaagtccatgctaatgtaaataaacaactgaatacataaataaatgcaggagagaaggtagctcttccttacagaagaattgtaattaataagtatagaaggaataaaggaaatacaaaattaccatcaggcaaacactacagtaataatttttgcaggcaagatccactgaaagatactaaatcagtaaggaaacttgacagacaccaccttaatcaagtgatcaaggttaacattatcagtaataagacatctcaacactatgtaactccctgatatgacgcactgagaaggttataccatcacttctgtggtattcttgccagaaatgcataacttcaatctaatcataactaaaccagggattaactcaaattgagagacattctacaaaacaactgacctgtactcatatcaaaagtgtgaggtcctgaaagacaaggaaacaaagaaactcaggctgggcatggtggctcatgcctataatcccagcactttgggaggcagaggcaggaagatcacttgagtccaagagtttgagaccagcctgggcaacatggcaaaaccccatctctacaaaaaattagccaggtgtggtggcacttgcctgtagtcccagctacttgagaggctgaggcgggaggatcacttgaacccgggaggtcgaggctgcagtgacggggattgtgccactgcactccagcctgggtgacagagcaagaacctgtctcaaaaaaaaaaaaaaagaaaaaagaaaaaaagaatgagaaactcatacagattagaagagactaaggagacacaacaaataaatgcaatgtagaatcattgaagggaaaaaaatattagttgaaaagctgagatcccgccactgcactccagcctgggccacagagcgagactccgtctcaaaaaaaaaaaaaaaaaaaaaaaaaaaaaagaaaagctgataaaatttgaataagccctgtagtttagttaataatagtgaagccatgttaatttcctgggtttggtcattgtgctctggttatgcaagttgttaacattagaggagactgagtgaaaggtatgcatgaactctctgtactaattttgtaaattttctgtaagtctaaaattattcataatatgcaaaaattaaacaaaaaataaaataaaataagcacatggaatgagactgtcccctgggtctctgtagaaaccaggtcaaacatcccaaatgctcttttacccccattctgagttgggccagaatggtcagaataatggttcccaatgtaccttgataaacacggaaactctcaggaccgagtcctaaggttctctgattcaataggtttggagtggacttgagaactgatctttttaataagggcctcagtctgtggaactattggcctcatgtgccctgtggataatcttggctgttggttcatttttcttaactgaaaacagtggcagaaactatggggatttttaaatctctaggctagaacattaactttttaaaaattcagaatagtattttatttgcctcaagcctgtgaatggggatcccacaaatcaccccccactgaagacaatgcccataacaaggtaacctacccatgagcttctgagggatttaggaattgtctaccatctcctctctaagaagggctcccacaatatatccccttctgcttgcttctaactccctatcacctgctaaagaaggacctcaccttttaatcactttcattgccaaggggcacaaggagccccaaactctgtcacctaggaagagcttgacctcatggtttccacactgtgtgcttttatgtccctgctccaggagatgatggacattgtcaaagccatctatgacatgatggggaaatacacatatcctgtgctcaaagaggacactccaaggcagcatgtggacgtcttcttccaggtaagtgcacacaccctgcacatgagctgtaagcccagcctagatcaagtcaacccacgagcatctgagcaaatgatttgtgtccaaccctgtactaagcatggttggtaacagaaaagaattataagatacattgtcctcaagaaacagatgatctccttaagctgcaagtgtacatgacagaagagaacaagaaagtatattattaaacgctagtggtatagtatgaactctaaatccataaaaatttggggatcagggtaaacacgaaagacttcattaattacaactgtggaggtgttaagcatttgtgtctgggaagtaaggggaaataagattggaaactaggatagggccagattatgagacctttaaatggaagagtttggccttgctctggtacaggatgggcagctagtgctgatccttgactaagggagtggtataatcattggggcattttaggaaaaaattaatctagcggtggagtatcagagaatatcaagagttcactctagttcaacctcccactttgcagatgggaaaagagagtcctctctggccttgtgcaagtttgtacagcaagtaacaggccagaatcagaacctcttttgcccagtgttctgccagatggacagggtagcagggagtctacagaagaagcagaataagccagcagtgaggtgatgagtgtccagagcaagtcttttgatttaaggaagctcatggggctcaaagtgttgtaatcaggacctaattggagttgtctggccagtgaaagacaactctcattctcagggcaaagttggttaatgaaatgaatgaaatgagctccagctcgttactctgagctccagcaagaaagcaggggagtaagctttggaatggagatcaccagattctgtaaagtgctttctgttatgtctttcagaaaatggacaaaaataaagatggcatcgtaactttagatgaatttcttgaatcatgtcaggaggtaaggagagatctcagggcacaataactctacatctgggaaaggaaacctggggcctggggacctgcagaaggaaggtgatgagaaacctgcacatacctgcaacccctcccatcagagccaacaacaccagcaacaactgtgaagtccacagttccactcctcaacctgacctgcagttggtcttggctaagcacaagactgaacagagagcctaagtaggggtctgggggcatgtgaaaactcagagggggtctctgtgaaaatagacttcccgagagggcaacaccattattttttagcctgcctctggcttgatgacccatttcccagactacaaggaagcagctggggggaaaaaaacctacaattgtgtgattctcaaaccacagtgtgcataaaaattgcctggaatgattctgaaaatgcatatttccaggcctcaatcccagagactctagatctgggtcactttaacacaaatgtcctggaccaatgcttctaacactttaatgtgtgaaacaatatccttgatgattttgttaaaatgcagattctaattccataggtctggggtagggcctgagatgttacttttctcacattctccccagtcacactggtgatgctgatcctgggaacacaactttcattaagtctaaccaatagaccagccccagagtccaccagagactgaactggaaataattgcttcatctacttttgagaaatccatttgtacccccacattattttagaaatgttcagagttactctgagctccagccaagaagaatagcaaatgtaagaaagccggggagaagttcctagcagatactgagcccccatcaagtttcaagcacatacataaacatcacagccaccctgttatgtagatgtcctatgtgcagggtgatatccaagatatttaacaactagaatggaatgaacactgacccccttgggggtgagttctcactgttaattcccttgagagctggttgtaaaacagcctggcaccttccccacctccaaccttgattcctctcccaccatgggatctctgcacacccagcttcccttcacattccactgtgagtggaagcagcctgaaaccctcaccagatgcagatgcccagctgaactttccagctgccagaataatgagccaaataagcctatactgacattaaccttttcatttctgatattgataatttgaaaagcagtcttaataagcatttatctactttattgatttttttgaaagagagcgctttggggggttttcttactgtatgtctctattgcatgttctgtattttacatttttctattatttcttctctgaggtatagtattgaatgtagaaaaatcctcaaatgttcggtattaagcaatacacttctaattcatggttcagagaagaaaatatctcgaataaaaataaaataaaaatatgacttatcaaaatttgtaggatctaaagcagtattccaggaatgcaaggttggtttaacattcaataattggtcagtgtaattaatcacattaatagaataaaaagagaaaaaatataatcatttcagtggatgtaattgttcagagcttcttaaaagaagcaactcactattttactagatgatttgtttcttctgaattcctctttaaggctacaggtggtgcttcttactttgaactgatcactttctaggtccccacccttacttcttgtttttcatacccttgtagagttttctccatataggaaacccatgcttgacatttgctcaccagagttacagagctctcagggaggagactcagagttctaaccctcttgccctccttttttcccaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaagaattctctgctgaagactttctatggaacccagcatcatgtggctcagtctctgattgccaactcttcctctttcttcttcttgagagagacaagatgaaatttgagtttgttttggaagcatgctcatctcctcacactgctgccctatggaaggtccctctgcttaagcttaaacagtagtgcacaaaatatgctgcttacgtgcccccagcccactgcctccaagtcaggcagaccttggtgaatctggaagcaagaggacctgagccagatgcacaccatctctgatggcctcccaaaccaatgtgcctgtttctcttcctttggtgggaagaatgagagttatccagaacaattaggatctgtcatgaccagattgggagagccagcacctaacatatgtgggataggactgaattattaagcatgatattgtctgatgacccaaactgcccatgtcatttgtttccagaaacgaggaccaataattctctcacactggcatttgtgctggtagtacaagtcctttaatatgtccaggaagggagccattgcccagtggtccatatctccaccacatcccctgcttgagcccagcgctgcatgtccctcccaagaagtccagaatgcctgcaaattgctgtaattttataccatgttctaaccaataaacagaactatttcttacactctcaatcacttcttcatgactccgttaggtaagagaggtaagctgtgaaaagggaaggctagtccattcatttgacacccaattattagtgcagttgtccctccatatgtgtgaaggatcagtcccaggactctccataccaaaatctgcagatactcaagtcccacagctagccctgagggactcgtgttttcagaaaatttggcctccatatatgcaggtttcacatcctataaatactgcattttctatcacttttggttgaaaacaatctgcatgtaagtggacccaataagtttaaactcatgttgttggagggtcaactgtacttacgttgtgccaggcctgtgccaggcaatgacttcatcctccccagcccccaagccttccccagcaaacatccaatccaaatgcaaatactgtgaccaaatgcaaatgcaacttcgagacaagacccttcacaacactttgcttccaacaagattgccacttctaagaccctctgatatggaaagcctggagcccctgtggtgtgagtgggagtgcagagataaagaggatgacggggcctcctgctgagagattttaggctctagaggaccatcaagcggcttcagcctataaccagcaaatgattactcatgttgaacactgtgggtcttagtttccccatttgacatcacatttgaaagactaaaagctaacagtagcattcttggaaggaaaacaatttactgaaaccctattttgtgccaggtgctgcactaggggctttatatacattatcttatttcatgctcatgtggagcattccagatggtagagtcctggttgtactgatgaggttgctgaagctcagagaggtaagggggacctgcgtaaggtagcacagctgatagggactccatagggaggctaaactcttctcgctctatcatagacccttcctacaaggggattttgcctcaccccaaggatgaggatacttcccactaatctcattcatctgaagtcagttcagagaggcattggtgttctttgagtctgtgtaacagatggagaaacagatgcagagaaggggaatatctcaggcagccacagtcaccggcagggggaggccacaaaaacatctcctgcattcatgacacatcccactcagatggccattggctgctgcctcttatggttggaaattgtaagtgtgatgatgagaatttgttggatagttcagacctgttcctctgggcttcctgcatgtagccatgtggttccctaaggcttctgggcatgtggctggtccccagcaaagcatctacttaggcccaagagaggatctgtcctagagactcttcccatatggggtcctaacctgcatcttgaggctttatgatgtctaggccagtgttccctgccctggctgcacatcagaatcacctgggaactttgaaaaatgtgaacatctggatgccacagcagaccaactgaaggaacatccctgaaggtgggacctgggcctcagaattctttagaggccacccaggtgggtgtactgggcacacagggctaaggtggagaactgacacatctagagctgcgaatgaagcgcgtggtctgagccatccccctggccacaaggatcaattcagggataggcttgagacccacgctggttcaaacagcatgaatctccaaactagtgctgggaatgatgagacaaagatgttctccctcaccagacatgaatgagagcgcacatagccctaagacatgccagtaactatttaggaattctgagagtttatctaataatcagagggttaataagccagagatcacataaggcaaggcagagagatgaaaaaaaaaaaaaagcaagcagaaacgagcctttgataatatcattgatctgctagatcaagctgcttctgaagctggacatacctctgaccttttcaggtgcctgtgtcaggtgcctatataaggtctaggtcaggccgggcacggtggctcatgcctgtaattccaaatttttgggaggccgaggctggcggatcacctgaagtcgggagtccgagaccagcctgaccaatgtggagaaaccccatctctactaaaaaatacaaaaattagccaggcgtggtggcgagtgcctgtaatcccagctactcgggaggctgaggcaggagaatcgcttgaacccgggaggtggaggttgcggtgacccaagatcacaccattgcactccagcccgggcaacaagagcaaaactctgtctcaaaaaaaaaaaaaaaaaaaaaaatctaggtcagtggctgccttccttccccgctggctgcatgtcagaatcacctggggagcagaggaggggaatgtttttgaagtgccaaatgcctgggccttatcccaaatgaattgcatcagaatatctggaggtgaggccctgaggatcagtatgctgtaaaggctcaccaggtgattccaatgcacacctatggctgcaaacccctgctctagagcagaggaagtactggtacccctctccctgtgttagccagaccacaagtaagacaccagcatcagccctgggcacttaaaactgagaggaaaatcagcagcttagatattcagagagaattcattgtggatggaagttttaaaagtagtcctcagatggataaacaacagaaagggagatggttgtcctaatgaagagcagggaaaggacacgttgcagcaatgagagcgtattggcctcatctcccacttgtcttcttggagggatcctgctcctcttgaaccatccaacaaattctcaccatcacgcctgctgatggggactcaactgtgcagcaggtgctatggacactttgcccaatccccttggtactcaccatcaccctgcaggtagactcaactgctgccaagtgcaatcacccgagagtttttgtctgtgactctaaccatcacagagtgtgtccatgacagcccgctatgttttgggtatttgagtctctaagcctcatgttgacatttatgtccaatgttgaaagggggcctaagataaggtgtttgggtcatgggggcaggtccctcaggactagatgaaggccctctcttggggctgagtgagttcttactctgttaattccttcaagagtggttgttaaagagcctggcatcaccaccacccctccgccccactcctcacttcctctctcaccgtgtgatctgcgcacacccagctccccttcaccttccactatgagtggaagcagcctgaagccctcaccaaatgcagatgcccaatcaaactttccagccaccagaaacgtgagccaaattaggctttttttctttataaattacccagccttgggtattccttatagctacacaaatggactaagacacagggccattctgccatggacatatcagtccaaaggatcaggtcatcaacacctcctagaagaagcccttggccaatgaccgatgggacttggtggacaaatatcccagatccttctcctctcagcaggaagaactctgaggtctcttctatatcatctcctagacttccctggtaggactgagccccagttgctcacaacagtaacttatgatgaataagacagacatgtgtcctgctttcataaacttcatattctagcaggaggaaactgatgacaaatgaaattattttagatgaaatggcatgcataaatgtgtggcatgctaaagagtatacagggtggctgcgggtggagagtaagtcttctctgaagagcagaccactgagcttgacatgatttggatcatggggttctccatggacaacatcttttttgagtctcatgacaaccctgcggggcaggtatcctaggcacctatttttcagatgaaaaaatgatgcccagagtcatagaaggaattacatacacagcaggaagtgggcttaaaagtctgccaagctccaaaatccatgcccagctttatttcttacagagcataaagaccattctccacctattcctaaaactagctctgatgatatacaaacaccagaaggtgtcaggaagcagatgctatgaaaactattagtaaaaagcaatgaaaacaaacccacaaatctgagccaaattattcctcctgtaaaaggaatcatgccaaggacttgtgcaaagatggccatatgggtttcttagaggagctgaaataagcatgtccttccacatcaaaataaggctcaacctaactggcagacttcagctagccctgcagtctgctccattgccttactggggaccaacaaagctcagaacttgaagactggggggagcccgagaggcagccagccccaccgggtaggatcctgaagacccatgatatgctacaggtcccagttctagaataaaacatagggaccaagactaagccaatcattacctcccatgcctctggccacagtgaaattttaggaataggcttaaaacctaaactcacgcaaatagcatggaatgttagggcttttactgagaacaatgaaagttgctcattgtcctgcctgacatgaatgaaaaacacagagccctgggacctataggccaccattctgtaatctgcagggaagccaagctagaaatgtaggtaaagagaccacagtgattcaaggcagagggatgaaagaatgggttgctgatgtcattgaactgcagatcaagcttcatatgaagttacatttacttctagtgttcattgcacgtatccataaatatcaagaaatttgcttttctttttttttttttttttttcttgagacagagtctcgttctattgcccaggctggagtgcagtggtgcgatcttggctcactgcaacctccgcctcccaggttcaagcaattctcctgcctcagccccccaagtagctaggattacaggtgcatgccaccacacccagctaatttttgtatttttagtacagacaggatttcgccatgttggccaggctggcctcgaactcctgacctcaggtgatctgactgcctcggcctcccagagtgttaggattacaggcgtgagccaccactccaggccgaaattcactttttaaaggcaattctagttgaactttctgtaacttgcaacctgacactttccattaataagccccgtcgtctaaccctctagtgtttcttctggccactttattccccgccatgcttctccagctacatctcatcactctctactcccagcaggaagcctgccaactccagtctaccccttctgccctcatcccaaagcccagtcgggaccccttatccagactagtgcaggcgagaaacagaggtctgcaatcctgtgtcactcttccctccagtgtgaactatattcagctggtgtccatgagaacgcctaaagggggacaaggattttaaggcaggggtttgagaacgaagagtatgcagtccaccccaacccgctccctgctctacctgagggtcaaagcccctcactgttcacaatgacacagactaggcaagtgctgggggagagccggggaaagacagacaaatgtggattctaagcagaagagcaagagagaacactaaacttgctgtggtcaagaaagaaagtaaaaggaggaaagaaggaagcggggaggtgaaaggggggcagaggaggaatgaataaaggggataaagtccttatgtagtaaatgctagcccaccgtaatagcgaattttatgtgttaacttggcaaggccatggtaaccagtttttggtcaaacatcagtctgtttggcattgctgtggaggtatttttcagctgagactaacatttaaatcagtagactttgagtacagcaagctatcctccataatgtgggtgggcctcatccaatcagttgaaggcctcaactgagagaacataagtcccccaaggaagagagaacactgcctccagaccgccacgcgattcgggacggcaacatcaactcttccctgggtctcgattttagacttgccagtccccacaatcacataaacccattccttaaaataaatcagtctggccgggcacggtggctcacacctgtaatcccagcactttgggaggccaaggcgggcggatcacgaggtcaggagatcaagaccatcctggctaacacggtgaaaccccgtctctactaaaaatgcaaaaaaaaaatagctgggcgtggtggcgggcgcctgtagtcccagctactcaggaggctgaggcaggagaatggcgtgaacctgggaggtggagcttgcagtgagccgagatcacgccaccgcactccagcctgggtgacagagcgaggctccgtctcaaaaaaataaaaataaataaatgattctggggatgtgtctgtctgtccatctgtctctctccacacacacacacacacacacacacacacacacacacacacacacatcctgttagttctgtttacctggagaaccttgactaacatacccattaaaaccaaaatatgtccttcagggtgttaatgtttggttgaagaaacacagaagtttaacaattgtatcaggctgggcacggcctataatcccagcattttgggaggccacaatgagaggatcacttgagcccaggagttctagaccagcctatgcaacatagtgagacaaaaaaatgaagaaaattaggggtgtggtggagcgcacctgtagtcctagctactcgggaggctgaggcagaaggatcgcttgagcccaggagttcaaggctgtcgtgagccatgatctcaccactgcattccaggctgggtgacagagtgagactctgtctcaaaaaaaaaacaaatctgtaccaaaattagatgattctagataaccaagaaggaactgtgcgagggcactctgatgggtggtcagagcagggtggagagagggacagcatttctggagcaacttctactgtcagcaccgaagaacagcacctaatttactaacacaaccaccctctgatatacaaatagaaataaactcccctttttccagacagggagagctcaataaggtaaaaccaccagcccgaggtcgcactgccagtaattaatgggttcagaacttaataatgataatgataatgaccatagcaacgtttattcggtgctcataatgagccagacaccactctgaatgcctaatataaattatctaatttaattctcaccaagaaaaaaaatcctatttcatttgatgtcccactttatccacaaggaaaccgactcagaagtgatggagacaggtttcaggtcagctggtccaatcccaaagcccattctacacgcgcccctactctggctacctcccactccaacagaggcgttttgtctccgacacctcccccctgctgttcacacaaagggaggacaaccctgggggttctggtaatcctggaaggcttcctgtcagaggtgggccgggggaaacgcgggcaggagaagggaagtctcgctcaggggagtggtgtgcatggggcagaggctgccagggacgctgaaggctgatagccgggttggcgcggaaatgggacgccgcagggtgggacaggcgggagggatgggatgggcagggtgtgatgccggacgaaggaaacgggcctgcccggcaggtggcagagagccacagaagagctccgagggggtggtgcgtgagatggcgctgcaggctggaaaggggctgcaggcagggtgcctccagagaccgcaagagaacagcttgcgagggaccgtgggaacttcaaggaaccgcaccgccctcctggaccacccgagaaaacaggggaagtgggcgaatgagtagaccaaagtactcatgacagggcaggagcaagtgagagaccctggaggaccatggagagaacgtggtaaccgatggagagggatgaaaaccgagccgcgggtgtgagtctgaggcgcccccaggcccaccagcgtgtgagcggcaggtgctgttcgccatcagccgctagatggagccggcgcctcgccgaatgcgccgggatccgtcgcgtggatgtcaggtccgggccagggagccaaagcggcggctccgcggggaccctccacagttccggactccagcccagcgccggcttcagggcgtgcgaccctgagcttggtttaacgctccgccaccgcggccttgaaattcacaatttgtgaacaaggggacccactttttcatttttatttttgatttacattttattttatatgttatgctatgttgttatgtatttttgaacgggtctcgctctgtcgcccaggctggagtacagtggcgcggtcatagctcattgcagcctccacctcccaggctcaagccatcctcccacctcagcctcttgcaaagctgggactacaggcgcgccagcacgcttggctaattttttgtattttttgtacagacagggtttccccatgttggccaagctagtctcaaattcctgacctcaagtgatctgccttcctcagtctcccaaagtgctgggattacaggtgtgagccagggcgcccggccccaccttttcatttttgccctgaacttggcaaattatggagcaggtcctgcccagggctttcagtttccagcactttcttgccttgactcattttccctcccacaccgcagtgaggagaggttagggtcccatttttttatagaccaagaaactaaggctcagagaggcgaagagatctatttaaaatcacgcactggcccttggtggagcagggccagaagccacatttgtgaccccaagtacagagctctttcccacccacctaagaggctgtcccctggcaggcagggtcccacctagaaggccaagaccctcgcccacgcccagcagggagcctccttcaggcccacctgtgcttatggatagcttagggtgggccagggcatctgggctccagttgctcagaggctggggcagggctgggacaagtggcagagctgttcccagagtctgtttcttctgatgattggaaactccctggcagccaagaggaagaggcagtcctcggagcccaagctgccagtcctggctctgcttcctggacagccagccacagacactggcggtcagaaggaccttccctcggggcagctgccccaccacggagctcctgcacgcagagcgggagggaggaaaggggcctggcttccaagtgaatgagacagaccagagcttgagtcctggctccccgcattccagctgcacgcccttaggcaggtggcccctctgagccttgctttcatcagaagtaaactcaggatcacattctcgggactgctgcagggagggttgcatagtgaaagcacctggcaagttgcagagacttcataaatattccttcatttactctcggtttcagtcacaaaggcagctgagttgtctgctctggaatcttcccctgggggatgaagcacagaagcctgctctgggggtcacagactctcccctaagcagggtgggggcagagtgctcggtgaggggagggctggagagcaagagagctgtgagaaatatgctccatcaggccagaccagccaccggaggggatgggggggcatggggggtgggggcccactgcaggtccgaagcggcctgccaggtggctttccacgctggttggggctgcagacaagcagatgcattgaggccaggccatggggcaggaggaagacaacacaaagataataatactcgcattgccccatgtggttctacaaccccaagctggtgccaaagccttcccctcgctgcatcctcacctccgcactttacaaatcagtgacccaaggtcaggagagtgacacaaagacgtggaccagcctcctaattcttgattcagtgatcaccctggtattgcagagtcagggccccagaccatggaacaaaggggcaggaaaggcaggatgtccctccttgttc

SEQ ID NO: 297 - DNA, 424120 bp, Homo sapiens
tggtctcactatgctgcccagactggcctcaaacacttggacttgagcaatcctcccacctcggcctcccacagcactggattacaggcatgagccaccacagccggcctggggagagatttattgagcgacttctatgtgccaggcactgtgtcagggggagacacagacaacaagcaaggggatacgtgagaaagaaggaagatcaatcgatgattaagatggctatggagaaaaataaagcaggggaggcccagcggctgcaagattttatttttaaatgggcgggtcgaggaagaattcatggagaggctgccatctgtgcaaataactggacgaagggcggcccatctgctggtctatccacccactcactcacccacccactcatgcacacatccaccagcacatatgcacctcctcacccatcaccacccacccagccatccagccttccaccagcctgcccacctgtcattcacccatgcacccatggcaatccatccctccatccgtccatctgtccattcgtctgtccatccatccacccgtctgtctgtcgattcatccatctatccgtccatctgtctgtccatccatccatccatccatccatccatccatccatccacccatccaccaatctatccatgcatccatctgtctgttcatccatctgtccatgtgcatctgtccatctgtccatctatccatccatccatccaccaatctgtgtatccatgtatcaaactgtccatctgtccacccacccacccatccatccatctgtccatctctctacccgtctgtccatcacttcacccacctgttttctcctctctccagttacccactcaccacttactaacttctccacagtgcctagtctctccaggatggcgagtcagtctctggtctcaggatgcccacactctggggaacaggcagcaggtagccatgggggattggccagagcaccccaagagcgtaggcagttctcgtggtttctccccagccagcgtatctcccagaagaggtcactatcctcgaggccaggagcctcaccttccgctcccctgacctcccccacaccgtaacccagcaaggctgggaattcagtaggtgcccaataaatcccggcaggctggctgagtcatcccacctcctcctcccctactgatcacccattcagctcctggccccattgcccaaaccctgccagcctttgggtgatctgctcagccgccacctcacatccactctcagctcggggccagctctgggctccagcccgtgatgggccatggtgggcttcagagggtgagccccccacaccattgtaccagtctggcaagacggatgagtgccctggtcagtagtggcccaccttggcctggaaggatgtagggacaggctgcccacccccatttgccctccttctctgagtggctaggacagccaccaccactctccagggaggggaggggctggcctgtcacacgtcccggacaggcctgcctgggcccaggaaagggctatgtgtgtaggtggcaggctgctgccctgggcaggggccccgccagggctggggaggcctcagacctttagattgtggggctggtccccagcactcccactgggggtgggaagcttggcggccagtgacgggagggtcagcagaggggcccgtgctcctggctgaagccaacctcccacacaaggtgatgccgacaactccaagaatcgatgctgtgtcaggagcagtctccggaagtgatttccgccagatgggctgggcccaggtgggaatctgggagcttccccagaacagggagcatgagaccagctcagagagtctgcagtgacatcagatgacctaacctcagatcaaagtgaacgcagccagaagcaccccgctcgcccacctgggcactgggccgagaccctgggtcctgggctgggaggagtgagtgtgggtgtgtgaccttcagggagggccccgccaccagccatgagcccacagggtgtagctccccacctctctactctgccccactgctttctgtcctgggtgcacctttcccagcctgctggatcctgctgctttaaggctgcctgtcttaggagaagggatgggggatccccaggtccttcatggtgacaaaaaggctctttcacacatgcacacctacacatacttgcacacatgtgggcagacacacatacagcctcagtcttccctggctggttcccagcttgtcgtcttggaagaggaggaggtggggtacacccaagctgtgaattgggagacaggtcatgacacacccatctcctacatctcctgatttcacaggtgagaaaattgccttggtggggagccctggcttcagtgtgcatgtggacctgcttctgggtggggggtgcctttctctatgaaggtgtgtctgtcctgcaccactgtgggattcaggaaggcaaggcctcttgtgcagtgtgtggggcacagtcaatgccggtgctgactgtggagtgaccatctgacatagcctgcaatcaggaaggaccatgtcaaggcagaactgaaggaccctgagctagttctggctctgtcctgctgtggtgcccaaacttggggaccctcaggacattccaaacctcagggtctcctgcacaggagagaggggagtacactaaaatgcagattcctggggccgacccagccccactgtactgggtctgcattagaggctgtttacagagcccccaggcaactgccctggggtcccctcccagacctgctggtaggggtgggtctgagctgaccggtctttatgagcatgcgggggcaggtagttagggaataggtgaggcagtgatgaaccaggaaccgcctgtggggttaggatcaagaacaggggcttgctgatgaacgtaaatataaaaatcctcaacaaatactagcaaaccaaatccagaaacacatcaaaaaattaattcaccacagtcaaatagacttcattcctgggatgcaaggttggttcaacatatgcaaatcaataaatgtggtttgtcacataaacagaacaaaaaaaccatatggtcctctcaatagattcagaaaaagtctttgaaaaaatccaaacatcccttcatgataaaaacctgcaacaaactagccatcaaaggaacatacctcaaaataataagagctgtctatgacaaacccacagtcaacatcatattgaacgggcaaaagctggcaaaagcattccccttaagaataggaataagacaaggatgtacactctcaccacacaaaaaaattacctaggaatacatctaacccaggagatgacgcatctccacaaggagaaacactcctgaaagaaattggctggatgcagtggctcacaccagtaatcctagcattttgggaggctgaagcgagcggatcacttgaatccaggagttcgagaccagcctggccaatatggtgaaaaccccaactctacaaaaaaatacaaaaattagccaggcatggtggcatatgcctgtagtcctagctactggggcggttaaggtgggaggatcacctaagcctgggaggttgaggctgcagtgaaccaggactgtgtcactgcactccagcctgggtgacagagtgagaccctgtcttaaaaaaaaattacagatgacacaaatggaaacacattccatgctcatggataggaagaatcagcatcattaagatggtcacattgtccaaagcaatctacagattaagcgctattcctattaaactaccaacgtcatttttcacagaattagaaaaactactctaaaattcatatggaaccaaaaaagagccagaatagccaaggcaatcctaagcaaaaagaacaaagccagaggcatcacattacctgacttcaaactaatgttcaaggcgactataaccaaaccagcatagtactggtacaaaaatagacacatagaccaatggaacagaatagagagcccagaagtaaagccacacacctacagtaatctgatcttcaacaaagtcaacaaaaataggaaatggggaaaagactccatattcaataaatggtgctgagacagctggcttgccatatgcagaagaatgaaactggacccctaattttcaccatatgcacaagtgacacaagatggattaaagatttaaatgcgagacctcaaactataagactactaagagaaaacatcggaaataccattctggacatcagcgctgggaaagaatttatgattaatttctcaaaagccattgccacaaaaatatacattgacaagtgggacctaattaagctaaagagcttctgcacagcaaaagaaactatcaacagagtaaacagacaacctacagaatgggagaaaatatttgcatctatgcatctgacaaaggtctaatatccagaatctataaggaactcaaacaattcaacaagaaaaaaataaataaccccgtaaaaattgctcaaaggagatgaacagatgcttctcaaaggaagacatccatgcggtcaacaagcatataaaagaaagctcaacatcactaatcattagagaaatgcaaatcaaaaccatagtgagataccatctcacaccagtcagaatggcctttgttaaaatatcaaaaaacaatacatgctggcaagagtgagcagaacagggaacgcttatacactgtgggtgggaatgtaaattagtccagccactgtggaaagcagtttggagatttcccaaagaactcaaaacagaagttccatttgacccagcaattccattaattcctggatacatatacaaaagaaaaatcattctaccaaaaagacacctgcacttccatgttcatcgcagcactattcacaataacaaagacctggaattaacccaaggtgcccaacagtggtagactgggtaaagaaaatgtggtatatacacaccatggaatactatgcagccatgaaaaagaataaaaccatgtcatctgcagcaacatgggtccagctggacaccattatcctaagcaaattaactgaggaacggaaaaccaaataccacatgttctcacttataagtgggaaagtgggaactaaatgatgggtgctcatagacatagagggacaacaatagacactggggactggtagatggtgggggagcaagcgttgaaaaactattggctaccattgtcactatctgggtgatgggatcatccataccccaaacctcagcatcacgcaatatacctatgtaacaaacctgcacacataccctctgaatctaaaaaagaacagcagggccttaaatggggtgatgccttacagatgtagggcatcatatccataggagacattcgccaggcataaggatcctctggagagacacatcagcttgaggaatacagggtggtggctctgtccagccaccctgccccatctcctaccctcccatccattctgcattgggtgcctcctgcatgcagagtcctcctccaacagcaaatgcctcccagatttgctgaagggcctgctccagggtctctgtggagacgcccctgggacccttgctgaccaccctccacaatctgcacccccatcctgtgcccccttcgttttttttgtcccaccactacctggtggtgagacagctctgtaacctgcgcctagaacagcgcctggcactcagccggtgctctgcgaggatctgggggaatgaacgaatgattgaatgaatgaataggtaggaagactacctgaaggaggatgttggccaggaagcctgtggtggcctggctgttctagcagcccagccctggcccgcagatgctgatctcacagcagccacacacccttcccttggtcagcctcagcttccccattcctcatgcattcttggtgacttctgaggctcctcccactgtgggcctctgaccctgctggaggaacatgaggtgagcctggtgagctgagggatgtcggcaaacagccctggaaggttggtgtgaggtagattgagtgccatgtttccagaaggttctgaggctctgggacagcctgagagcctgagaggctgggagagggttgccttcctgttcatgctggctgataggtctgtcagtctttgcatctaggacagccagggctggacatgtgcacccaccggaatgatagaggaggggctttcctcagtggagggtgtgtcctggagagagcaggtggcagctgggaggctacaaccctgcggtcctgctccctcagctgatgggggccctcctcacctccttgctcacacagagagtggccactgggctcggtcaggccccacttgtattgtctgtcctaccaggccatccacccttactcccccaccctcagcccttggcctcacctgagcccacacccagcccagcccagccccaccttacctcacctgcgcacctggccttactccctcctctcagttccccacccatcccccttcagctccttggagcttgcagggagcttgaagacaatcccttgtccagtctctctcctgcctcagtgtccccaagccaatgggaccccatacccccagagcagcaggctgtggcacagctcagggcccaggagacagccctgggggcctccaagaagcctccctagtgagttattagaattttttttttttagatggagtttcgctcttgtcacccaggctggagtgcagtggtgcgatctcagctcactgcagcctctgcctcccgggtccaagtgattctcctgcctcagcctcctgagtaggtgggattacaggtgtgtgccaccacacccagctaattttggattttcagtagaggcggggttttaccatgttgaccaggctggtctcaaactcctgacctcaagcgatcagcctgcctcggcctcccaaagtgctgggattacaggtgtgagccactgcatccggcctagaatttttaaaatatggaggcttgacctgcctgaccgccctgccttttcactcgttttcagaataatgagcaaagcaacctgcagaagatcaaataggatttttcagtattatcatgaatgcatgggcttttcagctatttgatgtgttttcatccatgactctttctgatgctcaaattgtcccattgttgatcagccccttctcaaacttgacaatgaacaatagtaggatatacctttttcctaagataaaatagctgaggagtctatgctaatatagtccattcaatttaaggactggtttgtacttctttgattttttaaatctgtatcacttttatactgaaaatcttggttccaaaggaatttagcatcattctttgatacacacacacacacacacacacacacacacacacacacacacacagagttctttgggatcctttggttgagtattagtgatcatattgatcatggcactccatcgtgtgactgtaccacagcacagctgaagcgattgaaggacattgtgattgtctctagacttttgctaatataaaaaatgctgttttgactatcattatgtatatgtacttttctatttttcctacatatctttgggttatttcctagaagtggggtttctgtgtcaaatgatacatttagtaatatcgctaggtctcttttctaccagtgatgaggagtgcacctgtgcctgctgcctctcccacagagttgccatcaaaagtctggatttttgccaatctgataagcaagcagtggtatcagagtgtacttttcatttgcatttttcttgttataaatgaggttgaacattttttcataagtgcaaaggtcatgaaccccatttcctatgaactgctcatgtcttctgctcccttttctataggactgtctggcaggttcctcacctcagttttgatgttctttatgtatcagtgatattaatcctttgtgatcgaaactgcaaatacttttcccatttggtcatttgtctcctttactttgctaatggtgcttctattttaatttttcttattttatctgttgcttttggatttcaagtcatagttggaaatgttttcccgattcacaggttcttgaggaattgacctgtacattcttgtagaatttgcatggcttcatctcaccctttacacttgagcctctgattcatttgagatttattctcgtgtgcggtgagatggacccaaggtatgctttttctttctttatgactgtccagttgtccaaacgctgcttattcaaagctcaccttcctcctgctgaggtgggaggggaaggcagagactccatgcaggtgtatgtatgttcacccggaaagtaactgctgaatgcgtgctgtgtgccctgcagagctgactgactgcccccatcttctgacccgctgcccttctgcaccttcactgatatgcttcccaggaaggtaccctctcctcggcctcccttgtgttatcacagcgcccagcacaagctgggacccactccatccactcttgctgcaaatacagactgtgcactcctgtgtggcacctcactagggtggggagtcaggcgtcaagggcctgggctggactccgtccacgataaaagagcagacttttggcagggggtggtagatacatcaaattgacccagggtgctcagggacgacctggaagtgtcacatgagttatgggtctcctggcggggcggagagtcaccgctgagctccacctttagtccctgcctcagggctgtgtgcagtatcctgaaaaaagccggtctcttctgttggctgccccccaccccccccccaagcctgagacgtgctgagacccaaatgccagtagcgggcgggaggcagtgcagagacctgtgaaaatcttccgatgtgaccaacccacccccacccaggggaatccacggggcgcagcggcagcgcggtctcgacggtggggaggacaaggcgcccattctccaagttactagggtggcgcaagcgcctctccctttaactgcccaggcagccccgcctgctatgcccggcagtcaaaccaggtccagaccccggctgtgccgcccccaccccccagcagccctgccggctccccacccacacagctcccactgggaggtacctgacagtggtggtcccatctcaccctcccggtccaagggccctggtgggaagcgacccgagcgtattcgccgcccgcagctcgcgcgcctgggcacccgggggcgctcacagtgatcgcggggccagcacaccctcacccaggacatccctttcctccccccaaccccaactccggagtggctcagagggagggaaagtagatgccggcaccctaccccgcccctcctgcccccgctgtgccgttctcggtcgtggtatcggccaggccttaccccttcctccctggcgcagctggggtcctcctccgggccaggcagagcaggcgggcatcagaagtgggggccaagcaggtgggtgagggcagggcaggagcaagcaggggagatgcagacggggcggggccaagcaggtgggtgagggcggggccaagcaggtgggcggggagggggcggggccaggcggggtaaatgcacactggaacggggccaaacaggtgggcgaggagggggcggggccaagcgggatagatgacacgagcggggctaagcaggtgggctcgggcgggggtgggggtgggggcgggggcgcaggcgggggcgggggcgcggacaggccaagccagggggtgaggcggaggcagggccaggccggtccgtggggagagggcgggccaagccggtgggcgcgggcagggacgccctgtgcgcgccggaccggcgggggcggggcgtgcaggcgggggcggggcacgccgtcccatgggaccggccctcggccactgccccctccggccccgccccgagcgcccgggctgggccggcagcggccccccgcggcggggctggcagcagtggctgcccgcactgcgcccgggcgctcgccttcgctgcagctcccggtgccgccgctcgggccggccccccggcaggccctcctcgttatggccgcggcctcctccccgcccagggccgagaggaagcgctggggttggggccgcctgccaggcgcccggcggggcagcgcgggcctggccaagaagtgccccttctcgctggagctggcggagggcggcccggcgggcggcgcgctctacgcgcccatcgcgcccggcgccccaggtcccgcgccccctgcgtccccggccgcgcccgccgcgcccccagttgcctccgaccttggcccgcggccgccggtgagcctagacccgcgcgtctccatctacagcacgcgccgcccggtgttggcgcgcacccacgtccagggccgcgtctacaacttcctcgagcgtcccaccggctggaaatgcttcgtttaccacttcgccgtgtgagtatcgccaccggcgacggccggcacgaaggtgcttcctgagagctggtgtgggggagctctgtcccagcgccacctgccccgtcggagctgcgaccccggagcagaggagggaaggaagtggggaaacgcagaaacacaaactctgcactctcccttgaagttcagaggcgctgctgtgtctgggggtgcgcatcttctcgcaggcccggcgtggggagggagccggctggggaggggaccacctggagcccagaatttggctccacacctccgggagggtagtccaggtgtgaatccttctgggaagagaagcgtgctggggagcgcacccttgggtgcagtaagataactcctcaaggtcggctgagactcgaggctcaggagcccccaagagagaaggcccctgatgtccggtgccgcatctcagaccccctgaggcccaggtggactctggggcagggggctgtccaggataggaaggtgacggtggcggtgctccctgagggctcagcatgccacgggccgtccccacgggccccacattaactaattgaaccaagctcatgaaaacctggcttgatgcagagagcggagaggcacgtttgcagctctcactaagaggcagctgtgctcccggagaaagcagcgctggtagcagaggcacctggcccccctgttaccaggtggttccaattcccggtacagcgtgcctgagcagggctgggcactggatttctcagggacaggcctgggaagtcacctccgggaaggtccaggctgctctcctccatgcctgcctggggccttcccccgctgccccagtggccctacttcctggctgcccagccagcggccttttggtgtggtgccagcctctggcctgggagcctctacccagacatcccatggctgatggctgtggggctcacctgagggctgaagggtggtctccctgagcgtcctcaggtggaagcatctcctctgcctcgggcaggctcagtagagaactggctggagggcatccagaggcctgtccatgcctgctggcagctgccaccagggcctcagggcgggtgacagcaggagccaggccccaaatggcttcaagcatcgtctcaggtgagggggtggggtaggggtcgcagggctactgccttccttgctaagaggtggccttccacatcaggaaggggaagtcttacccacctccctcctcaaagatgtggttggggggtgatcttggagacttttccccaccccagctcccaagcccctgtctcctgacatgtcagtgggtgcctgagccacagccgctgctggtctgtgagaggagctggctctgctcgtggctgcaacagcgggggctcggcttggggtttgggagatatttgtgtgcagtgaccccaggggaacccagtccgatgccactgtgcaaatgtctagcagatgccaggttcacaggtgctgtgtgctggtggccacctgcctcccggaccccagactctctgagatgtccaagggtgggaagacctcctcagccagaggccaaggcaaagtgcccgcagaccccctcaattctcacttgtattcaggtttgtggacacatgcctccgggctcactgcagccacccgtgtggaggaagaggaggaagagggctcgccacgccccagaggaagtctctgcttgcacttgtgttttcttcctcatttggattgtttaggtctcggaagtttgctcagcaagagtctaccttcgcccagcctccgcagagctggcaaggcaggggtggcttctggggacaggggcaggatggcttctgtgaaggggtggccaggaaagggatgcttctgtgaagtggccagatctggggctggtcctttccagttctgggtcctgtccttgtaagacgtgtgcctggccctgggaagttgtcatgaacagcctccaacccaggtacctccatgtggggtgggactggaggtggaccctgactgggcaggacatgtggcttggtgggggcctgggagatgcgctcccaccctcagtgccctaggaggttggcaggaccagtctcttgaggggagacctggtcatagaaccaggatggcagagtagctggaggccacctgcagcctcacgaaatcaggtccagccttgcgccagtccagccttgtgttgctgtaagaagtcttggcaatggtggcggagacagggccctgtccttaggtggattgtgaaatgagaaatattgtggtttctggcctgaagacgacaagcctggccttgaagagccagggcccaggcatgtgtgcaggggggttgaggcaggagccggtgttccgctgaccctacagggctagggcgaactctcctgtgtgcgcctggggaagccagccaggatatcctgtcccctcctcggggaaccccccctccccaggagagcagctcttcctgtgttccttctggcctccctgggctggccggggtggacacggcacctgggccacaactcttgcccgcttaggcttcctgcccccaacacccccagttatctgtggttgcttgcgcccccactgggggcagctcccatcttagctgaggggatgggggtccatacagccctgctgcacccagcggtcctagctcccttgctgtgagccttagccaggggtgtggacatccaggtggcatctactctggttgctgagatgcttggagatcctggttgtggccaaggagagggatttgaggggggacctgcagtgcatggagactgcccctgtaggctctcaaacctaagtctggctcagcagcccctgttccccgctcctacagccttggctttccctgtttcccaagaactttccaggggtgttggcagaaccctcgcgggtgcgtgttaatcaacaatggagccagaagcaggtcccagaggtggatggggctgatctggctgcctccccaaaagacaaggccatgcagagccagctctcagggtgcagcacccaactttgtggactccagtgccctcctatctccaggctctggcattggagtctgaagcagctgctgggcagttgttctgcagctgggcagggaggccagaggccaaggcaggtggtggggctgggcacagaggaggacggggctctctgagccatcaggtctctttctctccatcttctttaagatctgtccacccactcctcagccctagattcccaggaaaactgggaattccttttggggcttttcccagtgctaccttctgtggggcatgagcccttggtctcatcccctggctgtctggggtcccctcacctacatcgcagacccggcccagtgtttctagatccgctcttgccaacatgtcgagtgcctaactgtggcttcgtactagttggggggaacacaggcatcccttacccctggccgtcagctggggagggggtagtccaggtggcaagagcctagagcctgggagaaagggcctccccagcctgtgtggggacaggggatcaggagggtggtagggacttgggtccttgcaggtggcctgggcagtgcctggtgggcatggatcaggtggcagggctttgtgtctgggcatggccctgtggctgggctgccttggccagggtcctgggccttctgagtctgcgtctcattctctgtggcaggctcctggtgctggcaccttcagtgcagggtgcctcggttggagggaacattcacccgtgcctggcactgaagccacagctccctgtgggcatggtgcccgcagcttgagcctacaaccctggggtactgggggcaggagggtccctttttgcttggcagttgcgaggtactggaacctttgcatataacgtgcgggctgcgttgtgtcacagggccgggtctgagggaggggctttgcggggacactcctgggtaccgatgggatgaacttccgctgggcctgaaggcctgggatgcttttgggccggccagtgcggggtcaggtggttggagccagggagctggcacgtcagctgctgctatgagttctgccacgtgccatcctggcatgtggcacgtcttgcagaggacaggaagggtgaacagctccaaacccaccctatgtgtgctccagagctggaaacaggctgtgcggagctgagtgcctttgggggcagctgagatgggcaggagcaccgtgcccaccgagggtgtcagagtgacaggggttgccaggcaactccacccgggtggctgatgcccccgtttttaaaggcgttgggtgccgagaattcccctcctgctgctaggctggtttcaagtctgctccttctgcacttgacgtccttgccagtgtgatccagagctgctcacacgagcaagcgtcctcgagtcctagggatgctgttaacagggcagcgggtccagggagctggtcctgacgcaggggtcctgatgcagcgggtccagggagctcatgccttccagcgatgggaatgccaccggtccctgtagccaaggtgcagatgcacacgtcctggtcctgagcccctgctcggccctaggcagggcccccagttccctgcattccacccgccttgtctgggaggtggacgagccctccgtagccctgacattccaaactggcttttggcccctgcgatatcttgctgtgattcaagactctgtccacgggcaagaacaacaaggctgggacaatctcatctcaggcatctgtgggaggagacagctcccaagggcggtgatgccaggagaacattccaggcccaggaagagctgagagacagcagatgcccaagacgagttgctggtgtgtggccagtgctgggagagcatggtgtcggcccggggagatgccgcagagaagcttccagaagcccaacatctgctgctggaggggagaatgaggcaatgaatatcaccatcctgggccactttgacccagaccccaaggatttggttacagaggggagggcggcagcgtctggcttcactctcgggaggtgccttggggctggccagtatgggattgctgtcactgtgggtcactccagccccggatgctcctacaccatgctctgcttgcatctggggtccctgcgggcacgtcggtgagaccgtcctggcctccacaccccttcctggtgggtagctgtctctctccagcagctcctccaaccaccatgagaaaccccagacctcacagatgcaaaattatcgtggttgacaaagggaggcggctggtgtctctggtactggctgggtgaccacagggatgccgcgtgaccctagtccagggggccgcttttacacgaggcatctgaccatgtgatagggtgtggcttctgctgcctggcccagccctcttctgggagccccacgtgggtgggtgctggctggggaggggcttctctctggggagcaggccctggctggaggtggggaagatccatgatgggacccaggtgtcttcccacttctcgaccatctcctgggaagttctaatgtttggttcagggtgtggggtccatctgagcaggcatggtgcttccagaaggatccaggttaagggtggtgggtccaagggggtgcctgagcccttctgcagaaacaccgttccccgtagagcagcagtccccaacctttttagtaccagagacctgttttatggaagaaagatttttccacccgggcagtggtgatcttgggatgaaactgttccatctcagatcatcaggtattagattctcataagaagcgtgcaacctagatcccttgtgtgcgcagttcacaataggatttgtgctcctgtgagaatctaatgccaccgctgatccaacaggaggtagagctcaggtggccgtgcacattcacctgacgctcactcactgctgtgcggcctgctccctaacaggccacggacccggggttggagaaccctgtcttagaggattgaggctcggggccatgggatcggcactgtcattgcccttggagggttctgagcactggaaggacctggctgtggtcccaggcactgggtggatggaccagcagaaaggctcccaggagggtcgtggctccctcatcggcaccggactctcaggatgagccgcctggagtctgttggcatctgcctggccgcctctggcaggaacttctcctgatggaagagccgggctggggagctgactccaggacaggcccctgcccgctctgggacctggggcctgggctctgctccccatttcgctcctccactcacagatgaggacatttgggtcgccttacagatgagacaactaggcctggccactttgctcatgccacacccagaaagccctcaggacacccagaagcccttaggatgcccagaagcccttaggatgctgtggtctcaagtgaggtggtgcactattcctggcctcaggcccagtttgtatccatgggcacccccactcccacctagcacttgccaccaggaagcaccctgaggactgtcccctttgagagttggctctcaaagccttggtctgtgcctgcgtcctggcagcgggtgagctacggctgccctcacccagagagtgcaggttccctgggggcgggggctcttagctttccctccatatctgctaaggtgcacacctttctctgctgccttccaaaatcatactctggggcgcactgaaagggtgctctgagtagctctccccggctcctggctgaacttgctccaggcagagatttgaagagattcagaaagcaggaaccacaggcagagcagctggacagggacccccacccctgtactcccttcggccctggaatgctcctctgcatggagacagcccagctgcactgggacccctcaccccaccctggggccaggggctgtgtcctcgacttccacgcagagcagcccgggcagcttagaggagggagcagaaggagctctgactgagaggggtagacccctcccagaggcatccccaccctgccccaaagaggggagcagctggagacggggcgggaacctcctctggctatatctaagcagccccgggaaccatgcgcttcaagcgtttgatcttgacgggccctgggcttggcattctattccgtgacgtctccagctgttctcttgtgaagagtcacgtctgtgctcttggctaggatggctcaaatattataaaacatacagctttgctaattaaaacagcatgacattgccttataggcaggcagatcaccaatggaacagctttttaaaaaccgcatgtaactccattgtatatgaagtttcgtaaaagaggcagcatctccaaccagtggggaacagatgggcggcttcatgcgtgctgcggggtgggtgggtggccatgtggaaagtgaccagactgcacccacttgtcacatcacacaccaggatagactcccagtgggtcagaaaaccacttgggtacctaaagaaagcgcctggaattctttaccctgagagcgaagaaacttttctatgacttgaatgctagatgcgtggaggagatttatgtgtttgaccacataagaaagaagcaaccttggctgggtgcggtggctcacgcctgtaatcccagcactttgggaggccaaggcgggcggatcaccttaggtcgggagttcgagaccagcctgaccaacgtggtgaaaccctgtctctactaaaaatacagaattagccgggcgtggtggtgcatgcctgtaatcccagctacttgggaggctgaggcaggagaatcacttgaacccgggaggtggaggttgcagtgagccgagatcacgccgttgcactccagcctgggcaataagagtgaaattccatctcagggaaaaaaaaaaatcttaatgggaaacagccaattgccaggctgggggaagatgtgatgtttcacgaagggttaatctgtttactacagaaagagtttctgaaaacagaagaaaacccacagccagcaggagatgtgaataccactcacaggacagtgacccacagggggaccttgaacatgtgagaaggtgccgccttcactcctggcgagaggggtgtcgaggaaaatgtcactgaggtcccttctggctggcagaaatcctttggcatttgctggtaggcatgcaagagggtagactctgtgaggaagggatttggcaacatctagcaaaactgtcttcactgacctgtgacccagcaaccccctccccagaacctacctgaaggcactggcaaaggcaggagaagctgcgtgtgcagggctgcttgtgaaagtactgtttggaaaactgcaaatgcccattgtaggagactggttgaatcagagatttgtggaatattatgcagctgtaaaaaaggaatgcatagatctctcttattatgaagtgattatcaggatttatttaattatttttttcaggcagggtcttgctgtgttggcaagggtggtcttgaaatcttggcctcaagcagtcctcccacctcagcctcccaaagtgcttagattacaggtatgagccaccacacctggcgtatcaggatgctttttaagtgaaaaagcacagtgaataaaaatatagcagctattcttcatctgataaaggggaggatgcaagtctggatgtatattaaaaacgaaagcaatggaagcctccaaatcttaaaagtttacctcaaaagggtggcggggggggaggtggcatatggaatcaagatgcctctgaatgtacctggttttatagatttcactttgaagccatgtaaatcaatagcttgcgtaatttttaaaaagctgttcgtaatcgcttggtgaaaaatccctaaataaatcttaaccagaaaaagtagtccctcaaaattgaaatgaaacaaatgagcctaaaaatgtgtgctgaattagtggcttaaccacccagaaggactgatttcaggtgacatatttctagcgggttactgctgaagacaaatagagctgcatgcagtggccacataattgttgtgatactatttgttatattattctaagagtgctgcatgggaattgcaggttaaggtaagtaattgtgttggtatcaccaagaatggaggttttacaaaatatgattcacatgtaaacagaattaaaaacaaaaaccgtatgatcatctcaatagatgtagaaaaaaacttttgataaaattcatcatcccttcattaaaaaaccctcaacaaaaataggcatcaaaggaacatatctcaataagagccatctatgacaaacccatggtaaatgtggtactgaatgggtaaaagcgagacacattccccttaagaataggaacaagacaaggatgcccactttcaccactcctattcaaaataatactggaggtcctagtcagaaaaatcaggcaagagaaagaaataaaaggggatccaaataggaaaagaggaactcaaatcatctcccttcaccgatgatgataagattctatacctagaaaaccctaaagagtctgccaaaagccttctggaactgtaagtgaagtctcaggatacaaaatccatgtacaaaaatcagcagctttttttttttttttgagatggagtctcactctgtcacccaggctggagtgcagtgatgagatcttggctcactgcaagctctgcctcccaggttcacaccattctcctgcctcagcctcccaagtagctgggacaacaggcgtctgccaccacgcccggctaattttttgtattttttagtagagacggggtttcaccgtgttagccaggatggtcttgatctcctgaccttgtgatccacccgccttggcctcccaaagtgctgggattcaggcttgagccaccgtgcctggccaatcagcagcattcttatacaccaatgatgttcaaactcagagccaaatcaagaatgcaattccatttataatagacacaaaaagaataaaatacccaggaatacatctaaccaaggaggtgaaagatctctacacaagagttacaaaacactgctgaaagaaatcatagatgacagaaatggaaaaacattccatgctgatgggttggaagaatcaatattgttaaaatggccatacggcccaaagcaatctacagattcaatgctattcctatcaaactaccaatgccacttttcatagaattagaaaaaactattctaacattcatgtagaaccaaaaaagagccgaaatagcaaaaaaggaactaagccagaggcatcacattacctgacttcaaactatacttcaaggctacagtagccaaaacagcatggtattggtacatagacatatagaccaatggaacagaatagagaactcagaaataaagccacacacctacagccatctgatcatcaataaaatcaacaaaaatatgccatggggaaaagacttcatattcaataatggcacagggataactggctccccatatgcagaggaatgaagtcagactcctatctatcaccatatacaaaaattaaagacagattagacgtggccaggcacagtggctcatgcctgtaatcctagcactttgggaggccaaggtgggtggatcatggggtcaggagtttgagaccagcttggccaaggtggtgaaaccccatctctactaaaaatacaaaaattagctgggtgtggtggtacgcacctgtggtcccagctacccgggaagctgaggcaggagattgcaccactgcgctccagcctgggtgacaagagcaaaactctatctcaaaacaaaaaaaaaaaaattaaaaaagattagatgtaaacattagattacaaactgaaaaaatcctggaagaaaatagtcttctcaatattggccttggcaaataatatatagctaataagtcctcaaaagcaattgcaacaaaactaaaaattcacaagtgggacctaattaaagagctgctgcacagcaagagagactgccaagggaataaacagataacctacagaatgggagaaaatattagcaaactttgaactgacaaaggcctaatattcaaagtctacaaagaattaacaaatcaacaagcaaaaaaacaaccccattaaaaagtgggcaaaagggccgggcgcggtggctcacgcctgtaatcccagcacgttgggaggccaaggtgggcagatcaccaggtcaggagatcgagaccatcctggctaacatggtgaaaccctgtctctactaaaaatccaaaaaaaaaaaaaaaaaaaaaaaattagccgggcgtgggggtgggcgcctgtagtcccagctactcgggaggctgaggcaggagaatggcgtgaacccaggagacggagcttgcagtaagccgagatcacgccactgcactccagcctgggtgacagagcaagactcggtctcaaaaaaaaaaaaaaaaaaaaaaaaaaacccaaaaaaacaaaaagtgggcaaaagatatggtagacagttcttaaaaagaagacatacaaacagtcaaacacatgaaaaaatgctcatcactgatcatcagagaaatgcaaatcaaagtcacaatgagataccatctcacgccagtcagaatggcctttgtttaaaaagtctcaaaacaacagatgctggagaggcagtagagaaaggggaacacttacaccctgttgacgggagtgtaaatgagtccagccaccatggaaggcagtttggagatttcccaaagaaccaagagttgaactaccattcgatccagcagtcccgtgtgctgagtttatacccaaagaaaaattagtcgttctaccaaaaagacatatgcacctaaacattcatggcagaaagacatgagtcaactcaggtgcctgtcaatggtagatcgaataaagcaaatgtgatatatatacaccatggaatactatgcagacgtgaaaatcatgtcctttgcagcaacatggatgcagctggaggtcgttatcctaagtgaattaatgcagaaactgaaaaccaaatactgcgtggtctcatggattataagtgagggctaaacatcaaatccatgtggacataatgatgagaacaagagacactggggaatacaagagtggggaggggggaaggggagcaaggtttgaaaagttacctgtgggtgctgtgcgcactacgtgggagaccggatcgtttgtactccaaacctcagcatcatgcaatatacctttgtgacaaacctgcacttgtacctcctgaacctattaaaaaagttgaataaaatggaaacttttggcatgggagaaaaaaaaaaaaaacagatgtaagttagaagaggttacgcaaaaatcctccatccctgcatttgaatgaggactatcagtatgcatccaggatgacgtttacttaaatatctctgtttcctggaaaggcccaggaccaaggaccactcagcagctaagagcatctctagaccccagactgtggcctctaggtaccatttccccctgaaagaaaccagggcccctggcggattccaggtctgtggcagaagatgtgcaagctaagcctggagtattcatcacagcagaaggcagggaagttatcagaggccccctagggccatgtcactggaacttgaaggggtccttgtcttcccccttctccccaagctgaagatgcagtgggtaagcctcactgaaaataacagaggaagtggatgagctgcattgatggggttcagatcccaagttcatcctgatactgaggggcaaaaccagtggactttgatttgcatttctctaaagatctgtggaggtcaatagggagaccgctcatgatgttgaatcctggcaagcaaacggagagaatctgacatgtgtcccagtcgtgattaacctgtgaactgtaactcggggaaacccagtagctgatggggttgcgtccttctttgggactcccgcagatgcctgaggcggcagtgctgctgaagtcctgccaggctccagctcctggtgaggtcagggattccgcatgcagcgtcacagctgccaacctctccaaagcagtaaaggccttcggacagtgcacagaaagtgctcccatccacaatgcttccttgcctggatggatggatggatggatggatggatggatggatggatggatggatggatcgatcgatctcaccaagcctcgtgctctaagtacaagtttactggaaatactcgggccagaggaacgcgctaaatgatactacaggaggccacttgcagaatcccagtggtgggggatggctctgtaggacacatgacctgatttcctcagtaagtcaatgaccaagaaataacggagagaaggaggaaagaatcacctatccaccaattgtgacatatggccttagttaggtcctcaataaatgatgacaaatattggattaaattacttctggtttgctgcatgttccatttttgcccatgccgcacctgccatggtgcatttctgattcccgtgcccagttgggaggctttggggttgttgggatgcttttgtgaatggcttccttccttcccaggcacaggggctttatggggctctggagcagacagaccagagtttgcacccagctcccagctggccatgttacctcaactgcaaaacgagagacggacttccttgggacgcggtggtggggacactgtggtctgtctcctctgggcgccccgtggcgcccggtggtgtgaggttaggatgtggggcgtggtgtccagggactgtgtggcctgcctggagctgggcagagacaaagcatgcatgtgacactccctgacttcaggccataacaggggcaggggtggggggcaatcagggttcctagaggacaaccccatgtagttcctcactgcagggcttggagggagcaggtgaaggcttacctgtcttaggtaatgaggagctgtgcgggtctgagacagctctggttcctttaagggtatgtaggggtcactgccagtctgtagctccctctgtgggggcaggctgtggcactgtggcgactggcagtactgacttcctctaagccaaccgggcagggacaagtcagcttgttgttccgtccacagtagagggcggccctgggggtgaacggctgaccgtgagggcgtggtccctccccccagaccaccccggaggccccctccgccctcctgcctacaaagagttccccctttgtgttgagaggcctgggtctcagaggtagatgaatggagtcgtgaaatcaggcagggattcccttctgcttaaaacccactctccttcccatgcagcacaggtggccaaaacctgcggctgggtcagaggactggtttagtaagaatttttttttttttaaatgtggttatctgctagccagaaaaggtgtgtggtttcgcagtctttcagacaaactgaatttaatagtagctgacgtgaacccctgtttctcctctaggctccagagccgcaccccagtgcaggtgtggaagctcagttcctccaaaacccagacaggccttggtgtcctgactgccacccccagggggcccctcactcgagtccttgcttgcagtgcccatgggcagcagaggtgtccggagatgcaacagggcccagacccctaccagcctgtggcccagctgggggcaggactccggggcagggtgagtccctgcgtgacctgattctctgtgggcaggccgggcagggtggctgcagggcggcggagcctgtgctgctggcctgcatttctctggctggacagatactgcgcccatatccctggtctttcaaagggctctgtggctggtggagggcagcaatgccccaagggaggagcaggtgcccaagcccccaggtggccctgcgggtacaggtacttgtttactctgtggcatcagtcctgcttcccagctcaaggccctggcctccacaggcctcctccctccctccctccctccctccttcccttttttcctgtggctccaaggcccacagtagaaaggctccagtctgtgtccatgtgttttggaggcctctcaggtacagggactgtcagcccagctgtaagtggaccttggaccgcaaatttgcatgggcccctttgccaaagccctgtgcccactgctggggaacgctggggactccgctcttgtggggcagtggggctgggtgggagcaaccccccatccgggtggctgtggccgaggcccttatgagagggtggtaggtgtgtctccacagtgggggaccagatctctctctggccccaaagactgcttcaagcctctggaggagcactttgccccaggctggggcgtgactgcttctggttgagggttgctgcctgtgcaggtggccctcttgtcggtcttgtctgctgcatgggggtgtggcctcctgtggatggcccctgtcctgggtggtactgctgcaggacctgggtttccgggggtgtccgggagtcggatgggcctcactctcctggcctccactgggtccaggagtggcgatctgtgagccaatggccgtggctgggggcagcctggggtgttgagaggccctgggcagccaccttgcctctctgagtttgtcctcatgtgtctctggggctggaactcggtgtccgacctggtgatgggtcaggtgtgatcaggtgtgtggggctcggtctgcatgtgcagggctgtttgaaggcctgtggggccatctgatgccccccttttcttcagccttggagaggatggcttctcaggccgcctcgcagcagatttgtagtctggttgctgtcgttcctgaaatagcctctgaagctctgtccgggaagggaaccttgagtgtggaggagataagcctgctgactgggtgagccggccggggcgggggtggcccctcttcccttcctcccctgcagcttccatggcctggggctgtgagaggcccgggaaggcactgtctttgcgcctgcacatgtgtgtgtctggagtgtaggatggcactggtgccgggcctggatttactcagcccagatcacggctgcttttgtttacgtggcccctgctctcacccacaactccaggtttctggctctcgggaatttgaggcctgtggctgctgtggaccctgggaaagagcctgtgcttcctgagccagtgcggggcctggcatggagtaggtaccccgggggtggacagataggcagaggaagggatgggcaggtggatggggggctgaattgtggtcagttatgggtggcgggtagatgggtggacagctggatagatgaagtactgggtgggtggagagagaaaggggtgggtggacggagggatgggcagggagagaaatggatggggcatgctgcttccagcacccactgggtgcagctgtctgctgtctgctgtcctgggggaaggtctggagagggcctctcggtgagtgtggactcagccagcctagtcccaatacagctgggatgcattgctgctccttccgccatcccagcagctgtccagagatgagacccagccccactgtgtctttctgggattcacaagaatccttccctgggctgagggggcgttgctgtgggtgtatctcatggagagccccaaggagccagggaggagccttctggtggtttgggttctggattggtgggtgctgggtgggtcttcatggctgttcttggggctgccaggcctgcaaggtagacaggcctctggacttgagtgtggctgtggacgagggcagcgtcgccatcagaggcgatgtctagggccaccccctctgacttgcctcctcctccttctgacttgcctcctctctctgacgggcctgctcctgagcttgacacctgcctgggggctcccggcgaaggccgctggtttctagaatgcaccatctcttcctggcatgacgggaaccacctgtgacattgccaccacctcgctgtaatctgggcagcagctgtcatgatcccaccatgtgccccccgtgaggcccccacctgttactgagtggcagggacgtgctcccacacccccatgcgccatcctgcaggtgctttctgctgacttctgtgtgccctggggcctgctctcttggtaggggttgaccctgcctgtgacttagacagcttggagggccaggactgaggggagggggcggtggagtgaaggggagggtgggcgctgctggcaagaaccacaggcaaagagggtgccgggggcagggaaggcctggaggtttgaggagcagaaagtagacccttgaccctccctgggctggtgagtcggggcccagcccagagtgacagggaccaaacctgggtccatgtgccgtgcccagcctggggttcaggtttcttccccgtgagctgagcagacagggagggtcttgggggaaggctgtgggcccttgggtggaagagtcttgggtgaggcccctgaactggtaagcggggcagcggcggcagggggcccagggaagtggggccagtcgggggtcctcaggggtccttcagggatatacctgctgtcagggtgtggggagtgggaagtgggggacggggtggattccaggattccgggttgtgcttggtcagagtggggaactggacgctccgtccctggctcagcctctcccggctgtgaccttgggggaccattgactttactgtgtgcctggagagcctaatccctacctgccagtgggtgacacagaaggcaggaatgcagaaggcctttcagaagttctcactggcctgcaaggtagaggctgttttctgctgaggatacatttgccccctctatcccccagatcggcggctgctcaaggagcctggtacagctgcacggaggcgcagcacccacaggacaagtggtggaatgttctggttgtccttggtgcaggtggcgggcggggctggggggctctgtagccttcctggcttcggtcccctggacaggctccacctccctcttatcgtggcccctttggcaggctgcctgccacctcaaagtcacgctgccctgggcaccctgcctcttccggggactggggctggggctggggcagctgtgtttatgggtgtactccctgtgctgggcactgcgctgagctcaacacacaggggctcggggaggtctgtgggtgcccaggccgagatgtgaaccctgagtttgtgcaactcgagtttcagagtggcggcctctgctcctcacaagacattgccctgcgagggggtcagccctgaagccggatggcccggcccccgctaccacgtggaggctccctgtaggtgcttgtgtagatgcccccgtgcggggacttgtttggctgatggatcagggggaaggttctccccacggtgtgaggcagcaccgagggctccgtgcccagcaggctcactgtcggcagttgggtctggtttgataaccgtggaccggggtgacaggccctgactctgcagagcaggactgtggaaaatggacactgatgctgcccggtggatccaggcagggccgggatgtttgcaggacccacgggacaattagaacgactgggcctgactggcacagggatgtggactacggtgcttgccatcagcagatacaagctgtacgcagtgggccgcaggcgctccctgggccggaacacatggacgtccaggtgtggaatggcccggacagcagataacaagccttcgtcgtggtcacccctgggtgtgggctgtgggttttaatcttttcatttttgctcatctgaattttctaattaaaaatatattgctttttaaaaataataaaagatcatttaaattaaaatatataagtgaggagaggctggtaagaggattctggagtccctggagtgtcttctggcatcgcatggatgagaactctgaatgaattgagtgtgatttgacctaggagagtgccggggtgggggcaggtgcactgtggtcctgggtccacatggtgctagggtcccatgggctcctggcccctggctgctgcccccacattgggccctgcaccaggcatgagtcccatgtcctgtccttggggaggcctgggggacaggagttgggggggtgggcagtgcctctgtgtggcagattccagcttctctcaggggccaggattacatggtccgtgttggactctgggatgctggtgggaagaacagtctgggcgaggaggaaagggtggctctgctgacccctcctaggtgggctggggctgaggcggatcccactgtggggagctgcccagagatggaaggagctggagtccacagggcgcttctcttctcttttcctgtgtgttaaggtagttcaaagtcctcctgcccgaggaagtaagacagcaatctctggggtcctgggcaccaactctgggcactgatgggctggtccagtgcagggagctgccccggccgcccccgtgggtgcaggccatgggctcttgtttcctttcccccatctgtaaaatgggtaacggccgctccttcaggggctgttagccacatgcttagaccgcaccgagaaaatgcagtccctccagagctcctaaccttccatgggccacaggccccttcccagaagtttttttattttttatttttttttgaagcagggtctcactctgtcgcctaggttagagtgcagtggcacagtcatcactcactgcagtgcgacctcctgggctcaagctggcaccgtgaccccttctccaaggcctgccaggctggcctccagtccaggtgtgaggccctgaggccctggctgcagctggaagctcttgggcagtgcactgtccccacagcggactgcctcctgcagccaggtggccttaggtgatcctccaaggtccagccagccaggatctgagtcaggaggaaccacggcccccaccagggctgagactcctctgagctcgtcacttgtcttggttgggtagaggcctgagagggtggacacttgcccagggtcacacagcttgtgcgtagcagagctccctgtccggcccctgccccgtgctggcccctctcacaccttgctcacgctaggtgccttgtaccagtgcctgcttgggggtggaattggagaggggaggggtgggcgccgagctctgcctcccaccagcatgcttcccagagcttcctgggagaaggtttacggaggagtggccttgtctggtgtccctctgggtagagcctgtgttccgggcaggctgggaacaatgaatggtacagatccacggctccccttgggccttggtgggctccagccatgcctcctggaaggccatttggagcctggctggcaggcaggagctgtgtgctgccaggcgggtctagatgtggttggttcctggctgcacctgccgggctcatgacctgccctgtcctttccttggggagcttggtgacggctcaggtcgactcccaggggcccgcccttcagggcctgcatgagtgttctcgggctggctatgggggcattgcttcttcctgtcctagccgggacctgcccatccacccagggggctcagggacgtttttgagttttcctgaggctttgcctagggagtgtcgctgaggaagctggaacagtgaccttcgttgttgggggaggagatgcaggcaggctgtggcccagctgccccattttgtagctggggaaactgaggcccagagtggagaagcgatctccaaaggggaggtgacacatggctgagccccgcctgatgggtgcttgctggggggagaagtcctggctgggacttcccctccccaggctggggtttgtcccctactttgcaggaggaggggggctcccagaagagagtgagttttgagggaacacagtgctgggggtcccctcctgggcctggggctgtggttcttagaggggcaaggggctggcccctgttgctggctgtggcagccacagccttctgacccttgctggcctgtcgtggagtggggttcaagatgctatcactgacatctgcccaggctcgggggcttctgtgtggtgccagccttgcccgggggcacagccatcagcaggccagaagtcctcaggagagcttgctgccaggctgctgcctggggccaggcttcagatatgctggccagccttgtccagggggcctcctgccaggtgggcagagggagagggccttcctgtcctcatgagaacagggctgagctccatgttccttagcctcccttggcctcagtcatcctatctggaaacagggatcataatagttttagtttatagagagcgagggcctggcccctgcgctcttcctctgtggtctcctctgcccgctcccagaacacctggcctcctgctctgagggccagccctgggttgcagcagtgagcatgacctggccacagtctaggggctttggggtgggtttgtgggcagctgggctgcagggggctgtgggagcctgagggagtgccttccaggggaagcccgacagatgggggcactccaggcaggggcaggaggtgacctggaggtcggaggagcaagctgtggctggagagccgggcagggttggtcagcaggtccgagggcctgggcctccctggggtgagggccagggtgcctctgcaggggtggaagtgggctgtgagggggtctgggtttatctccccattgcacagggctccatggggtgggctgagccatgagcgcccttcgtggcaccttggtgtccggcagggaggcaggggcccaggaggagggcaggactggcttcaacggtgtcggcctctacccttttggtcctcacggaggaggctgctccctcttccctggagcagccagggatggtgtggggccctggtcccctggcttgatataggcttctgcagaggatatggtgtggccgggggctcagctgagaagccaccaggagacagatacagcctcaggaagtggttttgtatctctgctgagaaccacaatccgagtcacatgggaccattgagatcacgtcagggtgcaggctggggaaggctgggagctggggtttggcaaaggcgttggggtgctcttgtgctggacaggctgctgcccaccgggcctggcccaggtgaggtgagagacacctgccccccacgtcaatgcctgggcacacgggcccagtgcacacagccagcaggcgtgcgtcttgcaatgggggctgtggggacccctttgctcccctgatcccttccctgcagacccaggccaggtggattcaaggtgtggggcagggtaggagctgggcactgctggatggcatgggccacccgcactggggctgctgtgacctccgagtccaggcactgccttccacctggttagggacagggcagggaggctgatgggctggcccagcgtggggacctgcccagtggccctgtgggtgcaggccatgtgcctctgcatttcctttaccccatctgtaaaatagggataacagcagcttcttaaagggctgttagccacgtgcttagactgtgcccggaaaatgcactgtctctcctgggctcccaacctttcacaggccacaggcccattcccagaagtttattttttatttttcgagacagggtctccctctgtcacttaggctaagagtgcagtggtgtgatcttggttcactgcagcctcgacctccctggctcaagagatcctcccgcctcagcctcctgagtagctgggactacagatgcacaccaccacgcctggctaatttttgtattttttgtagagatggggtcttgctatattgcccagtctagtctcaagctcctgagctcaagcgatctgcctgcctcagcctcccaaagtgctgggattacaggcatgcactttttttttctaagtagctttacggaggcgtgcttggcatacggtaaactgccccagtttaaagcagacagttccatgagtcctgacatttggaggccctgtgaagccagcatcagcagagtgggcacacccatcaccctcacagcgtccccctgtccccacgaccaggccactgctgccctaccatcaggcacgatggatgggcttgtgccttgtggaattttatttggatggactctggcagccaacgctggtttcgtctggcttcttttattcagcgtcatgattttgagctgtgtgtctgttgtgtgtgtcggcctgttgtttgggtagagcctactttgccgatccatgcacctgttgatggacatgtgggcggctgtatcccatttgggctctcacaaatgatactgctaggaatagctggagtctctgtgcgagcaaatgcttttgcttctcttgtgcaagcaagtggttgaactgctctgcagcccgctgggaagtggaacggctgtgtcatggggtgggtgagggcttcactttctaggacactgacaaaccgttttctaaagcagcaatccccttttgcagtccagcagctccgtgcgacagctctagttcctctgtctccttgtcaacacttggtgtggtcggtctttaattttagccaatctaacaggtgtgtcggggccctccctggcattcctggtgactcactgtgtggggtcatcttttcagctgcttagttgttgtccacatatcttctttggtaaagtgtctgtcaaattgtctgttaagaaaacgtgggtggtttttcattgaattcaagagtttttttttttttctttattttgagagagaatctcactctccgtctcccaggttgtagtgtggtggcgtgatcttgcttggctcactgcaacctctgcctcccgggttcaagtgattctcctgcctcagcctcccaagtagttgggactacagatgcccgccaccatgactggctaatatttgtattttagtagagacagggtttcaccacgttggccaggctggtctctaactcctgacctcgtgatccacctgcctcggcctcccaaagtgctgggattacaggcatgagctacggctcccggccgagatgttacatgtttctatattctggaccaagtcctctatcagatacctgctctgtgaagccttcccttatcccttgctagtccttcagttcttttaaacaattttttttttctttttttgagacggagtctcgctctgtcacccaggctggagtgcagtggcgcgatctcggctcactgcaagctccgccttccgggttcatgccattctcctgcctcagcctcccgagtagctgggactacaggcgcccgccactgtatccagctgattttttgtatttttatagagacagggtttcaccgtggtctccatctcctgacctcgtgatccgcccgcctcagcctcccaaagtgctgggattacaggcatgagccaccacgcccggcccttttaaacaacttgtttttagagctgcggtctcactctgtcgcccaggttgaagtgcttggtgctatgacggctcactgcagttccaactcctgggctcaagccatcctcccgtctcagcctcctaagtagctgggaccacaggcgcatgtcaccacgcccggctgattgttaaattttttgtagagctggggtctggctatgtcgctgacaatcaaaatgaggacttgaagcatactcctcaaatcatcgaggtttattgagccaacgtgagggcacgcccaggaaaaactccagtcacagaagcatctgtggctgctttttccaaagaggtgcgtaggaggtttcattcatatttatatgttttcttgaaaaggggaggggcatcaagtgagacaaatgattatatacttgcgagactttagttagagcccagtaaatctacattttacagaagacgtatattggaggaaagagggagcatggaagcgtatatcccagggaggcggaagaacatctcgttatctcgtctcgcctttgttctgtgcctgggaaggaagacaagccggcgtcttatgaaaaggctggtttctgttcagccctttgggaagaaaacccaatgacagttatcaagggagggggtgtgatgatacgtatccaaccgcacatccatcatggccctgaactcagcttccagggtttctctggggttccctcggccaagtggggatccactcagttaggtgggggggggggtgcttagaattttatttttatttctcattgcccagactggtctcaaaaccctggtctcgatcaatcctcccacctcagcctcccattctcttaatagtgcccttttagagagcaaacgttttgactttgatgaagtccagtttatcaacttgttcccttatggattgtgttttttggtgctctcagaaatctttccctaaaccaagggcacagattttctgttttcttccagaaattttgtagtgtcaggtttcacactgaggtggatattccttttgagttaatgtctgaccagctgggaggtgtcggtggaggctccctttctgcccgcgggttccagcacatttgctgggatggccctcctccctccacagcagagttctacccgccctcaccaccctgtatcaactcatctcatcgatatctcccaacggctggggaacaagggctgactcggctgcaatcatcctgcagccagactcggggacctaggactctgaacctccaactggtgtggcttcagggtccccaacttttcagaccccacctctgtgttgctctgcaagtggggatcagcagggctgtaccccaaatgctgcttgcttctcccgccctcctccctctccccatctgctcttggctgcacccccaaccctgacccaagtgtccttcacgctcagcaacgccacagcctctgacactccacggcactaaagtgtcaagagacccaggggacctgcgagatccatctcgccccacacaccaccaggtccccaggacttggaggatgctgatggcccagctctgggtcctaagcatggcagtatcacagcctcacaggcacatgtgtatgtgtgtgtgtgcacgtgtgtatgggtgcgtgtgcacctgtgtatatgggtgtgtgcacgtatgcacggatgtgtgtacacatgtgtatgggtgtgtgcatgggtgtgcacatgtgtatgggtgtgcatgtgtgtataggtgtgtgtatgtgtgcatgggcgtgtgtatgtgtgcatgggcgtgtgtgtacttgtgtatgggtgtgtgcatgtgattgggtgtgtgcatgtgtatataggtgtgtgtgcacgtgtatgggtgcgtgtgcacctatgtgtgtataggtgtgtgtgtttatgtatgggtgtgtgtgcacatgtgtataggtgtgtgtatgcgtgcacctatgtgtgtataggcgtgtatgtgtgcgcgtgtgtaggtgtgtgttcatatatatgggtgtgtgtgcacctatgtgtataagtgtgtgtgcacatgtgtataggtgtatgtatggttgtgtgtgtataggtatgtatgtgtgcacatgtgtgtaggtgtgtgtgttcatgtatatatgggtgtgtgtgcacctatgtgtataagtgtatgtgcacatgcgtataggtgtgtgtgttttatgtatgggtgtgtgtgcacctttgtgtgtatatgtgcatgtctatgtgtgcacatgtgtgtaggtgtgtgtgttcatgtatatatgggtgtgtgtgcacccatgtgtataagtgtatgtgcacatgtgtataggtgtgtgttttatgtgtgggtgtgtgtgcacctttgtgtgtatacgtgcatgtctgtgtgtgtttgtgggtgtgtgtgtacctatgtctgtataggtgtgtgtgtttgtgtctgggtgtgtgtgcacctatgggtgtgtgtgtgtatgcatgtgtgcatgtccctcacagggcagagctggaaagaactggagaggctgaggctggtcccttcatctcagggtgaagcacctttacccagagaaggagggtcgtggcctgggctactttgtgggctggagtcctggtctctgtcactgaaaaaagcaaggcagagcgtctgggaggggtgtcatgcggggctttctgagtcactggctgcgtgagatgtgagtaggtctgtgggatagggagctggccagggacttgagctccctgcctgctatgacctcagtcagcccctgcccattgtcaggctccttccctgtctaggggtacccagtagagctgcccagccctgccactccagcttgtttgaggaaaaagtgcaaccatgctgtgggtggaggcagatgtgattctgtcctcagaggcatgggggtgactccatggctctgagccaagttgcagctctggggcccttcttgatactccagggccccccatcaccccagcaccgagatgggcatgagcagaggggctcatggtgatggggtgggcgtggctgggagaagcctgcatatgaaggcctctgtcattggaggagactgtcccatgtccctccagatcatgtccctgagtggggagcgccttctgggcagagtggcacacagggtcccacccatctcaagtccatgggattaactcccctgtgctggaagctgcaggagctgctgcctgtggctgaggagaggccaggacgggccaaggagagcaggcaagagaaggggtggggctggcagggagggggctccattaattctgatgtcatttattgctgttcctatatttgtataataaatggaagaaaatagtggttgggggcttgctggggactcagggagggttggggacctccagggcttccattcgacctgaggcccatggtgcagtgagtcctgcctggagtcccgtccagcaggaggcaggagagctggtgtttggagatgtgaggggctgggccctcccaggtgagcgggttgggaaaggaaagggtctgtgctgggaaatccaaggggcaaggccgtttcccgtcctggtccgtcgttgagtcccctgccgtgggacagcgctcagcatggcacagacgctcagccgtgtcatgtggcttgtagagcgagggtgtgcggccggcatcatcctcagggaactctggagggactgggcctcagttggcctggcctggcgcggggctgccagccaagagccttcctccatcccattgagagccagggcaggtcctggagatggcagcctgcaggttgaagcccccgacagctgggggaggcattgctctgcacaggtagggccatggggcccgctggccagggtggccattgctcagtggcaccagctgggcagacagccgcatgcgctcaccactcgccctccacagatgggagcctgggagagccctgcctcccggaacggacatcctccttcaccaaatccgcaaaataggcctgatgccaggaacggggcactgcagggcccttgggagggaggtaagcgggcagccgggccaacctgctgcttggggaagggctgtggctggccccagcctcctaccgctggcccagtggtctctccacacatcacccagtgtggagtggttttttgtctttctttcgaaacaggctttcctcactgagggctcaccatggggctgtgctggggacactggatgtgtccagggtccgtcaagaagcgttgggggtagtcagggtctcagggaccactctgctgtcctcgagtctcctggtggtgaccagtggtgactcttgtggcgcccgggccacagctactttgttcacctcctaggagggaagagggcgagggtgagcctagggcagatgccagggcagtgaggctcacgtgggtctctttgcctgatgtgccggtgtccaggctgcagtgggcacccgagccctgtgggaagcctcctgggtctgcagctgagcaaaacagcagccgccagatgatgggccctaagtggctgcagatagcaggcaccattaaatgcagaggccatctgaggctgcaggctcagcacaggtggctttggtgcccttagggaggggcagcggtggagcccaggtctctgaaacatttatgacttcatgcgtcagctggaggctctttcaccgcccagacaaaaggcccttgcgtcagagtgttccatgtggggcgggagcttgggctgagagcttgggcccctgctcccagagaggcccagagctggggtggccacacctgctgggaatgctgctggtgggactaggttaaggcgagaaggaggtgtccatggccaggtggattagtgcagattgtgatggtgtggtggtgctcacggtgggggacttgcctatgggaacctcatcacagccccacatcgggcccttttacagatgggaaaactgaggcatggggtgcatagctagtgaggagcagagccagatgggaaccaggcgtcgacttcagagctgacctttgtgcatttgtgcattgtttgtgttgtgataaaatacacgtaacgtaaaattgacctttttaacccatgtttcatggtcttcggtttactcgcagtgctaggcgtccgacacgtctttctaattcctgaacatttccatcatccgcaagaggaaattagcagtcacccctttcccccatgcccccagctcctgacaaccacaagcccactttctgcccctggatttagctattctggatgtttcatgtgcctgaaatcatggcaaacgtggccctgtgtgtctggtttccttcaccgagcgtcctgtcttcactgtccgccgtgttataacacgcaagggaattcccttcctttctgagctgagtagtggtctgtggtgtggatggactacgtgcagctgtctctgcctttggctgttgtggctagaggctccttcctgaaagcctgatacttagaatggatttaaaaacaaattcaaatgtgtgttgcttatgaaaatcacaaaattaagtatgatgccatcaaaatgaaaaaatggctaaagattttcaagcacacacacctaaagatagcagacattccattcaaccttcatctcaaagaattagggcaaggagggcgattctaaatggctggagacatagtcagctgtgaagctgtaactttcatgaagacagtgacgtggtttgtcactgcccggatctcatcttgaattccctgtgttgtgggagggacctggtggggggtaattgaatcacggggacgagtctttcctgtgctgttctcgtaatagtgaatacgtctcataagatctgatggttttaaaaagaggcattccgctacacaagctctctcatgttttgcctgccaccatccacgtaagatgggacttggtcctccttgccttccgccatgattgtgaggcttccccagccacatggaactgtaagtccaattaaacctctttcttttgtacatttgctcagtcttgggtatgtctttatcagcagtgtgaaaacggactaatactgacaataaattaaaaactatttaaaatgcaaaggaaaatataaatttaaatcacctcttcgagtctctggtagatcaagaaaacaaaaataatctgaattattgatatagttaaattaatagatatatcaaactttgtaacttaaaagcaaaagatgtaccttttacagtgttcctggaacactcacaaacattgatcatatactagactgcaaaaacttcaagacattctaaaattaagaacctatgctggatatctctgatttcaacgtatgtttaaaatatatgttattaattacaagtttaattaatgaaagtctaaagaagaaaagtctacttagaagtaaaaacatcagcaatattactgtgtaatagatctgaacattaaaggggcatatatgcatatctgtacaccgaggcaaatttatagctacaggcattttccttttttgaaaaaagtaaatatgtaagttaaaaagttcacagtaagaaaagtgaatgtaaataagagataagaatagaaaataataggaaacaggaaaacagacttgagggttctttttgggaggtgattcttggttctttgaggaaaacaatatatatcttataatttcaatcatggaaaaaccccaagtatatatctaaatttagacatgagaaggctctttggcaatcgatttagaaaagttttgtttgtgtttttaagacagagtctcactcaatcacccaggctggagtgcagtggtgcaatcttggcttacagcaacgtctacctcccgggttcaagcgctcctcccccctcagcctcccaagtagctgggtttacgggcatgtgccaccacccctggctaactttttgtatttttagtagagacaaaggtttcattatgttggccaggctggtattgaactcctgagcacaagtgatccacccacctcggcctcccaaagtgctgggatcacaggcatgagccactgcacccagcccagtttttaatgtgacagtactttgtaaaattgtactccagtgaatttgaaaaatgttgtgagatggcttattctttgggaaaaaatgttaagtcaaaattaggaagaagtggagacaatctcagtatgtgtgagatgaatctgaaccctcatcagaacgtccacagctgacggtgaacacattggcaggtgagatatgtggagacatggcacgtggtgaaaatgcttggcaaagtgttcaaggcaggatggagataccgtatgggcattcactggacagtgttttcatcccgtatgtttgaacaatttttaatgtgggatcaaaggtaggaaatgctctttacaaagtcatcaaaaagttttttctggaaaagcctccagcccacggtgacctaggttcttcccaccattgaattaggatgccgtctgctactgagagagccagtcatgttagtggctcaatgggcagggtgcccaggttagctgtgaacaaagtgatctctctgctgcctcactagcagagagaaaagaaaactacagaccagtgatatgtacacagagagcaatgaaaatcctcattatgatggcagactaaacccatagtgtgttaaaaatgaccacacatgtaggctaggcacagtagttcatgcctgtaatcccaccactttgggaggctaaggtgggaggattgcctgagctcaggagaccagcctgggtgacatagtgagaccccatctctttttattaaaaaaaaaaaaaagaccatacatacacacatgcacacacaacagtggtaatggattataattcatgaaaaaagaatctatgcatccacagggacacacccatgtatataaacaaataagtggaagaaaggaatccagttctcacgttagaatcaacagggctggaaggccatcaaggaaaccccgtggcaggggcaggggttcaaagagctggtggttgtagtctcagtgtctcccaccaccacttactagttacaaaggaaaaagaatcactttctagaggcaaagctggcgacaccacccgagccaagtgatccaagttaacatcaccaggaatgggacaggccagcttcaccaccctccggatggacagcctcggtagcagaactcctgccaaagacacagctgtccagggtcgaatcatccggagacacagggcaaacccacatggagggagacacacacagtggcctgaatactttgaaaatgccagggccaaaaaacgtagaaggctaaataaagtaccgttcagggtgaaggggaaggaagaaatgtgatgcctaagtgggagtctatgattccactatgttatgtattagtccattttcaaattactgataaagacatacctgagactggataatttataaagggaagaggtttaattgactcacagttccacatggctggggaggcctcacaatcacagcagaagatgaaggaagaacaaaggaacatcttacatgatgacaggcaaagagataatgaaaactgagcacaaagggtttccccttataaaaccatcagatctcgtgagacttattcattaccatgagaacagcatggaggaaaccacccccatgattcaattatctcccacgaggtccctcccatgacacgtgggaattatgggagctacaattcacgatgagatttgggtggggacacagccaaaccatatcattccaccccggcccctccctaatctcatgtcctcacatttcaaaaccaatcatgccttcccaacggtgccccaaagtcttaactcatttcagcattaactcaaaaatctgcagtccaaagtctcatctgagaccaggcaagtcccttccacctatgagcctgtaaaatcaaaagcaagttagttaattcctagacacaattagggtacaggccttggataaatacacccatttgaaatgggagtaattggccaaaacgaaggggctaaaggccccatgcaagttcgaaatccagtggggcagttaaatcttaatgctccaaaatgatctccattgactccatgtctcacatctaggtcatgctgatgcaagaggtgggttcccatagtcttgagcagctctgcccctctggctttgcagggtacagcctccctcctggctgctttcacaggctggcattgagtgtctgcagcttttccaggcacatggtgcaagctgttgatggatctatcattctgggatctggaggacagtggccctcttctcacagctccactaggcagtgccccagtggggactttgcatgggggctccaaccccacttttcccttcctcactgccctagcagaggttctccatgaggaccccacccctgcagcaaacttctgcctggacatccaggcatttccatacatctctgaaatctaggcagagctttccatacctcaattcttgacttctgtgcacccacaggctcaacaccacatggaagctaccaagagttggggcttgcaccctctgaagccacagcccaagctgtaccttgacaccttttagctatggctagagcggctgggacacagggcaccaagtccctaggctgcacacagcatggaggccctgggcccagtccaggaaaccatttttgcctcctaggcctctgggcctgggatgggaggggctgctcctaaggtctctgacatgccctggagacattttccccattgtcttagtgattaacatttggcttcttgttacttatgcaaatttctgcaggctgcttgactttctcctcagaaaatgggtttttattttctatcacattttcagactgcaaattttctgaacttttatctctgtttccctttcaaaactgaatgcttttaacaacacccaagtcacctcttgaaagctttgcagcttagaaatttcttccaccaaataccctaaatcatctccctcaagttcaaagttccacaaatctctagggcagtggtaaaatactgccagtctctttgctaaaacatagcaagagtcatctttaatccacttcccaaaaagtttctcatctccatctgagaccacctcagcctggatttcattgtccatatcattatcagaattttggtcaagcccttcaacaagtttctaggaagttccagactctcccacattttcttgtcatcttctgagccctccaaactgtccaacctctgcctcttacccagttccaaagttgcttccacatttttgggtatctttacagccgcaccccactcccagtaccaatttactgtattagtccattttcatgctgctgataaagacatacctgagactgggtaatttataaagggaagaggtttaattgactcacagttccacatggctggggaggtctcacaatcatggcggaagatgaagaaagagcaaaggcacatcttacgtggcagctggcaaagagagaatgaaaacagagtgcaaggggttcccccttataaaaccatcagatctcatgagacttaattcactaccacgagaacaatatgggagaaactgcccccatggttcaattatctcccactgggtccctcccacaacacatgggaattatgggagctacagttcaagatgagatttgggtggggacacagccaaaccatatcagagttgaatcctgtctgggaagagatggctgcaatagccagtgtctgggcagctgatgatgtgagagtgtgaggtagagaactgtagtgtgcaatagagacctgtagtgtgcatgtcagtgttgtttcccgattttgacaacagtaccacatggttacagaagagaacacccttattcctaagaaatccatgaggaggcgtttagcagaaaacaggcatggtgtctccaagggctcagaaagattcaaccaaaagagggaagtctggagagggacaggatggagcaggacgggggcagtgtagaaaccgcaggcaagtctaagcagagcacgtttgggagttccttctgctattcttgcaacttctctataagtttgaaatgaaatcatataaatcgaaagttagaagagaattaccacatcatgttggatttcactcatagccacgagaacgggtggtggtctcttctgcagtgaactgatgcgatgtgtgatgtcactagttctcatccaaagcagatgacaattccagttactcctcaccagacataagaaaatgcttttagtagatcagtttttctgattgtaaagttcagaaatgttaatcagagaacgtgcagaaatttttaaagaagaaaagtaaaatgactcatcgtaccaaaagccagagatgccagcttttagtttcctgctagtctttttctcggcgtgtgtgtgtgcgcgcgtgcatgcacatgtttctacttggtctttgtgtgtgtgttaagggcgtgtacacacacagtgcagtcaggagtgagttgcacgtctacagctaggctgcttccccgaggctgtgtggccatcagccaggcgtccccaacccccaggccatgaagcactaccagtccatggcctgttaggaaccaggctgcacagcaggaggtgagtggcaggtgagcaagtgaagcttcatctgtatttacagtcactccccatcactcgcattaccgcgtgagctctgcctcctatcagatcagtggcggcattagattctcacaggggtgtgtaccctgttgcaaactatgcatgtgagggatctaggttgcctcctctttataagaatctaatgcctgatgatctgtcactgtctcccatcacccccagatgggactgtctagttgcaggaaaacaagctcagggctctcactgattctacattatggtgagttgtataattatttaattctatattacaatgtaataatagtagaaataaagtgcccaatgcaagtaatgtgcttgaatcatcccagaaccacccacaccactggtctgtggaaaaactgttttccatgaaaccagtcactggtcccaaaaaggttggggaccacggccatcggctgtttgctttatgaatttgtgcctcagtttcttcatctctgaaacgggaacgatgggagccctcacctcgtatggtggtttgaggattgaatgaactcattgtccagcacccttagcttcttgccagctcaggaagtgctgagcagggtaacccctatcactgcgtgtgtgtgtgtgtatatgtgtgtgtgtgcatacttgcctatgtgtgtctgtgcaaatacttggtaaaattgagagggtactagacaactcatttgtatcttcttaccttttgacacatggcagacatgtctcacatctgttcttcctccaaatgtgacctttcaatggctgcctggcatttcccctgtgttattgaacgtaatcaactctctattgacggctgggttatttcctaattgactgctgtaaatagcattgtgatgcaaatccttgtacactcatttttgcctggaactcaagattatttccttgggtcacatttgcaggagaagactgacaggatcaaagggttcctgcatttttatggctctgacacctttggccaaatcaccttccgggagtgttttcctaatttagcttcctactgtgctgctggacatcactgactccccccgccaacccccaccccacactgcaccacaaagctgggtattatcataaaaacactgccattatgatgaagcaaaaatagaatatccttcctcctcttagtgaggggagtatgtttatgtttgttgagctctttgtattttagccacccattcactggcccacctgcccctggtgcacctgcagcagcaagactgtcatctaggttgttggggaaaccaggagtgagtggagcacgagggtcaccctccaggaagtgacctgcaagagaatggagagagtcatggaccggcatggcgtggtaatgcatggtgcgtgtctcttagcagtaagaccttgagaaggagccaggcagggaggaatgggagggtgaaggagtgccttttgtggaggggagtcggacacagatgggatttcagcagagacctgatggaattgagggagtgggtggtgtgtgcttctgcaggaagagcacccagacagagggcatggcacatgcaaaggtcctgtgttgggaacgtgcttggtgcatgtgaagaactgtgcagggaaggtgctggagataggacgggagggccacgagggttaagatcctgagagcaatgcggggggtgtgagtgatgagggacaacatcagtcctctcttggcttctgtactttaaaaaaatcattttgttttgaagcaattttagacctacagaaaagttccacgacagtactgagagttcctgtggactcctagtattaacatcttaataacggggtgtattgaccaaaaccgacacctgatacattaccgtgaactcaactgcagatctgattcaaatcccgcgtttttctagcatccggtttctgttctgtgatccccacgttgctttcagctgccaggtctcctttcgtgtcctgcagcctgtgccagctcctcagtctctctttgtctttcgtgaccttgatgttttagataagtactgggcggctgttttgtagaacgtccctcggtttggattctctgatatgctctcatgattagatcaagattgtgcatttttggcaagaacaccgcgggagtgttgttgggtcccgaggagtccctgtggcagggctgtgtgaggtcagcatgtcttagggcgggttcatttgaccttgaccactcaggtaggagtgtgtcagctgggcttctcagctgtaaattaaccattttccgcttcataattagtaaacaccttgaggaagctacattgagacattgcagctgccttttttctcctgagattttgccccgctgattttagtgcccatcagctggttttgcttgtgacaggcaaagtctgtggtgcttgccaaatggggatttgtttatttcccactttctttctatgtttgttaatttggattcttctccaggaagagctgtcccctttgttctggttatgtatccagtggcttatgtatatcagcatggtttcatagatacttcttttgtgttatgggctataagccaatgctattattatttattttcctccatttatttatttatttagagacggagttttactcttgcacaggctggagtgcagtggcatgatctcggctcactgaaacctctgcctccggggttcaagtgattctcctgcctcagcctcctgagtagctgggattacaggcacgtaccaccacgcccaactaatattttgtatttttagtggagacggggtttcatcatgttggccaggctggtcttgaactcctaacctcaggtgatccacccgccttggcctcccaaagtgcagggattacaggtgtgagccactgcacccagcctcattatttattttcattgctcaaattgtgctggcttttgccccagaaacaaccttccattcagcttccatgcccctttggtgggccctgtcttttcttggacactgccttcctggcaccccaagatgctctgggctcagcttgtatttccttgcctcagtcttgaaatcacccacttctccaaggagccagggttccttccattggagagtggtctttagaaacccaggcctgggtgcatggtgtgctcatcgccactgtggacctgctgctctgcgcccactcggccgacggagctggggaatatgtgtatggcacccccacgtctacgcttctgtgttcatctgcagatatattcatacatgagtgggctcatactgtctccaactccagttctgccccagtggggccaattctctctctttgttgtaacacctttcttcaatagtgagaaacctggctctctcaccttcacctgctcgtccaaccccagctgcaagggaactggctccatacttgctgatgcgtgcccccatgagaagtgactgaccacccagagcctggcgcctgtgcatggcgtctgtgcacggcgcgtcttgtcttcagcctcactgcgtcccatcagtgcttttccccacggtgactttgagtatttctttacttctgtactcccttcagtgtgattatgtcattcatctgtgacatgtttagatttatctgttaggttggtattccattttgggtgtcccccgattctgattgtttttagttacttatctgggggtctgtgtgaagggaatgtaaagctgctgtgactcctggagtcagaggtgcacaaagagtgtcctcagaggagagccaggcgcccaccctgccagcccttccctccccactccatcccccacccccccaccctggacaaaaccagctcttcagcctttcatgtctctcttgcaggcctctcgcacagatgagaaaatacacgtgtgttttcctgtatcccctctttcttacaaaaagggaagcacactatcaatactcttgtagatctttaattgcggtaagatacactaatgcaaaatttaccattttaactatttttaagcacacagttcagtggcatgaagtacattgattttgttatgcaaccatcaccaccatccatttctagaattttctcatcctcccaaactgaaactccatccccattaaacaccaactcccccattctctcttccccagcccctggcacctaccatttacctttcgtccctatggatttgactaatccaggaacttcataaaagtgggatcattgagtactctatttgtcttttgtgactggcttatttcacttgggcataatgtcctgaaagttcactcatgctgtagcatgtgtcagaatttccttttccttttcaaggctgaataatattccactgtatggatagaccacattttgcttatccattcatcttttgatgaacatttgggttgcctccatgttttagctattgtgaataatgctactatgaatatgggtgtacaaatatcttttcaacgccctgctttcaattcttttgggtatatacccagaagtggaatttctggattatatggtaattatagttttaatttcttgaggaaccactatgccgttttccacagtagctaccacatcctcaccaacacttgtaatttctggggttttttaatagtagccattctagtgggtgtgcagtggtatctcattatagttttgatttacattttcttatgagtagtgatgttgagtatcttttcatgctcttattagccatttgtatatcttctttggagaatatctcctcagctcttttgcccacttcattaaattgagaggtttgtttttgctgttgagttttagaacttctctatatattctggatattaatcccttatcagatataggatttgcaaatattttctctcattctgtggggtgcctttttactccgttgatagtgtctttgtacaaaaatttttaatgttcacgaagtccaagttgtctactttttgttttgttgcctgtgcctttggtctttgtgttagtccatttagcattgctataaaggaatacctgaggctggtaatttataaagaaaagaggtttaattggcttatggttctgcaggctgtacaagaaacatggtgccagcacctgcttctggcgagagcctcaggaagcttccaatcacggcagaaggtgaagcgggagtaggtgtctcatatgatgagacagggagcaagagaaaggaggttccagtctccttttaacaaccagatcttgcatgaactcattacctaatcatggggaatctgcccctatgacccaaacagcacccaccaggccccacctccaacgctggggatcacatttcaacatgagagttggaggggacaaatatctgaactctatcaatgttatatccaagaaatcatagccaaatccaatgtcatgaagcttttgccctatgttttcttctaagatttttatagttttacgttgcacatttagatatttgatccattttgagttaatttttgtatatggtgtgaagtaagggtccagcttccctcttgcatgtggatttccagttttcccagcaccatttgttgaaaagacagtccttttctcattgaatagtcttggaaccctagtcaaaaatcatttaaccatttatgccacggtttatttctgggctgtctcatgttccattggtttatatgtctgtctttttgcctgtgtcacactgtcttgattactgtaagtttatagtaaagttttgaaatcagaaagtgttaggcttccagcttggcttttctttttcaatattgcttttggctattttaagttccttgagattccatatgaattttaggatgggtttttctatttttgcaaaaagtgtcattgggattttgagagggattgcactgaatctataaatcactttgggtagtattgatatctcaacattgtcttctaatccatgaacatgggatatgtttccatttatttgcatctttttaagtttctttcagtaatgttttgtgggttttgctgcagaagtcttttacctccttggttaagttaattcctaagtattctacttgatgctattataaattaaattgttttcttaatttcatttttagattgttcattgttagcatatagaaatgcaactgattttgcatgtttaccttagattctgtaactttgctgacttcatttattagctctaataagtttttgtggaatctttaggggtttctacatatgagattatgttatctgtgaatagaaatagttttacgtcttttttttccattctggatgccttttatttcttttaatttttttcttgccaaattgctctggctagaattttcagtacaatgttgaatagaagtggtgaaagtggtcaccctggccttattcctgaccttagagggaaaaatttcagtctcatcattatgatgttagctgtggattttcacatatggtttttattatgttaaggtagtttccttctattcctagtttgttgagagtttttaataaggatgttgaattttgtcaaatgctttttgtatcaattgagatcatgtgatcatgtgagtgttatttcttcattctgttaatatgctcttttacatggatttatttttgtatgttgaaccatccttgcattccaggactaaatctcacatggtcatgatatgtaatactttaactatgtttctgaactcagtttgctattttgttgagaattttgcatcagttttcataagggatattggtctgtagttttcttgtagtctttgtctggctttagtatcagagtaatgctctcctcatagaatgagttagaaacctttcccctcctctttaattttttgggaaagattgagaaggatgggagtttattctttaaatatttggtaggattcattggggaagccatcaggtccaggcttttctttgttgagagttttttgattactgattcaatctcctcactagttataggtccatgaagattttgtatttctttgtgatttagttttggtaggtttcgtgtttctcagaatttgtccatttcatctaggttatccaatttgttgatacacaattgttcacaatactctcttataatcctttttatttctgtagaattgatagtcatgtccctattttcacttctgatttcagtagtcttctctcttttttacttagtccatctagctaaaggtttgtcaattcttaaaatcttttcagagaagcaactttgatttaattgatttttctctattgtttttctattctctattttgttggtctctgctgtggtatttattatcttctttcttctgctagctttgggtttagttcttttgctagttccttaagtggtaaagttaggttatttactggagatctttcttgtttattaatgtaacaatttatagggagggagtggagcaagatggccaaatagaagcctccaattgtcctccccaacaggaacaccaaatttgagaactatctacacaaaaaagcaccttcataagaaccaaaattcagataagcaatcacagtatctgcttttaactttatattgctggaagaggcactgaagagggcaagagagacagtactgaatcactgacagcactgtgcctcccatcccccagctatgtggcatggagagagaatctgagagcttgggggagggaaagtgcagtgctttgggactgtccatcgagctcagtgattccctgttgccacagaaagcagaaccaggctaaattcagcccacacccagcacagagggagcatttaaaccagccctagccagaggggaatcacatatctcaggggtcagaaactgagttccagaaaaccttgccaccacgggctaaagtgctctggggttctaaataaacttgtaaggcagtctaggccacaataactgcaattcctaggcaagtcctattgctgagatgggctcagagccagtggatgtggggggcacacaacctagtgagacaccagccagggtggctaaccccaggcagcacagctcacagaaacaaaagtgactcttttcctctgcttaaagagaggagatggagcagtaaagagaacattgtcttgcatcttggataccagctcaaccacagtaggagaggacactgggcagagtcaatgggcacacatttcaggccctggctcttggacatttccagacacaccctgggccagaagggaatccactgccttggagggaaggacctagtcttgtcagaattcatcatcagctgactaaagagcccttggaccctgaacaaccagcagtgccaggtagtatcctgtgggccttgaatgagattctgaaatatactggcttcaggtaccagcttgaccacagtggggtagagcaccaaatgggctcttggggtccctgattccaggccttggctcttggacagcatttctggacctgctctaggccagaagggagcccactgacctgaaaggtgagtccacagcctagaagccttcaccacaagctgactgaagagccctcaggccttcagtggacaaccatggtagcctgacagtactgcctatgggcctgtagtggtggtggccacagggagaggctcctttgcctatggaaaggagaaggaattctgggtatgactttgtcttgtgctactactgagtgccagcttagcctctgtagtataccacaccaggtaggtttctaaggtctttgactacagacccttgctcctggatggcatctctggacccaccttggacttgggggaactcaccaccctaaagtgaaggacaaaagcctggctggctttaccatttgctaattgtagagccctggggctttgagtgaacataggtggtagccaggtagtgcttacagcgggccttgggtgaaacccagtgatgtgttggcttcaggtctgaccagcacagtcccagtggtggtggccacaggtaagcttgtgtcactcctccccaagcttcaggtggcttagcatagagagagagtccatttctttgggagaaagtaagagaagaaaacaagagtctctgcctcgtaatgcagagaattcttctggatcttatctaagaccaccaaggcagtattttttttaatatttattttttgaaacagagtttcactcttgttgccaaggctagagcgcaatggtgtgatctcagctcaccgcaacctctgtctcccgggtttaagcgattctcctgcctcagtctcctgagtagctaggattataggcatgtgccatcatgcctggctaatttttgtttgtttgtttgtttgtttgttttagtagagacagggtttctccatgttggtcaggctggtcttgaactcccgacctcaggtgatctgcccgcctcggcctcccaaagtgctgggattacaggcgtgagccactgcgcctggccccaaggcagtatttttatgagtctgcaagaaccacagtgttactgggcttgggatgctgcctaatgcagatacggcttagatcacaacacccaagtccctttgaatacctggaaagctttaccaagaaagatgggtacaaacaagcccagactgcaaaggctacaataaatacctaactctttaatgcctagacaccaatgaacaagaccatctaggaaaacatgacctgaccaaacaaactaaataaagcatcagggaccaatcctgaagaaaagagatatgtgacctttcagagagagaatttaaaatagctgttatgagaaaactcaaattcaagataacacagcgaaggaattcagaattctatcagataaatttaataaagagattaaaataagaatcaagcagaaattctggagttgaaaaatgcagctgacatattgaagaatgtatcagaatctcttgataacagcattgatcaagaacaaaaaagaattagtaagcttgaagacaggatatttgtaaatacacagaggagacagaataagaacgaatgaagcatgatctagaaaatagcctcaaaagggcaaatctaagatttattgaccttaaagaggaggtagagaaagagataggggtagaaagcttattcaaagggatactaacatagaacttcccaaacctagagaaagataccaatattcaaatacaagaagattctagaataccaagcagatttaacccaaagaagactacctcaaggtatttaatagtcaaagttccaaaggtcaaggataaagaaaggatcctaaaagcagcaagaaaaaaaagacttataattgaactccattatatctggcagcagagttttcaatggaaactttatgggccagaagagagtggcaggacatatttaaggtgctgaaggaaaaaaaagaaaaaaacttttgctctagaatagtatatctggtgaaaatatccttccaacatgaaggagaaatacagaccttcccagacaaacaaaagctgaggatgtcatcaacaccagagctgtcttacaagaaatgctaaagggaattcttcaatctgaaagaaaagggtgttaataagcaacaagaaatgatgtgaaggtacaaaactcactggtaatacatacacagaaatacaaatagtattataacactgtaattatggtgtgtaaactactcatatattaagtagaaggatgaaaagaagaactgataaataatgactacaacaacttttgcggtacaataggcagtacaataagatatagagacaaaaaaacttaaaaagcggagagacaaaagttgaagtgtagagattttttgttttactttaagttctggaatacgtgtgctgaacgtgcaggtttgttacatacgtatacagtgccatggtggtttgctgcacctatcaacccatcatctaggttttaagccctacatgcattaggtatttgtcctaatgctctccctccccttggcccccatctccccacagatcccggtgtgtgatgttcccctccctgtgtccgtgtattctcattgttcaacttccacttatgagtgagaacatatggtgtttggttttctgttcctgtgttagtttgccgagaatggtttccagcttcatccccacaaaagacatgaactcattctttttttatggctgcatattattccatggtgtatatgtgccacattttctttatccagcctatcattgatgggcatttgggttggttccaagtctttgctattgtaaatagtggtgcagtaaacatatgtgtgcatgtgtctttatagtagaatgatttataatcctttgggtatatacccagtaatgggattgctgggtcaaatggtatttctagttctagaatctagttctagaatcaccacgctgtcttccacaatggttgaactaatttacactcccaccaacagtgtaaaagcgttcctatttctccacatcctctccagcatctgttgtttcctgattttttagtgatcgccattctaactggcatgagatggtatctccttgtggttttgatttgcatttctctgatgaccagtaatgattagcttttttttccatatgtttcttggccacataaatgtcttcttttgagaagtatctgttcgtatcctttacccactttttgatggggttgtttttttcttgtaaatttaagttccttgtagattttggatattagaccttgtcagatggatagattgcaaatattttctcccattctgtaggttgcctattcactctgatgctagcttcttttactgtgcagaagctctttagtttaattagatcccatttgtcaattttggcttttgttgcaattgctcttggtgttttagtcatgaagtccttgcccatgcctatgtcctgaatggtattgcctgggtattcttctagggtttccgtggttttaggttttacatttaagtctttaatcatcttgagttaatttttatataagttgtaaggaaggggtccagtttctgttttctgcatatgactagccagttttcccagcaccatttattaaatagagaatcctttccgcattgcttttttgtcaggttggtcaaagatcagatgattttaggtgagtggtgttatttctgaggtctctgttctgttccattggtttatatatctgtcttcataccagtaccatgctgttttcgttactatagccttgtagtatagtttgaagtcaggtagtgtgatgcctccagctttgttctttttacttaggattgtcttggctatatgggctcttttttggttccatatgaaatttaaagtagttttttctaattctgtgaagaaagtcaatgatagcttgatgggaatagcattgaatctataaattactttgggcagtatggccattttcatgatactgattattcctatccatgagcatggaattttttttccatttgtttgtgtcctttcctttccttcagcagtggtttgttgttctccttgaagaggtccttcacatcccttgtaagttgtattcctaggtattttcttctctttgtagcaattatgaatggggattcactcatgatttggctctctgcttgtctatttttggtgtataggaatgcttgtgaattttgcacattgattttgtatcccaagactttgctgaagttggctatcagcttaaggagtttttgggctgagacaatggggttttctaaatatacaatcatgtcatctgcaaacagagaaaatttgacttcctcttttcctatttgaatactctttattttttcgcttgccttattgtcctggccagaacttccaatactatgttgaatgggagtggtgagagagggcatccttgtcttgtgctggttttcaaagtgaatgcttccagcttttgcccgttcagtatgatattgcctgtgggtttgtcataaatagctcttgttattttgagatatgttccatcaattcctagtttattgagagtttttggcatgaagggatgttgaattttgtcaaaggctttttctgcatctattgagataatcatgtggtttttgtcattggttctgtttatgtgatgtttagtgatttacatatgttgaatcagccttgcatcccagggatgaagcccacttgatcaccatggataagctttttgatgtgctgctggattcagtttgccagtattttattgaagatttttgcatcggtgctcatcagggatattggcctgaagttttctttttttgtgtgtcgctgccaaattttggtatcaggatgatgctggcctcataaaatgagttagggaggggtccctctttttctactgtttggaatagtttcagaaggaatggtaccagctcctctttgtgcctctggtagaatttgggtgtgaatccgtctggtcctgggctttttttggttggcaggctattaattactgcctcaatttcagaacttgttgttggtctattcagggattcgactttttcctggtttagtcttggagggtgtatgtgtccaggaatttatccattttttctagattttctagtttatttgcatggaggtgtttttagtattctctgatggtagtttgtatttctgtgggatcagtggtgatatcccctttatcattttttattgcatctatttgattcttctctcttttcttctttgttagtctggctggcagtctattttgttaatcttttcaaaaaaccagctcctggattcattgatttttttggaagggtttttcatgtctctatctccttcagttctgctctgatcttagttatttcttgtcttctgctagcttttgaatttgtttgctcttgcttctctagttcttttaattgtgatgtttgggtgtcgatttcagatctctctagctttctgatatgggcatttagtgctataaatttgcctctaaacactgctttagctgtgtcccagaaattctggtacgttgtctctttgttttcatttgtttcaaagaatttctttatttctgccttgattttgttatttactcagtagtcattcagtagcaggttgttcaatttccatgtatctgtgtggtttttagtgagtttcttcatcctgagttctaatttgatcgtactgtgttctgagagactgtttgttatgatttccattctttggcatttgctgaggagtgttttacttccagttatgtggtcaattttagaataagtgctatgtgatgctgagaacaatgtacattctcttgatttggggtggaaagttctgtagatgtctattaggtccgcttggtccagagctgagttcaagtcctgaatatccttgttaattttctgtctcattgatctgtctaatattgacagtggagtgttaaagtctcgcactgttattgagtaggaatataagtctctttgtaggtctctaagaacttgttttatgaatctaggtgctcctgtattgggtgcatttatttaggatagttagctcttcttgttgcattgatccctttaccattatgtaatgctcttctttgtctttttttatctttcttagtttgaagtctgttttatcaaaggctaggatcttggccgggtgcagtggctcatgcctgtaatcccagcactttgggaggctgaggtggttggatcacgagatcaggagatcgagaccatcctggctaacacgatgaaaccccatctctactaaaaatacaaaaaaattagtcaggcatggtggcgggcacctgtagtcccagctactcggcaggctgaggcaggagaatggcgtgaacccgggaggtggagcttgcagcgagccaagatagcgccactgcagtctggcctgggcaaaagagtgagactccatctcagaaaaaataaaaaataaaaaataaaattaaaaaaaatggctaggatcacaacccctgctttttttttttttttttttttttttgctttccattgcttggtaaatattcctccatccctttattttgagcatatgtgtgtctttgcacatgagatggatctcctgaataaagcacactgatgggccttaactctttatccagtttgccagtctgtgtcttttaattggggcatttagcccatttacatttaacgttaacattgttatgtgtgaatttggtcctgtcgtcatgatgctagctggttattctgcacattagttgatgcagtttcttcatagtgtcattggtctttatattttggtgtggttttgcagtggctgatactgctttttcctttccatgtttagtgcttccttcaggagctcttgtaaggcaagcctcagcatttgcttgtttggaaaggattttatttatcctttactcatgaagcttagtttggctggatatgaaattctgcttgaaaattcttttctttatgaatgttgaatattggctcccactctcttctggcttgtagggtttctgcagagagatttgctgttagtctgatgcacttctctttgtaggtaacctgacctttctctctggctgcccttaacgttttgtccttcatttaaaccttggagaatctgacaattatatgtcttggggttgctcttcttgaggagtatcttagtggtgttctctgtatttcctgaatttgaatgctagcctgtcttgctaggttggggaagttctcctggataatatcctgaagtgtgttttccaacttggttccattctccccgtcactttcaggtacagcaatcaattgtaggtttggtcttttcatatagtcccatatttcttggaggttttgttcgttctttttcatcattttttctctaatcttgtctgcatgccttatttcgttaagttgatcttcaatctctgatatcctttcttccacttgattcatttggctattgatacttgtgtatgcatcacaaagttctcatgctgtgtttttcagctccatgaggtcatttatgttcctctctaaactggttattctagttagcagttcctgtaaccttttatcaggttcttagcttccttgcattgggttagaacatgcttctctagctcagaggaatttgttattacccaccttctgaagcctacttctgtcaattcgtcagtctcattctccgtccagttttgtgcccttgctggagaggagatgtgatcatttggaggagaagaggcattctggtttttagaatgttcagcatttttgtgctggtttttcctcatctttgtggatttatctgcctttgctctttgaggctgatgacctttggatggggtttttgtgtggggggtcccttttgttgatgttgattttgttgctttctgtttgctagcttttcttctaagagtcaagcctgcagtcctgcaggtctgctgcagtttgctggaggtccactccagaccctgtttgcctgggtatcaccagtggaggctgcagaacagcaaagattgctgcctactccttcctctggaagctttgtcccagaagggcaccagcctgatgccaaccagagctctcctgtttgaggtgtctgttgacccctgttgggaggtcttgcctgctcaggaggcatggggctcagggacccacttgaggaggcagtctgtcccttagcagagctcatgcactgtgctgcgagaatcccccttgtcaggatcagctgctctcttcagagccagcaggcaggagagttcaagtctgctgaagctgtgcccacagccaccccttctccaggtgctctgtcccagggaaatgggagttttatctataatcccctgactggggctgctgcctttctttcagagatgccctgcccagtgaggaggaatctagagaagcagtctggcctcagctgctttgctgtgctttggtgaattctgcccagtccaagcctcccagcctccttagcactatcaggggaaaaccgcctactaaagcctcagtaataccaaatgcccctcccgccaccaagcttgagcatcccaggtcaacttcagactgctgtgctggcagtgagaatttgaagccagtggttcttagcttgctgggctccatgggagtgggacccactgagtgagaccacttggcttcctggcctcagccccctttccaggggagtaaatgattctgtcttgctggggttccaggcaccactggggtacagaaaaaactcctgcagctagttcaatgtctgtccaaacagcaactcagttttgtgcttgaaacccagggccctggtggtataggcacatgaaggagtctcctgatctgcagattgcaaaacccatgggaaaagcatagtatccaggccgggtatcacagtcccgggtatcacagatgacgggttgatgggtgcagcaactgcatgcaaactgcatgtttgcagttccctcggctgggggagggaggtctcccggctccttgcacttcccaggtgaggcgatgccccacctgcttctgtgtgccctccgtgggctgcacccactgcctaatcagtcccaatgagatgaacttggtacctcagtcagaaatgcagaaatcacccagtgttgatctcactgacagctacagactggagctcttcctattctgccatcttgccagatgtaaagtgtagaatttttgattttgtttttttgcttgtttatgcaattagtgttaagtcatcatcagtttaaaataatgagttgtaagatattttcaagcctcatggtaacctcagatctaaaacatatggcagacacacaaataaaaagcaagaaattaaagcatgccactagagaaaatcaccttcactaaaaggaagacagaagggaagtaacaaaggaagagaatatcttcaccagaaaacaaataataaaatggcaagagtgagtccttacgtatcaataataatattaaatgtaaatgggctaaccttgccaatcaaaagacagagtggttgaatggacccctgcccccacaaaaaaagacccaattatctgttgcttacaagaaacacatttcaacctataaaaatacacatagactgaaaattaagggcttgaaaaaagatattccgtgccaatagaaaccagaaaagatcaggagtagctatacttgtattaggcaaagtagagttcaagataataactataagaagagacaaagaaggtcattacatcatgataaagggatcaattcagcaagacgatataacaatttcaaagaaacatctaacttaatctgcactgtagaccaaatatacctaatagatatttacaggacatttcatccagcaattccaagagaagaatacacattctcctcagcacatagctcattctcaaggatagaccatatgttagatcacaaaacaagtcttgaaacattctaaaaaattgaaatactatcaagcatcttctctgaccagtacagaataaaactagaagttaataatgagacattttggaaactatacagacatacacatagtaattaaacaatatgctcctgaatgaccagagggtcaaggaagaaattaagaaggaaattgaaaattttattgaaataaattacaatggaaacacaacttaccaaaacctgtgggatttgtttgtgtcttttttacttccttgagcagtggtttgtagttctccttgaagatatgaacagacacttctcaaaaaaaagacatttatgcagccaaaaaacatatgaaaatgtgctcatcatcactggtcattagagaaatgcaaatcaaaaccacaatgagataccatctcacaccagttagaatggcgatcattaaaaaatcaggaaacaacagatgctggagaggatgtggagaaataggaacgcttttacactgttggtgggagtgtaaattagttcaaccattgtggaagacagtgtggcaattcctcaaggatctagaacccaaataccatttgacccagtgatcccattactgggtatatacccaaaggattataaatcattgtattataaagacacatgcacacatatgtttattgcaccactattcacaatagcaaagacttggaaccaacccaaatgcccatcaatgataggctggataaagaaaatgtggcacatatacactgtgaagtactatgcagccataaaaaaagatgagtttatgttcttttcagggacacggatgaagctggaaaccatcattctcagcaaactaacacaagaacagaaaaccaaacaccacatgttctcactcataagcgggagttgaacaaggagaacacatggacacagggaggggaacatcacacaccggggtctgttggggggtgggggcaaggggagggagggaattaggagaaatacctaatgtagatgacgggttgatgggtgcagcaaaccaccatggcacgtgtatgcctatgtaacaaaactgcatgttctgcacatgtaccccagaacttataaaaatcctgtgggatacagcaaaagcagtattaagagggaagtttctagttaaaagcacctgcatcaataaagagaaaaacttcaagtaaacaacctaatgatcttaaagaacaagaaaagcaagagtaagtcaacctaaaattagtagaagaaataataaagcttagagcagaaatacatgaaattgaagtgaagaaaacaagacaaaagatcaacaaaataaaaagttggttttttttttaaaagataaaattgacaaacctttagccagactaagaaaagaagagggaagatccaagtaactaaagtcagagacaaaaaaaggagacattacaactgataccacagaaattcaaaggataattagtggctgctatgagcaactctatgccaataaattggaaaatctggaagaaatggatacattcctagacatgtgcaacctaccaagattgaaccaggaagaaatgcaaacctgaacagaccactaagcagtaatgagattgaacctgtaatttaaaaatcttccaacaaagaaaaccctgagacttgatggcctcactgctaaattctgccaaagatttcaagaactaatactaatccttctgaaactattatgaaaaatagaggaggagggaatacctccaaactcatctacaaggcccgtattaccctgttaccaaaaccagacaaagatacatcaaaaaaaaaaaaaaaaaaaaaaaaaaaaaggaaccacgggccaatatccctgataaatattgatgcaaaaatcctcaacaaaatactagcaaagcaaattcagcaacaccttaaaaaagatcactcttcatgaccaagtgggagttatcccaggaatgcaaggatagttcaacatatgcaaatcactttatgtgatacatcgtatcaacagaatgaaggacaaaaccacatgagcatttcaattgatgctgaaaaagcacttgataaaattccacatcccttcaacataaaaactgtcaaaaacctaggtatagaaggaacatacctcaacataataaaagccatatatgacagacccacagctagtaacatactgaatggggaaaaactgaaggcctttcctctaagacctggaacatgacaaagatgcccactttcatcactgttatttaacacagtagtggaaatcctagctagagcaatcagacaagagaagaaaataaagggcatccaagttggaaagaaagaagtcaaattatccttgtttgcagatgatgtggtcttatatttggaaaaatctaaagaccccacaaaaaaactattagaactgataaattcagtaaagttgcaggatacaaagtcaacatacaaaaatcagtagcatttctatatgccaacagtgaacaatctgaaaaacaaatcaagaaagtaatcccatttaaaatagctacaaataaaatacctaggaataaacttaaccaaagaagtgagagatctctacaatgaaaattataatacactgatgcaagaaattgaagaggacccaaaaatggtaagatatttcatgttcatggactggaagaatcaatattgttaaaatgtctgtattgtctaaagcaatctacagattcagtgcaccccctatcacaataccaatgacattcttcacagaaatagtaaaaacactcctcaaacttatatggaatcactaaagtcccagaatagtcaaagctatcctgagcaaaagaacaaaactggagggagcacattacctgagttcaaattatactacagagtcatagtaaccaaaacagtatgtactgacataaaaacagacacgtagaccaatggaacagaatagaaaacccagcaaacaaatccatatgtctacgacaaactcatttttgacaaaggtgccaagaacatgcattgggaaatggacagtctcttcaataaacgatgctgggaaaactggatgtccatatgcagaagaatgaaactagacccctatctctcaccatataaaaaaaacaaatcaaagtgaattcaagaattaaatctaagacttcaaactatgaaactactaaaaagacattggagaaactctccaggacattggagtgggcaaagactgcttgagtaatccctacaagcacaggcaaccgaagcaaaaatggacaaatgggatcacatcaagttaaaaagcttctgcacagcaaaggaaacaatgagacagcctgcagaatgggagaaaatatttgcaaagtgcccatctgacaagggactaataaccagaatatgtaaggagctcaaacaaccgcacaaggaaaacatctaataatccaattaaaagatgggcaaaagacctgaatagacatttctcgaaagaagacaaatggatgaaactggaaaccatcattctcagcaaactatcgcaaggacagaaaaccaaacaccgcatgttctcactcataggtgggaactgaacaatgagaacacatggacacaggaaggggaacatcacacactggggactgttgtggggttggggggaggggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaaaaacaaatgacaaataaataaatgaaaaggtactcaacgtcactgatcatcagagaaatgcaaatgaaaactataatgagatatgaccccaccctggtcaatatagcttttatccaaaagataggcaataatggatgctagtgaggatgtggagaaaagggaatccttgtacactgttggtgggaatgtaagttactacaaccaccgtggaggacagtttcgaggttcctcaaaactaaaaatagagctacctctgatccagcagtcccactctagttatatatccagaagaaagaaaatcagtccagcagagaaggatccgcactcctgtgtttattgcagcactattcacaatagccaagatttgggagcaaactgagtgtccatcaacagatgaatggataaagaaaatgctgtgtatacacgcaacggtatactagttagccatgaaaaagaatgagaacgtgtcatttgcaacaacatggatggaactggaggtcactatattaagtgaaataagccaggcacagaaagacaaactttgcatgttctcacttatttgtgggagataaagattaaaacaattgaactcgagatagagtaaaaggatggttaccagaggctgggaagggtagtgggggttgtgagggaagtagagatggttaatggaaacaaaaaaaaaatagaaaaatgattaaaacctggtatttgatagcacaacagggtgactatagtcaatgatttaattatacatttaaaaataactaaaagagagctgggcacagtggctcacagctgtaatttcagcactttgggaggccgagtcatatgactcacttaaggccaggagttcgaggcctgcctggccaacatggtgaaacccccttctctacaaaaaacaggaaaattagctggacttggtggcatacacctgtaatcccagctacttgggtggccgaggcatgagaatcactcgaactcaggaggcggaggttgcagtgagctgagatcgcgccactgcactccagcctgggtaacagagtgagactgtctctaaataaataagacgaaaagagtataatgaggttgtttgtaagacaaggggtaaatgtttgaggtagtagatacccccatttacctctatgtgattattatgtactgtctgtctatgttagaatatctcatggaccccataaacctatacacctactatgtacccacaaaaagcaaaaagaaaaagagcttatgggtatcaatttttctgttagtaacgcttttgttgtgtcccagcaagttttggtacattgtcttctcatctttatttgcatttaagtattttctaatttcccttctgattttttttttttttaatttaagtcccaggacacatgtgcaggacatgcaggtttgttacgtaggtaaatgtgtgccacggtggtttgctgcacctgtcaacccatcacctaggtgttaagccctacatgcattaactatttattctgatgctctctctccctctgcccccctttttctttgattcattggttaagagtatgttgtttcatttccatacatttgttaatttttccattttacttctattattgatttctaagcttatcccattatcgttggagaagatcctttgtatgactggcatctttttgagtactttgagacttaattcgtggcctgatctctcctgggaacatttccacgtgcacttgggatgcacatgcatgctgtggtcatgggtcgagtgttctctgcatgttggttagatctaggtggcttattgtgttaagtcctctattctgtaacttatcttctgcctggttgttctattcattatagagaatgtggtactgaagtctctcaccatcattgtagaactatttctcccttcggttctgtaaatttttcctttgtgtcttttgatcgttagctgttagaggcataaatgtttataatggttatctgtaacatcttcttgcagcctcgaacctttaagtgtgcagcgtcctcttttgtctcttgtgacctttctaggtttattataaaaccatttttggctgatgttagtgtagccactctgctttttgtgtttgccatttgcatggaacctctttctccactctttccaccctttcactttcaatctttttgtgtctttggctctaacgcgagtctctagtagacagcatgtagctggatcatgtttatctattctgccactgccgatatcaccttttgatatacagactttacattttcataaaatttaatttgtccacgtgcttagcccctgtgatccagcaatcccactgctagttatatatccaaaaagaaagaaaatcagtccagcagggacagatgcgcactcctacgtttactgcggcactgttcaccggagcctgtgccttcaatgtcgtattcaagaaatcatcctcaaatccaaagtctttctattttctcctatgtgttcctattgctttaggtcttacatttatacctttgacccatattgagttaattttttatatccagctttattcttttgcatgtagatactcagttatcccaccatcatttgtcgaaaagactatacgtgaactttttgaatttgcttttctcacgtaatagtatttcctagagaccactacatatcagttcgtggggtccttccatattcttttttacagccaccccatactttatggttggatgtgccatgcttattcaaaccctctcctatttatgggcatttaggttgttctgatattgtgcaatgataaataatgttgcaaagtatagccttatacatatgtctattgtattcttgaaacaatgttgcaaagaataacttcgtaggtatggatgttcctattgttggaggtgttatcttcagggtagattcctagaaatgggagtgttgggctgaaagagaagcccgtagttttgttggatgtgaccaaatttccctgcagaacggttgcacatttgcactcccccagcaatgcatgagcataccggttttttctacagttgcgccagcagcgtgctgtcacaccactttttgccaggtccatagctttgttttaatctgtatttctgtaattacattgaatttgaatgttttccctgtgtctaaaagtcatgtgtgtgtgtatttgtaaatcgtctgtcttctcatttccaacttcttccattgggtttttggttcttggtctctcaatttttaagtcatttatattgtgggaacgtttgtctggactaatgtgaattgttttcccagctggtcacttgtctttgactttgcttatggtgctttttgctatgagaaatttcgcatgtttatatcatcaaatttatcatgcttctttctactgactccggattcagggccacagttgagagctttttcctccaccgaggttaaggggaatccactgtgttttcttctggaggtttggggtcttgtcttcagcatttagctccttgtccgtttggagtttgctcttgtgcatgatctaaggtaatcttttctcagagagtggcctgagacctcttccttagaagttcaccccactggctggggccttcacgaggcccctctggcctctaagtggagcatggagtgtggggtcatcgggcaggacacgagatgcgcaggaggctgtgactgaggtggctgtgggatgggacggcgtggtttgctctagagggtttgaaggaagggtgagaagtcaggaccactgctgtagaaaacagggtttgcaggtagataaggtggcgggtgcagcgggaggaagagaaaaggatgctgctgggacccctcgcacctgggaggatgcactttctgtttctgacatgggtcagggttggggcgaaggagtccagctggggacatgttattttggaggtgtttgtgaggcagccaggtgaggtgggttgaaggcagtaagacctgcaggtgggagctctggggagagagtgcgggctgggctcacaagttaggggaggtgtcagtgtgtaaatgacatgagcgcaggggctagacagggcctcctgtagcctgggtgggtggaagggcagagggcaagggccaagtgatggcagctgtggaggctgagggcaaggaaggcaagtccgggaggttgggtgtcctgcagcctccacaggggcaatggaggaagaacaaaggactctgtgttgagccctcctgagaggttttggaactggccttgacttggtgatgtggggttatgagttttattccacacacgtatgtgggagtctgggtcctggtgggtcccagccccgtacatggaggctgggaccctgccctgaaacctctcagacacaaacacccagctcggccccacagagctggcctgggccccagcaggggtctgtgttgccttggccccacggcagtggagctggggtttcccagggatgctgctgctgaaggtgaggtttgcaaacactaggcatgcatgtttgaggtaccacaacctccaccaacccatggtggtcaccaagggtctttgggctcctgtggggaccatactggcttgtctgacttgccgttacccggcggagatatgtcttggaaagactttaggccaggagcccatcattgtcctggaacctgggcttggcagggcaagctttggggagcactgtccagacagtgccctggacactgcacctcaggtcaggacacagctcccgaggcctggctgctctgcatggggaggagtgtgggtcctgagtggagtgtcccatctgtcatgcagagagggtgatgatataaccagctgggtgttcgcacctgagaggtttcggggcagggtcccagcctccatgtacggggctgggacccaccaggacccagactcccagactagcaggtgggcttctcagagcacagagggtgtgggtgacccagatatcctgttgttgctcagagacccccagggaatccttgaagatggcagtgaccacctggcttcctctatagaaactccccgaatgggagggatgggaaagactgttgaactaagctttttaggaagaaagccatcaattcccctgctctcatacaggcttgaggagggctaaggaaagtcacagttgaatgcatgctccctccacacccatgtgcctgatgcacacagcctggcccttgtgggcactggagggcaccctacagtcacagaggcaaacgaagaatgtagagctccagctggatgagggccgtggggaaggggcacagccctgggcaagggtgtgcagagtctgcatgggatttgactgagcaatctggaaggcttcctggaggaggagctattgctcagggtgaaatagaggtcttgaaattagtacaacacatgccccatactggggaatttgggggtccctgggggaaggactctgttaccaaaagcacacagcacaggttgggagagcaactatctcaaggcttttatttgctgtttcatgaaactgaaaatttaagtttttaatatcacatattatttcatgaagagtggcttcggactttggggtagggtctggtaggatcccagggccccttcccttggcatcatcattgtttcccctccatgttcaagttcagcatctctgcaccccttgcctggcaaaccccatcttcctgtccaaagccagacttggctccctttgctccagtgagtggccgttggctgggaggctgggtctgtgctgtgtggggggtgtttggtgtcctaggaggagtctctgtcctgagcagagacagaggaaggcagggcagcctgctcagaggatgagcccagctattctgggaagcaggcaggaagtggcagctccaggtccgggtgtgagggcagtagtgcaggtcgtggtcccagatggccacggaggtgtcagcgtttcactcccagcacgtcacgccacgtccctttcctctgctttgttcctcctcagctgtgaactgtctgggactgggccaggagacagtcctgggatagggaaagaaaagaggggcttccgggggtggggagcggggctgggcggctgctggctgagccaagtggactgggaggtgtggacagggaaccctggcggggccggccaatggtggcgtgatgcagcctggcttgggaaatgcccatggaggtgacaagtgacagccgggaacagacccactgccagggctgcctctctctttagatatgtcctggcatctgactttggtttcctggtgtttaaaggctaattgggatcggtcgtggtgcctcaggcctgtcaatccagtacactgggaggccaaagtgggaggattgcttgagcctaggagttcgagaccagcctgggcaacatagcaagaccccatctctaaaaaaaaaaattaaaatattaatactagctgggtgtgctggcacatacctgtggtcccaactactcgggaggctgaggtaggagcatcacttgagcccaggagttcaaggttgcagcaagctatgatcttgccactgcactccagcctgagtgacagaacgagaccctgtgtctaaaaaaaaaaaatttttaaataaataaataaaggtttgttggacatgttagctcacgcctgcaatctcagcatttggggaggctgaggcaagtggattgcttgaggccaggagtttgagaccagcctgacctgcctgggcaacatggtgaaaccccgtctctactaaaaatacaaaaattagctgggtgtggtggctcacatctgtagtcccagctaccctggaggctgaggtgggaggatcacttgagcccaggagtagaggttgcagtgagctcagattgtgccactgcactccagtctgggtgtcagaaccaggccctttctcaaaggaacaaacaaggctaacatgttgggctttctctgcttctgggcaatgtccgtgaaattgaagccgcactggtgttgttccacccttccttccagctggtctctgaggcccaggccagatgcttctctggttagcagcagattctaggccagagcctgcctccaggtcctgggaaggctggcacgctcagatgcactcctgggcgtggccttcctccgatcacagtgtgagcgaatctccctgcccatcactctgctcccctggcccagaccaggccatgcctcagggcttctgcacgtgcagttttctctgcctgcagggtctgtccctagctctctacccgattcagatcccacaccagctcctggggcagccctcttgccctgcctctccccgagacgtcaccctttctcttttccccattggtggtggttttatgtgttcatttacggtttattttctctctccctgtgtctgttatctgtctctgcacccctggagcccagcgtggtgccaggcacacactacgtgcctcctgggttgggggcagcagggacaaaagccaggcatgggatgtggctcttgtgggatgcaccttgggtgtgactgtcacggaaaaggaggagacgtggggtggggaagggggcagcccctactgttcctggcagcagggccagaattgagagccagaggttgccactggagggcttcctggggaggcagctggcaccgcctgattcctgtttctgaatgccctctcactctcccccacccccatggaaccagaaccacctcgtcaggcccagcagcccttcagggtcagtctctgcatgggtggtaatatggcttacctgagtcctggtcagtctgtggcctgggagtccaccctccatgactagtggtttgtggcaggtgacgggtgagtggtctccatgctcccagccgctgtgtagaggtgccaacctgcccctcctgccagagctgggctcctgttgggcgggactgaggataccgagacagaaataaaactgctaaatgcatctgttgttgaataattcaatgccccatgccaggcctgttgcaaaattagccacttcctccctccaggcccatgagtgactcctggatttggtgaaagccaggcctagtggaattgtggcccggaaggttctctgggagctgggaacctccatgcaggagcccaggggagggggtgcttggccacatgcgggcccctcaatctgccctgtggagcccggcctggcctgcagccccctgtgcagggaaaaacccgcggttttccctggtggagggcacaggtcagagcgggcatggacagggcatgaggaagcagtgcagaggaagcgtgagcatttgtctcgggccagctggagaaaggaaatggggctgcttcctggagggcagagacatcaggggctgcgctgtcgggctcggcgtgcaagatttgtgtctcatcccagggttaggtgcctcccaaatgccagggcttcccatgggccatacacactcagtcgaacaagatttgcacaaaacctgggccataagctcgctgagcacttggcctgcccagccggtgacaatgagaaccgcacatgctcagccttccctggactcagggccctacgggtgctggagccggggcgggagagggccgcaggctgcccctgcctctgcatcctccccgtcgatgcctggggccactgggattggcagaaaagggatgcccccgagatgggcagccaggagaactgtctgtctcctatcccaatatgcctacctccctctctgaatccccatttccccctcatccttgcccccacacacccagatttgcaatgggacacacggccacctgggatgacaacccctcccagtcttccctcaagacaagtgtggccatgaccgcatggggccagcagggtgtgagttgaagtgtcccgcagtggcttccggggatgtgcagccctgccctgaggccctctggccgcctcttgctctctgagcagggatgtccgtgccttgggcctgaggctgagctgggctaggtccctgggtgtctggggccacactctctggtccagcctgctgttacaggggatgcctcagggccaccactggtcatggaggctgggggcgcctgcctgtctgcccgcctggagttcaggtaaacaaccccactgaggaggcacccctagccgtgggagttggcgtgtcctgctccccagggcggtctgtccccttggcgagatccttgctgtgtcagcagagggttttcctggcccagggtcttggggagcagatgatggggctttaggagctctggctctgggaaggcagtggaccctggagcagggatcttgggaggatggagagttggcggctcaggaaggaggctgctcaagccccggcctgctcactgggaagagcggtccttggaggagagagctcccgaggagaaagccatgatgctgtgctgcgctctgggccaccaggtcttgtctggggggaatcctgaccctgtgtgatgtgagtgcagggactcccccaccctccgaccaggacctttgtactctcctggccgtgtcattgcacaactccaggggccgtcactcacctgagccctctttgctcttcttggctgttccctgatatggccacgcagagactatctctaagtgtcagttctggactcagctggaaaggtttcatgacctcaagggacccatgggacttgagggtggggcagctgtttgccctgtggatcaaaggggagtgtctgggatgggatccacctgccctgccctcaaagtgctgggcagtccctcagagccatagagcctagggggtcttgggccctcttccccagggcatggcccaggcacctgctggcctgaggtccctgctgggcccaaggcatccctgccgtgttcagagttccacaggcaccagtccaccatgctggggcctactgggagagacagccacccgcctgctgtcgggagcctccatcaccagagcctgggggtgtcccagccaccctggccgctgtttctctgcctccgcaccggcctctctcctgagttccatccatccctgcaggttgggttctcctctctcctctgggatctgcacaggttgccattctctctgcctagactgggcctccacctctgagaagccctcccttattgccccttccagtgggctgggagagggaggaaggccaggtgcagaaagagaattcacctgcccggctaaagccccacctgcctatttcaaggcctctgatgccccccggcctgcaaggtgtgtgcatggggcctgtcccatgctggctcacccagctgctcagagaggcaagtggctcccgggccccacagtgacactgggggactctttgtctccatttggggggtgtgcaggtcactcctggtgccctggtcagcttccccaacctgagctgccctcagctcctggcttggccctccacggagtgggagatgcccccctcccctgccattatcgtaccttacctcgctggcggccatggaggcagtgagaagagccgagggagctggccggggcgcatttccgtgcaggacactggctgcctcccagctcactcttagcctggtcatagagcccggcagcatcttgccaggtgcctgtggtcccagatcctggggctgccccatctctggaatattgaggtgtggctggggctgatctgaggatgaatgtggctcaggttgccgggtgcccttgacgcattcccatgtcccagtggggaaaccaaggctcaaggaggccacacagcagctccatttccagggacacccagtgttctctgtagtgggtaggaggtttccctatacaggagaccaagctacagcaagaaagacttggccgggcgaggtggctcatgggcgcggtggctcacgcctgtaatcccagcactttgggaggccaaggggatcacgaggtcaggagatcaaggccatcctggctaacactgtgaaaccccatctctactaaaaatacaaaaaattagcccggcgtggtggcgggcgcctgtagtcccagctactcgggaggctgaggcaggagaatggcatgaacccgggaggcagagcttgcagtgagccgagattgcgccactgcactccagcctgggcgacagagccagactccgtctcgaaaagagacttgggctagatgtgaggagggactttcccaagtagggatgaaccctgaggacccacaccctgagccgccagtgggtcgtgttgacctggcagctccagggcacctgaggccttcgctgtccttccgcacctcgcccccttcccgagtggaggtgctctgggagctctgcctgcttcctcaagtctttcttgtttttttatgttattttattttagatttgaggagtacacatacttgtctgttacgtgcgtaatggtggggtttgggcttctcgtgcgcccatcagccggatattggacgttatactcaataggtaatttttcaaccctccccctctcaccctctccacctcccctttggagtcccagagtgacctttctccgtctttctgtccaagcatcccatctgtctagcttccactcatgagtgagaacgtgccgtgtttggttttctgtttccggtagttcacttaggatcatggtctccagatccatccgtgttgctgcaaaggacatgatttcattcacttcttggaggctttaacgcctgccctgtgtgagggagggcggagcccctggcccaggggcggggaggcctgtccacccctcccacccgtccccgaggcccctgctgcccagcaagaccaccaccctctgctccaggacagcgcagccgccatcagtgggggtgaggggacaaggctgctgggaccaggcctcgcccaggcagagcctcgccatttctggggtggggggtgcacaggtgcatctggtctgcccagcccctcctcaccctaggcaggcctctcacagagacaagacgagtgtcctagggcagatagggccacatccatggggtcacttcagtttgtcctcccggcgccttctaaatatactctctgtgggtgtcttatcacagcccagggagccaggcttggtgtggccggccctgggagcacagagccccgttcccagcagccctcggccctggggggcttgtgctctgccgggccacctgcaccctccgggccccaggagaagctcatgcctttcctgcttgcaccccagagcctggccacccctgtcctctgctgaggccctgaccacctctatgtgtgccatggctgcagtgacagcccagaccccaggggccgggcatcccacagctctcctcactgagcccctgggcctatccgcccacgcccaggccagggctcctgctggaatctccctgtggaaggccaggctgcctggatgcccaccactccaggcttacttctgggttgtagttttcggggtgcttcgaggtgctgtggggacctgtgatgctgtcagggagacccggagtccagttctcgccaaccgctcgatgctgtgtgacttgaggcaggtcccttaacctctctgagcttcctcctctcctgtgaacaaaggatgggtccacttctcaggcttctcatgaagtttagaggcgacaggaggaggtgggctttaaatggctcagtcccagcgtcccctcatgcctgggaccgctgacccaccgggattcttgggggccaccatagagcctgtttttaaaggggatgtggcggccagctctgggggcacacgttcctgtttgaattctcaatctccgggctcaaaattggcccccagaaagcctttgagatggacagggagctggaccttcccaattcggttgcccttgcttgatgtttacatgccactgttgggtgctcctgattgtgtagcgggtcccctgaaaccaacacacaggtgcagacacccacatgccatcctgccagagccctgggttctcagcaggactctttgccgggatcctcatgctacggccaccacctgattttgtcgataaagttttattaggacacagccatgcccggccgaatattgccacagaggccacctgccccaccacgcctaggacatttcctctctggcccagaggtgtgccagggctgcactgggctcttctggtggggagggacattgttctggcccctcctgatctctcccccaccttgccacgaccccccagagtttgcctggtgtcaccgggaagcttcctggctgcccgagggtcccccagcacctgtccctctagggcctctgaagggctttgacgtgacactcgggatggcatggcagggccctcaagcacggctgtgttcaccccccaggctgctcctggaaaggagggatcagggcccaggctccacgctccgcactgaggtgtggtcgagggccctgggcgtccgggtgagatgggaatgagcccttggtaggtgccaggcggggccagccctcatccccactgcaaggcctgagcgtccaggagccccgtgcgcagctggacccatcagtccccaccctgcagggccgttgaagagggaatgcacacctgtcacctcttggtgcgggggcatccaggttcctggcgatggggatggggtgagatgcacctgatggacctccaggtgggaagctcctgggacaccctggagggctctggtgggagacatggcattctgtctgcaccgaagggggctcagggctgagaagccctgggacgggttggatttggggcgcgttccccagggccccacgcgtgttgagtccccgctgcgtcactgtctggcctgtggcgcctcacctctctgtctggcaggactcaggcagaatggaagtaaaggcaggaccttgtcccaggacatccaggcatgtggcgtggcaaccaggtgggatggcagggtttccccctggcaggatccccacctcctgcacctgtcctgacttggtcttctggggcagcccctaagacgcttcttcagggaagagggaccggtttggccagtgggaccatggccctgggagcatatgcctgcacgtcctgcccgctcacacctgcctgctgggggggccatgcctgcgcccgcagctcacgtcagagcccaccccaggaggctcccagcgatctgtcaacctgtgctgttggcatgcagcctgggggtgaggggtggcggaacgctgcctcagtaccacgtcctgctcaaaggccacttgcgagctaggctgagcctgtggtgtgcggtgggataggaaggaaaagaacagagtctaaggagcctaactcacttccagattcacccggaggcctgcatggaggaggcggcactgagacttcattcaccgagcttgagggtttaccctaacattcattcacaccatcagtcattcagcaaacacttcacaaacgtgcatcccacgcctggcactgggccttcggagggagggaatgcagctggtgggcccctgcctggggagcccctgctctggtcggggaggcagtggtggcagtggctgcctggcggtccatgaactggtgcaagccagagccggaggcctcctgagagcctggcagggaagcccaggccagggcctccgcagaaggagggtttggggtccaggcttcatgtggggggtcttgtaacatgggagggtagacgctgccttgggacaggagagacagaggcggggggaccaggggagtgggctgcagttggggtgcaggcctggtggccccggcagggggaccagcctctggggaggtgctgcaggcacaggagttctgtgtggacccagccgaaagctggcaggaagggacctgtttcttggggttcccagtccagatctgtgttggaaaaagtgtcagctgaaaccccaagaggctggggacagccttggtcctgctgtgggacacaggtttaatctccagatggctcctggataggcgggctggcggctctgtctaacggggacagcacacttggggcttcgggagacaatgagggcagaaatcttacccaccggccacaccaagtcacccattgttgtgtcccttgggctgggatcccatggctttcaagaactttttaaagaaatgagactcagctgccgcggaacaagccacaggtaaagagtataagacagcgtgaggcatggggtggccacgggagccctgggccaaggaggcccagtctggtggggaggcgtccattcacccggagctggacggggaggaccaggctgtgggtctgtgaagcgggtgtgggatcacatccacgctccttctgtggtttgtgccctgttgtggctgccaggggaggggcttccaaggccctgccaaccagctgggcagtgtggacaatggcagacagggtgctgtgtgggggcctgaggggcaatggttggggggcagctgttgccgttctggtgagaagtggcggtccctgaagggctggggtgctagggagcctcatggacctactcccgacgtggcagctgcctgctgcagatgggccagccatgtcccgcctgtgccgggaatcaccacccccagctcccttctctccaacatgacagggttcgggtgatgccctgtgggctgaatggtgagagaggcgtccctgtgctgacaccagtgggcgtggacgtgaccctctttttaaaagaattttttcagatgcaattccattaaggatctggaggtgagaggatgaaaaggaaactctgagctttgagtacatttttaattatgttttaaaaattaagacatgaggccgggcatggtggcttacgcctgtaatcccagcactttgggagactgagttgggaggatcgcttgagcccaggaaatcgaggctgcagtgagccaggatcataccactgtcctccagcctgggtgacagaacaagactctgtctcaaaaacaaaacaaaacaaaacaaaaaaccaaaaaacaacaacaactaatatatgtttttgaccaatacctaattctgttgtttaagaattcaaaatctaccaatagtgatcataagtaatgtattaaatacttacatagtacagcaggtgttggcccccccccacaacattggtttccatccctggaagctgcaaatgtgacctgacatagaaaacacccctttgcagctgaggctgagggtcccgagaggcgtgattgcattatccagggggcccaagtccagtgacacgtgtcctcctaaaagacaggacagattcaacaaaggaggatccggccacatgctgcacagcacgggagtgatgccgccacccacccaggacgcgggagcccgcagaggctggaaggctgaaaagggccctgtcgcccccaccccccaggatgacgtatggcctgatgtggcattcctgcctcaggaccatggcaccaagtggtggcgctggggcccctggagtcggccagtctgggcacgtcccatgctgtgtctgagcctcagtgtccccatcgattggtagtgcctcctgaaccccaatccagggggcttctggggggcagcctgggaccagacgtgcctcaccagggcttctgtctcctcaccaggacttccatgatgtgacaccttccacatggggttcagagcggggaacctgtgcctagtgtccagcccagcgtggggccctcggtgtgggccagggctcacccctttgggaggggtcgggagatgcctggcccaggctccatccatgcagagccaggaagcaggtgaacctgtggggaccttggcgacctccaaaccctgctgaggctgcctgctgacagccactggtgaggggggtgacagccactggtgaggggggtgaccagctggtagctttttctgaggtgcagattcagccctggggaacagccctggcaggctgtgagacctctgcccctgggcgtccacatcccagggctctgagctcagcagccctggagccggcagccacatcagggatggagggagacctgctggtgaccagtgagtgagcaggggaagcctgtcctctccagcgcccagtgtttccttcctggggcacatgggatttggaggcatttggagtctcccaggatgacttttttttttaagcccctagaagtggtttggggtttaagcgtcaatatttaatctcttgaagttacacattcaaggccctatcctgccttcggctttaggttcgcttcacaaacccattgtctgcttatcagcctggcgaggtcccgtccccagtaggggtctttgaacattgctcgatctcattcaccagccacggggaacattttgaaccctctgatgcttgctctatgaatgttgtttgctttaaaaaaagttttttttttattgtgataaaatacacataacacacaatttaccgtcttaactctgtgtcaggtcacggcccagtggcaataggtacatttacatggttgtgcaaccgtcaccaccatccaccccaaaacttctctcccaaactgaaattctgcacccatgaaatcccactccctctccccggccccgccatcctgctctccgcaaccgtggatccgtcctccccatgtccacagatcccctctccctcggccccgctgtccgcttccctgcgacggtggatttcgctgctctgggcctttgcgcttctgtgactggcactgtgtgttatccggtgtcctcaaggtgcctctctgctcatgtccttccatgcatgatgctttcagactgacaaaactcttcaagtattaacgtaatttttaatgtttacagattcaagaaattaagcatacggtcacgagagtgcaaagttctgtgaaacgctccagtggttacacgccccggggtttcagcttcgaccctgggtgagttccatggtgcagtggcttccagctggagttctaagggcaccccttgagctgcccacgtgtctttgcacgtgaagtaggtggctctctttaaggttcctcaactttattgggaaacatctcagggttacaaaacgccccccatgggctaaagaggctgtcactcactgtgtgtggggcctgtccccgagtgggcatggaaggccagagtcccggcacagcccccacccggactggatttgcttggcgggtcacctggatcaaccaggcccatttaggagcaccactcaggggccctagtgtgtgcggcagggcaggtcatggagtctccagccttcagctcgcgttagccccaggccatctgagccgtggagcccacccaggcccgctgcctgcaccccgggggagccctcccacagcgtctcgggctatgaccctggcagggttcctgcattctcctgtgttcccgggcacccggggctgagatgttgaaatgatgtcggataattcaccgggtgccttcggggctggtactcgccgtcactgctcctgaggcctatttgctgtcaaggggaacaagtaggaggttgttttctggggtgcggtgggctccccgctcatgcagctccccgccccccgcatgaccacgccctcttgggagctcgggtgggacagcattcaggggaccacatgagctgggggggggtcggtgtcttctctcccccaccccttcgctagcctgtcctgcttcccactccgagtccaaaacacgcataggattcgtcctctcccagggccttagtttcccggctctgcagagtggggggctgtgactgcctggccttggagctgaggcagagggggtggtaggtggccctgcagaggcaggaggggacacaggcaccccaggccctgagtgcctcaagggcagggaccccagctcggcacctgtgaggttcccagctccgcccgagacaagaatagataaagcggtaaataagataaaactctttttatctggagtagataaaagtaagctttgtcatataattccttctgaggctagcacggtatatcaaaatatcggaagaatcatttagccttcagaatatggcaaggctgacagccagcctggcccatgggcacctgtccccaccatctgcctggcctgcgggggaacgttcctcagcccctgctggctcccaacccccgggcctggagccctgtcttctgcctcagccgcgattccactgcacgggactttcccaggcacctctgcccaggtagttggggtggacgcccacttgggtgcacactctgtgggggctggtccaggaccacccatgtgcagtcttccctggccacatcctgtattctcccgcaacgcccagtcaagaatcttcctgctgcagtaactccacatatctgagccagctgtgtctcctgagcacaggacatgggcaggagaggcccctgcagctggaatccgcgccatgaagcccaggcgcgtggtatttgcagccagtcaccaagttttcaagccctcacctgcggcctgtgagtgcccaccctgcacatggtgctaaccagcatccatcactgctttcttttttaatttaatttaatttttttttttttgtggtggagtcttgctctgtcacccaggctggagtgcagtggcgcgatctcggctcactgcaacctccacctccctggttcaagcaatccccctgcctcaatctcctgagtggctgggattacaggagcacaccaccacccacgcccagttaattttttcatatttttagtagagacggggtttcaccatgttggccagactggtctcgaactcctgtcctcaggcaatcctcccgcctcggcctcccaaagtgctgggattgcaggtgtgagccgccgcgcccggccccaccactgctttctatgctgtggccgaggtcaccaactgccactgtgatggacggctgtcacccaaacagcacgagaatcgaaaagccgtgatggcagatgcagaaggcagcgtcgcctgtggtcttttagaagggcagctgtgaagtggggttatctcagcttccacattgcatcacggtgcccctgtgaagggcagaggagctgcaggtaattctgttcgctcgcctctgccttggaggaagtttacagttttttttttttttttttttgaaagtttaaagctttcaacctgggcctggaggctgcagggtcagcagacctgggtcctgcccatggcccccttccctcctcaggcctccatttgctcatctgagagtggggggagtgcagcgccttccgtgcaggtcactgagaggctggggcagtggcgtggattcgggtgcatgactcgcagacatggctgtcgcttggctgaacggtggcccctgaggtgtctgtgtccttgtcctgtgaacaagttaggttgtgtggccaaaggggctttgcagggtgactgagggatggctcgtgagaggggaggttgtcctgggttacccgggtgagccctcactgtgattgtgaggattcttctaagagaagcaggaggatctgagttggaggaagagacgggaggatggaagccaggctcggcgacgggaaagctgctgtgccaccctcaccgcagccctatccctgctcacgtgcaccaagaccagagcctggcaagtcgtctcataccgagggtcaaaggggcccagggcccagcctccagggaccccagccatgccgggtcagggaaccaggctgcagtcctgtgtctcctcctcagtttaccccaattgtgacctcagaagcccttggagcctcagtttccctacttgtagcatgtgtttgatgatagtgtggcagtgatgtcacagtctggcagggtctcgtgggggtctgtgttactgtctgcaaagcactggctgggccagtggtcagtgagcaggggcgtgggtagcgggcagtggcctgcagtccccaggagcacttcctgttgctgaacagacagcaacttagtggatccttcccagggcccctggtgggtggtgggttttgccacatctttgcagtagacagcactggcagcttccggcttatccaaggcctcagggtgaagtcgacgctcgctgctgattccctgctggacgtcaggtgacacttccctccacagcctgggaagaagcacctgtgggccacttctttgtgttgataaggaaactgaggcaggggagctgcctgggtcaccagtgggcactgcatctccatgtgcagatggtgccctggccctctctgcacgccgtgggcctggggagcaggcaggtggcatcttctgccccgggcagcccggctctgcttcctcgtggctgagccaggctgtgtctaatctcacttccctgctcactgcaaatcaaaacaaacagacgtccaggaggattaagtgtggcagtcatggcggagggagccctggtagggtggagagagccaacagttgcaccagcaaggggcagagacccagcccagccctgggggctgcagggtgtggggacagggcctgcagcttggcacaaagactcttctaagaacctggagggaaccctgctccggcagtgggcagcatgctgtgtgcaaggtgagccagtctgagcccattcccagtgcccggaatggtgcccagtgcagatgggcactcacccttccaaccaacctttgcttgtgtccccgtgagatccacagattcaccctacggagggctccccacagggttggcccggaggctccagctgtgtctgttgaacaaattactctgcatccaccgcgtgctagcgctgtgcggattatagtcccagagacagatgagagcaggggtggtcagtgtaggagcacccagagggagcctggcagggcctggacatcctgtccaagctggccaggaggagtcctcagagccaaagcagtgtggagggtgggggtgcagagagcgtccctggctggaagcaccgcgtttgcaaatgccaggcagcttatgcagccagcgctttgggcaggcgggagtcagggggactgaggcccaaggaggggtagggctgcatgccagccttccaggtgctcctgggaaccacgtggctgatcagacttgtgctttgggtcgaatgtcccagtgggggagtaacctcagggagcagaggaagggtcatggtggtggggatgaagcagcagcattggggcttagagattaaatgaaggaagtcccacggggctgatcacctactgtgcaccaggctgcgtcccgggcatggactgcagcccacagccccactcttggggtgctcatggtctagggggtggacaacagactctggtcccagcgatgatgcttgagtataaaggacacagttggggtgttgtgggggccagggtcagacatcagagctggcctctgcctatgagacagggcccgctggcaggaccctcaagctgggcttttaggctgggcagcagcaggtgcacgggccctgaggtgggccgggctgggcacagtcaggactggcaacaagggccgggaggagctggggtgatctggggccatcgtggtgtaaatactggggcacgacatggagggttcactgactggctgggtgtgtgggctgggggcgccgagggtggaggtgggcactgtggtcagggggagatgaggatggatgggcagggtgcagacaggggctggctgggttcggctctgcaggtagagctgaccggtgtggcagggacagggtgtcggtgaggcaggtggctgaggaaatggtagctgcaggttttggccccagtcccagcagcgggactatggctgtggggagggaggaacccagggagggggcctgagcagggtctttggctgagtgagccctcaagggcctttgggtagggctaccagaggccaggaaaggattgtcctgtccacaggagcttggggaagggggtggggggccagagccccaccttccccagaaacctccgtgcagcaggaggatgagccgaggcaggctgtgctgggaggtagcctgtttgttgtgggctctgggggcctggggagggtgggctgggctgtccacatctggacaggtggaagaggatgggttctgggtggggctgacttcaggaggctggatgagaggcaatgcagggggccttctggctgtcctggggtgggttagaagccactcaggatggcaggatctcagggagcggagggagcctggggcaccctatgccaggcagaggatctatgccggggcccccagggtctgtgtgtggctttctctgtttgtgtctcccctggccctgggggccatgtggccatctcctggctctccggtcgctgaggatccacgggggtccctggagtctccggagcccgtgggaatccccctagaggcgggaggaaggccgggcgggccctggagggtacgtttgcagtggcagcagctccctatctttatggttccggcgatcagagaaggcggcccgtcttttctctgcgggcccacaggcccagaacgttggccccagggtggggctctgtgcgccttccctttcatgagttctgtggctcggcctcggggccttggaaaggaggaagtgaaactggaggagagcggcccacagcctgccgcctggaggctcctctgggaagcagacgcttggtgcaggtgtcaggacccccacctggcgggctggcttctgtgctgtgaccaccaacacccctgccctgggccctgaactcctggacagggggcgttgactgctctctggaagtgatttgtaaaatcagctttgtagagacgtaattacacactgcagttcatttgtggctctagggccctaagtggctctagaatgttcagagttgtgtagccaccaccaccatccacatccagaacgtttaattaccccaaaagaaaaccccacgcccacagcagtcccgccctggggcagccaccagcctgctttctgtttctgtggctctggctgtccagggcgtagccacactgcaggtggtcagcaggtggtcacctgtctgtgtctggccttggcgccatgtttctcggacccatccacgtggcagcatgtgttggtgcttcgtcccttcccgtggcgggacggcatccctcgtgcggacctacctctagtgtgtgcttaccagctaatggatgactgggttttcgaagcactgtctgttcctacctgggggcggggctgaggccaggggcccctccactccccaggtgcatctgtgggatgggcagaggccgtgatgctgactgccgtgtccctgtcttgcagcttcctcatcgtcctggtctgcctcatcttcagcgtgctgtccaccatcgagcagtatgccgccctggccacggggactctcttctggatggtacgtagcatctgagggcatggctggatgtcatggctgccttggaagctggcatctccctggcgctgggccccataaggtggggggcagagccactcccagccccttgcccacacattggtcctgccctgatacagggggcacctccccagcccccacacttgccaagtgacttgggatgtatgtgccacaggcgagggggaccaaggactgaggggaacctggagctggtggtctgaaagggcttcctggaggaggggcttccaggctgggctggaaggaaggaaggaggaggtagggtagagctggtgtggccagcaaaggcctgcccgagccttcgtgtccctggggtctgggtgactctgttcctgggttatggctggcacacaggccctgctggtgtcccagcagcagcccccaccccaggcacctggatggtcccttccattggcctgagcggtgtctgtgccatttctgccaggcaggtgctgagagcagggcagggcaggctcatagcctggtgggaaaccccaaagttgatctggccgtgaggctgcctggaaggtggggtgcagggggccagctgtgtctggagcccacggggtccccacggaagccacctgaatgtgggccgtgagcagcaggactctggcaggactgggtctagcacctctccgtggccaggcttttgtgttttcctgtcttgtcgtggaatagttctagtatctacaaaggaagagagtgtcacgactcagctcccggcatgcacaggcagatctgggctggtttcatgctgctttctggcactgtgtcttcctggccaggggagcccgtccctccggggtccagagtcctctcgcgatggcctcggcagtggtatccgtctcatttctagggagtccgttttacctttcctttgttgcttctggaccttgagccatagctggaagaactcacctgtggtttcctccagccctgaccaggttaactgtgtgtgctccatggtggctgggagtttcctgggtaagtggtgtgaggcacaggcctgctgtcactcttccctcgtcttcccagttctcccagcactatgttttccacagtccatctgtcctgcctgactggaggggccgtcttctctgtaaaccagacgtccagaggcagtaggaagggtctgctttggggtttttctattctgtcccactggtctcctggacttttcctttaccagggccctactgacttggtggtcccggtactaaaatcaatttcatgatgtcactttgtgcctcggcagggctttctttttcgggggtttcctggtggcgcttgcagccttgcttttcccagtgaacgttgccatcaccttatccagccccgggaagaaactcgaaggccgcgggtgaataaactgggggagactgacatctcggtggtctccaggagcatggtgtgtgtgtttatgggcagcattttatggtttcattatgtagattgcaggcagtttaagtctattcctcatcataataatattgagagaataagttgttattgttgccatcacatagggagtttctagtctatcatgttttccaggcactttcctggcgtctgcgaaagctgttaatttctgctacagcctgtggtcctgctacttctcgtgactgtggtcgtagaagtttttccctctgtcctttgcatcttttgcgtttccagataagggatgccttccaggagggcagattgctgcttgggtctgtccagagctgggggtggtacctgcggccagcggggccctcctggcttctgtgggcgggccggctgccaggcggggggtgcgcacctcccgtgctcaggaagggtccttcaggtccgatgcctggcgtggttttacggtgaccatgtggattctggtcaggggtctttcctgcttctgtgaggtgctcctgtcagtgaggggccccccttgccttcctggaataaacccccttggtcctggcgtgtgagtttcatgtcctatcacattgtactctcatgctttgttcagacttttgcactgccctgtgaagtggggtgtgtgtgtcatcttgtggtgccatcttggttggggtgaggccgtccttcccccacagggcgatgtccaatacccttggcagcatgggcctcatgttttatggggtccccaaggtacctgcccaggatccccaagtcctcctcacccaccacagacctggctctcagatgagcacccagccaagtctctggccatgtctagcaggaggatgttctgccccggccaactgacagggttggctcaactgcaggagtgggcacggcatgtcctttgctggttctgccatggggcgggtctgtggggggtccctgacctggtagttgtccctggagggcctggggccaaggatgccagtggttcccaggctgtgagagccgcgctgccaaacattcccctggagagtctccgtgtgaggccctttgtacctctgcaggtgtgtgtacatgtgtgtatgtgagtgcccacatgcacgggaatgtgtacacgcatgtgcgtgtttatgggtgagctgtgtgcttaagtgtgcatctgtatctgagtattatgtaagtgtgcatacacatgagcacgtggggactttcacgcatgtttggctctgtttcaatgtgtgtacatgtgtgcacatgtgtatctgagcgtgtacatgtgtgaatgtggccacatataggcacattgtagtgtgcgcctgtgagcatgtattgtatgtttatgcatggctgtgttgtgtgtatttatgtatagctatgtgtcgctgcgtgtgtgtacctatgtgtatgtacgtgtgttcatgcctgtgctgtgtgtgagacgtgagatcctgcctgtcccatccctcacgtactaacctggatctaggtggttagcccctcgcccccaggtggcctgggacttgcctggttttaaatggagccccggtgctaacgtgagcccacccaggtgctcctgcccagccagggctgtctgtcagcaccacagcgtccaagttcaggtcctcacttcctaggtggttatctcccaggcagctgggagggcgaagcctggagaagcctgcacccaggctggacctgcagggaccttcagacgtgccctgggctccacatgcccgtctgcagctcgagaattagacgtgccctgggctccacatgcccgtctgcagctcgagaattagacgtgccctgggctccacatgcccgtctgcagctcgagaattagacgtgccctgggcttcatgtgcccgtctgcagccctagaatcaccagcagcaccccaaggcccccatgcggcatctaaaccaggcaggggacaggggcatggagcagaccaggtagggttgctccctaggatgcagccctgcccaggcaggagggcagaccctacacagtgctgagctgtgcccccagggaagcctccaagatggtcctcatcccagcagccctgcccactgtctgcgcatccctggggtctgtgcgccacctggtggctatttgctgaactgtggccacaaacccctggtcagcaggaaccggccctttcactgccctgcagctccctctcctccggggtggcatggcagagaagcagcccgtggccccaagcatagagccccctttctgctgtagtcccccttgcagtcccctctgccttttccactgcttggaaggcagagagaccctggccgcctcccttgtccctttatctgtcatgccagctgcctccctgccacaccttgcgtctcaccaggcaaccctgcaaacagcagctggggaggactttctaagacaaaaacctgatcattccagaagctccctgtgacgtttaggctacattccccaaggtggtgccacgttcaggcccatcacctgtaacactacccaccccacctcacccagcctgggctcactcactccaggccaagccttggacattcctggctgccccagggcctttgcaagccctcttctctggacctggctgtcctcgggagtgtcagcactcagcctcttgtcaggtttcaggcctctgcttggcactatcctgcacaccatccccgccgacctgccctgttctgggttcatggggctctgggaggctcacaagcatctgtctgcctcaggccattccacactccctgagggtgggaccccgtggctgcgctaaccccacaagctctgcatggcgcttcctggccgtgcatgtccctccctgcatcaaatgcataggccagagttgcccagcgaggatgacccagcttggtatgtgctcccggcttcagctgcccctgcgtgatggagacaccctcccactcgccttgccacacttcccagcagtctctcgaagcactggccgcgtggaaacaaatccttcaaggggatttgagggtccagctgtcactcagtcatggccatggtgggggcacgttggggacacagcagagagtgaggcagccgtgggcctggccttgacaggcggatgtacagacacatcagggccgagactgaggcgtgggctctgggtggggagacagtgaccacttgcttggaggagggggcgctcaggtgggaggggcacagtgagaaggaggtaagctggtgctggcggggcaggcagggacccctcccagggctcacagcttccagcggacagcaggcacagggctgtggggatcagagcacaggcagaagtcacctgacagcaggttcccgaggcttcaggcctggaggagtgaggacggctgttgggttcttgattccagcagagggaggctgtgcagggttgcaggaaggacggttgggggcgcttcggggaggtacgagaagcaaaggtgtttgcagcccttggggccaggcggcgggaaggcctgtagacgccagagggcgctcgtgctacatgcaactcaggagctgctggcacccgccaaggagtgctgagcgcggggagcccaaaccacagccttggggaacccaggaggggccgggcgggtgcaggacccgcatgagggattccgagagcacgatgtttaaatgttgggggaaaaaatggatcaaagcgatgtgttcccagggagcccctgttttctcgtttcttttcgtacgcccagctttgcagtgccagaaagctgttatctcagcactgctaaggaaaccccagcgcggcctcggagggattaggcattctgctgaaccagggatatgcggtgggcctgaaaaagccatttcgggaggaatctggtctcggctggggtccggccggcaccgtgaacaccacgtgaacaccacgtcggaaatctgctgggcagggagatttcctcaaggcctcccagggaggagagccacttcctgggctgcaaagagggccccaacctggcttctgaattcagagggggctgtgtgtgcacgtgtgtacgtacgtgcatgtgcacgtctgtgtacccatgtctgtggaagtggcacacgtgtgcatgtgtgcactcagtgtacgtgtgcgtgcctgtgggtagctccgtgcgcacatgcgtacacatatgcctggtgtgtgtgtgcacacgtgtgtctgacgtgtgtgtgctttgcgtgttcttgcctgggaaggagttcccggtttgggtggctctcctgtttcttgccgaagccagctgctgctagaaactggccccctgctctctgcagtaagagaccctgccctggcccaggtgagggcctggcttttgtctccaggatcacagcttttgtcaaactccacacaaagagagaggcactcaaaagcacaacacaaacacggctagtccgcgcctttggtggtgaacataccagggaattgtcctgcaatgcctgtggttaaaaaaccccgtgagctgcggccccggaggcctaggggatgaggtcatcgctgcggcttcctcccctctgctgaggctccctccgccccgcccggtggcccacccctcccgccagctgcagcctccactgcctgggtttctgctgcgccttcagcacacagcgaggcctcagtttccctcccagctcagagcaaggcctcagtttccctcccagcagcaaagtgagaccctgtagggagtctctgggcctccgtgacggccctgggcggccctctctgtggaacaaggtcgggtcctgtcctcagcgccctggcctccacttgctcagggcgcccgcaggcccgcaggtcctcacctggtgtttttcacctgggacccgcagctgctctgatgaggagcctgctctgcgcacggcctggggcggtttcccgcagcaccatttctgccgctgccgggaaaagacgcagagcaaaggcacctttgcccaggttggggaaccagtgggtgactcaggattttcctccacccaccccgaggtctgactccctctgcagctgccgcccgctgagggttgtcttcctccctgcctgcctcgccctgcctggtgagctcctatgggtctgacgaagccccgtcctgcacacttgcttcgggggcaactccccactagactggttgcccagggacgggggtacccactccctcctcagggctgcagggtgctctgggaagagttgtgtccctctgtgggcctgtgggctcacttgcctttttgtccctgtcacttgggagctacccagctaagaccggtccccaccacccaggccactctgaggcttcagaacgcggtcgtcttctccctggcagggttgtttccgcctgcatttgttcagccagcaaatctttattaagcacctactgtgtgccaggatctatgtgcaagcagcccatgggctcatgaaaggcagagctggactgagattccgcacccctgggatcctcactgcagggccctgtgtatgtgcgggctggagccctggttcctgtctgcactgagcccctggagctaggcccagaggacttgacagatgtgggccctctgtctgcacagcccccagggcacggggtggcctgcagctctgcccagccagacttcaggtcactgccccatgagcctgtaggagaaacttctcactcatctgtcctgagacctgcctggagcccaccccagggagacagaggctctcggagcctgttcagggtgaaaggacgctagacactggcctgcaggctttgggcgggtaagggtagcgaaggtgaaagtggaccaggggcaggtggagcagggtaggcccaagtgtctgtctggggcagctggggacacccaggtgggctgaacttcagctgccacccagcttcagctgccaaggctcctcccgggtcagggtcgacccctgatgtcccggcaagagttccaagaacaaaggctcagaatccaccaagcggaacttgaagccactgccctgtggggacaggagaagtgacttggccggctctccggagcccagtgttgatcactgaggaccaccggatacaagtccctcctgccttcccctttagtgacactgaagctgttgaaatccccatccaccaggagctcctggtcctggggagccctgtgcaacccactcactgcctttcagagccctgtggcgtctctctcatgcgctggccgtagagcttcctgaaagcatctctatcacccactctgcacctgagagagggcggtcaggtgactggtaccccctgaagacctgggaccaggccccctgcctctgggaatccatcaaaatgctcccttctgaggccgctttgctgggcgtaggatcagccttgctttgagggctgtttaggagaggaaccccggcgctgctgctccccggaggcagccagtgcttgtgatgggcaccctgcctccagtgttctgcttcagggtgtgggatgcacagctgggggcaggggcgctgctgaagccacagtctcagagcctgaggcccacggggcatggcatgaagacccggtggttctgttcccccgggacagccttggtccagcctcactggccacatgctctgccgagcacacccgctgctgtccccagccacccagccccatgcacaggccacgcggcgacaggggctgctgaaggaaggctggtccgctccctgcctgtgacaggagctcaggctcagggcagcaggggcgctcagctgggccgcggctccacggtgttaagggattctagaaatttcctgctgtgccaggctgcagcagagactccggccccaccaggcttcctgtacttggtgataaacacaccatccgcactgcctgcggctcttacaggagtctctcgtgcaccattgctcaacccccgagagttatggaaggaagggaggctggggtgggtgccccgagtgccttgttggagtggaggctggcgctgccctgccccacagggtggctggcagggctcagcagttgcctggcctgtgggggcagaggacctggggagacatgctgagccctcccagcgagacactgagggtcgggagggtaacatgtgattttgaggccacccgctacagcttcttgggacctccctctctcaggcgggtctggaacccaacagagctggtttgggccacagcagtggcttcccaggctgggcttcaaaaccggacacagggcgtggctctccctcccagcctgccagagggaccgctgggcctatctccagccacgtgggtcgcgagagtcgacctgggctgcgtgatgggggaccccaggctgggcggcttaaaccgtggaggtcgccctctcacagctctggacgatggagggccgagacccaggtgtgggcagggctggttcttctgaggcccctcccggcttctgagggtggctagcaactgtcttctagatgtagtaccccaatcccccccagtccctccctttacctcacagggcatcctccctgcgtgtgagtctggagccaaatttctcctctatgtaaggacaccagtcttactggattggaggctaccctactccactgtgacccccctcctaactgatcatatctgcagggaccccatttccaaacaaggtcttactctgagtactggggattagggcttcatcatatgaatttgagggcaacccaggggtctccaaaccatggcccacagggtggctccctgtgtgtgtaaataaagctttattagcacacagcaccacatacttgagggcctaatgcctctggctgctttgtgccatggcagatttgagtcctgccatggagaccatgcagcccacagggcctaagatttctactacctgaccttccaggaaaggtttgccacgctatttatttagcaggataattttggaaagagcagttgctaggggcatttaaacttgcagtcgaattagtaacaattttattttttgggaaaatagaagtgggagagcgtgtgccccgggccagcccaccgtgccccacgtttctacagtgcccaggttggcgcagggccttttggttccacagtctgtgtctttcttcctgggtgtctgaattttgatttaatctcaggcttgtcagaacgagcagctcccaggcaccctctgccaggtcagcagtggctttcatcttctgccatttgctctgcacgtttctctctatatgcaaaaacctatatgggttttgtggggttttttgttgttggttttttatttttatttttttgagagagagagggtcttgctgtgttgcccaggttggagagtagtggcatactcacggctcactgcagcctcggcctcctggcctcaagtgttcccacttcagcctcctgagcagctgggactgtgggtgcgtgccaccatgccccgctaatttttgtattttttgtagagatagggttttgccatgttacctaggctggtcttaaactcctgagttcaaacaatcctcccacctcggccaacccaaagtgctgagattataggcatgaaccactgcactcagcctgctttgtttttatcctgagtcatttgagagtaagttggaggcagtatgaccgtttctccgtataaagcccgtgtatatcctctggaatgaggaccttcaacttagccagggtgtccgactctcaggacaccgctgtccatttcacagcctgcatttaaggctcgtcactggtcccagtgagtgtggctggttttttctcattgcacatggctgtcacgcggtttcagcttctttgacctggagcagccctgcccggccttcccttcttggtctctctcttgggcagggaagggcggtggacatggaggcttggggacagtcccctggccccacggatgttgtgtggacgagttggagggctcacaggcccctctgtggggcccagggcagaggcagcaggcaggctgtctccaccacgatggacatcatttatgccccagccaggtcccctgtcccaggaccgcggttgacagggtttggattggctgcgttcctgtctgaaggcagctgcttgggaggaggacagctgacattctttcatgcgaaatctgcttgcgggagagtcgtgaaagtgggaatcctgggctggaaccggaacgttccccgagtacataggaatcctgggctggaaccggaaacttccctgagtatacggggccttgtgtgtggaggggccctacggtgaatcgttttctgtaacaaaggcttcctctgtgcagcccacacacgggcctcacgttatcttctgcaggccagaattgtcatatatatcaagtttgttcagaacaagatggggtggggtggggggcagtgaggggcctggggcaggaggtagaggaaactgcaagattttttaaaccttctccaaaaacacgtaacccgattctgtccaagcgatttgtgagaatggggttgacacccctgggctggaacctgggaaccaccagtcagcgtctttcctccagggaggctgtgcagagggaaggcagtgagccccacctgggtttgaggaacctggggcttcaagggaggcggtctcagcccatggtgctccggccaggggtggggcagccgaggcatgagtggatgatgtcccgtcggcagcccgtggtccctctggggggcaaggtgcctgttccccattgctcctccaccagaacacctcctccagatctccgccaggtgcgccccctgaaggaaaaggggatgggggcctggctcgtgcctggtggcaagtcctcttgggccccagaaagaccccataatggccaggtagaagctcctacctgctgctgcctgaagagtctggggccctgtcggctggttccatcgtcttccctgttttcaagctacaggagcgcaatctttccagagcattgagtggctagaggaacgggcttacgctaggcaggcgctggcatcttagacaatacctgacatctttgcgggagctctggtgagaggccccacaagcgtgtgaccctgtgcggactccaccgcggcagcctgggagccaagccgatggctgtgctggccgaagggaacaccgccatggtgctctgctctctgcagccctgggtctggttggaagttgcatccctggtgaagggcggccgcggctttccagctctcccaggccagttcccgtgttttctctcccgccttccccatagtccaggacaaaagtcagaccttggtggggggtgcgcctgctgcaggggcccccaggcttctccattcgggtttagtgggattagagtgtgcggccatggggacaggtgtttcctttatgttctgcctgagggctggaaagagcctcatcagtgagtgccacgttcggtgggggtctctggtgcaggggagccggcgggccgggttgggttatgtccttgttttcacatctgaccctggccagctggagagcctcgcttgaagcgcagggcagcagctgacacaacacaacgggacgggctgagcaggccgggcgcaggcaggcttgggggagctggcactggcactgcacgtggggctcctagggggctgctagggaagtcattgggggataataggatccaccctgtggggcccactggccatggagtactgcacagtggggtccacccgctgtgtccctgaacaaggaggtagcctgaggtctcctctgacgctgggcagcagcctggggagggggctgggcaggtgccaggggaaccccctagagggcattacattcagatgagttctaattatgttcttggcttcccaggtcacacagagtgaaaaccagaggccctggccgtgcaccattgaagtgtgtcatcatgtgactttgcaggttggggggacagggctcggtgcggcctcacggggtcaggagccacggctcgagcacctcggatcccagccccctgttcagggccaggcctagacagctcttcccacgagattttctttctcccgggtataaaactggccaacgggatgcctggtgggatgactggggtacctggggccaggggcggccagcagcctcctcagtagcttgtgggagatgctctcaaccccaaggtcagctccagctggcctcaggaggagtggatgttcccttcaggtgtctttaggaccctggcaactggggacaatagtctcctccccaaatatgcagtcttgactcctggccacttgggaaggtgcgttctggtcctctgggcctcacagctttgtgccctctagggtggcaatgggaggcagagagcacagcctggggacttgctgtgaggggactgcatttagatttttaggtgaagccaatccctgttgggctgagaaaagtcctgggcggctgtgagctggtggtgagttttccagacttggtcatggtcaaggtagttgaagtcgggggttgaaaaacacactcgtgtccagcccagatgccttatggagaagaggatgcacaggcacacacgcacagacatatgtgcacggatgggcgtgtggacgtatgcacacataggtacccatgtggacacactcacgtgtgtgtgcacgttcaggctcagacacgtgcctgcatgcacacgtgcacacgtgcacacccagccctggacctcaggcaggcagggagagagacccccttggggccgcgttccatttgcacatttaatccagaaactgtcagcatgggaagcctggatgagaacaaaatgtcaagtgtgtgccgagaggcgcaggccagccccttttcctggcggggtgatgatctggtcagtttccgagcaccatgtgctgagaatgatgcgtgcattcagagcagcatttggtggggaacctgggggaagggcgggcgtctttatttcattttagctttctttagcggggcctgtgtctcttctcactgaccgttttctgaaactggctggggagggtcagggatggctgctgtcctcgggggagggactgagctgggcccttttcgttggttagttctcagtgtggcctacccagccaggtccctggacctggcggtggctatgaaagcctgggattgaggacaaagccatggggacgccgttttcgggatgcttgtgagcagggctttgtccccaccgttaggatactctgaacgttcccagaaagcccccttctgctcaagttctcttgcttcatctcaggctcaggtgttttgagtttttttttttttttaaatgaggacatctgttagaccacttaggagttctagaacctttggaaaaccccctctcatcccgggagtttgtaagaatttgtagtttctccccagagttcatggagcccctgtcagaggcgctgaggcccaggtcctgtggctggtcctcgcatagacatcagctaagggggtttgggggccagtcggcagcctctggaggcctctgcacccctcctgtgaaaggccggcgcagagctgcaccgtggggtcccctggcttggggtgggcctcagaggctgtcgccgtgcctgctgtggctctccatggccctggagcctgggattgcagaaagactcccagaccttgctggggaaactccaggatatgggggtatccagactcctgagacttccccgtgggtccacacacgtcaccaatcctctctgcacctcagcttcctcatgtgtgaaattcaggtcatatcaggacctcagttcctggggctgtgccgagggtgtggggacattgggcatgaaggttctcagtccagagccaatggccaagagggcaaaagggtgttggtggacgatgcctcctcccctggcgggggcggggaaggaagtgctaggggaagccggtgtaaggggccccgtgcccaccaaaggcgcgctaattgcgaaggaggggcctcagccaggaaccgccatagcctcagttttatttattctgctcactcaaacaaaaaatcagctttgttgaggtataattggcatagagtggaaggccttgtttaaaatgtaggatttgacaaatctggacatgggtgtacgccacaggaccatcaccacaattgagacagcaggcacatccgtcacccccagaaggcttctcgctcccgtcgctggcccctcctccgctgctcctggctccggaggggacccctggtctgtcttgtcagtgtagacggttggcgttttctggggcttgttgtcagtgcaatcatacagtgtgtggtttttattgtctggttccatatttgagagtcatccaggctgtggcatgtaataattcattcctttttcattgctgagccgtatcccattgtacggacgcattgcagtctgtttatccacttgtgtgctggcggactctgtataaaagtgtttgtagggacttatatttcctttctgcatgggtaaatacctaggtatagaatggctggataatgtggtgagtgtatatttttaactatttaagaaactggctaactcatcaacccttgacgtggtccgtcattttcatgttagccagtctaagaggtgtgcgtggcatcctgctgtggttttaactttcatttcctaaggaccagtgatgttgaatatcttttcacgtgtttcattggcatccaggaaacatctttggtgacatatctttttaaatgtttcacccattgtaaaattgggctgtttgtcatctgagttgtaaaagttctttgtatattctggttacatagatatttgttttacacatgtattctctagtcggtggctttccttttcatttatttagtagtatcttttttttttgtttgagactgggtcatgcactgtgctcaggctggagtgcagtggcgtaaacgtagctcactgcaacctcgaattcctgggctccgaggatcctcccacctcagcctcccaagtagctgggactataggcatgtgccaccacaggtgctaactttttaaagttcttgtacagacagggtctcactttgttgcccaggctggtgtcaaactcctggcctcaagcgatccccttgcctcggcctcccaaagcgctggaattacaggtgtgagccactgctccaggcccaatagtatcttttaaagaccaaacattttcaattttatgaagtcaaatatagctttttccttttaaatatgtttcatgcttttcacattctatttaggaaatgcttaccaaacacactcttactaagattttctgctagtagttttataatttttgtgcttacctttaggcctaggatgcattttgagttaatttttctctatcatgtaagacataggcggagattcatgtgttttttcttatggatgactgactggtccagtgtcatttgttgaaaagagtatcctttacccagtgaatcatcttgactccttttaagaggttcagtttatcataaaattgtctctttctggacactctactgtgatccgttgatctgtccttttgccagtcacacactgggattgttacagccctataatacggttaaaataagttagggtaatttagccaactttgttttgctatttcaagttgtgttggttgttcggggtcctttgcatttacatataaattttggaagctgcttaccaatttttgcaaagcctggtagaattttgtttgggattgcattcaacctaaagatcaacatggggagaattgatgtcttaaccaatattgaatcctctgatcaatgagattatctatctcatatatatatatgtgtgtgtgtgtatatatatatgtgtgtgtgtgtatatatatgtgtatatatatatgtatatatgtgtatatatgtatatatctatgtatatatatgtgtatgtatatgtatatatatgtgtatatatatgtgtatatatatgtgtgcatatatgtgtatatatgtgtgtgtatatatatatatggttacatacctaatatgtatatggttatatatctcttataagggttatatatctcatatacatatgaggttatataccacttatttagatttttaacttctgtcagagatgtttcatagtttttagtgtataggtcttgtacatcttttgaggtacctaagtgtttcatattttttatgctatggtcaatggtatttcttctaatctagaactgaaattcattttgacaaatttatcttgaatcttgcaacctttctaaactcatttgttccagtggcttttgaaaaaatgaattccattgatttccttatatgaatgatgttttctgaacatagagacagttttacctctttttttcaaatgtggacgcctatttgtttctttttctggcctgattgcactgggcggctcatccactgcagtgtccaatacaagtgaacactgctgtgtccccagccttagaagacacacatcattgttcaccgtcaagggtgatgttggctctgggtttccatagatgtctttaccaggttaaggaaacgtcccctctaatactatagctgagagcttttaatatgaatgggtgttaaattttgtcaaatgctctttgatacatcttttgatatgatcatgtgctttctctacttcagtctcttaatatgataattacactgattcattttcacaggttctgtattcctggataaaccacacttggtcatgctctagtattctttttgtatatcactggacttgacttgttaaaattttgctaacaacctttgcatctaggttcatgagggatattgtctatatattttcttgtaacgtctttggctttggtattagagtaatgctggcatgaggagtgagttgggaagtgttctctctcccttttagaggtggagtttgtgtagaattggtcttatttcttccctctgtgtttggtggactccatcaggaaagttgtttaggtaggcctggactttgcttgatgagaagattgttaactagattttaaattgacttaatagttttattcaggtgattgataatagttatattcagttgattgataataattatattcaggtaattgataatagttatattcaggtgattgataattatattcaggtgattgataatagttatagtcaggtgattgataattacattgaggtgattgataggtgataattatattcaggtgattggtaattatattcaggtgattgataattctatttaggtgattgataattctattcaggtgattgataatagtggtattcaggtgattgcttcttgagtgggctttggtattttgtgtatttgaaagaatatgttcatttcatctgggtgttaattgtattggcataaagtttttcagaatatcctgttactatcctttaaacagctatagaatttgtagcaatgtctcttctctcattcctgatactagtaatttgtgcctctttctttgttagtgtaatcagtcagctaaagttttagcaaatttatggatctcaaagaatcagcttttggtttcattattttttttctttttggttatttgattaattttaattattttattctgcctacttagttttaatttgttcttttttttctcgtttcttaaggtggaagctgaggtcattgaatagaaatttttttttcctttctaatacaggcacttggtggtataaacatccacaaattttgtgtttttttatcccatttaaaatattttctaatttcctttttaacttcttctctggtgtatgcattatttaaaagtgtattcaaaacatttagggattttcaagatacctttctgttactgatgtctaatttatttatggctatagaaacacttaatataatttggtctcttaaaatatattaagacttgatttagggcccagaatatgatttatcttggtaaatactccattgtgtgcttggaaagagtgtgtactgctgttgttgggaggactgttctataaatgtcaatgagactaatgtggttgatgatggcattgtccaagtctacatcagtaatgatacatccttactgattttgtatctacttgttctattaattcattcttgggagaaggatgttagaatctccaactgtatttgtggatttctctctttattcttcagttctttattctttattagttttttgtttaatgtattttattttttgcttttgtcatttaaaaaattatttacattctttatttttcatttttgtggatacacaatagttgtacatatttatggagtacatatgatatttcaatacaagtataccatgtgttcaatgtgttttgaagcttcgttcttgggtgcattagcatttaggattgttatgtcctcttgagaagtcaacacatttgtcattatgaaactgcctctttatccctggccactttctttgctctgaaatctgctttgtctgagattaatatggctattctggctttttctttttatcattgttagcatggtatatattttactcatttactttcaaaccatttgtgtctttagactcaaaacttgtttttcatatgaagcatatagttgagtcttattttgtgagtcaaactatttttctcctgaaaagtacagctaatttgcatttattcataggactgacattcttggtctcaactctgtcattgtcttttataattacgtgtattttgtcacggttgctgttgtagttttctttacaatatgtgtattattttcttttaaaaacatttgggtaattaggaggttgtattatttatttatttatttttgcgaaacagtttccctctgttgcccaggctagagtgcagtggcatgatctcagctcactgaaacccccatctcccagggtttaagtgattttcgtgcctcagcctcccaagtagctgggattataggtgggcgccaccacacctggctaattttttttgtattattagtagagacggcgtttcaccattttggccaggctggtcttgaactcctgacctcaagtcatctgcccgcctcagcctcccaaagtgctgggatcacaggcatgagccaccgtgcccagcctgtatttttgtcctaatagttacctttatacatatgcctttcaaagtttccttggtccctggtttctcatttaaccctttactgtctggcttaccgtttttattaatctgccttaacttctacttagtgcctataccacaaacaataagctgactccatttccatcttttataagttcagacccccacaaccttgggtggactactgactacttcgcgggtaagaaatggtgagtggcatggaaggggaggggcggcagttctcagtggagcggccgggctgcgagtctctgtatggaggtgaaggtccagatgttggggtttcagggtcaagcattcctggcagagagcatggcacgtgccaagacccggatggggcgtgtgcctggcgcgggtggagggagctgtgaggagcctgtagcattcagagacaggggagcagggagcggtgggggatgaggtcagggaggtggcaggacctggcgtgtgagggcttggggcgactctggggagttagggtttcgctctgcatgacaggagcctggggcctggcatggtgtgactcagacttaacgccgcccctctgactggtagaggccaggcccaggataaggtggcggcaggcaggtctctaagcagtggcagctcagacccgaggtcccagggtcatgcgtgtttgtcctgattgcacgagtcgtgtgagcacagaaacgtaggtggaaagatggtggcttcgtccagggaggtagactgggaacgtcttttgctgcttcccttggattttgtttctcaaagtctgaatcaagcgtggcagaagaaaatacagcagaacatgggatgggaatatccatgcgtataatcggtcaggttagttgctgtattctgacttatttgaaagatttcatagcgaacaaagaaaaattccggtataactataatttttccatagcagtttatattccctttctcagccttgtaggtgtaggtggagtgtcctaagctctgggggtggggggacacgtttacgtgtctgcaaaccgctacattctgctaagacatctcaggagcccgccaagcccttagtgaaaagtttcttaaggcggtttcataggtgcgtgtggggctgttggatacagtgacccacttcaaggtgacatcttcttcttgcatctcagatagcaccaggtttgtgtgtttatgcgtgtgcacacacggtgttgggctctggcggtggcctgggggtgcttaggctgtgcacaaatgcccacgcacgtacacacacagacacacagcctgacttggcccaggtgggtgggtgtctgaggagaagttcgccattgtcgactttggggtaaagtgaggacctgtctggcgggaataaaggggccctactgtcccccgactaccactgccccagccctcctgagcccctgtgactgaaaaatcctcactttggaggatgtttggtgacaggtgctggggcccggacacgacctggtttcttcatcccaggggctgtctccagggtgggttctagagtacatccagcttccacccaagggagagtggctgggtggagagggggcaggctgagatctgagaagccaggctagggggttgtggagcaaatgatgatgtctcaaccatgtggctttaggtccccagcacgtgctagtggccatcagcaggctacagcatccagccagtgccaccaggagcccactggtgccaggatgctggggtggggctatggggaaggaagacatgtgggccagggtgcggggtgcgggacaaacctgggtccaggcacctggggcgaccctccttggccgtccttgccatcctcgccatcctctctccacacatctgacctttgcctgctttgggggcagtttgaggcctcagattttctacctcaaagcgatggaacccagaagacatggggccctcgaggagggtcccccgggggctgcaaaagcagagggagtggagtgtcaccgggtgtcccggcgtgggcaggtcctgttgtggagcctcgtgacctgctcatagcacagctgggacacttccagtgactgctctgcgaggcccggggtaggggcgtgggggggcctcctcctcccaagcacctggggtgggaacaagaggcgttttgtgttctgcatgggtggccctgggctccccaggcctggtgtgggggtgcctggggggcagtggacgtgagcagcagcacgtggcccccagtcatgagtaccccaggcccctatgcgcctccttccccatgactggccctgggtggcggagagacccctgggcaggacacccctccctggcttttccttctgcaccactcaatctgggggttccggctccttgcccaccgcccccgccacccagcgcgagccgcgtagaggagcaggaagggagccagctccacctccagtagacccagagacggggaggccagggtgcaggggactgtttgggcctcgagagggacggaccccagaactggaccccaatgtgcaggtctgggtgtggatgtatctgtatgtctttgcggagctcagatgagagatgctcagagttgtctgtagagaaccagagctgccgagccccggcctggatggacatcccgcaggcagtgcacgtccctcccccgcctctctttgccgttgccgggactgggccgtgtgcctggagtttgaacttttctgatcacggggtgagagggtctttgcagttgcagagccgtggcgcggcgcctggatttccgacacactgcagcatctgcatccttgccgtcacccctcacaccccctgctagggtccctctgggggttgaatgaaaaggcataggtagaaggtgggagaagcccacgttctgggagcgtcgcagtggcccagacacccatgttcctccctaggcagctccatgcgcgggccccggagctggaaagcagccaagggcactgcccgccctgggagctgatgcctgacatgcatcctcgcctaggccagagtgccaggcagggtaggggaacaaatgccaacacgtgagctgagtgaccggaagagggggcgcctccctgagcaggtgaatgaagggtgctggggtggcgagttgagggccaacagagatggtgtcccggctgatgtagggtcaggggcttctggaaggagcctcacaggaagggcagggcagcaccaggctcagcccaggaccagagcgcaaatagggctggagtcccgagtacaaggcatggacaggagccaggcttcacctagcacctggctccccgggggcccagatggcaggcgaggggtgcctggggaggctgccaagtgaggggggggcacagactgagacagggtccccgtgttccatccatggggtacagctgctcccaggccagactctggtggtagcaggaggcaggggaggctgtgctgagctcagtgggcttggtggggtcatagctgcctctccctctaaatagattaactaaaaagtattgttgactgactcatgcatttcttaggttttcttattttctaatttcttcttttaaatttaggtttgtcgaggtttaagttacatacaggaaaactctccccctctgtagatgtccagttcgatgagtcctggcaaacatttatggtcctgtaaccacccccaaagtcaagatccaaggtgttcccatcacccgaaagctccctggtacccactggcggctagcccctccccgcacctgggaaccgtggacgtgtttcctgtccccatggttttgccttttccagaacgtcatgtgaatggaatctcgcggcgtgtagcctctgcgcctggcttctgtcacttagcataattcatttgaggcccatccgtgtcatggtctctgcattcagcagtttgtctccttttatttggaaaggataaaatgtaccacagtttgtttatccattcacaggctgatggacatttgagctgtctccagttttcagctgttatgattaaagctgccatgaatattgcgtgcagttttttgagtaatcatatgtcttcatttctctggggtaaatccctgggagtgggattgcgggatcatgtgttagatgcatattttcctttcgaagaaactgccaaagcattttgcaaaatggtaggcccgttttccactcttaccatcaatgtacgagcattctggctcctatggattctcaccagcacttagtattgtctgctttttaagctttgcccatcctaaaggctggagccatattccgtcatggtcttcatttgcatttccctagtgacgaatggtgttgggcatatttgccattcatatatctcctttgatggaggatctgtccagtttgttgctggttttaacaattaggttgtcttcttagaataatcatgtgagttgtaagagttgtgtctatgttctggatatgagtccttcaccagatctgttttacaaatattttctcccagtcatggctttgtctttgcattttcttaacaggatctttcaaaagagcagcagtttttaattttgatgaagttcaattcatcagggttcttctttttttttttctttagggttcatgttctttgtgttctgtctaagaaatattcgcctaatccaagattacaaagttttttctcctgttttctgtagaaattttatagtttcacatttcttgtttagatctgtgattcatttcgagtttaattttatatatggtgacaggtatggatggaggttaaatctttctgcatgtggttatccagttgtcccagagacttttttcccattgaattactttggcacctttgatgaaaatcagttggccgtgtgtgtgggttcgatttctggactttgtcatctgttctgccaggaaagcactgtcttgattactgtgacttttacgctaagccttgaaatcaggtcctgttaatcctccaattttgttcattttcaagagtgagctgttctgccagctccttcacattctcatgaatatcttagaatcagctcgtcaattctaccaaaaaaaaaattggctagaattttgattggcattgcattggatatgtagataaatttggatctcatacacgtcttagtaataccgagttttctgatccacgaacacggtctctctccccagtgcctcatgcacgtcttagtaataccgagttttccgatccacgaacacggtctcgctccccagtgcctcatgcacgtcttagtaataccgagttttccgatccacgaacactgtctcgctccccagtgcctcatgcacgtcttagtaataccgagttttctgatccacgaacacggtcttgctccccggtgtcttagatatttttcaacaccactcatcaggattgtgtaatttttagtggtgtgaaacttgctagatttgttcctaagtattttatgtttttgaagctactgaaatgatattgttttctcagtttcacttttggattatttgttgctaggatatagaaatacaattgatttgttcgtatattaaccttgcgtcctgtgactttgctcatgttacttattagtttgagaaggtttcttgttcatctgtttttggggttttttttgttttttttttttttgtttttttgtagattctttaggattttctatggagatgattgtgttgtccacaattaagtcagtcttatttttgccttttcagtccatatactatttatttcttgtttttacttgaatgcacctgacagtgtctgccagtggggagagggctgctatccttatcttactcctaaggtgaagtgaggtaatctttcaccattaggtgtggtgggagctgtagggttttagtagaagccacttatcaggccaagaagttcctcctcttcctggtttgctgggaatagagagtgcgtcaagaatggctgttggattttttgacaagtgctccttctgcctctattgagataatcatatcatttgcaacaatctcaatcaaattctttcttaatttgctagtgtggggaatcgcactgattgactttcaaatagcaaagcaaacttgcttcccttacacaaagcccacttggtcatgatgaatttttattttattttattttatttatttatttatttattttatatgtatttgtacttttttaaattttttatttttttgagatggagtcttggtctttttgcccaagctggagcgcaatggcgtgatctcggctcactgcagcctctgcctcccaggctcaagtgattctcctgcctcagcctcccgagtagctgggattacaggcgcccgccaccacacccagctaatttttgtatttttaggtagagatagggtttcaccatgttggccagggtggtcttgaactcctgacctcaggtgatctgcccgccttgaccttccaaagtgctgggattacaagcgtgagccaccatgcccagctgtcatgatgcgttttaaaacacctttttggatgtgactgacttcggttgtgtgtagaacttccacgcccacgctcacgagggcgtcacctgccatgtgttggctgttgtgtctggttttggcatcagatgccgctggcatcagagaatgagttgggaaatatttcctgctcttcaatttttaggaagagtttgtgtagaattgcaattatttctcccttaaacatttgatagctagaacatgtggaggtatctgggcctggagttttctttgtggagaagtttgccattggaaagtcagcagatacagggctatgcaggttgtctatttcttcttgatgaggttttgattgttcatgtctttgaaagtatttgtccccaaggagcagaagccccagcccaaatttggaaacaagaccatgttgtgctgacatgtcattcctgagcagcttaggggctgtggggtttgcagacctctgaatgcagccatctgcagggggaccctcctcagtgccctgagagggggcctgggctgggtggtctctgctgctggccatcccactgggcactgcctccccagggattctgcaacaggacaccgtaaggggcacgggggacaaagatcagactttctctgtttccttccagctttgctccccagggaggcagtcccttctcagaggaatgaaatttaagaagacaggccctacaatttcacgacaagtctgcttttgactctcccgtttactgtgtaaacttcagccctaaaacaacatacatccttctgaagttgttcacatattagctcttaaaacagcaaaatccgtgcacaatttcctctcaatcccttaaaacattcctgaaagggggggaaaacaactgtttaaattcaccgcctgttattaaaatctctagatttgcagaatcagagtgaggtactcagcagtcagaaaacagactagacaggcccgtgtgcacacacgcgctgacacacgtgcacacacacacgtccacagggcagcctttaataaccgcaggccttcctgtcccaacactgcgcgggcccctgaagggccggtgtgggttgcagctcctcaatctctgctaaagtaaacagggttcaaccctgcggccttctcagcactctccccaagtcaaaagaagggtgctcagcccctggtctctttggtttgccaaacttctagtgctggtgaaattcttaaatatgacatttttagaagcttcggctcctggcagataaaaataatgtcccccgctccacccccttttccccctatcccagttctagctaagacagtgatcagaggggtgcaccgtctttggggttaacagccatcagcagtggggttcccaggctgaaactaaatcctcgtttaactggcctggagacggaaacagccctgcctggggaagatgggggatttgctttaaatacgtgtaaagctgcctgccaggcggctaatggtgtctgcagccaggcgtgggcgtctccgggccatgggctcccccaccacaaattgcagggcagccggcttgggccactcctgtgtgtgcggggccctgggtatgattcctgggaggcagctcccaaactgtggggctcagcagaggattcagggcctgatttgcgggcagccccacctgcctttttgactgttcagagccctgagtgcctcccatatgcccacattttcctgcccctgggccttttcttctggtcatcggcctggagtgcctccactggcacattgagttctgccttcagagcctgggttttctggtggaatggggcaggggtaggctgatagacctcttggagagacagggcccactttcttgtaggcccacagggaccccgcctggggagagagaagcttcaggccctgaggcctatggcctggacctctctagagaccctagaacagacctctggcctggccttgctgatgacctggagcccctgggtgccagctgcagccccctgcctgtccaggagtctgagctccaggtatcagcgaggtgggttcgttctgaggctgtgagggagtgttccaggcctcccccagctactgtggaagggttcccggtcgacgcatcgcaccagaccctgcctccgcctccatacagcgccccccggccggcaagtccatgtccaggtttcccgtttgataagaacaccagttgtatgggaataggggcccaccctaaccacctcatcttacctaatagcatctgcagcaaccctatttccaaacaaggtcacactctgaggtgtgctggagggtctaggacctcaacatatgaatttgcggggcgggggacacagtttagccggtaggaatacctacctgtcagaggattctttaatccaagggtccgtaaaccatagcctacaaacctggctgctgatctgtataaataagatttgattagcacacggccacgtgtgcttgtgaacatctcatctctggctgtttttgtgctataacagcacaaaattgtctgctggagttgttgcaacagaaatcgcgtggcctgcaaagcctaaaatatttactatctggctttagagaaaaagcttgtcaagccctgttctaaactatgaagacaatgttggaggttgctttctatacccacagagccgttgatggggtgaagggagaggggtgaaatgcagtcacacgcaaattcttatcttcctgaggagaaagccttagggagcccactacagtggacactgtctttagagagtagcagacctggctgtgagtttgaggaaccagtgaaatgagagttcagtgacatcctcaacttcatgaggatcagaacatggataacatgtggctcaactaaacaaccaaaagcaaaagggagaagtcaacagagtcaaatagcaaatataaggacagaaagagtcaaatcaaatgcctccaacttcacaccaaatgtaaatcgcctgaattcctctttgaaagacagagaaggccgtgccgtagctctgggcttttatcttttaacaaatacattgctcagcagcattaagtaaggcaaagcaataatgggtggttgaaaaataaaggaatggccaaagagaggccaagaaactgcaagctaaaagaagaaaaggagagaaaaaacagggagatcaggatgaatatcaacactgaagcccaaacaagacaagtgtgaatgagatcaggcactattagaagacctgactgtaatctttaaggcatcatacaacataaaatacataaagcaaaaactattgaaaatctgcaaggacaggaaggttaaatatgataacgggaggagattttaatgtacctcttttggaataggacagttctagtgggcacaaaataagtgaggacatggacaggtaaatgttgtaatcatgagcaatttcagattctaacagtaatttgaaataactcctgttcttgttatctatagccatgtaacaaaccatccacaaatctagcaccttcaaaatacgcatcacgcctgagctcgctagcctacagtctggcagggctcagtgggacggctcatctcccctctgcatagtatcagctggggctggagcctccacagcattgcatctacatggctggtaaggctcctgttcatgagggcttctccaaggctgcatggattcctcacatctcagaaatgaacagtccaggagacaggcagtgccagggactgagagccacctggctgtattctcctgatgcaggtgtcacagagcccaggttcagttggggaggactggcaaagaacttcataggactgtgctttaaaaccagcactatcacttcgaaccctagtaatggagttgttttgttcccttatgtctgcggaacacttacaaaaccaatcattcatgtggctacaaacaaatctaacctacctcaaaaaattgagatttaactggccatgttctctgatcaaaacccaatatcatgagaaataaatgattaaaagattggggaagaaaaatcccttacctatttgggaattaaacaacactctcctaaatagccagaaagaagagattgatgtgggaagtgcgggccctgtagggcgttatgagacgtaggccccgctgcctgccccagcccctacatcactccagctgccccccagcaccaactgtagatgcttttattttgtaaattccatgccagtgcccacatcgcttgctggtggcttcactgtgtttgcaaatgttgtcccccacgtggattgaaattcatctattgcctgaaagtaatgaagtatgtgccttgcacactgtgtaagcatacgtgtttattcagtgcgtcctgggttctcaccccttgccaggtgatgggttgattcagtgtgctgggggtctccaggcgggggggtccacatagtttttgcttcatcagaatctgctgataagcccagttcggagcagagactagatgggccagcctgtgggcactctgcctagcgccatctgcctctcccaccccaggcaggtgtcaggtggctgctgcgccctgtgtccgcctcctgaccttgagaacacccaggtgggggaggaagtgggccgcgcttcgggaacccccaccccgccggcttgcgcagcgagctgggtcccagggctggaggcacctcattaaaccgcctgaaacgtgtgtaactctagtcggcccccgtaaggcaccggcagtacatgtgaaattaaaattactgagaggccccactctcctcccctccatgggtgggcagccttcatggggaggccaaggcccggaagccggcagtcctgggaaagatttggccccaatgataatgggcccaagaatgtgctaggcccagggtgtggtccaagttcctttcttagctaacccctccaccctgagaagcctcccccactacacccacacatggggccagctgccttgagcacctcctgctcagacccaggtgaggtacctgagtgacaaatgtcaagagtttgcagttactcccagagctacggacaaggggcaaggtggggctggaggcaccggctcagcaagaggggtcacttgagccttggcctgcagggaggttttgctcaaggagtgtcccttgagcaaaatattgcactttcgttgctctctgaaagcctaccaggcagtcttcccagaggtgcttcccgggaagcccgtggagaggatgcattcgacacccaaggccttatggaatcagtcctggggcctggagggtcgtagagaaatgtgtgaacatggctccccttaggccaggggtagacgcaggcacagggaggatcaggaaagccctggatcttgttgacaccccgggatgtgcccttgtggctacttagacgtagagcccggggcagggggagggccagcccctgtggttttagcctcctgagagtctccccagacagcccacaggggacactgggcctcatgccgcctgtcaggatggtgtccgggatgtggggaccagacgacagctgtcacccacttgcagggcccggctgcccggtggatgggaacggccatccccatgacgacccagcaagtcccttgcctctctcgctcaccaggaagaagacacgtccgggcagctggcaggtggggctagttctggagggaaagcggcctcgtgcctcccagagtcaccccgaaatcattaacggggagacaagcacacagagcagctggccgattgcagctctgaaggtcagagatggccgccagctgtgggaaggcctgtggctagggctctgctgcctgcttcctgggcaggggctccttcctccctctctgtctctggggtcccatgggaagtcagggtggggcctggtgtgtggcttccgctggtttcctgggtgtgtcttcctgcagggccaggacccccagagtgttccagtgacttcagagaggggcagccagaccaggaggagctccagaggtgccctgtggggagaggcagcgtcccaaacacgggggagggggtaccgccagcctggggacagatagcagcatctcagccatggggggccgtgacatccggtcaggagggggttagcatctcagacatgggggggagatgtccagcccaggggaatgaggggggtgatgtccatcctggggaggggtgacatccatcctggggggacggaggcgtgacgtccatccttgggggatgggggggtgacgtccatcctgggggagtgggggcggtgacgtccatcctgggggagtgggggcggtgacgtccatcctgagggaacaggggggtgacgtccatcctgggggaatggggggggtgacatccatcttgggggtactggggggtggcgtccatcctgggactggggggtgacgtccatcctggggggacggtgggggatgtccatcctggggggacggggggtgacgtccatcctgggggcgggtgatgttcatccttgggggacgggggaaggtgatgttccttctgggggggcgggggggggtgacgtccatcctgggggagacagtaacatcccaaacatgggggatgatgtccagagtgggggtcttcaggtctttacgggcccctcagcctccccttccacaccccaagtacagcacccacaaggcaggtgcctgggagggagacacacctgtcccctgcctgaagtttctcagcaggattttgggcacaaggtgggtagtgagctggtctcagcactgagcttgcaggtggagaaggcgggcccctgactttagggcgctctgggtgggatgaggacagacgtggaggaaaggagggatcccagcagaggcagcagtggatgggggagggcttcactgcagggagagtgaggctgcgcggtgccctgcaggacagataggaactcccaggcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcagtagaatggtgtgaaccccagggggtggagcctgcagtgagccgagattgcgccactgcactccagcctgggcgacagcgagactccgtctcaaaaaaaaaaaaaaagaaaaaaagaaaaaaaaggaactcccagggtggagctgtggacagataggaacttccacagccaggaaggccaggtgacgtggagggccccaggcagctgggccagcacgggacggggcgtcaggtcagcggggctcttctgtgctgtgtgcagcatgagagtctgtaccccacctgtactcaggaccctgccccccgaggacaaggtcgcttccctcttgagcacatgggacaccaccttcctgctacactattcccatgccctttccacaggcccaggccactgttgtcatttcgccctccccacagtcctaggaggtgggcactgctggtgccccattttacaggtgtggatgctgagcacagagaggctgagctgctcgtctgggtcccccgcctgggatgccaccagtgtcctcacaccagcctgctcctgccctgtgcccatcctcctcctgcttagcgatcctttctcttgctaatgtgtgggacaaggggctctcagggggcctggccaaggtagcgggtccccccaccatactcccagtgccacccctggctgcctggagctagctgtgcaggggcccagaagccctcccctccgaggaggtgggcctgttccaggctaccttgggcgggcagggccttgggtggccagggcctcaggagggacacagagggccccactcaaggtcacgggctgcacgttccatggggcctggggaagcagccgagcagaaggatgcagcccgactaaggctgcctcagggtggcaccccagcggtgcccacactaaggggacacttggcaggggaggggctgtggcagggcagggtcatgtccccagcagtaaggccaggacagggcagccggaccccgactgtgccaccctcagcccagtggatggtgcatctcacctgggcctggccggctgcactgtggcgcctgccccaggccaggctaccttgggcggggtggggactggtactccccggggggtgggggtgagggcgggggtgagtgtggatgagggccccagctgtgcccagcacgtcactgggggcccacaagctctcagcacaggctggcggctgggagcagctggccacaggcaggccctgggacaaagggcgctttgagctgcctgagtgcctgcattgccctccggccagctgaccctccccggagccgaggctggctctctctgtggcttatcagggccgggccggtgtggagttggaacagctggccccaaagcccgccagccgggctctatgctgtggggaccactgcccccacagggaagcgcctggctcagcacaggcccagccctctggcttcctcgctatgggagggggtgagaccctaatcccgggtccccacagcaccctcagcctaacccctgtgtccacccctcttcagagtctccaggccccatcttggcctgatgaggcctcattgtctcctaaaaagtgtgggtacagatctcaggcttttcaagggtgggtggattcctggctccagtggaaggtccccaggcctaagtctatgggggcgccagggaggccggctgtgtttctgcatccttgaccctggccccttccacaaagctcagctctgatccttcgtatttaatcttcatcttccgccgtctttaaaattaattttcctttaaagatactgtagagcagtaacatcagagacaccaaaatagacaaaagagataatagaagagtaatatcagagacactaaagtcctcgcgataagggtctgcgaggcttcctttatgttttgcaaaaaaatctatatatttcatccagagagacaggatgtgagcgcagctggtcagaaccagttatttcaggctgccctgtgatctttcccacgtgattgattgacacagggaccttctctagggtcctaaattatgtggttccagcagcatggaacttcaaaacacattgaaccccagaaaatcttcgctatgttggagattcgccggctgataaaagcaaaacaatagataagatggccaggtcgaccttcagccttctcggagaacaccggttccacggccggttgcaacacgtttgagccaaagtgcgacctttccccgctctgttcactcggagactaaaaatcccagataagcacctgctttgctagacccttgctggccctccggcttcgggcaggtctcctctttatgccactgtaaccccacaacaccggataccagcatggggtcggcctgcggggccatgtgtctcctcctgtgtgaccttgagctaccttgagcttccattttccttccgcaccatgcactgatttcccctgggttgaggttgagggtcccagggtctgtctgcctaatgacaagatttcagtaccaatagcgaagccgtcagtggcagtgactgtgccttagggtgtcccgttggcatccagggccccccgtgaaggatggcaccgagcaccattcaacataagtcttgtcagcgttccgatgaaacaagattaggggaattttacagcttgcctgtgtttttccacccagggccctttgcactgcctgctatttgttttctgtcttcatcctgagagggctcaaggtctgcatgccattttgcaattgacaaatggcttgtgcttagctatttcgttgaatgctgaactaacaatagtcagtgaagattaagaactaaaggctcaaggacagctacagatgaccacagctggagtgcggcagatactcggggccgctgggtggccctgaaggcccacagaatccttttggagacctgacccgcgggagcccaggtgagcaaccgccacgggccagggcccctcgaggcactcatttcagtatcagagaacacacataacgtaaaattcaccatttcagccatttcagccatttcagccatttcacagcgtgcaatttggtggcatttagtatgttcacaaggcggttcagccaacacctgtctccggttccagagctttttcatcacctcaaaaggaaaaccatccccattgcccttctcctagttcctgacaaacatgttctttttaaacattatggtgaaatataaggccaggcgcggtgactcatgcctgcaatcccagcactttggaaggctgaggcgggcggatcacctgaggtcaggagtttgagaccagcctggccaacatggtgaaaccttgtctctactaataatacaaaaagattagccgggtgtggtggtgggtgcctctaatccagctactcagggggctgaggcaggagaatcacttgaacctgggaggcagaggttgcagtgagctgagatggtgccactgcactcctgcctgggcaacagagcaagactctatctcaaaataaaataaaatggaaatatgttttaccatcttaaccctttttaagatcacagttccttgcgaccatcgccaccatccagctccagagcttttttcatcttgcaaaactgatgaaagtctgtccccattaaacactcactccctactcccccttccccagcccctggcgcccatcatctactttctacctctgtgaatctgatgactgtagcgacctcacgtgagtggaagcagatagtatttgtccttgtgtaactggatcatttcactgagagtaatgtcttcaaggttcctccatgttgcagcctgtgtgagaatccccttcctttttaaggccaaatcctattccgtggtagggagggaccacatcttccgtctccgtcggtgcactgagggacactgggctggttcccctttttggctgttgtgaatgttgctgctgtggacatgggtgtgtatggatctcctttaaagagaccggggacagactccaaagtggaattgctgggtcatacagtaattctgttttttttctggcatgttatttaaacagactatttgttagagcagttttaggttcacagcaaaatcgagcggctggtcatttcacgctttaaaggagctgtggcattctacatcccccagcagcacacaaggtcccaacttctccggatccttgggagcacttgtcactctgtttggggtggcagccaccctaatggatgagaggtggcatctcgttgtggtcttgatttgcatttccctgatgattagtgacactgggcacctctccgtgtgcctcttggccatctgtgtatcttcttcacagaaatgactgtccaagccctttgcctattttttaaaaattgagttgttaggaactttggttttttaaataattttaaagcacacaaataagacacctgagagccaacttataacacgccccaggatggacatggattcacactcatggtagaacagagctgagggtgcagtgtgggatgggctgacttgtggccaggggaaagacccgtggcctatcttgttttggggggcagggacccagaaactcattgctttcaggccttgctagaaaagcatacagtcgaacgagtgggtccgatgtggagtgcagtggcatcagccaaggctccgaggcgtttcttcccacttcacatgtcttttctgttgtttctgcgaaggtgtctcagggaggggcagaacccatggggtttggcttcctgaccctgaacgtctttgtcccaggcccttcactgggtctggaggaaggagggtgctgtggtcctggtggctcttgtgcctgcacccgccttggggccatctgacacccacaccctccctccaggccagacccagctctccagcttcccggctgcccactagatgaccaccaaggcagggcggctggtggtgctgacggctctgtgaggcccaggcctgtcttccccacctcaccccacagggctgagacacctccctgtcccctggcagggctggaggctctggagtctctcttggttaccctctctctcccagggccacttttgcagcctggtgtccttatctcatgtctgggtcccctttgccaagggtcctccagcctttggcctgcacccactcatctggcagtaacagggccacttccagaaccaccaccatgcccaggtcatgtctgtgcatgagagtggtcagccctccatggcaggcctggcctcacctgccagtgtcctctcccacacccgaggacacctgtaccttgtcccggggcggggctctctctgccatggacgccagtcttccctcccctaagctgcgggtgacctgacctagttgagcctggctttcctcctctgtaaaatgtgaacagaggccaccacccccattatgtgggtctgtgtttgctctgtgcacgtctcggtgcccagatctgaggcccttttgtccatgaagccatctgcagccaggaggcggccttgctttagtctgaaggagagtgaccagggtaggaggggcctccttgtccctttggtctgtttgtggtctcagtggagaccaaggacggctcttcttctcgtatctacggggcagagctcagggccgcactccatcagcatcccgggccattgcatccttgaccccggggggcttgcaggcaccacatagatcttgtgagaggcgctttgtggggctggatgatcctgggtgcccctcagagaaggccctggggctggccttgttatcagtgggggagtcaggaagtaccccggttctgtacctgtagtggatggggctctcagagggattgggggtgatgggggtgctgagctggcctgagaagggtggggtaacctagggggtggagtgggggagggagagagcactcctgacacagggtcctgaggaggcaggggtgccccagggaatggggggcacctggggcccacgggaggctctgggggagactgggcggtgagcccctgggaaggaggcctcagggacagccctagactgtcaccctcagtgtggacagcaggagctatggcagctgcttgagcaaggtgggcaagggagaagtaccaaatgtgtgcaggttctggggaggagcttgaggcccctttagttcacctttggaacttaggaccaagtctgcaaatacagatgaacccagggttaggagggtggctggggcatcacccacctggggtctggactgctggaaccagggggaggcaggcctgccattctgtgagcctgctttagactggggatgtggtcccgtgaatcaggggtgggccatggcatggcgtgggggaccagccctcctccctgtccccagctgagtgtgagctccctggggtcttgctgtggccttggccctgggtgttgtcccacacagcccaggagagcgtttgaggctgatggtggtggagatagttttatctctgagcaaacattccatcttgctgtttccagcctagagatggtgaggggacttttccttggctctttcctggcctgctagcagcaccagcctaattaacctgacaagcggggcctccccagccatgcagccttgcactgccttcccacatccagctggatttggggatcagtgttgtttttaatcattcctaccaccttgtcccacaggcaggagtcctgccatcttcgaaggccagcccctaaacaggttccctgagtgttaggtcaaaataactttaaaaagacacgcagctatccacagcaatccttaatagttacttatctatttcagggtataacataagacacacctatcatttcagacctgcctaggacatgcctggagaaggtatttaagtaattttaaaagtgcatcaaaacaaggtcaggcgcggtggctcacgcttataatcccagcactttgggaggccgaagcaggcagatcacctaaggtcaggagttccagaccagcctggccaacatggcaaaaccccatctctactaaaaaaatacaaaaaaattagccaggcgtggtggcatgcgcctgtagtcccagctactcaggaggctgaggcaggagaattgcttgaacctgggaggcagaggttgcagtgagccgagatcacgccactgcactccagcctgggtgacagagcgagactctgtctcataaataaataaataaataaataaataaataaagtgcatcaaaacaagaaaaaccctgctaagggccagtctgctgggtggtggatgggtcagcagagctgggctgggagccgctatgcctccccatcaaggccaccaatagtcgggtgagccggcctctgtgccgtcatgggcaccctgtctcagctccggggacttggagctctgtgtttccgtggcctttttcacgatgaccaaacaaaggcgggtgttatggtgtccaggcccggtctccctaacgggcagtttctcagaagcaaagaccgacgagacagagctcctgctaccagagagccctaggccggctcattggaatagtcatttatttgttccttcattcgttcattcagcatgtccatgttgagcactgactggagcaggtcctgttctggggcctgggaaatgggggtggataagaccaaggtagcctcttctctaaggagctcagccggacctcagcctagagccctggtccccaggagctgaggacagaggtgggacccacaccccccccatgaggccacagagcctgcaggtgtccacaccttttgtttttgttttttgatttttgtttttcgttttttgttttttgagatggagtctcactctgtcacccaggctggagtacaatggtgtgatctcggctcactgcaagctctgcctctcgagttcaagcgattctcctgcctcagcctcctgagtagctgggattacagggcgtgcgccaccatgccaggctaatttttgtatttttagtggagacagggtttcaccatgttgatcaggctggtcttgaactcctgaactcgtgatctgcctgcctcggcctcccagagtgctgggattacaggcgtgagcccccgcacctggcccacaccctttctttaccttacacccctgccatctccagtatgcacctgtccgcacacacccacacacccctgaaggatttgacgtcatgagccaaaaacatttttgcaaaaggaaagcaactaagctcccagcgtgtctccccttatccattgggcttgtcccaaacacatgccggatggtgtaagtatcattccatcctaattaataacatttgggagccagcgatggcagtgtccagctgactgctcatagtggactccctggtgggggcgtggcatgggagcaaggccagccactgtcacccagtgggagcagaagtcccctccagggcccggcttctgagggaggacaggcaggagtccgccggaagtgggcctgagacgccgtatgcctgtggctttgtggctttgtgtggctagcgcctctcacacgtgggggctggtttcatcttccagccccacacaccttccccaagggcctcccgtacaccccggctgcctgggcgctgggctccagcctgcaggtggccgctgcactttaagtgtcacaatgggctgcacttcacatgaaagctgcattttggcaataagtccccaccaagcccactgagcctggccctgctgcatccacactatacagctgaggaaactgaggcccagctttccacttctgtgcctagggggtgggatccagctccgagggtcttcttcccactcctccaggaacctccgccctctggtgtcggtggagttgaggaggtgttggggtgtggaggggccaggtgactccctgtaagggcaaagtgatccagaggctgcccctaccgcaggtacaccaggctcaaaggccagctgtgaggctttccggggctggatctggtgggaaagtgcttatcacggagggcacccggggttcctggcgtgggaccccctctgacccaggctagggttcctggcgtgggacgccctctggcccaagctggggttcctggtgtggggccccctctgacccaagctggggttcctggcgtcggacgccctctggcccaagctggagttcctggtgtggggccccctctgacccaagctggggttcctggcgtcggacgccctctggcccaagctggggttcctggtgtggggccccctctggccaaggctggggttcctggtgtggggcctcctctggcctgggtgggcctggcctgagagctgcagcctcacctgggctccactgcctatggacatgagctgaagctgctcagccttccagggcctctgtgcgcaggcatcaccatccgcagcaggccaggacccgggcctgctgttctcagggtgtccttcagcggaggctccagcatggctgggttcaaacaggttgcagggtctgaagccactcaaggccgagcctgcctgcagtgagcgtcccactctgtccctgcaggagatcgtgctggtggtgttcttcgggacggagtacgtggtccgcctctggtccgccggctgccgcagcaagtacgtgggcctctgggggcggctgcgctttgcccggaagcccatttccatcatcggtgagtcatgcctgccctgtggaggtcacgcccaggtttccagaccaggaaggacccccacctcatgacccctaccagatggagtcccctaaggactggggaaccccaaggccagcagggggtgactgcccaggacccagcacaggagcattggcagccctcagcagcctctgcactcagacgctgatcatggtgttgggggtagggggttggtccctcacagattcccatgagcctcacagcccagcatagcttcatggtgggccagtcaccctcggcagcctgagaaccatggtccaggcctgaggccctgccctttctggccacttgcagggctcagcacagggcccagcctaggccgggggctccacatggccaggacagaggttgggtctctccgtttagatgctgcctgcctccctatccgaggtgtctccatgtccccggtcatcagggcgtgacccgtctgaccagcaagccccttccccagacgagagcagggtgtatgctcttccctggggccctggctgtggcgatcacgaaaagctccccctctcctgcactccacagacctcatcgtggtcgtggcctccatggtggtcctctgcgtgggctccaaggggcaggtgtttgccacgtcggccatcaggtgcgtctgtgccacaagctccccccgccatgccgccccaccccgagcacccctcctgagccgcgggtggtctcacgccccatccaccttgctcagatgcaaggtgccttggtgcccactgcccccgggggcactgagccatgtgctgggatgggtggagcagggtgggtgcaggcaagtgtggagggcacggctcaacccaagatgcctcaggcagccctaggctctggcccagcactagcgcctctgaacttccaggacttgggtggtaacctgaccatctgggcacacagcctgcccatctgcaaactggggtgacccaaggagccccccagaaggcagtctggggactgagggaatctggaggtacctggccgacccccagctcagccctgtgtgggcagattcagagcaggctctggggggctgcgcctgagagggagattcccaggcccctgtcgggatggacatatacccagcctccccacccagagtggacgcctgggaggggcaggggcagggacacccatgccatcggccagccctaggcccggcgtgaacagctgagcccagcctggctccctcagccccacaccatctccttcgcaggggcatccgcttcctgcagatcctgaggatgctacacgtcgaccgccagggaggcacctggaggctcctgggctccgtggtcttcatccaccgccaggtgggtggcccgggttaggggtgcggggcccaggttggggacaggacggagggagcagagcagcccacactaggacagcttgagatgcgctgaggccccgggggccggtgggtgcctgggcgcaggggtacctgaacggggcccaggatctcagagcaagcccaagcttgagcccagcctggatgctccaccccagcctggtgccagtgaccctggcctgccaggctgatggtgtgctcaccttcctctgagctgggggcaaatgaagacagaaagtcagaaatgaaaaacccaggcaaatcaaggacccggtcaaggcagggccaccagactccctcccgagggctgcactcagatgggttcaggctgcactggcccctggctctgtggggtgaggggacccttcctctccctgaggatctcctgggtcctggtccattcttggttctgtcacgtggcaggaaagagagctgggcaatcagtggagcccgcgccggcccagacagtgggcctagggcgaccccagggctgagcctcattctgggggtaacccccacccgccacttaccggagttgtgaggagtgggctatattgaagccggccctgtgcatgtgaaccgcgctggagcggcgtaggacgcccagtgatcgctgggactcgctgccttaggcgtctgcacaggaggctcccagcctgcggttcctggagcccgacactgtgtgttttctggcctaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtaagtcggaaacttccaggcatggggacaggggcagctcaggctgaggagtgggcaggacatctgggcactggtgtcttgagacttcgggccttggcaggggcttctcacctgcacgctcacaggcctctgtccacaaacctgtgcttggagccgctggcacaggtccccacgctcagtgttgagtcctttggcatcaccatcttgaagttctgaatggtctcatccttgaacttgagatttgagagggaaatcggaggggtcactggagcgtgtgttgggggcttagcggtttcggctcccccatggctctgcctcccgccatcgtcctaggttgcccattccctgcctccaccgtggccctcaccctggcagggcccaaggagagcggcgtcagatgcatacctcgcgtgtctctgagggtccacacaggccctgtaagtgcccctgtccccaaggagccagacatgagacagcaaacaggaaagaccatgatggctcaagagaccccagcagagatcagagagcccccgtgtttccagtggatgctgggcctgcaagttctggagccgggcctgggcagtggcgacataggtgcagctgggcctagggaagcagggacccggcctgtgggcccagaggctgcccctggctgtgaaggtgggttccggccacctagagcagcccgggagccttggggaagccggtgtgcagcaggcagatcccgcactggaacaccgagccacccaaagctcagagaggctgtgcgggaggggtggggcagggtgtcttgggccgtgtctgtgggggcttccttgagggactcaggcttgcacgtgggagagggagatgttccgatgaggatgcagctgcaggaatcagggtgcgccctccgagctgcaggctccccaagtcccaagtcactggcctgtgggcccagcagcagtttctcatggctcagaggacgctggctgaggcatttttagggggcaggcctagcttgccagtgtccctctgggagctggtggctgccttcaaatcctccagtgaaagtcggcgtttatatatgcatggagctcaagggctgcttctagggggaacacgtgggtaccccgaggggagtagctggctggaggccagagtgcagggagggaatgactccatcccatctccccccacagctgcagggccaggtgggccgtccacaggccactaaggcccagggtggcaccatcacaccttggggagtggccctgggtggggaccgagaagcccaagtgccgaggtgacagggtgacccctactctgccgccacaagcctgcccccgcgtctgcccttgtctaccgacctccgggctcactcagtccgataacaggttagatggaatcgtggtagcaacaggggctgggggctggggaggaggccgtcgaagcccacacagggtgggagccaaggcctgggggccgcacgggggctggaggtgggggcgggcagggcagccgtgggaaacacgtggtggtgccaggacccagtccgtctgccccgagtcctccttccagaaaggaccggacttgctggctctcgggaccccccaccaccatcagagcatatctgggtggggtgagaagcctcccggtggctccccaggcaggcacgtgtccctgcgattgctgtgcctcctccctccccctcaaccgccgcttcccccatgaggccagacactcagcagtggctcctgacgtaggccaagtcagcaggttttctggaagcttccaaagtgctgcaatgctcagggatggcaggggcatgctgacacagctcctgggttggggcaggccccactttcggcctcttcccgccttcctgggggcctgtgtccccgaaggccccagtgtggcaggcctgagcaggtttgggcagcagggcccagcccccctgcgggagcctgcctgcagtgagtgtggatgggtagggcgtgctcgggggatggacggcccagagccaggagagttcccgggaggctggtggcaaggtgggcagtgaggagctggcggtgcagcaaaagccagtgggtactggccccggcacggctgataagcagtgcccagccttcgctgctgccctgcctgccttcccagccgcccactggagctgtgggcagcggacgctactccccagccccccagcccgcagcagagcggcactcccactcccacacctgtgcaaacatccgcccgctggccgggaacacggcccctttgtgcccggcttggcatcagtgccccggcccacaccgtcagctgcagcccgagcctcggccatcgcgcgccctggcctggccattgttcccgccaggccccgcgcccctggtcgccctgggccccccaccgcccagggctgtggggcaaacagctcccattcagctgccctgcagctgtctggggggagcggcccctgaggcctgagttatgggctgtgttcctggcatttctcggacaaacagaacttgagaaacgcaagaaggggcagcagcccagatgggggcttttaagccagttttgccaatttgcaactgcgccctgagcagttgttttctttcagctcctttgtcctgcttccttcaccccaccggggagtgaagtacgccctcgccggccaggcagccagggctgctccatgtctgtccgtccgtcggggctgccacaggcccttactgggtgggaggtggcttcctggaggccaggccattctgatcatcatgctgcatctgccccagaccttgcctggactctgtggactcctcacccctcagacacaccctgagagggtgctggagctgccacaacaaagtccgcgaactgctgggcccagagcaacagaaactcatgggctctagaggccagagcccgaagcgaggtgtgcacagggcctgcccctccgaaagctcagggagaaatttcctctcctctccccgtggctggagactccaggcgtgcccggtgtgcggccgcctctttcctctgtgtcaggccctgtctctcatgaggacacttgctgttggctttagggtccacccaggtgatccaggaggagctcatcttgattgaatcttcaaagagcctatttccaaatatcgcattctgtgggtccaggtgaatatgaattaggggggatgcagtccagcctaggacagtgggtggcccaggtggacttcctgggaaggtccctccccttgccggccaccagtttccacagctgtccagcgaaggcgccggctcagtggttgagtgtcccctcctgtccccttcgccggggtggggatacgcaacttggatgtgagaactctcgaatcccctgagtgtggcgcctgccctggctgccaaggcgtttggggagaatttaagacttttctttgcccttggaacaaaatgcgtttgtttgtgttaaagtttgagtggagggagaagcagtttttgcaaacacgggcttctctgttcagcgcccgggggtctctacaaacaggaggctgccgggctgtgtttgcccctctgcacctaaatttagaattgaaagtaaagaagctggaaccccattcctacatttcagccgccttttgaagtcgagtctgactgcctgctgttcactctctcctcacctggagcctccagaaattcccgcctccctggcaacgctgcaccctggcggggcaaggccagaaggggctgggggctggtgcaggggtgtgcgtgagggcagggcctcccagacagtcacaggccagccctgttggcactgcccagcgggaggggtggtgtcaggaagagctggggaagccaaggcgccgtgggccgaggggcggcaggacctggccacccaccgagcccctgggtcagcgttcttcctcctcctggagttccgtgcaaaggggaacgagttcagctgccctactgagtgggcctggggacagaggcagagtacgcacctgctgtgtgcctcagtttctccatctgcacatgggagacagcagtccgtctcccagggccaatgcagggcccgctgcaagggctgctgaggactgtaatcccagaggctgcaaccgatccctctgctgcggagactttccctggaccgaaagggcctcctggtgaggctgggtctccgtttgtggactcactgttgaggcgtgtggtttgcggtcctgctgtgtgccaggcaccggcaggggttcgggcagccctgtcttgctctctctgtcacagtcaggagcgagaagcatggtgtgagctggggctggcctgtggtggttcgcaggtggccatgggaagcaccgccggagtgtccctgcaggactgtttcggcccaggagcagggaggcctccttgaggaagtgacagctgagctgagacctcaagacacagtcacctgggccaccttccggcagggcgctgagcctggctgtacctcggggaagacgcggcctggggcctgggtgccatgggggtgttgacggtttcaccaccagcccgtgtgtggggctccgggcttcgtgagtgaggagaggactccatgtgacggggaggcctggccctcgtgaattggtgttcgtttatttactttctcctgctgaaaggaagcaggtttattttggggtgtgtgtctgcttttgcttttaccctgagagtttgccagcctgctggcttgttcccccacccccacctggtggcgtcagcccctttatggctgttcctgagagacaggccggagtctccagggcggccccacgggggctgggcgtccccttggaatgtgagtgcctggcctgttagagccccaggaccgctggccccacccttctctgtcccagagacagtcctgccccccacccaggggcctccctctgtccacggctccccctttcccaggccacccccctaggcccctttcctccaccttcattggccctgccctctgtagtgtcacccaggtcagtggggccctgtcctgccctgtcctgaggagtgcatgtctctgagccctgcatggggggagcccaccagctagcagaggcccagaaggctctagacaggctctagactgggtctctaagtctgcaaggggcaccaaagcactttacaaattccaggagtgagtgacaggctggccacgtgccaagccctcacccagcaggcagcccgtgagaagtgtgttgtgatcatgcaccttcccgagagggggaaactgaggtacagaacatgctggggctttgcctgaggccagacggacagggtgagaactgccccccacactcagagccacggtgccagcccagccttgccagcagggcagccacaggacttccaggcaaggtgacggtgccaggtggggcccgaggccctcactcatagggcattgtcccacatcccctggaaccactgagacaggcatcgtgccacgagaggggacacctgcctggacctctgtgtgctcagcctactgggggcactgaggccgagggcccagctctgcgagatcctgcatgggcttccttccaagccctggagaggggagcaggcctgggagggcgcccttggcccagagcctccatgaagagccaggggcctcctcatggctggggccccagcacagtgacctgggaatggctgtggccgcatgggatgtcccggagcccctgccgccctccttggagctgtggggctgagcttgggtgctgcgctctcctgactccatccttaggtgcctcctcacgggcaggctgggctctcgaggctgggcaaggtcggggcctgcaatggctgaagcagcctcttagcccatctctgccttcggggtggccacagcggggaacgtgggtcctgcaggccttggtccagctgtctgcctggccactttctaatggggagccctcagcacagtgactgcccagcctcagtttcctccttcgtagatgatcttgacctgagagtgccagctggggtgtgacacctctgggctaccccctcctcccgctcttgaccaccccttcctctggacagacgaccaccacatctccagccaggaccaccccttccttctgggcaaatgactaccacgtttccagccggggccagtgagctctgggagccagggcttggcatgcggctggagctcaggtttctgggctggcctctgtcctcccctcgaggccagccttgaggaggctacttctgaaaggagggaatagaatcccagtgtttctcagggaggaacatggggggactagaaggctccccatgcctcccgccccttcacatgggagtgaaggcacaggccagcaggagggcgggggaaacacactgaccagtggggtgtgcgttccccgctcgcccccacagttcctgccatgggcgtgactttgtgtgcctcatatggctggtgccctggcaaggagccacggcccaggagacagacatgtggatctgcattccaggtggtgggccatcagggactaatccccagcatggtgaccataaaacagcccattcctgagctgcctgtgtctgaatgcaggaaaaacaaacaggtctgcagggaggggccgtttccttgttaacttgaggatgagggtctggggccgggtctgggcagacaggcagaccaggcgaaggtggggtcctggagctgcgtcctgctgtatgtgtgctctccacggtgggcagacacccaggggcacttctggggctggcctttctctccctctcggggcacccctgccttctactgaccacccagccagccagcaggagcccacgtgcacccagctcagccccaggaggtgacacccccaccctcagcagctctcgtctgtttgggggcaggtttggaaggtggtctcgggtgtccttacgcgagcaggtggctacctcacctgctcacctgaccccaactccactctgacttccaggccagccccactccattccaccttcatcatgcagtttctgtattagatttttaaataatcaaaatatggtattttcatttaaaaagtaatgcttttaaaatatattaaaataatttaatgttgttattagaacaatgtttaatatgccagcccgtgccatttgtcttgatgcctgggtttgctggcgccccttacgcttggcacgcaaggcaggagctccccactggcctcccccaactgcttgccgcccagcccccctcaggccaattcctgcctctcagcctatcttgggtttgtcctcggctgcctcgggaggcagccgtgcccaggcctcttggtctcagggccccttggtgcccctgacggagaagcctggctcgtgggcattgtgccatcactatttaatacagtggaggcatgtaaaaacaattccatattaatttattaaaataatagacccattacattttcataatgtcatgaaaaatttctatattttccaaaacaaatattatcgaaagaaaaatatgcatttttgcaaatctccagaaagcctggctccccagaggacggggatccccacgcctgtcccggaactgtctgtgaagagcaacgtcccactgcttacgcttgggtgggagcaggagtgcctgttagtgccccccagccacagagagtgctgccgtccctgagcccagccccagcagatcatcagcacacatttgcctggggaacacagacagccctgtcctggacgcagcccttcaaccctgcttctcatacctgacccccaccttgggcgctggtctgccacaccccaccacccctgctttcttcagcctgaccttgtcctcccggacccagtgctaggaggatgtccaggcggggtgggacttgggcctgcgctgggctgctcctcaagtctcgggctgcacgtgccagccaggcagacggtgctgagaggggcccttctgcagagcggaggcagagcccggagtggaggggtgagcactgcctcagggcattggcaggggctgcgccagcccaggcacaggtctgagggatgaataggaggttgctggatgaacaagtaggaatcagcatgttcatactgaaggggtgagtgtccccccaaaaaatctggattagacagactctggagccctcttgctccaggttgcaggggccctccgagctcaaggccaggataggccagggtccctgccctgcccaggcccttctaggcccgtttctgggccacctgtgtgtgctttcttggacttgctgtagacttggtaaacagtggatgtgctgggaccctgggctgagcccctttgggctgagagctcaccaggtggaagtcactccccagggcaggactggcacagggtctccgatgccccgcccactttgcagccctgtgtctgcctctgcaactccccaccccagtgcacctgggccctctggggaaggtagcggcagcccagcctgtgcatgtgggtgcaggccctctggggaggacaccctgcagacgaggggctccggttcccccagggcccccctctctgccagccactgtcagcctcacccatggcctggcttcaccctgcagggacctggctgcgctccgtgtgcctgcgctgtgcgttcaaggtgtctgcacctgaatgtgccctgagagtgtcaggctcggacatggggaccagctcccttttcacatgaccttgtcatctgtgtgacgcacgtgcgtgtgccgggtcgtgtgtttccgtgtgtgtgtgcacaagcacagacacgtgcacgtgtggagcatcccatctctgcatggggcacgcttgtgagtgtgcacccacatacacagagccgggtggtccactgaaagggcctggcagtaaacagcttcctgtgcacattgtgtgtgtggcaggggcatgggggcatgtgtgtgtctcttaaggacagtggcgctgcagggagagctccgtgtgcagctgtgggaggtagcctgcaagcagcctctgcagaagcatcctggccataagcgaacgtgcggtcagggcactagtggggcaggggcctgggtggcggccagggctcagcagaggcctgtcccgccctgtggcctggcggcggtggctggcgttcatcactgttcgttaacgtgctcatcggtacagcctggtttcccgcaatgtggccgcttctgctacctgagcctccgagcctcctgctgtggcagttctgggcagtcgcgtgagccgtgtgcacctgcctctctgtccgcgtgtgcgcctgtgcacccctgcccgggggtggccatggggcttctccccaccctccctcctcctcagtggctggtggaaaccacagggtggcccagggaccctggtctcgtgggggctcaggtgggccggggtttgttcttgccttccatcagagtgtgttaaacaggcctcaggccttcctgccatcagcactgggcccatagggctgggaatccagtgggggtctccatgtggttcccagctggggcattcctgggcctgcaagcggtggccgtcacttgaccttgaccagaagccccaagccggtaaatgctgtgctgtcctgagtgtggtgcccagagcagggctgcaaagacctcccgcagccacagccatggtctgggccaccatgcctgctgtccagatgagcccaggcaggagcctgtgtgtccacagggtgagctgtgcctgagggccactctgggtctccttgttgggctcagcgccagctcctgaagaacccagcaggcagcctgcacggaccaggcccagccagggtaggctcctacgtcctgcagaatgacatttccaggctcagactggaatccccaggaagcaaacctcagatgccagcgcgggggaaagggtggggggagccttctattgtcccaccacacgtcctggacggatggctctcccaccaagaagaaggcttgagctgcatcttgtactctcagaaaagaggaaaataaaacatctggtgccctggagtggcgtcaggaagcagcgcgtcatcccagcccctgctctttgttgacgaccagcctcagtgggagctcccggtctcctgggggccggcgcacagcaacgtcggtggcccaggggcccagcctcctggggacaggcaggcagatgaggcagccggtgtggggcgagctcccaggcccacgttcccagccagcaggcctggcccttcgtgggtgctgggctccttacatgtgctggtgggacataccttgtgtgtgacgccgagagcctgggagacatgtgccatcccgcggctctgttcctggtgctttcgccgagtcacacggggtcgtcctggtggtcagggtctcttgccggcctctccgctcatcagagtggtgggtttgggttaggcagttggccctcccgaggctccagtcccatccgtggctgaccactgtccctctccctgcaggtcacagtcaccaccatcggctatggggacaaggtgccccagacgtgggtcgggaagaccatcgcctcctgcttctctgtctttgccatctccttctttgcgctcccagcggtaggtgccccgtgggtgcgttttccctggctccttggacagctggggtcctggggtggctgcacgcccctccctgtgagcagacccacttacgttcagaaccaagagggtgcttcccttctagaaggtgctatactccagagccccacctgccctccctggggccctggatgcagacttcccgtttgcagtccccactggggtccttgcaggcagtgtgggaggcagcctggagtggctgtgcatgggcgcagtgtggggcaggcctgctcactcagccctgggtgggtgggcaatgctgctaccacgccccatggaggcagaatcttgtgcctggagagggcacttccacgctgtggctgggggggttttgttccatgtcctttccagaaaccacagattgtaaggtgatgtgtctagttcacaatgcctgtatgtgggtgtgtgtgtgtgtgttatgtgcgtatgtgcataatatgtgtttgtgttgtgtgtgtataattttatgttacctgtatactatgggtatgtgtatatgtatcacatgggtgtgtatgtactgtatgtgtgcgtgcatactgtgtatacatattgtatgtgcatatgttgtatttagtatgtgtgctgtgttgtgtgcacatgtatgcattatacatgtatatcagtatgtttgcatatgtgtatttatgtatctgtgtcacaggtatgtatcctatacatctatgtgcgtatatgtgtgtgcacatgacatgtagacatgtgttagtatgtgcttgtgttagtgtttgtgtgttagtgtgggttagtgtatgttttagtgtatgttagtgtgtttgtgtgttagtgtgtgggtttgtgtttgtgtttctgtgttagtgtgtgtgttagtgtgcgttagtttgtgtttgtgtgtgtatgttagtgtatgttagtgttagtgtgtgttagtatgtgggttagtgtgtgtgtttgtgtgttagtgtgtgtgttagtatgtgtttgtgttagtgtgtatttgtgtgtgttagtgtttgtgtgtgtttgtgggttagtgtgtgttagtgtgggttactgtgtgttagtgtttgtgtgttagtgtgtttttgtgtgtgttagtgtgtgggttagtgtttgtgtgtgtgtcagtgtgtgtgtgttagtgtgcatatctattgtgtgtgtgtgtgcatcacacatgcacgtgcaccacgtgatctcctctgtagacacggagttccctagcttcagggtgggtcctttgcatcccatcaaccgtccttgggcgaggcagcagcagggtcctcctcagctgaggactgccttctcacttgcgaccccaatcccagtgcccagtatgaccccttcctgggcacatacagatggaccagcccacctggcccccagaatggtccctgggaatgggttagagcggctgcagccctgccccatgggactgggccccttgctggataagacctggggtataagttctgccccccatgctggcccaggacaggcaggctgggcccgaggtgggacttgggggggcttccagcactgaccatacctggccttcccacaacggtgaccggtaaccacgtcctgaggctgcacccagctggcagtggcctgtgtggacgggagcctcctgtccattccttcccaggggattcttggctcggggtttgccctgaaggtgcagcagaagcagaggcagaagcacttcaaccggcagatcccggcggcagcctcactcattcaggtgcggtgcctgcaaggccctggtcactgtcattttggtcactgttattgttgcatccagccctcacggccacctgtcagaaccatcattggcccctgcatcagcttggctggcctgtggggcatactctgcttgtggaagccttggctgctgtggtgatggggtgagcacggggcattggagcctgtcttcctccaaagctgctcccatcaagggccatgccctgtgggctggagaggaggcacggccgtggccatgccaggagtggacgtggttggctctgaggctcccttgtgctcccattctccctcccactgcacaacaacctgagggctgagtctgggagtggggtggccaggtgattgtccccaagggaggtaggacccagctgtgcagttggtgccttctggagggcctggcatccctcagggctcgggaggccctggtgcctggaggtgaggactggcgatggatggcatgggcctccctctgggctcacaaggccagtgggctgggaaaggcagagccctggagcaacaggggcaggaaggttctggaggcaggtggggaggcaggcagtaccaagctctgggatgctgggctctggctctgtcactccaggctctccaggacccaccagagaatgggactgctctgttaacgtaagcaaggacttggcacaggagtcacttgagaattgcgtccctgtgggtctctcttgttggccactgcagggccagggctgccctgaggaacagccgctgaggtgcccagagggtgggcgttgccgggttgaatgacaagtgcccactggggatagggcctccgcccagtgcagtggctgggagcacagtgtcagttcctctgggcacactgggcctgatgtcccccaggaaggcccaggacctgggcagcccccgctggctggcgtcccccctgcagtcctcgtgagctcgctgccccaggcaaggcccaggctgtcaggggccagtcgcagtcctcctgcactcctggctcagccatcgggggggctgtgtgctcccacccttagcctggttttatggcttcacagtttctccttcctgggagaccataaatcaggcccgtaaacccgccttggtcccagcatgagcatgctggccgcccacgcctggcaggggaccacattggattcctggtcccactccctgggaaccacaggtcctttgaaaggggttccctcggaagctgcacacactgtgggaggactggagtaggggccccaggtggcaggtgtgcacaggagcagggcaggggtcatggggtttgccagggttgggggaccacgtggagtgctcagcctgtgtgtgtaacactcgggccttggaaggctgggcttgtgccctcgcctgcctgtccctgggtgctggatgggagtgagggctgcaggtgcccctcgccagctgctgtgtctacctggggctgtcacccaggagcccatcagtgtgggggaacattctccactcggccctctctcaggctcatgtggccagtgatgacaaggccaccaggacatgtcctcatacaaggccctgggagcccctcctgcccatctggacgctgcacaactgctcccccgccgggtcccctgccgatagtgtcccctcctcccacccttcccttgtggtgctgccatggggtctctctgaaatgctggcttcagagctgcacccatgtgccatcagaggctcccccaactgcaaggtggtataggcctctgggagagacctcacctcctgccagccctagggatcctgcctctccctgccccctgctcagcacctgcaggtcctgggcgacccctctttctcagcccttcctcactgtgtggccactggttgcccatttccgcattggtctcctatgcacgctgtgtaccctggcacctggggatgatgtgcgacctgcccacctttgcaagtctctcctttggctcaaggctggctcagggctggtaaagacctctgtggtgtcccagctgtgggtaacaattagcccatgaggcagtgagctgcctggtgcagcaagggaccaagccaggctgcctgggcagagggtctgggagctgggaccatgtcaagcctgtgactctgaggtcccagaccctgccacccagaggggaggggccaggcctggggaacagggagggggagctgtagcttccataagggcccccgccgggtggctcagcaggtgacagcctgtccccctgcccgacctcagaccgcatggaggtgctatgctgccgagaaccccgactcctccacctggaagatctacatccggaaggccccccggagccacactctgctgtcacccagccccaaacccaagaagtctgtggtggtgagtagcccacctgccaccagggcagggccttcttgctagcaggtggggaggccgtgggggccgcagcacgaggctgggatctcaccatgcatttggcttggtacagcctgtgtcagggagtcagcatcgttcgggacactgggccatacacccgatgctaggttcctgccatcccaatgtcccccgacttgggggtatgtaggaccggtcattccagggccagggcatgagagctccagagatagagctctgggagcaggacgggctggaaagaaggctcttcagagggcctcagggttgggctttccacaccgggcgcagtgggtggtgagcagtgggcagggggccgcgcgcagtgggtggtgggaggggagcagcaggggagggaggtgaggcaggggtgcagcgaagggggtctggaggtcacagggcagtggagtttggcaggcgctgggcagaagtcttgtgacatggctggggtcataaggggttggggctgacgctggcatggttccccttcctggcccgtgcccaccccctgtggagagacctggccttcccagtttccagctgccggtggagcctccgtgcctactgttccctgtgctggaatgttcccccagatttccacacagcctgctccctcacttcaggcgccctcttcatgccctgctggcccccagcctgttcccccgatatgcattctcccctactggtcacagcccctgttaccacctccactggcaccatcttgtacgtttatctgcttcctgctgtcctgttagcgaggccgtgagctcacagggcagcacctgggccaagccccccacgtgacccccagcagccctgccctgtctctgtgtgaagacactggagctggccccaggcctcaggtccctgtccgggtgtatgtggcgggggctgggctcggggcggctgcacaggcactctggggccggcgtagggcctggcagacgatgtccaggaaccgctaatctgttgtcttgttttttttaggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctggtgagaacccctcaggcagttgggggccgcggggccgggaaggtcactgccttttttgggagcccgagcaagccagtgagtttctcccttgggctgtggtctctgacaacgaggtatgaacagacagagggtggagcttctagaaacttctgtaaaccttccaggtgccttcccctcagagtcttcccaaggaggagctggccacgccttctgttgcgagaggaagcctgggcaggtgatggggtgggtcggctccatccggctgtactgagggaagggtgtgttcctgattccagctgcctggcttcctcccagccgagcccacgggctctggttggaaagtggctagggtgacctctgggcctactggcagggacgccagagggaaggggtttggggatggggccctggaggagcagcaccaggcccgggtaaaacgtggggggcctgacgggacaggcccttctcatgcagcccaggggccccgagtctgtgcgtgatggtgtggctcggatctgcgtccctcctctcacccctgcagcgggggctgggatgaagctaccttctgcgggacctgacgattggatggcagacctgtctagggtttagatgtcctccatccctggtgaggggttttacccacgctaactcgtaagcgtggctctttgacagatgtggagagcgaggccctagaggctgggctcgtgtgctccagccacacggcgggaatacagcagtgcccggttgtggctcccacgagtgaggccctggaggctgggcccatgtgcttcagccacacggcaggaacacagcagtgtctggttgtggcccccccatgcctcccgccaacttctgctgttcccagaagtgcagctggctgagcacagacacagcaggtgacctgtggtgatgccagggcatcagcgcttggcctccccacactgctccagggcagacctggcctcctggctgcatcaggaggcacacgtgatgcatccgtcatctcgggaccagttttgagacaaacatcctatagggcaggaccgtgaactgggtagctctacagagtgtgaggggctggagacctcctgcccactggccacggatgccacggatgcccttgagagttaggagaggtggaagggaccccacttctccctgggagctccaacttctcttgcatgtgacttcagtgcccacttctggggactgtgatcccaaactgccaaattctctagcagctctcttaaaaccaaatgtgaaggattctggctttttctgtcctctgagcccagcgtggggtatttgagatagctgtgctgccaccaggacaggggcgtgcaccttgtcttcccaggagaaaacacagcaaagcctgtttgctccctagtacctcgtgcaaaggtgccatctgtggccctgctcgctgcttcctctgaggcagacatagtagtgactgtgttctgatacaaagatggcacttgcccgatgctgcactgcagcaccaatgcagaggccctggcaaatgttcgcagaagcccccgtcccagggcgtggtcccccttggaggaaaagggcacctgttttgaaaacacttggttatcatggtgccagaaagcactagtttaggccccacatgaaacagtggccttgccctcccagcatgggagagccctcatcttccaggtggtggggggagcacagcatttgaagcccactcccctttgaccacttgctgttgtccagacagacatcacgcacgtgggccttgcattggttcctgcttactttgtctctgctgacccggtttctgctccttgaagtctcagcccccttcttccatgattccaaggcatgtccctctaaggaggcttgaccccaccctggagggcctgctccccactctctgccttccatgccccatgggagggctccatgtggcccagtcccttggaggctggaccccactgttccggactctgggctgttggaagccaggccctgcctcagttgtgccaagtggccagggttctatgcctggcagaggaggtgtgggaggccaagcgctgatgccctggcatcaccacaggtcacctgctgtgtatgtgctcagccatccaagtaatatgatccattcccttctcagcagccgtccctttaccctttggtcatttctgcatccatctctccctctcggacctcttcccagtgcctgggactaacccgaatgtctcagcttaccagcagttgtaaggatgctgtcacatcttatgcatggcagagaggggacaaacccacagtgttcgcaaccctttgtgctcgcaggcaccagcccagcccgccaagctccagttcattcaggatggctcacctgcatccccacctccttggcaggaggctgggtggtgttccctgccccttggggctttcctgggcatcccatgtggaagtcagcaggcaagaccaagtccaggctcccgctccactgggcaccaggctccccaggacttagatgccatcaggattgggctgggacccgaccacatctcagtgagcccccgggacgtgctcccgcctgcccgctggagccggcacaaagggcgattgtgccaaccaatgcccagtgcccccacagctccggattcagggctgagaccattgtctccatgcaaatgggggctttctgcgcatgctaacgggcaggtgggcgtggccgggggctggggacccagcctgtgtgcggcctggagaagcatcgcttgctgcttgctgaatgcggggcagcccgaatcgatgccgtccattcagcctggttagtgttatgaagtcattagtgctgtctgcggaatgttaatgaggggcaagtgcggagaaagtcaggcgccttttgtggaatgctcctccacggagaagatttctctttcctgctggagtttgttctttcctaacttgataagtcagcccaggctggaaccaccagctttctggagcctgagctgttggcctggcccccagggacagagcgacccctgataatccggagtcccctttgcccaggaggctcttggagagccctggcttggggagaaggagatgctgatcccagggcagatgccactcctggggaagccccacagccccactcccgcaaggcgggtacgaacagccacactgagtcccccgcaaagtcaaacccaggcctcgaccttgtctggctgtgctttctgttgtgtgaacctgcaggttaggcagaagtccccttgaccctgcctcagggctgctacctgtctgcgccatccacctgcacacaagccccttcagctcgtgctctagctggtgctgtgcggtgttggccccatttatagatggagaaacggaaggccagggccatgtggggaactcctgaggacacctgtgtgtcctgacacctcactgagcctgtcgagaggcacaggcaggtatggcagtggcagacctcaggggagggaggctgggaaggtagaaggtcccccatggtagcatcagaacacagactaacctgcagcaaaaatgggctgtgtggtccctgtagagcagcctcactgaggggaggcaccagccctcatcccacgcagcagggcccgctgctgctccctcaaccttctgacctgggtggggagggaggggaatgtcagcagccacccagcccgagagccagagcacagcaggggctggccagcctagccctagagtctttgcagtgaagcgtcacagactcctcatgaaggatgcatggggacccaaccgcatgccacttggcttggcagtgtcaaagggactggggacctgcgaggatgcggtggccattgtctgtgcccagcctggggagcctgacactcacagcccggctgctgctgccttgggcgtcctgaagatcctctgtatgcttgtggggtgggggcagacacacaggcagcctcctgcccagagggtccaagcgggcatggccatccacatctgcaggtcagaagaggcctgggctggagccgcatactggccatgctgcctcgctgtccctgcctcagagccactgtattcactctgcctggaactgtctttcctggatcccaggagtcctgaaggagccgcctccatcctgagctgcctaccctgcccctcctccactccagttgtctccacagccaggtcaccattgaccaggttgtccagtcccctcctcataggggagtggccctttgtctttcaccactgacccttcccaagctggtaccatgcctaacccatggtgggtacacgataaaaatgcagggctgtgccaccagggttttgtcttgacaaagggactggaggcaggttgtcagagtagggctggccggaggtggcctcctgaatgcccctaggaggccagaggagacttccccaaattcactggtcctggaggccgcctcagaggccttttgctgctcagagaacactgggctggaaggtcgtggtctgtgacgtaggatcggggaggccacctcagaggccttttgctgctcagagaacactgggctgtaaggtcgtggtctgtgacgtaggatcgggcagcacgcacctttccacctggcctggaggtgattctgaagggcttctggggaggcgtcttcaaagctgtgcctgtgtgtgtcaccacgtgtttgccaggtgacctgggactattgtgtggtttcccgtttgtgaagtggggcagcgtgctggaggagcatgcatcacatacccagaggtccccagtgtggtctggggactcatcgttcacactcgtgtgtgtgctttctggaggcatgcgtcatggaacagcctcacctctcacttctgcacttgtgagcctggttctcacagggtcaggctgtagcctcctcctgctcccggctccgcgtcctcagcccaacacaccaagcctggcctttcatgcactcctccattcaaagccgtgtgttctgattgtgcacttttggtggctgccacaggattaaatcctgaatgctttgccagttgagatcaaaagtcaccccaactcctctgaaacctcactgggacctcaaggtgctccagatcctactgcctcctgccgtttcctgggcctttgttgcccagtattttggttttgtcttttaaacaatcctctttttgttgatgctgcatacattgagatatttactcacagacttgcagttttctgtctcaccatttggatttaatttcctttttcctgaagtctgtgtttctttcagtgaaggtaaactctcagtttcagtttgtctgaaatatttttactttgcctttattcttggatgatggtttcgttgggagaaagtaacaggttaatatgtacattttgtctgaagactctggagctgtaacactgcagtctcctggcttctgtgggtcatcaggctaattgattttcctttgtaagtgaccctccctacctctagtgacttcagaaaccttccttttgactttagtgttcagaggtttcaatgtactgtaccaaggtggtgcattatttttatttatcatgcctacactttgttgtgattcctgaatctgagggtttatgtctttcatcaaccgtggaaagtcagtaccattatgttgtagaatattgcctcccctaatgcttctgatcttttccagaaacttctatttgaccatctcattgtcttcctcagctgtctcatagattttctatctctgtctccctctgcttcattcacagaattttctatgcagtttctaactcttgagatgtttctgttccactgctttatctacccactgagactttcagttatatattttttccttccctataaatccttgtatgggggtttaatttgcttgattttagcatcttgtacctttctcatattttaaactacaacttttaatctttaggtcatttgaacatgcatattttgtaccctctatcctgtcatttcatcatctgcagttcttggagagtctaattctgttcactgtagttttttctgactcttgctcatgatggctcatttcattgtgggtttgcaatttagatcatgagtttgtgtggtggatgtttttgtttgtggggttcctatgtatcctgtataaggtacatgcctctggagaagctgcacttttgcttgtacagggtgacccagtgaaccaatccaggaccttcatgatccatgttttagatatgggatcttctagacaacctatgcagtgtaaacagaaaccccaatctcctgtgagagcaagtctaagtaacatatattgagaagagagttttattttataaaataaaactgtctttatttgcagaagacatggttatctatgtagaaaatctgatgaacatgcaagatgaccactatgactaatatatgagtttagtaaggtggcagatacaagattaatatgcaaaaatcaattccattcatatattcttgcagcaaataaccagaaattgagatttttaaaatacaggcgtgtctcattcttattgactgcactttgctgataatgcattttttacaaattgaaggtttgtggcaaccttgctcaagttgaagccagtactcacgtaccatttcaacaatcctagggcccttaagaattatgctaaatctactctgcttatgctctataatgaagcaacaaagcccgatgacagtacatctgttgacaacatggtttactgaatatgttgagcccattttcgagacctattgctcagacaaaaagatccctctcaaaatgttactgctcattgacagtgcacctggtcatccaagacctctgatggagatgtacaagattagtgttgttcttatggctgctaacacaacatccattctgcagcccataatcaaggagtaatgccaactttgaagtcttattatttaagaaatacattttataaggctatagcggccatagatagcgattgctttgatgaatctgggcaaagtaaattgaaaacattttagaaaataatcaccattctagatgaaattaagaacattagtgattcatggaagaacgtcaaaatatcagcattaacaggaattgggaaaaagttgattccaaccctcatggatgactgaggggttgaagatttcagtggaggaagtaactactgatgttgtgaaaactgcaagagaactagaattagaagtggagcctgaagatgtggctgaaatatcattagttattagagaaatgcaaataaaaaacacaatgaaataccacggcccaattattatattatataaaatgagggagatggatgataccaagtgttggtaaagatgtgtcggaggtggaactctcatatgctcccggtgagaatgcaaagtccaaagcgatgcaaccatttgggaaacagttcagcagtttcttgatgtgttaaatacatacctaccatattctacagcgattctattcctaggtatttatccaggagaaataagatcatatgcatgccaccatttgtacatggaatattcatagcagctttataaaaactggaaaccccaaactggaagcaacccaaatacccatcaacatttgaatagatttttttcaaagttgtagtatattcctaaaatggaatactacttagaaatacaaaggaatgaaccactgatatgcctacaatatggatacattgcaacataattatggtgagtgaaagaagccagacaaaaaaaaaaagagtacatggtatcttatttatgtaaaaatctagaaaatgaccactaatatagagtgacaaacaagtcagtggttatcagtggttacctggggatcaggggtagtagtaggagggaaaaggacaaaagggcacaaaaaaacttttggggcagtggatatgttcattatcataatcatggcgatggtttcatcatgtgtcaaaagttaccaaattgcacactttaaacataagcaagttatgtcaattatatctcaataaaactgtttataatatataatgtaaatatataatatatattttgcatagcaaaaaaacatactgaaaataattttttattgataacctaaagaaaccagttgccactcacctataggcatggggctaatttaattgctatataaaaacgctcttgtaaatcaagatagaagttaaaggatattaaaacagttcacagaaaaggaaataccaataattcttaagaatgaaaatatgctggatgacttcaattatgacaagagaaatgcaaactaaagcaatggggtttttgaaacttatctgattattaaatatcaaagagtttgataacactctatgggtatgtgtacatggaaactctcagtctcagtcattgatgttagaaaaataaattgatacaaacctctgtggagataaataaggcaatttcaatcaaaattaaagatgcatatgcctttgaatcattctagaaatttattctacacatatcttacacatttgcaaaataatccatcatcaggatattgatttctgcaattgttaaatagcaaaaaattgcaaaccaccgacatacccatcagtggaggtctgcttcaagtatcatatctccgttaaacagccatcaaaactgtgaagcttcactctcatcactgatgcaggacatccctgatatctgatcctagaaataacagtacatctttcagaagagtatgaaatctgccatcatgtgggggcaaatacaatggtttacaaaacaaagttttatctaccttccttgttctgtgtcttggaactgtttgaagaacattgggattatcttttctgtagaggttaaatagaattgagttgtaaaaccatctgggcctgatacatgttttataggatatctttagtaatttctttttagtctgttttatgatatgttgttctaaattagtttattgcatcttttggagtaatttattcattgctatttaatttcctcaagcatttcaattgtgttgccacttggtagcaactgattttttcctttagtgattttatggtcttctctatcatctcttcgtttttcttttcctttatgcctgaacttttgtggtttttctccttttttcttaatcaagcacatgagaaatttatgttttatttatattttattatcagaaaactatctttgtactctttgttatctatttcattaatctaagcttttatagctattaattcccttttcttggctaactctatttttgttttcttttacttaagagtcatagttcatttatttgaagttcttctactaaaggcatttttaaaggctataaattttcctctgattgcagctttagctgtgacacgtagatctgattatgaaatatgttccttttcattgctttcttgatagttttaattttgtgttttgatttttctctttagagttcttttaatgtcttcttaatttttaagcagtaaatttttatcactgttatttatttctaatttagtaggcttacagtgaaaggatgtagcctatgaagtctccactttttttaaaatgaagattttctttgtctccaagtatgaaaataacatcattatttttgtaaatgctccacagacctcagaaaatatcttctgtatttgtataacacaaagttttatttgtatacatggacagacaaaatgtacattgagatggattgtgtatacatacttattcattgcctcatttaggtctgctctgcccttagttaaaaaaaaaaaaccctaatacatctgccaaattctgagacaggaaaattaaatcttcctgtacaattatgtttctaaaaattgagtggcaggtttcatggagtggtttggagcacagcctatatggccaaccttctttagggtcatagcccagctctgccattttcttatgtggccctaagcaagctactgcattctctgtgcctcagtttccacatctgtgaaatcaggatcctaactgcctgctcccaggactcctgtgttgactgagtgagttagaacatgtaagtgctcacccaggacccatatgcagcaaacagtcttgtgtctctgtctgctgccaaattggcctcaggctctatcaataccagatctgaataggggctattctttcttttagtgtccttaatgttgtattactttccaatattcacactttaactttacagatgagtagaatggaatagatgtgtttcagtacagaacttttttcttatgtttgcttgggctcccctcctctctgttacctatgttgataatctaggatttgttgtcttacatttttcctgatgttcatataatattcaatgaaataaaatacatgtgacataatgaaggcattatcattgttttccaaactcacgggatcatatcatacctgctttctgcatcttgtttttctcaatcagtaaaatagtaaaaatgcctctaaggctgctgaaacaattttattttgatttaattctatctctaattgaattttatttctatttcaattctattctaaaatttataatctctgcttaatttcctttggtgtacatactctgtgatgttctctatcgcttaaaattcattttgttcaagaacataggttcttgaacctgtttctatgtacagaacttttatttctatgtgttaactttccaggatgtattagtttgctaggactgccataacaaaataccacaggctgggtggcttagacagcagacatgtatttctcacaattctggaggatagaagtctgagatcaaggtgtcagcaaggctgctttccctgaggcctctttccttgccttgcagatggccgccttcttcctgtgtcatcacatgaccattgctctgggcacttgcaccctggtgtttctctgtgtgtccaaatatccttttctttaagggcaccagtcacactggattagggcccaccctaacagcctcattgtagcttcatcacctctttaaaggtcctgtctccaaacatgctgagtcacgtgccgaggtattaaagaccagggcttcaactgcaaaccttgtgggacacaattcagcccgtgacacaggaataggcttgttaatttcagtgatgtagccaggttgtttttctcgttttgtctgaccttgaattccacaggcagggttcctctttcccggccggcattcctgcccaccagtcctggcagagtgacttattgtcagccaagtggggcagagtttctccactgtacctctattgaaatctagtgccggataattctttgttgagggaggaagtcctgtctattgcaggatgtttagcagcatctccggcctcagttatgaccaccaaaaacatctccacatgttgctacatgtcccctggagggcaaaattgcccccagttgtgacctgctgagctaaagcagtccctcaggattgtttcttaaaacaaaacaaactgtttatttggccataattttgaactacagaaaaattacaagcacgagatataaaaacacctacatacccttcactaagatttaccagtttactaattgttacattttgccacatttgctttatcatttgaacccctttctctacattatattcacataacatgtttttctgaaacatctgtgagttgcatactccacagctctttgcccctaaacattttgctgtgtatttctgaaaaataaagatattatctttgaaagcagtaatacagttattgacttctgcaattaaacatcaatataatacttggacctaatttaatgcctatgttcccattttgtcagttgccatgacaatgtcctttgtggcattttttcctccactgcaagatccagttcagggtcagtactgcctttagatgtgtctcttcagtcttgtttaatctggaacatttctagtctctttctctgttatgacactgatattttttaaagatacagtcctgccacttcttgggggagtctgatgtttcctcaggttagatccacgttgtgtactctgtaagtgacctgatgtccttctcagtgtatcacatcctgaggcacacagtgtatctgccccttattaacgatgttattttgatcaccaaattgaggccgttatccacttttctaccttacagttactatattttgccttgcaaccaataaacaatcgggggagattctttaaggccatgcatataccctgctacttgttaaaaaaaaaaaaaaagtctctccagatttaaatgcttttggaaaccaggctttactgtggtagttgcaaaaatgatcattttccaactctagcaccccttccacgaaagtacagaaagaaaaaaaaatactgtccagttggaatggttacctcattgtggttttgatttgcattttcctaatgatgctgagcatttttccacgtgcctagtgcccaattgtgtatcttctttagtgaaatatttattcagatcttttgcccgtttaaaaaaatgagactttcaagctttttatttttagacattcatatgcagtggtaagaaataatagggatcccatgcaccctttagttagtttccgtcagtggtagcatcttctaaaaccatagcacaatatgataaccaggatgtcaacagcaagagtccagatgcagagtgctcccgtcgccacggggttcccattatttgtccttttacacggactttctcccatcccatccctccaatccctggtgaccactcatctgttctctgattctctagttttgtcttttcaaaaatgccacgtaaatggaatcacacaatacacgatatcttagaaacggggtcttttggctcggcatcattctctggattcattccggttgttttgtatcgcgacagttcattaaatcatagtgctgagtggagtttcacggtatggacatataccccagtttatttaaccattccctcatccaaggacatgtgggtcattcccagtttgggctattacaaatcagagtaggctgaacaatggcccccaaagtagccaggtcctaacgcctagaacctgtgactatcgccttctatggcaaagggcactctgcagatgtgtcaaattaaggaccttgagatggagagatcatcctgggttatctgaatgggcccggtgtaatcacaagggtccttataacagggaggcagaagaatgactacagaagagaaaaagggttacgtggccacggaagcaggggcaggaaatggcaatgtgatttgaggaaggggtcacaaaccaaagaacgcttccagaagaaaaggcaaggaaagggaagggatgctcccctgaagcctccagaaggaaccagccctgctgacaccttgatttttcgtcccctaagactcttttcagacttctggcctctagaactgtgagaaaaaaaaaaaaagcgtgtcttgttttaagccactaagtttgtggaaatgtattacagcagccatgggaaccttatacattgataaggatgacatgaatattcttgtaaggttcttgtgtgaacataagtttttatttctttgggataaaagcccaagcttgtaattgctgagttgtgtggcagttgcatgtttagttttataagaaactaccaaactgattttccagagtgactgcaccatttcacattccccattcctgccagcaaggtctaagtgatctagtttctctgcattcttgctggcatttgatgttcacactgtttttaattttctccattcagataggtgtgtagtgagatctcattgtggtttacatttacatttcctcattaggatgatactgaacatcttttcatgtgcctgtttgccatttttgtattctatgcagtgaaattcttgttgatatcatttttccatttcccaattagactttttgttaactgtcgagttttgggagatgtttatatattctagatacttatcttaagtcagaaacagggtgcaaatatttattcattgtagctttcattgtcatcatctcaacagggtactttacagagcaaacattttaaattttgatgagattcaatgtttcctttttatggattacacttctgatgtcaggtctaagaagtctttggccctggaccccaaatatcttctgctatagcttttttctaacagccttgtggagatatagtttacataccatacaattcacccatttaaagaatataattgaatggtttttagtataggcatacctcagagatattgtggttcggttccagtacactgcaatgaagcaaatattgcaataaagcaagtcacacaaattttttggtttgccactgcatataaaagttatgtttatattgtagtctattaagtgtgcaatagccccatgtctaagaaaacaatgtgcctaccttaattgaaagacactttattgctaaaaaatgctgacccagaatgaagtgagcacatgttgttggaaaaatggcactgatagacttgctcagtgcaggcttaccacacacatttaattttttaaaaacacaatatccacaaagtgcaaaaaagtgaagtgtgcctgtgtatccccagagctgtgcaactgccactccagtttgagaacatttttatcattccaaaaagaaacccagtgccttttaaatatcacccccaaacccactattccatccccctcagccctaggcaataactaatctttctctctatgggtttgcctattctggacattttatataagtggaatcatacaatgtatggtcctttgtgactggttactttcacttagcatcatgttttcaaggtttgtgcttcagtgcttctttttttttccccgagacagagtctccctctgtcgcccaggctggagtgcagtggcgcgatgtcggctcactgcaacctccgcctcccgggttcaagcaattcacccgcctcagcctcccaagtaggtgggattacgggcacgcaccaccaagcccggctaatttttgtatttttagtagtgacggggtttcgccatgttagccaggctggtctcgaactcctgacctcaggtgatccgcccacctcggcctcctaacctgctgggaccacaggcgtgagccactgcacccggcccttgtgcttcattcttttatgaatgaataatcttccatcgtatgatatacaatgaataaacattttgtttatccatttatttgttgataagcattttagattgtttccacattttgactactatgaataatgcttctagaacatgtgggtttttgtgtggacatgtgttttcatatctcctgggcatgaaagagatatgaaaggctgggtgtgttggtggctcacacctgtaatcccaacagtttgggaggccaaggcaggtggatcacctgaggtcaggagttcgagaccagcctggccaacatggtgaaaccccatctctactaaaaatacaaaaattagctgggcatggtggcaggtgcctgtaattccagctactcgggaggctgaggcaagagaattgcttgaacccgggaggaagaggttgcagtgagccgagactgtgccactgcactccagcttaggcaacagagcaagactgtttcaaaaaaacaaaaagaaaggaagaaaagaaagagatatgaaaacacatgggagtggaaagctgagtcaaatgatcactatcttttttttgagatgaagtcttgctctgtcgccaggctggagtgcagtggcgcgatctgagctcactgcaacctctacctcccaggttcaagcgattcctctgcctcagcctcccaagtagctgggattacaggcacatgccaccatgcccagctaattttttgtattttagtagagacagggttttaccatgttggccgagatggtctcgatctcctgacctcgtgatccacccgccttggcctcccaaagtgctgggattacaggtgtgagccacagcacctggccgataactatctttttgaagaactgaccaattatttccaaagtgggtgcctcattttacattctcaccaccagcatatgagcactgcgcaagttctccatatcctcaccaacacttgctattatcttttttcaattatagccatcttagtggttgttaagcagtatctccttttgggtgtgatttgcatttccctgtgactactcacgttgagcatcttttcatgtgtttattaactatatgtcaaccctgaagaaatttctattccgatttttcatccattctttaagttgggatatttgtctttttgtttttgagttgaaggagttatttatatatccagtaacaagtcccctatcagatagattatttgcaaatattttctcccatctgtaggttgtcttttcactttctttaaggtgtcttttgaagcacaaaagcttttaatttttatgaagtccaatatatctactttttttcttttgttccttgttctttggtgttatatctaagaaacctctgccaaatccaaggtcataaagatttacccttatgtttaccctaagaattttatagctttatctgttacgtatttatgtctttgatccactttgagttaatttttatatatgatgtggagtggaccaattgatttttctcatgtggatatcagttgtttcaacactatttgttcaaaagactattctttccgcattgaacattcttggcatccttgtcaaaaatcaattgaccatagatatatggctccgtttttacactctgattctattcccttgatctacatatctatctcatgccagtatcacattttctcgaatactgttactttgtagtcaatttggagatcaggaagtatgaagcctccaacttttctttttcaaaattgttgctattctgggtcctttgcattttcatatgaagttgaacatcagcttattattctacaaagaaaccagctgagattctggtaaggattgtgttgagtttgtagatcagcacgattccgggagtgttgccatcttaacaatattaagtcttccagtctatgagcatgtaatgtctgtccatttatttgtatcttcttttctttcaacaatgttttgtaattttcagaggataagttttgtacttgttaaacttattcccaaggtattttattttttctttattatggtaaaaatatacataaaatctactattttactcattttaagtatatagttatgtggcattaggtaaattcgcactgttgtgctttattcttttttgatgttatacatggaattgttttcttaattatattttcagattgttttttgacagtgtgtagaaatacaattgatttttatatactgattttgtctcctgcagccttactgaactcattcgttgtaattgtttcacaatggattccttggggttttctgtatacaacattgatacggtttggatgtttggtccctccaaatctcattaaaatgattcccaatgttggaggtggggtctggtggggggtgtctggatcatggacggagccctcgtgaatggcttggtaccatccccgtggtaatgagcgaattcttactctggtagtttatgctaagagctggttgtttaaagaatctgctacctccctccaccttgctcctgctcttgccatgtgatatgcctgcccctctgcctttcgccatgattgtaagcttcttgaggccctcaccaggagcaggtgctggtgccatatttcctgtatagcctgaagaactgtgagccaattaaaatcttctttataaattacccagcctcgggtgttcctttatagtaacacaaaactggaccagcacaaatttatgtcatctccaaatagttctacttctttctttcagtctggattctttttcttcccaaattatcctggatggaacactcaataaatgttgaatagaagtggaaagagcagatctctttgtctcattcctgatcttaacggggaaacattcagtcattcactgttaagtatgatattatctgtgattttttttttttttttttttttttttttgagacagagtctcgctctgtcacccaggctggaatgcagtggtgtgatcacggctcactgcaagctccacctcccaggttcacgccattcttctgcctcagcctcccgagtagctgggactacaggcgcatgctgccatgcctggctaatttttttgtatttttagtaaagacggggtttcaccatattagccagtatggtctcgatctcctgacctcgtgatccacccgcctcggcctcccaaagtgctgggattacaggtgtgaaccactgcacccggccaactgtgatttttaatagatgccctttatcaggttgaggatgttcctttctattcctagtatattgagtagggctttttctcccatcatggaagggtgttgaattttatcacccaaatgcttttctgtgtcttttattctatcattaattgctatagactgaatgtgtgtgtttcctcaaaatgtatatgttgaaatcctaacccccaatgttggtattaggaggtgaggcctttgggaagtggttaggtcatgagggtggagacctcatggaatggattagtgcccttgtaaaagagacctcagtgagctcctttttttcttccgtcatatgaggacacaagaagacaactgttcatgaaccagaaagcgagtcctctccagatgctgaatctgccagtgccttgaccttggacttccaagcctgtaaaattgcaaaaaataaatttctgtgtttataagccaccagttcgtgatactttgttataacagtctgaacagactgacagaaatcgtggtgttttgtcttttattctgttgataatggtgtattacattaattgattttcagatgttaattcaaccttgcattcctgaaataagtcccatttggttataatgtataatcctttttaaacattgcttgattttacttgctagtattttgttgagggttttgagggttttacatcattttcatcacagttattgtaatgaaatacaaaaatcaatagtattcctatacactgtcaaaaacaatctgaaaataagaaaacaattctatttacaacatcaagaaagcataaagcacaatagcgtggatttacctaatgccacagaactatatacctaaaatgggtaaaataaattttataagttctcttttcatgtttttgtctggttttggtgtcagggtgatactggactgaaagaatgtattggaaaaattttccttctcttctatttttttgttgttggaagaggtcataaagaattgatattctttagatatttgttagattcactcatctggccctcttgggcttttcttttcaactagtgttctcataactaattcaatctctttaacttattacagatccattcacattttctacttatttcttagtcagttttcatagttttcatctttctaggaatttgtcaatttcatctaagttttataatttattggcacaaaattgttcatagtgttccttcataatcctttttatttctgtcaggttggtagtatacttccctcattcattcctttttccttttctttttgagaaacagagtctctctctgttgcccaggctggaatagagtggtgtaatcatagctcactgtaacctcgatctcctagtctcaagtgatccttgccccttagcctatgacaggtgtgcaccacaacaccagctgttattcaaaaaatattttgtagagatagggtcttgctttgttgtgcatgctattcttgaactcctggccacaagcaattctcgaactcctggccacaagcaattctcctgccttggcctcccaaagtgctgggattacaggtgtgagccactgcagctagcctcgtttttttgctttaatttgtaaaactgtcattcatttctgattttagtaatttgagttttctctctccccctttgcctcatgcacttccctctctgtctttcctcctccccctctttcttcctccccttcttttcttctccctctccctctctcttaccaatctatcaaaggtttgttaatttcaaagaaccaaattttggatttgttgactttattatttttatattctatattttatttctactctaatatttattattttgttttttctacttgctttaggtttagtttgctcttctttttctagtttcttgaggtggagagttggcttactgatttgaagccttattttttgatataggcattcatagctataaaattccatctttacactgctttaaatgtatcccataagttctgttatgttgtatcttcattttcattaatctcaaagtacgttccatttcccttgtgaattctttcacccattgattatttaagaatgtagtgttgtttaatttccacatgtgtatgtttccctaatttctttgctactgagttctacttttatttcattatattcagaaaaagataccttgtattatttcaatccttttaaatttatgcaggtttgtttcgtgacttagcatatggtccttcttggagaatgtctcatgtgcacttgaaaatactgtatattcaatgttggttgttgggcgaagtgctctataattaccttttgagtctagttggtttatggtgttgctcatatcttctgtttccttattgatcttctttcttgtactacacattattgaaagtggagtgttgaagtctccaactactattgttgaattggctatttctctgttcagttctgtcagtttttgcttcttatgttttagttctctattgttaggtgaatatatgtttataatcattgtatcttctcatgaattgacattttatcattatgagatattcatatttaacttcagtaacattcttaatttaaaatctcctttgactttattatagcacttcaggttacttatggttgctgcttacatgatatatctttttccatccttttactttcagttggcatttatcatctaaagtgtgcctcatatagatggaatacagatggatcctgtttttcaaatctggtctgataattcctgcctttgattagattgtttaatccattcacatttaatattattattgatataattagatttatatccacagttttacttttggtcttttctatgtactatttcttgttcctctatttctcctttgctgctttcttttccatctagtgactactttctaatataaattttcatttcttttatgattcttcaatattctatttgttattagtgtttgctctagggcttaccttatgtatcgtctcaaaatttacttcatatttatattaatcctggtgagatacagaagttattcctgtatgagtttattcagttttaccactttttgtggtattgttacatatattacatctttattatgcgctattataatgatcatactatataatgatatatctttaaagaagctgaaaggagagcaagtatatatttctagtttctgttttattaacctccttatatcatatatttgatccacttttttggtttttatggatttgagttaccaactggtggtatttccttactctagaacagctttgctcctatttacctccttgctctttgcttttggatatatgtgaacttcctgggagcacttcctttttgcctgaagaacttcctctagtagttcttacaaaactggtctgctaacaaggaattctgtttttgtttatctgggaatgcttttattttgccttctttttgaaagaaacttttctggacacagtattcttggttggctttttttttttttttttttttttttttttactttgagcacttgggatctgttaccccactactttctgggtaccactgtttctgacgaaaagtcagctccacatttgtctccctgacaccagaacaggggagggtattaagcagagtgccacatagcctcacctcccaccatttcatccaagaatagtagttgggtaatagttcaataactcactctgaataattgatagaacaacaagacagaaaatcaacaagagttagtactattattgttgagttgtctattattgttcagttgtctgtttctctcttcatttctgacagttttatttcatatacttcagggctgtgtttttagctgttataaatttttatttctttatgacttctgtttatgatttctatttcttcctgttaaattttcccttttgtcattgtaaaatgcttctcagtatctctaataacatggtttgtttttaaagtctattttgtctgattttatttatttttattttatttttgggatggagtctcactctgttgcccaggctggagtgcagtggcgtgaccttggctcactgcaacctctgcctcccggattcaagccgttctcttgcctcagcatcccaagtagctgggactacaggcatttgccaccatacccagctaatttttagtagagacagagtttcaccatgttgaccaggctggtcttgaactcctgacctcgagtgatctgtctgcctcagcctcccaaaatgctgggattacaggtgtgagccactgcacccagccaattttgtctgattttagtacagtcactctagctttcttattactgtttgcatgtcatctttttccatcattttactttcaactatgtctttgaatctagaatgtgactcttatagaccatatatatttggatcctgcttttaaggcagtctggcaatctctgctctttattgagtttttaattcacttatatgtaatataattattgatatggaaggatttatatctaccatgttgttatttattttctatatgtctcatatcacttttgttcctctcttcctcctttactgccttctgcaggttgaatagatatgttctagagtaccattctaattcctttgttagtttatttcccccatttttaaagtgtaatctggaggttacaataagcagcttaagcaaaaacaatctgcttcaggttaataatctactcaaatatttttgtctgccctattctctccttctcagtactcttattaacacatatgttgttactccttaattccacatatgttttctactcttaattacatatatgttacaacttaattacacatacattgttacacatcctgttaggacaggggttcccaaccccagggccatggactggtaccagtctgtggcctattagaaactgggctacacagcaggaggtgagcagcaggcaagcaagcattactgcctgagctctgcctcctgtctgatcagtgatggcattagattctcacagagagcaaatcctattgtgaactgagcatgtgagggatctaggttgtgcactccgtatgagaatctaactaaagcctcccccaactggctgtggaaaaattgtcttccacaaaactggtccctcatgccaaaaaggttggggaccactatattatggtatccaatgggtatctcttcatttttcttcattatttttctttctattcttcagtctgaatcatctttatggatctgcgttgaagttcattgattctttcttctgccaggtcaaatttgcttagccgcactagtgagtttttcacctaagttattatatttcacaactacagaatttctatttggtttctaatttctatctctatattgatattatctatttgatgagtctttgtcatcacacttgcattctttaatgtggtttcttttggttctttgaacatagttataatacttactttgaaatcgcgccctaacatttggggcccttcagagataattcctatttattgctcattattcttgttcaagggtcacaattttctgtttctttgcatatctcattttttttgttaaaaacttactttagataatatatcgtagaaactctggattctagttcttctccctaaccagggatgatttctgttactcatttatttgtttgctcgcttgtgtatgccttctctgcatggattctgcagagtctgtgttctcctgcagtgtgcagccactggtgtctttgctcagttttgtttgttttaattcttatgtttgttttgtaagcctggcttcattggtgtcacccctggatcagcataacctagtggtcaagccatgattagtcagacatttgtttaaacatcttgagccagtgaatcttccaccctctgctgaggggatctatgtgtgggttgggacattcaaagttcaggcactttataactctgtcctgtattttactgtctgcttgcaaaaggtctcacagtcagccaaggataagtagatagcaggaaacctctctgatctctcctgcaagcatgtacaacttccatatctccagaattccttttaaaatttttcttaatctgtcgcttgcccaaccagtattgaaacattaggttgctgtgatgtgggttgcctccaattatttgccactgaaatccttgttgcttaacatagtgcatagggttttctatggaattcaaaatcagatgagccttctttgttgctggtcctcaagcctaccgtgcccctgagcttgggtggggagatggcagccccacgttaaatcataaccctgctattcttaggaaggcttaatattttttctttaattagcacttttcaattttatatttctttgtccagttttatcattgcttttcagggagtggttatatcaaggtgctcattccaccacctcagaagtggtccctatcttgttaattttattttttgaatacatataacattaacatacttccaaaagtcaatactaaacaaaaggagctactgagagaaatcttcctctcacccatatctcttccatcctaattccccctacccattataggtaaccagtttcagtgttttctagtttatagtttgtgtgtgtttgctctttataagacatgattattttctcatttcccaaaaaagtactattctgtatatgcccttttgaactttgcttttctcacctaacaacatctcctagaaatcactcaacatccattcacagagatctttctcattgcattgctaaagttgcatagtattccttagtgtgactgtgctataacctttcaaccaatctcttatgcttgcatgtgtaggtggtttctagatggcagctatgctcaccattctttggctttcctaccatgtctctgagatacatctactccataaatcgaatctacccccaagaggtgattctctgagggtgccacctcaaatcttagtcatttgcaagagcctccactatagctgctgctctggactacctatttctgacatgtgttctccatgttgacatttaatatagagtcttctttttctggtgataattctgtctgtgctgctttttagtcttctgtgcaccctttaaattttttaagtaacagaaaccatttcaaaatgtacaattcagtgtcacttagtacatttacaatattgtgttttttgtgtcttttctaagaatttatttccaatctcaagtcataaagatttactcctgttttctactaagaaatttatgcctttaactcttattttttggtctctgatacattttgagataatttttatatgctatgagttatgggtccaacttcattctttgatatatgaggatccagttgccccagcaccatttgttaaaagactactcttcccactgaattcttgatacatttgttgaaaatgaattgatcatatatgtgagtgtttatttctacattctctattatattccattggtctatatgtccatccttgtgtcctagagaccacattgtgtcagtaccacattgttttgattactgcagctttgtaaaagttttgaaaatggcaggcctgagtcttccaactttgttctttttcaatatgattttagattgtttggggccctgggaaaattccatttacattttaaaatcagtttttacatttctgcaaataaaaaggcccttgggattttgataagggttgcattgaatctgtagatcactgggtaatatcgccaacttaacaatatttaatcttccaatctgtgaacacaggatgtatagttctatttatttaagtcttctttaatttttgtcaacagtgttttgtagtctttagtgcagaagtctttcaccttcttgttttaatttattcctagctattttactctttttgatgctattgtaagtggaattttaaaaattgacttccttcttgggctgttcattcctggtatatagaggcacaaatgattttcttaaaataaatgttgaacatgtaccctgcaattttgctggacttgtttattagctctactagtttgtggattctttgattttctagatagaagatgtcattattgaataaagagttttactgcttcctttccaatttggatgctattcatttacctgtttgtttatttatctgcctaattgtcatggttaaaactttcagtacattgttcaatagcactgggtaaagcatacagccatatcttactctttgttatgggagaaatttttcagttttttttctcattaagtatattagttgtggatttttcacaaatcctctttaacacattttgaaagttccatgtttttatcctgaaaggttgtagaattttgtcaaatgcttgttctgagtgaattgaaatgattgcatggattttttatccttcattgtattaatgtggtgtattacattgattgatactcttgtactgaaccacccttgtattcttgagataaattccatgtggtcatgatatataatcctttttaatatgctgctgaatttggcttactagtactttgttaaataaaagattttagtatctagtttgtcttttcttgtggtatatttgtctggctttggaatccatgtaatactggcctcatagaatgtattgcaaagttttttctcctctgttttttggaagagtttgagagggattggtgtgaattcttcaagtgtttggtataattcaacagtgacgccatctgtgtagcattttcttcattggaaggtttttggttactgattcaaactttctacttgttatgggtctgctcataatttcaatttctgttttggtctgtattagtattttgtgaattcgtccatcttatctaggttatataatttgttggtatacagttattcatagtattcttttatcacactttttatttctgtaagatcagttatatcgttcccacttttgtttttttttcttatttttgtttttttttgttgtgttcctacttttgtttatgattttagatatgtgcaacttctctaattttttattagtcattctagttaaaggttttcaactttgatcttttcaaaaacaagcaacttttggttttgttaaattatctctgttgtttatttaagctcgaattcagttttatctccactcatacatattatttcattctctcttttaactttaggtttacttcgttcttctttctctggttacgtaaggtataatattaggttatggatccttcttctttttcagtgtgggcattcacagctataatttttcctctgagcacttctttcactacatcccataagtctgagtatgttgtgtcgtcattttcactttttgaaagtattttataatttcccttctgatgtcttctttgacacaataatttttaaagagtgtgtagttttatttccctgaatttgttaatttttaggtttttcttctgttacagatttctggcctcactatattgtagttagagaagatattttgtatgatttctatattttaaaatttattgagactcttttgtggcctaacatatcatccctcctagggaatgttccatgtgcacttgagaagaatgtgtagttgggtggagtgtccatatatgtttgtaggtctagttggtttatggtattgttcaagtcctctcttttcttattgggcttctgtctggctgtacattatcttgttgtgttttttttttttaattttaaaaatatgcatatttagtgtataaaacatacagttaaatcgttaacatagtgatgcaaattaatatgtccatcatctcacagttattcttttgtgtgtatgagtgagaaaagctatgatctactcaattggcaaaaattccaaatgcaatatactaactattctcatgttctacatgagatctctagacttgttcatcctatatatctgctacttggtatcctttgacctacatctttccattttcttcccccacaccttgcccatggtaaccactagtttattctatctctgtatatttgacttttttctttttaagattctacatataggtgagattatttaaaacttttcatttgtatatggcttatttaacttagcacaatgtcttccagtttcatccatgtggcaagtggcaggatctccttttttaatgcggaataatattccattgtagacatacacaccacagtttagtcatccatcaatggacacgtaagttttcatatcgtgactcatgcatataatgccacaatgaatataggagcgcagatatctttatgaggtggagatttcattttctttgggaatatacctagaagagggattagtgggtcagatgatagtatattttcaatttctttaggagccaccattctgtttttcattatgactgcaccaatctacagtcccaccaacactgtacaagagttccctaaccctagccaacacttaatagctattctcatgagtgtgaggtgatatcgcatagtaattttgatttgcatttccctgacgattagtgatgttaaatgtcttttcatatatgtgtttgccatttttataacttctttgcaaaaatgtctactcagttccactgcccattttttaattgggttatctattttcttgttattgagttgtatgcattccttataaattttggatattatcctcttataagatatatggttggcaaatattttcttctagtccataggttgccttttccttttgttgactgtttccgttcctgtgcagaagttttttagtttgatggtataccaattatttgtttttgtagcctgagcttttggtgtgatctccaaaaaatcactgccagagccatgtcgagcttttcccctatgttttcttctggttgtgggttttggtcttatgtttaggtcttttatccattttgagtttatttctatgtatggtgtaaggcagcgatatcaaatcttttggcttcccggggccacactgtaagaacaattgtcttaggccacacataaaatacactaacaataacaacagctgatgggctaaaaaaatgcaaaaaaattcaatgttttaacaaagtttacaaatttgtgttgggcctcattaaagccatcctgggcttacatgtggtctgtgggccatgggttggacaagccacagaactgggtttcctaacgtcatttatgagagagactatctttctgcattgttttcttcgtgttcttgtggaaaattggttgatcatatatctttgaatttctttctgggctctctattctgttccactggtctacatgtttgttttttatgccaggaccatactgtttgatcaatagttttgtaaaataaaccagaaagtatgaagtctccctttgtttttcagaacagaattttcagaatttcgttggctacttaaggttcttgctattccaaatgaactttagaatttaaaaaaattttccatgggattttgatagggattttattcaatctgtatattgatttggatattattgacattttaacaatattattcagattcatgagcatgggatatctttccatttatttgtatcttgtttaatttctttcatcaatgattcatagttttcagtgtacaggtctttcatctttttggctaaatttattcctaagcaatttttttgatgctatcataaatgggattgttttcttgatttcttttttggccaggtcattatttgtgtatagaaatgcaactactgttttatattgattttatatcctacaactttactgaactcatttattagttctaacaggttgctttgtcagagtcttcggggttttctatatgtaggatcatgtcatcttcatataaagataatattacttcttacttcctgatttgaatgtctttcatttctttttcttgtctgtttggttgtactagtacttccagtactatgttgagtagtagtagctagagtgggcatccttgccttgtactggttcatagtagaagggcttctgttttccctcattgattataacgttagctgtgggcttttcataaatggcattcgttatattgaggagtgttccttctatacctgaactgttagaatttatcaacaaaggatgttcaacttcatcaaatactttttgtgtgtcaattgagatgatcatgtggttttcatctttcagtctgttagtatcacattgattgctacatgtatattaaataagatttgcatgccagaaattaattccacatagacatgatatataatctttttgatgtattgttaaatttagtctgccaatattttattaaggatttttgcatcggtattcttgggttatgttggcctgtagtttccttttcttgtgatgcctttggctcacctgggtatcaaggtgatgctggcctcataaaatgtgttaggaagtattccctttagctgcatttttttttttttggaagtattccctatagctgcatttttttggaagagtttaagaagtattggtattctttgaatattgggtagtattcagtcatgaagctatctggtcctgggcttttctttgtttgaggttttggggtttttttaacttttatttttgatttagagggtatatgtacaggtctatatgttgcatggtatatggagtatactgcatgatgatgaggtttggagtgtggataagcctatcacccaggtagtgagcatagtacccaataggtaggttttcagcccacctctccattcctcccccaagtagtccccagtgtctactgatcatctttatgtccatgtttactcagtgtttaggtcccacttgcaagtggtaacatgcagtatttggttttctgttcctgcattaatttgcttaagatagtggcctctagctgcatccatgttgctgcaaaggacgtaagttcattcatgtatatatatatattttttttttttattttttttttagacggagtttcgctcttgttgcccaggctggagggcaatggcatgatctcggctcactgcagcctccgcctaccgggttcaagtgattctcctgcctcagcctcctgagtagctgggattagaggcatgcgccaccacgtccagctaattttgtagttttagtagagacagggtttttccatgttggtcaggctggtctcgaactcctgacctcaggtgatccacccgccttggcctcccaaagtgctgggattacaggtgagagctaccgcacctggccgaattcattcatttttatggctgcatagtattccatggtgtacatgtaccacattttctttatccaatccaccactgatgggcatctaagtggattccatgtctttgctgttgtgaatagtgctgtgatgaacatacaaatgcatgtgtctttttgatagaacaatttattttcctttgaatatatatccagtaatgggattgctgggtcagatggtagttctgttttcagttatttgagaaaactccaaactgcttagcacagtggctgaactaatttgtattcctgccaacagtgtataagcgttcccttttctctgcagccttcccagcaacttttatttttttgactttttaataattgccattctgactggtgtgagatggcatcccattatggtttggtgtttttttgttgttgttgttttgttttgtttttttttgtctgttttttgcttttttgtttgtttgtttgttttttgagaaagagtcttgctctgtctcccaggctggagtgcagtggcgcaatctcggctcactgcaacctccacctcctgggttcaagcaattctcctgtctcagactcctgagtagctgggattacaggtgaccgccaccatacctggctaatttttgtgtttttagtagagacggggtttcaccatgttggccaggatggtctcgaatacctgaccccagatgatccacgcacctcagcctcccaaagtgctaggactacaggcatgagccaccgtgcctggcctcattatttgcatttctgattattagtgatcatgagaatgtttttttgtttggctacttctgtattttcttttaagaaatgtatgttcctgtcctttgccaattcaattggattattcgttttttgcttgttgattggtttaagttccttatggattctggacataggacctttgccagatgaatagtttgcaaatattttttctcccattctatatgttgtctgtttactctgttgataatttcttttgctatgcagaagctctttagtttaccactgtgatctctttgctattggtctgttcaggctttctattcctgatttaatcttagcaggttggtttttttctaggaatttgtccatttcctctaggttatccaatttgttgggatataattgttcataaaagtcccttatgatcctttttatttctgaagtacctgttgtaatatattctccattttcatttctgattttgtcctctttcttagtccaagagtttgttgattttatttttcaaaaatcaattctttgtttcaaaaattgaagtcttagttttactgacttttttcccctatggtttttctttctaacttgtctctgttctgatctttattatttccttctgttaactttggctttagtttgttcttctttttctaattccttgaggtacaattttgggctatttgaaatatctcttcttttttaatgtaggcaaggcatttattgctgtaaacttccctcttagaactgcttttgctgcatgttttgcttttggtatgttgtgttcccactgtcatttgtctgaagatatttttaagtttctgttttcatttcttctttgactctacccattactgaaagtacgttattgaagtccctaagtattattgtagaactgtctttctcactccaattctgtcagtatattttcttatattctggggctctatattttggtgtgtatacgtttccaattgcgaagtcttgagtaattttccattttctcagtatgtaatgtcctcctttgtctcctataacaatttttaaattcaagtttatttcttttattagtataattacctccagctttctttaggttactatttgtatgaaatatcatttttcattctttcactttcaatctacttgtgtctttagaccaaaagtgagtttgttatatacagcataggttgatggttttcttttaaatccattctgccaacctctgctttttggagaatttaatcgacttacatttaaagtacttacttataaaaaagaagttctgacattttgtgccttttcttttgccttacattttttaaatacaacatttcctcccttactgcctttttttgtgtttgatgattttctgatagtgtaccattatgattctctattcgattgtctgtatgtgtgtatgtgtattttaaagactttatatttttagagcagttttagggttccagcaaaattgagaggtaagtacagagatttcccgtatacccactgcacccatacatacagagcttttcccattaccaactctcccaccagagtggcacgtttgttacaacttatgaatctgcatttacacattattatcaaagtccctagttaacattagggctcactgttggggtgtacattctgtgggtttctacaaatgtgtaacatgttgatatggtttggctctgtgttcccacccaaatctcatcttgaactgtaatccccatgtgtcaggggaggggcctggtggggggcaaacttcccccttgctgttctcatgatagtgagttctcatgagatctggttgtttaaacgtgtgtggcacttcccatctcactttctttccctctcctgttctgccatggtaaagatgtgcctgcttctcctttgccttccgccatgattttaagtttctgaggcctgccagccatgcttactgtacagcctacaaaactgtgagtcaattaaacctcttttctcacaaattacccagtctcaggtagttctttatagcactgtgagaacggactaatatgcatgtatctaccattatagtatcatacagatacgtatatttacatatatttgtacattttcactgccctaaaagtactctgtgcactgcctattcaacccttcttccccaacaacccttggcaaccactgaactttttactgcctccatagcattgccttttctaaaatgcaatatgattggaatcatacagtatgtagtttcttcagattgccttatttcacatagtaatatgttttttaattacctccatatcttttcatggcttgatagctcatttctatttagtgatgaataatatttcattgcctggatgtactacagtttatctgtctactcacctatggaaggacatctcggttgcttccaatttcaacaatcacaaataaagcttctgtaaacatctctgtgcagatttttatgtgaatataagtcttcacctcctttgagtaaataccaaggatgtgattgctgaactgcatggtaagaatatgtttaattttataagaaaccactgatttcgatatactctggattcttcgggggatatgtatacacattcagaagtggaattgatggatcctatgataattccatttttaattctttgaagaaccaccaaactcttctccaccagggctgcaccactttacattcccattaatggtatatgtcaaagtggctgtaccattttgcattcccaccagcaatggatgagtgttcctgttgccccacatattggcaagtatttggtattgtcagtgttttgaattttggccattctaataagcgtgtagatatatcacatttcttgttttaatttccatttccctaatgacgtaagatgtggggcatcttttcatatacttagttgccatctgtatatcttcattggtgagatgtctgttaaggtcttcagtccattttgtaatcagattgtttgttttctaattgttatgtttttaaggttctttatatattttggatgagtcctttatcaggtatatcttttacaagtattgtctcccttctgtggcctgtcctttcatcctcttgacagtatgttttacagagcagaaacttttatttttaacaaagtctagcttatcaattatttctttcatgaatcatgcctttggtgtcatatctaaaaagccatcaccaaactaaagatcatctagatttcttcctatgttatcttctgggatttctatttgttgttgatttccaaatcttttattgtggcaaaatacacttaacataaaaattaccatcctaaccaattttagtgtacaattcagtgaatgtattagatacgttcacaatgctgtgcaatcatcactatcatccatctccataacacttgtcatttgtaattatgaaactctatatccattaaacaataattccccaacccccccaccaccgccatctcttggaaaccaccttgtactttctatgtctctgatttgactattctacatacctcatataagtggaaacatacagtacttctcttcttgtgactgctgtatttcatttaacataatggcctcgaggttcatccatgttgtggcatgtgtcaaaatttctattttttttaaagctgaataatattacattgtatgtatataccacattttgcttatccattcttccatggacatttgggttgcattgatgttttaactgttgtaaataatgccactacaatcgtgggtatacaaatatatctttgagactgcttttaatccttctgggtgtatacacagaggtggagttgatggatcagataattctgtttttaatttttgaaggaacaccaaactgtttaacacagaggctgtaccattttgcattcccactaacagtgcacaaggattccaatttctccatgtcccttccagcagtggttattttctgtttatgtgggatttttttgagacaagatctggctctgtcacttaggctggaatgcagtggcatgatcatggcacactgcagcctcaacctagacctctgggcttaggctatcctcccaccttaacctcccacgtagctgatactagagatgggtctcactatgttgcctaggctgtgtttatttttttaatagtagtcatctgagtgtatgtaaggttgtggttttgacttgtatttcctaatgactagagatgttaaacaacttttcacgtactattatccatttgtatatcttctttggagatacgtctgtccaagtcctttgcccttttttttttttttttgagatggagtctcactctgttgcccaagctgagtgcagtggtgccatctcggcttactgcaacctctgcctcctgggttcacatcattctcctgcctcccgagtagctgggactacaggcgcccaccaccacgcctggctaattttttgtatttttagtagagacggggtttcaccctgttagccaggatggtctcaatctcctgacttcatgatcctcccgcctcagcctcccaaagtactgggattacaggcgtgagccaccgtgcctggcccttttgcccatttttcaggtgcattgttttttggtgatgacttttagaagttctctgtataatctggacattaatcccttatcaggtatgtgatttgcaaatttttctcccattctgtaggttgtcttattgcttagttgatattattttaatgcacacaatgtaaatttttaaaatttatctagttttacttttattgcctgtgcaagtacaatttatctatttttacttttattgcctgtgcctttggtgtcgcatacaagaagcactgccaatgatgtaaagtttttcccctatgtttccttataagacttcatagttttaggactttgacccattttgagtaagtttttgtacacagtgttaggtaagggtctcaacttcattctcttttatacatggttaggtaaggatctcaacttcattctcttgagttaatttttgtgtatggtattaggtaagggtctcaacttcagttatcctggcaccatttgttgaaaatacagcactttccctattgaatggtcttggcactcttctcaggaatcatttgatcatgtatacaagggtttatttttgggctctctattcaattccattggtctctacatctttatgtcaataccacatagttttgattactgtagcttcgtaataagttggggtttttgtttgtttttcagacattcttactctgttgcccacgctggagtacagtggcattatcactgcttactgccacctcaatctcccaggctcaagcaatcctcccacctcggcttcttgagtagctgggaatagaagtgtgtaccattacacctggccaattattttattttttgtagagatgaggtctccctgtgttccccaggctggtctcaaactcctggactcagaagtcctcccacctcagccttcaaaagtgctgagattacaggtgtaggccattgtacctggcctgtagtaagttttcaaatcagaaagtgtgagtcctccaatgttgttcatcattttcaagaatgttttagctattcaaggtcccttgagattccatgtgaattttaggatggggtttcttctttctgcaaataacatcattaggatttttattgggattaccttggatttgtagattgttttgtgtggtactgacaccttaacaatattggccttccaatccatgaacataggaggtgttttccctttatgtctactttaatttctttcagcattgttttgtaattttcattgtacaagactttcacctccttggtaaagttggttcctaagtttgttattcttgatgcttttttcagcttttattgaggtataattgacaaattaaaagtgcatatatttaagaacatatttgacctactgtgaaatgattactacaatcaagccaattaacatataccttacatagttgccatgtgtgtgcgtgtgtgtggtcagaatacctaagctatactctcttagcaaattccaagtatagaatatattaactatagtcaccaatctggacgttatgtcaagaacttattcatctgataactctatgtttgtacccttcaacatttcctatttcccctactccctgacccctagtaaccacccttctactctccgtttctctgagttcaagctttttagaattccatatgtaactgggatagtgcagtatttgtctttctgtgtctggctatttcacttagcataatatcctccaggttcatctatgttgtcataaattgcatgatttcctgctttttaaaggatgaatatttcattgtgtgtgtgtatatatgtgtgtgtgtgtgtctgtatgtatatgtatgtgatgtgtttatttgggaatttggtgatacacacacacacactattttcttcctttctttttgagacagggtctccatctgtcatccaggcaggagtacagtggcacaatcacagttcactgtagcctcaacctcatgggctcaagtgatcctcctgcctcagcctcctgagtagctgggaccacagtcatgcacccccatgcccagctaatttttaaaattttatgtagagatagggtatcactatgtttcctaggctggtctcaaactcctgtgttcaagctatccttcaccttggccacccccaagtactgggattacaggtacaagccaccatgcctatgaatactatgttgctcatttcttgactactgtaacactacaatgaacatgggagtgcagatacctcttcaagatactgactttgttttccttagatatacccggaactgagactgctggatcatatagcagttccaattttaattttttaaagaaaatctatcgtgttttccataatgactgtatcaatttacattcctaacaaaaatgtataagggacaccttttctccacatcctcaccaacacttgctatcttttgactttttgataatagcgattctaacagttatgaggtgatatctcagtgtggttttcatttgcatttccctgatgataagtgatgttaagcacctttttatatacctgttgaccatctgtatgtcttctttgaataaatgtctattcagtcccttgtccatcttaacaggttattaattgggttattaagtttttttgctagttatatgagttccttatatatattggatattaatagcttatcagatatatggttggaaatattttctcccgctacatgtgctgccttttcattttgttgtttcctttgttgtgcagacacttttttgtttgatgtagttctaatttatttttgcgttttattccttgtgcttttgatgtcacatctaaaaaattgtcacaaaaaccaatggcaaggagcttttccctgttttataggttttatggtttcaggtcatatgtttaaatcttattcacttttctctacagtgtagggtaaggttccaatttaatttttttgcatgtggatatcctggtttcacagtgccatttattcaagagagtaccctttccccattgtgtactcttggtgtctttgtcaaagattagttgaccataaatgtgtgggtttatttctatgctttctattctgttccattggtttatttctataccagtaccataactttgaaatataattcaaaataagcatgtgtaatatctttcactttgttcttattgctcaagtatgctttagatctttaaggtcttttgtagtttctttcaaattttaggattttttttgtctatatctgtgaaaaaaagtcactggaaatttgataggcattgccttgaatctgtagatcactttgagtagtatagctatttcggcaatatttattctattgatctatgaacaccagatatctttccatttatttgtatcatcttagaatttgttcaatgtttcatagttttcagtgtctaggtcttttatctccttggttaaatgtatgcctaaatgttatgcagtccaatttctctattttttattttatctgtgcctttcatattatatccaaatgaagtcaataccaaatccaatgtcatgcagtttttgccccatgttttcttctaagagttttatagttttaggtcttacatttaggtctgtggtccactttgagttaatttttgtatatggagttaggtaaaggtctcgacttcattctctcacgtgaggatatccagttttcctggcaccatttgttgaaaagagaatccatttgccattgaatggacatggcatgcttgtcagaaatcatgcgttcatatatgaaaggatttatttgggagctctctattctttttgatgctattttaaatgaaattgttttcttaatttgtttttcaggttgtttattattagtgtatagatacgcaaatgacttctgaatgctgattttgtatcctgccactttactgagttagattattacttctaacaggttttttttgtggagtctgtagcattttctacatatatgatgtcatctgcaaacagagacaattttacttccttctttctgatttgagtgtatttatttatttttcttgcccaattcctctggctaggacttccagtactgtgttgaatagaagtggtgagaatatctttttcttgttcctcatcttagaggagaggcattcagcttttcagcattgagtatgatgttagctgtgggctattcatatatggcctttattgtgttgcagtacattccttctatacctaatttgttcatagtttttatcatggaaggatgttgaattatgtgaactgcattatttgcacttatcaaaatgattgtatgatttttatctttgattttattaaagtatcccatttcttgtatatgtacacttaactgtccttatgtactaaggataaatcccatgtttgtgatatatgatttttttaatgtgctgttaaattcagtttgatcatattttgttgaaaatttttaaatgtatagtcataaaaaaatatcagccagttattttcttttcttatattgtccttgtctggccttagtatgagggcaatgctagccttgtaaaataagttgggattgttccctctttgtttggggggaatattttgatcttatacttcccccgctacattttatttttgatgccccaaggtacaccttttaatattgcatatccattgagaaattatgaaaacaatagtaatttttaattatttttcttttaacctttatactagagttatgtgatttatatactaccattacactattagagtattcttaagttgcccgtatatttatttatcagtgaattttgtactttcatatgttttcatgttactaattatcatccttccatttaagcctgaataactccctctggcatatcttgtaaggcaagagtagttgctgataaactccttcaacttttgtttacctgaggaagtcttgtatctgtttcatatctgaaggacagctttgctgtgtaaagtattcttagatggcagttttttatctttcagaactttgaatatataatcctattgtttcctggcctggaaagtttttgctcagaaatccactgatagccttatggaggttcctgcagatgtaagaactttatttatcttgccgctttcaaaattatcttgtcttccattttttacattttgatggcaatatatctaggtgaaacctcttttagatggaaactaattgtaattctttgagcttcatgtacctagatgtccatcaatctgggaagagccccagatatgggaagttttcagccattatttctctgaattaactttctaccctttacctctctactttccttctataaatcctgtgtgaacattaactctcctgatggtgtcccataaatcctgtaaacttcccttgttaccttttcattctttatttttctcctctactggttattttcaaataatttatcctccagttgatgaattcctccttctatttgatcaagtctgctgctgatgctttctatttcacttttcatttcatgcactatattcttcacctccaaaatgtttgttttttttttaggatttctatttctttattgaatgtctccttttgtgtattaatgatttcattaggttgtctctctgttctctggtagcacactgaacttccttaaatcagtcgtttttaattttctgtaaggcaattaatgtatcccaatttcttgggagtcagtccctgaaaattattgtatttctcaggtgggtgctatgtttccttggtttttctgtttcttgttacaatgaattgaaatctgctcacttgatggagtgttaagtaggtagggtgcagcagctgtagcccagatgaggatataatggaatactcttcttgcagctccatcagctgaggtcagcagtggcaaacattacaaaggtccttggtggccaaggctgagtgtcctgatgctgtcgtgtaaatagagttgtgttaataatatccctttcagattgtttgtgattaatgtatagaaatgcaactgaaagctgggcgcagtggctcacgcctgtaatcccagcactttgggaggctgaggagggcagatcacaaggtcaggagatcgagaccatcctggctaacatggtgaaaccccatctctactaaaaatacaaaaacattagccaggcatagcagcgtgtgcctgtagtcccagctacttgggaggctgaagcaggagaatggcgtgaactcgggaggcagagcttgcagtgagccgagatcgcgccactacactctagcctgggcgacagaccaagactctgcctcaaaaaaaaaaaaaaaaaaaaagaaatgcaactgaattttgtgtactgacttactatcctgctactttgctgaattaatttattcagtttttgtggtgagttttcagggatttctacaaatatgatcatatctatgaacaaacataattttaattcttcctttctaaatgatgcctttatttcttttccatattctttggctagaaagccactactatgtttaatataatggctaaaatgcgcatcttgctttattcctgatcttagaggaaaagctcttagtcttttcaccattatgatgctccttgtgggtttttcttctaggagtctttttctttgtccttttatttttagtcaacatgtaataattgtagatatttatgggatatacacagtgatattgtgatacatgtatataatgtgtcataatcaaatcagggtaattagcatattcatcaactcaaatatcatttctctgttttgtgagcagtcaaaatcctccatctttctgtgcctaatttcatttaacatattatccaagttcatccatgttgctgtgaatgacaggacttaatgctttattatgactgaataatattccattgtgtatacataccacattctttctctgcatctgctgatggagatttaagttgattccatatcttaactgttgtgaacagtactgcaataaacatgagaatgcaaatatcttttttatatactgatttcctttcctttgagtcaatacccggtagtggattgtcaaactgtatgatagtctacttttagtttttttgacaaaacaccacagtattttccataatgactcactaatttatagtcccacaaatagtgtattatttcccttttctctgcatccttgccagcatttgttatgttttgtctttttgaaaacagccattctaactgaggtgaaataatgtctcactgtggctttgacttgcatttctgtgatgagagatgttgagcattttttcacatacctgttggccagttgttctattttgcacatttctaaatcagataatctggtgttttttgctgttgaattgtttgaattccttgtatattccggatattaatcccttgtcagatgaatattttctcccattctacaggatatctcttaatagtttattatttccttttatgtgtaggtttttagtttgatacagtcccatttgtctatttttgtttttgttgcctgtgcttataaagtcttacccataaaatcttcgctagacccatatcctgaagggtttcccttctgttttcttctagtactgtttgcttcaggtctcatgtttaagtctctaatcaattttgagttgatttttttatatgctgagagatagtatagtttcattcttctgcatatgatatcctgttttcccaacatgatgtgttcaacatggtgtcctttccccagagtgtgttcttggcacctttgtcaaaaaccagttgtctgtaaataaatttatttacttctgggttctctattctgttccattggtctatatgtctgttttatgcccattgcatgctaatttggttaccattgttttgtatacaagggggattgcttccgagaccccctgtatataccaaaagccatgtatattcaagtcccagagtcagccctgtgtaatgcgcatatacaaaatgtcagtcatctgtatacatagttttcacttttgtgaatattgcattctatccttgttagattatggggaaaatccacgtataaatgaacctatacagttcaaatctatgttgttgaagagtcgactgtattttgatgtcaggcagtgtagtgcctccagcttcattctgcctgctcagtattgtttgtcctatttgtggtcttttgtggttccatgcaagtttaaggattgtgtttttgctatttcggtgaagattgtctttggtatttttttttttttagatttctcttttctctctctctcccttttttttattatactttaagttctagggtacatgtgcacaacgtgcaggtttgttacatatgtatacatgtgccatgttggtgtgctgcactgattaccttgtcatttaccttaggtatatctcctaatgctttccctcccccctcccccctccccccccaccccacaacaggccctggtgggtgatgttccccttcctacgtccaagtgttctcattgttcagttcccacctacgagtgagaacatgcggtgtttggtttttcattcttgctatagtttgctgagaatgatggtttccagcttcatccatgtccctacaaaggacgtgaactcatcctttttttatggctgcatagtattccatggtgtgtatgtgccacattttcttaatccagtctatcattgatggacatttgggttggttccaagtctttgctatcgtgaatagtgctgcaataaacatacgtgtgcatgtgtctttatagcagcatgacttatagtcctttgggtatatacccagtaaggggatggctggatcaaatggtatttctagttctagatccttgaggaatcaccacactgtcttctacaatggttgaactagtttacagtcccaccaacagtgtaaaagcgttcctatttctccacatcttctccagcacctgttgtttcctgaatttttaatgattgccattctaactggtgtgagatggtatctcattgtggttttttgatttgcctttctctgatggccagtgatgatgagcattttttcatgtgtcttttggctgcataaatgtcttcttttgagaagtgtctgttcataacctttgcccactttttgatagggttgtttgttttttcttgtaaatttgtttgagttctttgtagattctggatattagccttttatcagatgagtagattgcaaaaaatttctcccattctgtaggttgcctattcactctgacggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttacggttttaggtctaacatgtaagtctttaatccatcttgaattaatttttgtataaggtgtaaggaagggatccagtttcagctttctacatatggctagccagttttcccagcaccatttattaaatagggaatcctttccccatttcttgtttctgtcagctttgtcaaagatcagatgattgtagatgtgtggtattatttctgagggctctgttctgttccattggtctatatctctgttttggtaccagtaccatgctgttttggtgactgtagccttgtagtatagtttgaagtcaggtagcgtgatgcctccagctttgttcttttggcttaggattgtcttggcaatgcgggctcttttttggttccatatgaactttaaagtagtttttttccaattctgtgaagaaagtcattggtagcttgatggggatggcattgaatttataaattaccttgggcagtatggccattttcatgatactgattctccctatccatgagcatggaatgttcttccatttgtttgtatcctcttttattttgttcagcagtggtttgtacttctccttgaagaggtccttcacatcccttgtaagttggattcctaggtattttattctctttgaagcaattgtgaatgggagttcactcatgatttggctctctgtttgtctgttattggtgtataagaatgcttgtgatgttttgcacattgattttgtatcctgagactttgttgaagttgcttatcagcttaaggagattttgggctgagatgatggggttttctaaatatacaatcatgtcatctgcaaacagggacaatttgacttcctcttttcctaattgaatatcctttctttctttctcccgcctgattgccttggccagaacttccaacactatgttgaataggagtggtgagagagggcatccctgtcttgtgccagttttcaaagggaatgcttccagtttttgctcattcagtatgatattggctgtgggtttgtcataaatagctcttattattttgagatacatcccatcaatacctaatttattgagagtttttagcatgaagggctgttgaattttgtcaaaggccttttctgcatctattgagataatcatgtggtttttgtctttggttctgtttatatgctggataatgtttattgatttgcatatgttgaaccagccttgcatcccagggatgaagcccacttgatcatggtggataagctttttgatgtgctgctggattcggtttgccagtattttattgaggatttttgcatcaatgttcatcagggatattggtctaaaattctctttttttgttgtgtctctgccaggctttggtatcaggatgatgctggcctcataaaatgagttagggaggattccctctttttctattgtttggaatagtttcagaaggcatagtaccagctcctccttgtacctctggtagaattcggctgtgaatccgtctggtcctggactttttttggttggtagactattaattattgcctaaatttcagagcctgttattggtcttttcagggattcaacttcttcctggtttagtcttggaagggtgtatgtctccaggaatttatccatttcttctagattttctagtttatttgcatagaggtgtttatagtattctctgatggtagtttgtatttctgtgggatcggtggtgatatcccctttatcattttttattgcatctatttgattcttctctcttctttattagtcttgctagaggcctatcaattttgttgatcttttcaaaaaaaccacctcctggattcattgattttttgaagggttttttgtgtctctatctccttcaattcttctctgatcttagttatttcttgccttctgctagcttttgaatgtgtttgctcttgcttctctagttcttttaattgtgatgttagggcatcaattttagatttttcctgctttctcttgtgggcatttagtgctataaatttccctctacacactgctttaaatgtgtcccagagattctggtatgttgtgtctttgttctcattggtttcaaagaacatctttatttctctgccttcatttcgttatgtacccagtagtcattcaggagcaggtggttcagtttccatgtcgttgagcggttttgagtgagtttcttaatcctgagttctagtttgattgcactgtggtctgagagacagtttgttatagtttctgttcttttacatttgctgaggagtgctttacttccaattatgtggtcaattttggaataagtgcgatgtgatgctgagaagaatgtatattctgttgatttgggttggaatgttctgtagatgtctattaggtccacttggtgcagagctgagttcaattcctggatatccttgttaacttccggtcttgttgatttgtctaatgttaacagtggggtgttaaagtctcccattattattgtgtgggagtctgtctctttgtagatctctaaggacttgctttatgaatctgggtgctcctgtattgggtgcatatatatttaagatagttagctcttcttgttgaattgatccctttaccattatgtaatgaccttgtctcttttgatctttattggtttaaagtctgttttatcagagactaggattgcaacccctgcctttttttattttccatttgcttggtagatcttcctccatccctttattttgagcctatgtgtgtctctgcacgtgagatgggtctcctgaatacagcacactgatgggtcttgactctttatccaatttgccagtctgtgtcttttaattggagcctttagcctatttacatttaaggttaatattgttatgtgtgaatttgatccattatgatgttagctggttattttgctcgttagttgatgcagtttcttcctagcatctatggtctttacaatttgtcatgtttttgcagtggctggtaccaattgttcctttccatgtttagtgcttccttcaggagctcttgtagggcaggcctggtggttataacatctctcagcatttgcttgtctataaaggattttatttctccttcacttatgaagcttagtttggctggatatgaaattctgggttgaaaattcttttctttaagaatgttgaatattggcccccactctcttctggcttgtagagtttctgctgagagatccgccgttagtctgatgggtttccctttgtgggtaacccaacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttggggaagttctcctggataatatcctgccttgctaggttggggaagttctcctggataatatcctgaagagtgttttccaacttggttccattctccctgtcattttcatgtacaccagtcagatgtagatttggtcttttcacatagtcccatatttcttggaggctttgttcgtttgtttttactcttttttctctgaacttctcttctcacttcatttcattcatttgatcttcaatcaccgatatcctttcttccagttgatcaaatcggctactgaagcttgtgcatttgtcacgtagttcttgtgccatggttttctgctccatcatgtcatttaaggacttctctacactggttattctagttagccattcgtctaatcttttttcaaggtttttagcttctttgctttgggttcgaacttcctcctttagctcggagaagtttgattgtctgaagccttcctctctcaacttgtcaaagtcattctccgtccagctttgttccattgctggcgagtggctgcgttcctttggatggggagaggtgctctgagttttagaattttctgcttttctgctgttttttccccatctttgtggttttatctacctttggtctttgatgatggtgacgtatagatggagttttggtgtggatgtcctttctgtttgttagttttccttctaacagtcaggaccctcagctgcaggtctgttggagtttgctggaggtccactccagaccctgtttgcctgggtatcagcagcagaggctgcagaacagcgaatactgctgaacaccaaatgttgctgcctgattgttcctctggaagcttcgtctcagaggagtacccagccgtgtgaggtgtcagtctgcccctactggggagtgcctcccagttaggctactcgggggtcagggacccacttgaggaggcagtctatccattcttagatctcaaactccgtgctgggagaaccactactcttttcaaagctgtgagacagggacatttaagtctgcagaggtttctgctgccttttgttcggctatgctctgtccccagaggtggagtctacagaggcaggcaggcctccttgagctgtggtggactccacccagttcgagcttcctggccactttgtttacctactcaagcctcagcaatggcaggctcccccagcctcgctgccgccttgcagttcgatctcagactgctgtgctagcaatgagcgaggctccatgggcgtgggaccctccgagccaggcgcgggatataatctcctggtgtgccgtttgctaagaccattggaaaagcacagtattagggtgggagtgatccagttttccaggtgccgtctgtcaccccttccgttggctaggaaagggaattccctgaccccttgtgcttcccaggtgaggcgatgcctcgccctacttcgtctcacactcagtgggctgcacccactgtcctgtacccactgtcttgacgagccccagtgagatgaacccactacctcagttggaaatgcagaaatcacccatcttctgcgtcactcacgctgggagctatagactggagctcctcctattcggccatcttggaaccaccccacttactgcaatctttaactcccaggctcaagtcattctccatccttgacccctcaagtagctgggactacaggcatgcaccaccatgcctggataacttcttaattttttgtagagacagggtcgtgcattgttgcccaggctggtcttgaattcctgggctcaagcgatccttctgccttggccccccaaagcactgggatttccttttttttttttttttgaccgatacataatacttatggggtacatgtgctattgttacatgcatcgaatgtgtaatgatcaagtcagggtatccatcaccctcaatttatcatctctatagttaggaacatttcaagtcctcttttttattttgaaatatacattatattgttaaatatagtcaaccaactcttatcaaacattataaattatttattctaactagctgtgtatttttacccactaaccaacctctcttcaccctccagacatacctttcacagcctttggtatctatccttctactctctacctccatgagatcaacttttatagctcccacatatgataataacataagataattatctttctgtgcctggcttaaaataatgacctccagctccattcatgttgctgcaaaggacatgatttcattcttctttggtcaattagtattccattgtatatatttacctcattttctttttccatttatccactgatgtacacttaggttcctgagtccatatctttgctgttgtgaatagtgctgcaataaacacggggatgcaggtacatttttagtatactgatatcttttcctttagataaatatccagtagtgagattgctggattatgtcatatttctctttttaggtttttcagaaatcaaactgttttctatagtattaatttacattcccaccaacagtgtataagagttccctccacatcctctccagcattggttaatttttgtctttttaaaatagccattctcactatggttttggcttgcatttcccttataattactgatgttgggcttttttttttaaatatacctgttggctacttgtatgttttcttttgagaaatatctatccatgtcttttgctcactttttattggaattaatttgttgtttactattgagttattggagttcctagtatattctggtattagtaccttgtcagatgagtagtttgcaaatattttctcccattcaacaggctgtctcttcactctggtgattgtttcccttgttgtgtacaagctttatcatttaatatagtcccatttgtctatttttgtttttgtctgtgtttttgaggtcttatccataaaatctttccctagaccaatgtcctaaagtgtttccccaatgtctccttcattaatagtgatgttatagtttcatgcctcatgtttaagtctttaacccatcttgagttgattttagtatagcaagagatagaaacggtttcatttttcacatggatatcttattttcccagctccattaagtgaagagggtgctcttttcccagtgtatgttcttggcatctttgtcaaaaatcagttggctgtaaatacatggatttacttccaggttctactctgttccattggtctatcagtttttattccaataccatgctgcttttaatgctatagccttatatttttaaatcaggcagtgtgatgcatccaactttgttatttttgctcagaattgctgtggctattccagctcttttttggttccatctgaattttaggattttttctatttccatgaaaaatggcattggtattttgagagagactgcattgaatctgtagattgctttgggtagtatggtcattttaattttgttaattctcccaatccatgagaatgggatgttttttgtgtgttcttttcaatttctttcatcagacttttgtagttttccttgttagaggtttctcacctctttggttaaactcattcctagattttttgtagtggttgtaaaagataatgccttcttgatttctttctcagctggttctttattggtatatagaaataagcctgatttttaaatcctgtaactgtaatcaatttattgatcagactgaagagttttgatttttgtatttcatggtatgagttgtaatatcccctttttcatttttgattttattcatgtaggtcttctctcttttcttcttggatagtttagccactggttattttgtttcttttcaaaaaccgattttgcatttcattgatcctttatatttatttagtttcttgtttagttctgctctgatcttcgttatttctttccttctactaattttatgtttagtatggtttgttcttgcttttctggttccttcaggtgtatcattagattatttaagatcttttctaccttttttaatggaggcatttattacaataaactttcctcttagcattgcttttgcagtatcccttaagtttcagaatgttgtgcttctattttcacttgtttcagtaaattttttatttctgccttaatttcttctttgacccattggtcattcaggaacatgttaatttccatttatttatacagttttgaatgctcctcttatttatttatagttttatgctattgtggtctgagaagatatgtgatatgaatccaatttaaaatatatatatatttaaaatcatacttagtgtcctaacatataatgtatcctggagagtgttccatgtactgatgagaagagtgtatattctgcagctgttttatgaactggtctgtaaatgtctgttaggtccatttggtataaagtgcagtttaaatccaatgtttctttgttaattttttgtctagatgatctgtctaatactggaaatggagaattgaagttcccaagattattgtgttgaagtctacctttcccttcagatttgatgtttgccttatatatctgggtgctttggtgttgggtgcatatatgtttagaattgttatatcctcttggtcaattgatccctctgtcactatataatgacttcgtctctttttagtgtttttagcttaacctttgttttatctgatgaaagtatagctactcctgtttggtttttgtttccttttgcatgtaatatcttttcccattcctttctttcaactatgtgtctttacaggtgagatgcgtttcttgtagatagcatttagatgggtcatgtttttaagtccattcagccagtctgtcttttaagtagaaagtttaatctatttatatgcaaggttattgttgatatgtgagggcttattcctgtcattaattgatttctgattattttgtgtgctttcatgaagttgtcctttcacttcttcctgtaagactcccttaagcattttttgtagtgccagtgtagtggcaattaattccctgagcttttacttttaagggaaatactttatttctccttcatttctgacgaatataactttgctaagtacagtattcctggctggcaggtttttggttttgttttttctttcagcactctgcgtatataatcccatcctcctggcctgtaaagtttctgctgaaaaatctgttagtctgcaggttgttcccttgtaagtgtctacaacctcttttatcgctggttttatgattctctctttgtcttgggatgggcaatttgctataatgtgctgtggaaaagacctttctgaattgtatctatttagggttctgagattcctatatttggatctaaatctcttgggagattgggaagtgttcaggtattatttcattaaataggttttataatcttttggtttgctcttcaccttctgggacactgaaggtgtcaccttatggcatcctatagtcacatagcctttgttcattcttttctattttttctatatttttgtctgagtcatttcaaaagacttatcttcaaggtgtgaaattctttcttctgcttgttgtggtctgttattgaagctttcaaatatgttttttatttcattcaatctattattcaattccagaatatctgtttggttctttttatatctatctcttgggcaaatttctcattcataccccgaattgttttttctgatttctttgtatagtctatcagatcttctttaatattatattgaatttttcaaggtttcatcaatttctttttcactggaatctgttggagaattattgcattccttaggagttgtcatgttttgccttttcatgtttcttgtgtgcttacactggtatctgcacatctggtgtaacagtagtttcttccaattttttgatctgtctttcctaagagagtcttgttcctgaagatatatctatggtgttctttgggcagggcactttggttttgattctgggtgcctgcagtagtgtgatctccatggaatttttttcagctgtaaacagcaccagtagtgtctgggagttcctctgtagtttaggatgcagttgttggtggaggctgtggtaaagtctggctggggatagggacaccagctgggccagtcctcaggccccagtggcagcagtggctggccccgaatgcttatccttgggcccaatggtagtgtatgctggtaccagtgttagcaagtccagggaaaccaattttgggcctccaggcaacttgctcaggtgccaatgatgacagagctgggccacagggtgggtaggtccttgagctctgagcagcagatatggcttgggcaatggcagtagcagtggcagaacaatcttctgcctcccaaggtgtccatgctggtattgggatggctgggataagctggatgagcttgtcccaaggcccacaggtggcaaattcaagtgaatgccagttgtggtggtaatggtcagttgggtagggcagtcctcaagcccccaggagtgctcaggtgccaacaatactggatagggcagggtgatccctaggcccagagatggtatgcgctggcactgggagaaaagagggtgggaccaggccaggtgggcctgtcctgaggccctccagtaatgcaagaatgtactgactgtggtaggcaggcacaggaagatccctgtataccctgctgaatgctcatgttggggcagcagcaactctattgcagccctactcctggggaagttgagtgggattgctttcagtggcagcagctataaacaggcagttgggcaatgcatgcttcggccccaggtggtgactatgggcagggtcacctttcctcatggcagccttgcttcggaggtagcagagtattgccaatggctcatgctttggcctggagggagcagtcaggagtggcaaccagctttgtgtaagggatgtccatggggctccagggatgagatagagggatgtggggcccacagcagatgcagtctggtgggggttgggctatcaaaatgggactttcctgaagttgcctgaggattcaggggatgtgtgaattgcctgaggattcagggtgatctccctctctgggagctgttcattgccatttcacagtctgtaggtagcctcttgttagtctcaaggcatctatgggtcagggggttctctgactaggatttcaggagtctgctgtgggaatgtggaccactaggggctcacttacttacctttctgcacatcgaggagtctcttcatgatcccagccagtcccatagaagcagactgcctgactcccctcttatcccttgcattgggtttttcttattacttctcagttgaattccagcattctctcagaggcgatctatataaactgtggttacctacttgctatattttgtggaggaggtgagtgccagatgcctctagtcagccatcttgaagcccctgctgatatctggatagggatttcatagcatctgtatattgctataggtaaatatgatcattttaacatttttctttcaatccatgagcatgggatgtctcaaaaaattttgtagcctcttcaattactgttatcagtattttatagttttcattgtggaaatctttcacctccttggttaagctttgcttttttttgtagctattgcaaatgggattgctttcttcatttctcttttggctaatttgctgtttcacagaaatgctactgattttttgggggaggcaggggagtgcagacagggtctcactctgttgcccaggctggggtgcaatggtgcaatttctgctcactgcaaccttcacctccgaggttcaagtgatcctcccatctcagcctcctgagtagctgaacttcaggtgcaggccaccacgcccagctcatttttgtactgatgaggttttgccatgttgcccaggacagtctcaaactcctgggctcaagcaatccacccgcctcatcctttcaaagtgctgaaattacaagcatgagccatcatgtccacacctactaatttttgtttgttgatttttttatcctgcaactttattgaattcctttaccagttctaaaagattttggtggaatctttaggtttttctatgtataagattatgccatctgcaaaggacaatatgacattctcttttccaatttggataccctttttcttttacttgcctaattgttctggtgaggacttttcttactctgctgaataagaatagtgaaagtgggcatccttgtcttgttctagttctaagagagaaggtgtttagcttttccccaggtggctgtgggtttgtcatatatgaccttcattgagttatgttccttctagacattatgtgatgagcttttttttttatcatgaagagattttgaattttatcagatgctttttctgcatctattgagatgatcatgtatttttttgtccttccttctgttaatgtgatgtatcacatttattgatttgtatatgttgaaccatccttgaatccctgggataaatcccacttgattatggtgtattatctttttgatgtgcgattggattcagattgctagtttgtgtgtctgtgtgtgtgttttgtttctgaggattctgcatctatgttcatcagggagattggcctgtagttttcttttttgctgttattgtgtccttatctggttttggtatcaagatactgcttgcctcacagaatgagttagggagaattcctttctcttcagtcttttggaattgtctgagaagaattcatgttagttctttaaaggtttggtagaattcagtagaaaacccgtgcaatcctgaggttttctttactgggagactttattactgatacaatctcattccttgttattgctctgttcagattttttttcttcctggttcaatcttgggaggttatatatgtccaggaatttatctctttcctctaggttttctaattgttgacatatagttgttcataatggtctctaataatcttttgtatttctgtggtgtccattgtaagtctcctttttcatttctgattttatttattgggtcttcttggttagtctagctaatggtttattgattttctcttttcaaaaaatcagttttttggctgggtttgttggctcacacctgtaaacccagtactttggaaggccaaggcaggccgatcgcttgagtccaggagtttgagaccagcctgagcaacatggcaaacccccatctctaccaaaaaaaaaaaaaaaaattagcgaggtgtggtgctgcacatctactcagaagctgaggcaggaggattgcttgagcccaggaagcagaggttacagtgagccaagatcacaccactgcgctctagcctgggtgacagagtgagaccgtgtctcggggggtgggggggaggcctcatttcattgatcttttgtcttttttaccttttatctctatttcatttagatctgctctgatctttactatttatttccttctaattttaggtttgatttgttcttgcttttctagttccttgagatgcgtttattaggttatttgtttaaaaactttctaccttattgatgtgggtgtttattgaaataaatgtccctcatagcacttcttttgttgtaccctatacatttttgtatgctgtgtttctattttcatttgtttcaaagaatttttaaatttttaaaatcaatttcttcatagacacagtggtcattcaggaacatgtagtttgatttccgtgtatctgttcaatttcagaagttcctcttgttattgatttccagttttattccattgtggtctgagaagatacttgataagattttgacttttaaaaatttattgagacccgttttgtgtcctaacatatggtatatcctggagaatgtgctgtgtgctaacgaagcagcagttcaaatctaatatttccttgttgatatttttccatccaaatgaattgtccaatgctgagtatgaaatgttgccatccctaactattattgtattggggtctatctctttagcactaataatatttgtttaatatacctgggtactccagtgttgttggttgcatatataattgttatatcttcttgctgaattgatccatttataattatataatgacctcctttgtctcttttttctttttctttttttttttttttttttttttgactcagtattttttgtctgtctactcctgcatgcttttggtgtctgtttgtgtggaatatctttttctatccattcccttacagtctatgggtgtctttacaggtgaagtcagtttcttataggcagcatgtaattgggttttatttttttaattcatttagccagtatctatctttcatttgggaaatttaaattacctacattcaagattgttatcaataggtgaggacttactcctgtcattttattgttttctgactgatttgtatacttttgtttcctctcattgtttttctttgcaattttttggttttctgtagtgataatcttttattccttttcctttctcatttgtgtatctgctctactagtgttttatgcttttgtagtttcatgatggtagatatcatcctcctacttccagatgtagtactcccttaagcatttcttgtggggctgatttagtagtaatgaattccctcagtttttgcttgtctgagggaggcaaaatttcttccctcattctgcttcatttctgaaggatagctttgctgggtatagtatttgtggctagcaattttgtgagcttttccccaccttgcagcacttttaatatggcattcaattctttcctggcctagaaggtttctgctgaaaaatctgttaatctgctgttgattcccttatatgtgacttcatgcttctctcttgttttttaaattctctctttgatttttgacagtttgatgaaaatgtgcctcagagaggcccttttagggttgaatctatttagggatttgtgagcttcctttatctgttagtctctttctctcccaaactttggcagttttcaggtattatcttcttaaatagattttctggtccttatcccaacacttcttctggaactcccaaaatgtgaaatattgttagcttaatagtgtctcatatgtcacgcaggcattcttcattcttttttattgttattttttaaatctgtctggtttattgcaaaacacctgtcttcaaatttagaaattatttcttctgcttgacttagccggcttttgaagctttcaattgtattttttatttcattcatttaatttatcacctccaggatttttgtttggttctttttcatatctaactctgctggatttcccatttagataatgaattgttttcctgatatgtttgtattgtctatttgtgttctcttgtatctcattgggtttccttaagatttcctttactttggagtctattattggagaattattgtgttcttttggcaagtcatgttttcttgtttttttccccccaagttttttgtgtccccaagttgatatctgcatatctggaataacagagacttccaattttatggagtagccttagtaaggacttttcctgtacacgcgtctgtagtatcatttgggtagggtgctttggctttggttctggttcagtgcagaagtgtggtgtctctacaattaattagactataatccacatcagtggtatctgcaagttcatcagtggcttaggctgcttggtgcttaggatgtctgtgaaggcaagaaggctccttagaggtacttactcctctatttttgctgatgttgctaactaccttcaaactttttgacaaagcattttaagcctcttctctgattctgtatgcagttttgcagtgctgggcaggggactagaatgctattggaatttggctcactttgctacccacaggcaatttgaaggtattctttctcctaatactgctaacagcatgggtcatgtggttttatttgcacttactgattttatgcttttaggggaggatgagtgagatgatttatagtcagaggggatgaggagcagcatgctatttttctccaagcctggctgaaagtcttttttaaattatccttttttcttagtacccctttctaatctatcagtatgtcttatcaactctctggatttgcccacacctagtctctccagctatctccctggttaaaaccaccaccatttctctgcctacattgttgtccatacctcattactggtctcttgatttccactcttgcttcctgtactccattcttcacataacagctcaagggagttctttaaatgtacagtggatcttgctgcttccctactcaaatgttccgacagcttcctgtcaccctgtcttgtgtcagtctcacagcacacacagcttaattcaggaattaagctgtgctggtcacttattgagaaagagcttcatggtgggcagctgggaagctgcacagaacactcctcagagttctacaagcggctgagagagctggggtatttatctttcactagtgagtgctgccccggtggtggctcactttccattccttttggcctgccctgtgtgcagctcagcaagtgcctgaagtcagaggtagtgcttatgaaagtatctggtgggcttgcattaagaagctgtcagtgtgaagaacgtgaatgctaagggcatatgagtgtgtccctgagaacatggatattgtgttctttacctccatgtctccagtgcctgccacatagcaggtcctccaagatttgctgatctgcctgccccacctggggtctctgtctctcccacagctcactgacattagccacgtggccctctgtttcctgtaataggccatttcctaagtaagcatcatcctcatttctatacgttttctctgattactggaaattcctcaagtgttgaccattttgattcctgggccccttaagagtccattagcattggaatggagcccacaggaccataccagacagatgccaccacatcttttcttgaagtagtgttcaggctgagggggtcatagccgagggtccctctggggccgcttgctctcctcctactcacagccctcctgcagccagcagcagtgggggagccaagctgagttgattacttttgacatcagttgttaacataattttgatgttgagcctccccccagttctggggtggctctgactgtgtccaggctccaatttgagaagctatggggagcctctcggccccagttctggcctggctgggaggtggcctgggaagggacctgtgtttctcaagcccgcgccctcggggcctgggggtggggccccagcagatgtctggatttggtagccagggcctggagccggatgctgagaatgaggcctgcaactcatttccccattaaacattctgagaacatctgcaccggtttccaaggcttctccctcactaattgctttgattattgtgtgaagttaagaactggcacatttccgcgatgttgtgatgaaggtgaaaagatcgctcttaattagattaaaaacatttttttcttcctgtgtaattttgtcttgaaaatcaaggccacttttttgttttctccatccaaagacctccagaaactttcctccccacctctccagaggtttctggggaatgtcctgtgagctcaactcttggagaagatagtgcttaacccagattccattgtatattaaagtttcctagggctgctcttgctgcctggaaccttcccctgaaaatgtgtcttgggagacctagacagtgacttcctgcagcatggagacccgggtgggtcgattttagttgtgtgggtggctgtgttgctctctttccgtttcctgggctcactcacgctcagggttgaccctgtcctggctctgtcactgcctgtcttcctcagcgcccccgctactcagaccccacccttgggcctgcagagacatttccgttcactctgagatttgtgtatgctgaggcttgctatacttattctaaggagaagtgtttggggtgtggggtgtggtcctcagtatcctaaacttaggttttggaaagcccagcatcctccctgggacttctcaggattccggaagtcatctttgactgtgtcacatcactgtcatgcttgaggcaaatctattctgcacacctttgatccaatgtgagatccaacatgttccataatttgcatcaaacatcctcatacagcagggtgtggagagaggctcactgaaggtttggggagatgaggacttgcatcacagcagtagaaagccaatgtcccaccttaggaaatccctttccaagagttccctgtgctgttgcagggctagggccagggccttggcctcaggccagcttctttcccacaagccttctccctgccctctgccctgaaaactagtgggggcagtgcagaccagtttagctattttgtaaccttgactgcccccaggcccatgtccgtaggctcacacctcacccccaactttgtcatgcacattcctgaagactctcttggtaacaaatgatggaaccccaactcaaacaagcttaagcacaaaagggacattttttggctcacacagctggacccagctgtttcagacacagctggaccccagagctgagatgatcttgctcacttgctctcactctcccctcttgcactccccttctcccttcccgttccctcttttgttctccctttcccttgctctctatccattggccccatgggatggctgtatccttaggcagctactttctaaaaggggcaaaatggccaccagcttgcattcaacagctcaggaagcccagcagaacgaggtcatctcttccaggattcctgccagaatctaaggccaggttcttattggcctcagctggggtacaagccatccttggacctgcagctgtacctccgatggctgaggcaaggtccacagggacccctttggggatggccagagggtacctaaacactgcacactaggagtgggaaaggaagagccccctaaggaagatttgagaagctgttcccagaagccaggcctggctgctggcaggcaaaaacaacaggtgtccactcaagcaaggtattttcctaagcggaactgggtgccagctgtgaatatacattttcactccattcctcgccttgttcctggcagctgttgtgggaatggcttttacactttccatccatgtcccttacttctcgcctctgagtggagacacaggtggtggcggggccactctggctcagggtctatgagccgggcatgggcagctggcacaggctgtggggctgcggctcagcaatgtcacgcagggcctggctgcagctgtccggatgcccctggggagggcttctccttcacagtgcaggatccgcagggctttggtgaatccactgagagggggagatttcttgagggggccagggagggggcttctacttgcaaaggatagggagagcttctgttcatccttgtgaagtaggctggctcagggaactcgcctgtgccaaaccctggggagacatgggtgaggcagaaggcaaggttcccgtgctgagcgccaggcacacataagccctgcagccgtacaggggagggggcaatctccggagccctggaaagcttgtggaagagggcttgggttacacctgggagattaggccggattttaatcaatcaggaggggaagggcagggggtgagtggttgggtgaagttactaggaagggcccagacactggcgagagtctcttgagggcagagggcagcagagatgggctggagctttgagctttgtcataggctggacttggggcttgaatgctgacctaatctgggcagggaggggtctggggctcgatgagaaggcagaggaagtgagaccagaatttcttgggaacagaaagcctcaaagactttcatgataggagagctctatgtagcctcatgggcagctccaggccaggtggagggacatattctggcaactctaggataagatgtgcaaggtcgtgggccagagagcaaggcacagatacaggagacttccacaaattattgtttcttgacttggaaaagtatcatgcaaaatagaaaacacagacacaataaggaaggaaatgaaaatcacccaaagacaaagttaacatttggatctgtttccttctagtcttttttctgtgcctgtatttttaaaaaaataaaattcaaatccccctatcgagcaggaccactgactagaaaggaggatgctgtgctgagtttgattcctgttctcttgagagggtgagacttggcagccagcgtccccagctggggtagtcgccacgcccgaggctgcctttgccatcccagacctcccactttcctagaaaacaaaattgttttgttctgccctgaaaatttaggcccagatcctggccttgacaaagcaaaggcagccaaagaattaaagcatcaaaaaccaggactgtcttaggaaagtgtgacttcattgtcaccaggatgctgtgctctttgtccccagggccagccactctaggcagttcagcaaagggcacctggcattgctccggtacctcctgcagagcctggatatccagatgaactgccctttcaagtacaccatgggctcaaccttctctgcagctgtgagttcaggctgtgaaatacccacttcagaggtgggggtgacaagcaagacctgttagggcacagcacttgccctcaagccctggcctgaaagaggcagcaccagtgtgtctggaaagagctgaatccccacccacccacccccagctcccctccatgctctcctagatgcctgacctggctacgaccacaggtgaaaacagggaagaggtggcagctctggtcactgcctccctgtggtggagaaagcacgccccacagtctccaacacacaagccagcagacaataacctctcctcttgaattggaaaaacaaatctgtggaggccttctctgccccttgttataggggccccatatgccgttcccaggattaaaccaaaaagcacacattcctctctggcaggtgcaggtcccacccactctgggcagccaactgatgtgcacattttaatttcctaaaacaccaggacagaaccttcctcaggggtcaggtggctcacccttggccctcaggctttggagatgggcacttgtcatcatgggtgtttggaaagcaactctacgttctagcctgtgctccatcgttccttctacatacaagtgatgcaaacatcaaaatatgttttttctttcttccttcctttaaaaaaaattgaatcctggatgaagttttagctctgtcacttgacaactgcattatataacctagggtacttgaatctcagccccaaatctctaaaatgggggcagtaacatgcttctgccaggtcccagacctgtgggtctccaaatctgcacattcttcaagccttacaggtccttccctggtctctctaaggatgtcatgggcacagagccctttcactctgagcccttctcctggctgtgactaagtaatgtctgtgtggtttcctgctggaagtctgccactcgcccccacgggccatgagctcctgagtttatttacatttccctgattgctagtcaggcgcaacacctttccacatgctcatcagccttttggattcctcttttgtgatgtgctactttgtctattgcccattttctattaagtcatttatatttttcctattgatttgtaggagtcctttgcattttgtgggcactgtcttttcactctttaaggtgtattttgatgattgggtcttaactctaatgtcaaattactcagtcttctctctcatggttattgcttcttttaaaaaaaaccatcctaatgctgatgtcattaagatattcttctatattcagtcatgtgacctttatagttatgcttttcatagttaggtcttcaatcccctagaatgacaagaatgaatttttggtatatgatgtgaggtaattaagggtccaacttaatgtttttccagtgtgggtatccaactgctcctgaacatttgattgaaaagtccatgctcttcccaggatgtgcaggccacctctgatacacagcaagcttccatatttgtgtgggctgtttcccaatgctcaatcctgtcccattggcctatttgtctctccctgtgtcaataccacattgccctaatgaccactgccttggaagaagtactgatgtttggtacagcaagttctcccaccttgttcttcttcaagaatattgccaattcttggctttttgcacttccaagtcgcagttagaatcagcttgccaaagttctcacacagaagccttgagatttttattaagatttggagagatttattcagattttgagataatcttttcagtattgagtcttctagtcattggaatgaaggcatatttctccatttatatcttcttcattgtctcttactaaagttttacaattttctccagagttcttgcatatacttagttagataattaatattcttttgtgctattgtatacaggttctgttttctcttgttacctcacattttttatttacagaagagaaacaaaaatagtaccgagtacccacatccctttcaccagcttcccctaatgttagcatcttatataaccatggtacattgaccaaaactaaaaaattaacattggtacactattaagctagagttataaatttatttggatttccccagtttaactactaatgtcctttttctgttccaagatcccatctaggatcgatcattacatttattgtcatctctgatcggtgacgggcttctcagtcttgttcttcattaacttgacacttttgaagaataccagtcaggtgtcattgtccctcagtttggatttgtctggtgttttctcaggactagaccagggttataggtttaggggaaggaggccagtgaggtgagatgctttcctcattgtggaacatgacatcaacatggtttatcactggtaatattaaccttgagccactcgtttaaagtggtgtcggccaggctcctccactgtaagtgaatagctgtttttccctttccatagcttagtctttagaagcgagtcactaagtatagcccacactcaaggtggggaagggaggggttcaactctacctcctgcaggagagtatcaaaaaaaatctgcaaatatgttaaaactaccacagcaattaaaatacatttcaaggaagaaactgtgaagtttctgagtttcactaactaatttcagcattcattcatggatcgttttcctgcagcaaatattaccgtgatgtacttctattttcctcattccttctacattttttatttggaattcctttataaggaagatttgtccctctcctccaattgtttatttaattttatcagtgtggatttgggagtatttattttttgagttatagtccaatattatttattttgttgctcaaattgttcaagctgtggccactggtgggttcatgtgtccttttgatgtgccccccgccatccttttcatttatttttaagcatttcttttctagcacttgacaatacttcaggctcatcttttattttccctaccctagccctagaatcatccattcatccagagagccctggctccctggagaatgaatagaaaacctggatctaggcacggggtatgctcgtggctactagggtatcattgcttcagtctcctctcagtggacagagctaggaaatatatgtatgtatgtaacctgagtacacatacatctttacatatctgtatctatataaagctaaccatgagttcatactgacatttctgaccagagttcatccttgccccctcccccacaacttatttatagctttttctctgacagctagaaacctggctcccattacctacagttcatttacttatttgtgtaaccctattgtacacgtagtaccctatgtgaagcaaatttacctactagattagagtgtttaggacagacttttgctttaaccatagagtgtccagtcaaaacagtgtttttgaaagcaacatatgccagctcctcctcctcctttcctttcactgctatgtcatttgtttgtaacacgctcatcatagtctgcttttcatcgtagggtcctccaacatccgggttaattttttaaatttgcatacagtaaaatccactctttgagattcagttctgtgggttttgacagatgtctggagtcatgtgtccacaatccagtatcattcacagaagttccatacccctaaaaataccctggggtgagtcttttgaagtcaagtacttctcccctaaccactggcagctattgatctgttttatgtccctgtagttttgtttttctagaatgtcctataaatgggatcctataatatgtattcttttgcatctggcttctttcactgcttagcaaaatgcatttgagattcatccatgttgttgcataaatcattagttaatttctttttattgctgggtggtattccattgcatgaatatatacattttgtttatgcattcacctgttgaaggacatcttcattgtttccagtatttggtaattatgagcagagttactatacacatttatgtacaggtttttgcgaacataaaaattcaattcacttgggtgggaaaggaaccgataggtcatgtggtatgtgtatgtttaacttaataagaaattgctaaactatttcctaaagtcactgtgccattttgcattcccaccagtaacatatgagagttctacatgttccacatcctcaagagtggttggtattgtcaggttttgaattttttttttaatttatggaatttcattgtgattctaatttgcatttccatatttatgttaattatgtatcttttcatgtgcttatttataatccatttttaaaattggattgttcactttattgtcaagttgtaagcattctttatatattctgagtgcaagtccttgacctgataggtgatatgcaaatattctttccaagtctgtgctttgtcttttcattccattagcagtgtctgttgcacagcaaaagcttttaattttgataaagtccaatttgttgattctttttctcttacgagttaaacttttggtttcgtatttcagaattcactgccaaatccaaggtcctggagattttctcttatgttttcttcaagatattttatggttttatgttttattttagattttttttcagtaagtttgtatgtagtaccctttaaattttcattttctaattgttgatcatctgtcctatcaggcatagatactaaatgcattaaaacttttacacacatacatatgtatacatacaacacattcaaatagtgaaattaggaataaatttaagagagaattgtattacgctgatgtgggaaaaccttccttttttataaagcaaaagatgtatcactttaaaaacataaaacattttctaggataaaagcaacataattcaggtgaaaaaacagactggggaagctatctatgcctcatataacaaggagttaatgtctgtaatgtatagaaaattcctacaaagtgataagcaaaagtgagcaaaggacatgaacaggcaattctgcaagaggaaacccaaacagatgccaagcccataaaaggtattcaacacagatggaaataacagcaatgcctcagttttcatccatgcttgatagtccctgcaaaaggtgctgacaaccttcattcgggcttcattcaacacttcattcaggcatggatgtgggaaagctgggggagcctgaattgctacaacttcttgggaaagcaatctagcaacatttattaaaattactaaggacacaccctctcaccctgctccagtatgtcagcttttaagaataaagatgaatatggcatcatagtctgaataattaagcagcttaaaactataagagcctgaatgtccatgatatacagaatggttagctgtggccaatctaaactgtggactattatgtaatgactaaaataattaaatccatgcctatatacctagagaaaaatgaaatgagcttatgttacagagtgacaggaacagagtcacagtgacatcccatgtgcataaaagcaactcccacctggcatctgctgctcggatgagcagagagggtgggctagggatctagttggcagttaacactgatgaccttgggggaggaaagccattgtgaatctttgaattattccacttctcacagatgagtacttaatccttttgcaataaaatatttaaatgaagacaaatataagccaagagcaaatactgatagtgtcaacagagagtggggagtgataaggatcagtatcctgagctcctgtgtcaaagttgcagaggtgggcccaggaatcataatgtgaagccagctgttggagggactcctgtgcctcattgggggtacaactggttgatgtagcatcgtgttttgaggaaggagttctgtggctgcccccacctcccaggcttgccattcctcatgggtcagaggtcctatcaccccatctttcctgacccactactctgtcaatgtatgagtgtgacaatgtatggtggtgggagctgttgtcccttaccaggcctgtgcctgtcacctctgttttattcttgacccaagtgtcagttgtgaacatgggaagaggcccagaacctgaggtggggagagtcttggacacctgagcacagccccaggcacagttaccactccgaagatgattcactggcctttattctcctcagacactgaggtgtcaggcactttggggccatcttaaacacccacccaccccaacacccaactataaaactgattgtcagggctggagcttccaggcacaagctccactcctcacctggccctgggagctcacaggcctggctccacagcactggcaggttgggtgggaggcctaacgtgctgtccccacactttctcctcagtaaggaagagcccaacactgctggaagtgagcatgccccatttcatgagaaccaacagcttcgccgaggacctggacctggaaggggagactctgctgacacccatcacccacatctcacagtgagtgcctacatgtgcgtgaagggctgggctggaggggactggagctcaaggagtcagacttggtgctggggaagccttgctctctggccagagtgctatctactcgcctagtgcccaccacttgccgtctgcctggccccaacacggaggcaccaggcaagagaggagagcaagggcacttcccactgagcctgggaacatgatcctcttgttttgacttatggaaaaccagactgatcattttccacttgttttcatgctttgagagtctgagattgtttttctctcccccagccccctcccctgccccccaaaaaagagacgactttgttttttagcatttccccatggaaccctggccaaagccatggggcagatgccgggtgcagtctgccagttgctgctgctgtcctcaggggctccttcaggtggaggaaatggctgattttccacgccttccagttggccttcccctgaggcacagctggcctgggatgcatgcccgtcctcccccgccgtcacggcatggccaggccaatccccggtgcccggccacggtgtgattcccctgcgacatgtgactccccgctggggtgcccagcggtgacagccgtgcagcggggtcagtggggcacccaagtccattctggccacagtcccattctggctgctaacccgttggggattccccttgataaatgtctttgtgtcaagatctgtgagtgacactcgcggcccttctgagggtcacttgtggaaactctccttctctctaccaacatttttctaaagggtgttttgttctttggactctctgggggtcaggaggttgtcctgagccatgtgtgtctttgtcgtagtgaggccctgggcctcctgcctttgcagccagccaggtgcaaggcctggccttgcaaatcactgaggaaatcgggacccatggtgctgggggctgcaggtgtaaccagagaactggcagggttgggtagccagaatgaggccacctccagggaaggagtggctatcttaaggggtaattatgatcagacaggacctgcccactgtctttccaggcccccccagttcacagagaggttggcagtacctcatggtgggtagggtgtgaagaggctccaagggagccagcagatcactggaaagcaggggtgactagtcatggacaccctgagaatagggctctgagcttctgggcccctcctggctgggtaaaaaggcaggagcagaggtgtgagcaggctggtagccagatgggctgcccaggtacaggtcagcaccagaaggcagaatgatggcttacactgtggccaaggcctgtaccaagtcctggatatgatggacctccaaagtgatcagtgttagtttagtggctcatgttgtgtgcaatacaggtggcagtgcctgtattgcctcttggctgtcccctcagagaggggactgtcccttctcatccttctggctgcttgcttctcctgttggagctctcgctcaccttggttctcttggtcacggaccagcatccagacatgcaaaaagtcctactgggaggagagggccatcacccacagtccatctagctgggcagccaggccttaccaactcttgggtcttgcaaggcccctgcaggtgaaggtggtgagagaccaggcacttatgtggatcacagccaaacttgcagctgcccagtaaatcaccactatgggggtgagggctgccagtgctggtatcagcacatgccaagctccctggagccagaggttacccacctgcccaagggtgaccccaagccagtgtggctgtgtcatctaggacactgggctgtttcttgttccactccaggatgacagggcctgagagacctgaacatccatccccaagctctctgcccactttgggtctggcacattaccattctgcaagatcctgcagccttttcaggttggcactcccatggcctccagtgataagtgggcccaggcaggtcagagactccagtcattacccaaccaggtccctgccctgtaacttaccaaggcctctctcagagcaggctgttccaaaagtggctgctagatatgagccagcctgggaaggcaggaaggagcccaggcatggggcttggggtgagggatctgaagaggggactgggagagggaaaaacaaggaggttgctgcaaaggggccaccttgaggcattgtgttctggtcagggaagactcagggctgaggcttcaggggagctgggttcctgcatcctcagaagtcagggtacggtccctccagagaggcctgaaggggagagtgggcacgtacagtgtcagggcctaggaacccaggctcctctgggatacaggctgggtagaggccccactccatctgggggagaaggctggcagcagtgggcaccctgtttcctcagggcccaaaccgcctggcggcaggggtgtgggggccgtgcaggtcttctgcccgcattggggctgcattcctccacctcctgcacagcccgcccagtgatgcccataattaaattcggctccagctgctcagggatgcagcgaagctcctgtgggcagcctggccccatggaccctgaactgggaagagaggcacacgccctggtgtgtgtgagggacagggatgtgtgctggggtctcacagggggcagagtgggtgggaggcagttaccaaaaaacatttccatttttcttcagcattctactgatgttaaatgtattaccatgctgggccagttccagaattcaaattaaaaacataaataaagacacattttgtttccatctcgagctctccccgcccgcagggccccagagaggtgaggtcactatagccttgattacgggaaggtccctggggctgggcgaagctcctctttccggggcctgttagccagaggtggggtggggggtgagcaggcctgatgcaagctagggagtcatgacaagctgaggcacggggtacccaggagataaagagtggcgtcgctgcaccccagcctataggtgggccctactgctcagcctcaggaccctcaaccagctctgggcggccaggactcagcctcgaacacacctttcaggcagaagctgtcttcctaggttgaatggggcacaagagagtccctgccagcctcaaactccctgagcctgtgtctcccacccagaaccatatgacagggcttctgagagaaaggtgggaagtagagactgtaggcctgcatgggcagttggggagcacccccatgacaagaggagccctgtaccccaagagccaggatgagttcctgggattctgacccactcactatcctctgctcaccaagggtcactggcacgacagtgggtggggacggtgccatgcctgtgtgcatccctgtgccttgcgtgtggtaacctgccatctagaatgcccttgtcacccatctgcagccaccagatttccattcatctttccaacgtctgctcagtaaaccccccaggacacacttaggctgtacggctgtgtcctcctttggctctcaaagccctcagtaccagttccctaagcctttcgaatggtgccaggagggagaagggcatgtatagccctcttggtctcttcctccccagaacccccaaagccccaggcatggagaagccctaggattgctgctcactcaaccctgcctaagatgaagcaaggactgcagacacattgtgccagtgctgaggcacagggctaggggcctgaggatctgcggctctgaacttgggggctgtgtgcaggtgtggcctgggtgagcttctccaagcaaccctgggaggctgaaatcatttttgtgaaatcctccctcacactgcatccccaactgccaagccagccaggactggcctggaattcacacgtctgccccattggttgcacatggatacctgagatagacggcccaagaggacaggcccataagccctgcagcctatggctctgcccagcccagtcatgtggtttctctgaagggcccctgtctcttctgttttggcatcttagatgggcaagccccagctcgaggttaacagataccgccctcagtcccactctccagagggacactcagggagcacccggcccattgagatgggcatgggggaggaccaggacccccgaggctgggcagagggggtggaaagaaggcagagggaaagctgcagagacccccaccaggtgactgtgagcacctccctggcaagcatgtgcttgcctggcctcttgtgacatgacagcttcgcaaatccttgagcaaaaacagccccgtgtgcgttaattagaatttccatgtcttcaactttctcctggaccctgcagaatctcacgccaagacattcgagttgctcttttccagcaaggccgctgtggcctggctttcatccacatcactactaatgtctcctgaattctgcatttgtcagcaaggacagggccagtctgtgctgtctggaaataagggcaaacgtcacaagggtggccccaaatttggcttcatggaccaaggggctagctcttttgatgggaccagcttggcctgggacattttggagacatccaggtccactgtgacctactcccacagaccccagggtaccaggcactgcagctctgtgagtgtctaagctcctcaccatatttctctccctgtaaactttggtgggaaaggacagaaaggacattctgggaaccagtgtccagaaggatgagtgaggggcttgtcaagaacagatgagaccattttgtctttctagaccagtgtcctgtcttctgcaaagctccagaccacctctgtctgcacgagatgccaaggaagccctctgggggcccgcccgggagggctgtacagggctgcatgagtcataggatccccgtcagagccccacatagccccagccaggctcaaacccgtctctgaaatgcacggggggattaaatgttcttctaattaaattaaaaccgaggcgtaatggctcagtgggaaagagatgggattgggaatcagatgccctcaatctggcttccagcctgccatcagcccagctgtggcggccccccgtggccccctaacctttccaaacttcacttcctccgtctgagcacgtgaggaagaagcggctggcctagggctgctgctatggggagagggccgcactgtctaggtggatggcccagaagaaagcagtgaggcttctcatttcctctgcaagggaaaggccatccaaatcaccctgccccagtgcactctggccaggctcagccctctccacttgtgaactcccagccatgatgctgctcaggtcctcagccaagcagatggtgttggaggatgtgacagagagaacattcacgccacagaggtggctggagggcaaaggacttcacaactgcactgatattgtcatggagacacttctggcagttggggcagggggtcggggcggggttgggcggggggcacatcccatatagatctcttgtgtgctctgctgatacctgaaaggggagattgaactgcagagcctctggaggctgaagcacggaggtgacctagtcaggaagtctggaagccgtgtccccttaagtgagggagtgggatggggctgggcctagcggccctgaaggccagggctatccacctaattaggctcacctgggctaccctggtatagggtggtggtgttaaacttttagttaaagggtaatgtgcatgcacacagattagtacacaggtctcaagtgcgcagcttgaggcatcttcagtccctgggacccatgtgtgcagcacccggaggaagcaacagaacccccagaaagcctctcaggctcccatttcctgtcactgaccttgagattaaccacaggcctaactgctagcagcaaggaccagctttgcccacatttgaactttatgcggtgggaatgatgcaactcatacacctttgtgtccaatgtccctcactcaatttgatgtctggcagcctctctatggggctgaagggagagtgctccctcatgctccttgctgactggtgctccattgtgtgcatggcctacatcattcatccattctaccacctgtggccagcaggcagtttctggtgtaggttgctgtttaagaatattctgtacatgcttttggtgagcatcaggttgcgtttctggggaatatatgcctatgtgtggagctgcagggtcctgggtgggcatatgtttactcttagtgaatactacccagcagtctaccaaaggagtcattccaattttcattcccacaggcagcattctggctgctccacatcctaacacttggcattttccgtcgtttccttttcagccatgatggtgaatgtctagcagcatcaaatggtgattttaatttgcagtaacctgttgactaatgaagttgagtccctttccatgttatcatttagtcagatacatcattctgtataaattgcctacatcttctgcctgttttatgtttatttatggtcctatatatctttagatattctggagtcatttgtcagagagagagatacacacactcacactctctcacagacacacacattgcaaatatcgcctccccctctgcaggctgccttcttcctctcttgatggtgtcttttgatgaacagaaggtcttaattttcatgtggtccagttaatcaaacatttcctctctggatagggctgtttgtgtcctatttaagaaactttgactactccaaggtcataaagatattctggtttattctaaagctttattagctcacctttcccatgtagatctgcactccatctgggattgatttttgtgtccaatgtgaggccgaggtcaaggtccactcttcccctacttggatatccagtctagctcagcacccggcatgggaaggcccgtcctctcccaactaccctgccgtatcagtgtctttacaatcagctcactggctacgtgtggctctgtttctggaccctattgggtgccactggtcagattcaagttgttctttgtggccaggaccttgcttccttctcactgtagtttgctaacaggttttgacagctggtcctgctggctctggctgcttctccttccccatcactggctttgctgtctttgcagggtttctcctcaccatacatatgccagttgccatggaaagcctcctctaggcgcagcagcctctagatgggcatgggagaatgggtatccttatagttttggggctcctgaaacatggcatcatgtgtcccttgtttatttaggttgactttcatatcttttaccttgccctgtagttttcagtgtggtggtcatgaacagcttgtcagattcattccttgtcagctaatggtttgatgtatgttcgctgaatccagggacaaggtctgtcagggagccctggccagcttgggtcatttcatcctgcccacaggacactggggcagtcacctaatctctatcagcctcagtttcctcttgtatacattgggagtatatctcacagtattagtgtaaggccttgaggagatggtgttaggcatccagccacatacctgactcggggaaatgcctgaaaatattagccagcatagaatgtctctttgtgatgggagatcctgtggggacattccttatttggcctgagagcttttgagactgccaggtcatgagttaccatgggatacaaatggggtcacaacatatggctgtcagctgctgtccttaataagatgtgcctagaggcctgagagtcccaagctccaggacagtctggagtcaggtggagggaagggaagtctagaggtccccaagtcacaacctcaaatctcggaatggggttcaggagctgttggggtcccgtggaggtacaggcggaaacctagcactcactattctgctctggggagggggttggaggcagaatcagtggactgtgtctcatggcagtcacaggtgccccagtatgcatctgtcatttgttcttatcactgtcgggcccatctgccaaggcaagcacccacattaaagcagagtgaagagcagggcgagctgtgtagctcacctgcctttgaccctgcacatgacgggcgagggaagaggaccatggtagcttgtctctaggcaacccataggtgcccaatggagagataatctcaaatatggtagcagagttcagactcagtggctttcagatggttagtataggctgaaattccaagagcattaaccagacacctactatgtgtatttcttgtgttggggttaggagatactgctgttggctgagacacacagcccacatccttggtaggtccctcagagagcatctagtgggcctgtcctcccagctcacagaaggggaaattgaagcctcaagaaggatagggacttgccagtatcactgggagataggagcagaagccagggctcattcccagacacacaatctctgggggagcctggatatgcatggcagaggccaggatgaaccctgaagattggtaggaaggcagtgtagcagtaacaagacaaagggattctgtggcccatggagcaggagggaacagtctgcagatattatctgggcactggccagtggctcttgtggctgccctctgcaataagaattcttcaagttcagcctctatgtgcatcataaacctggtgccaccagccaaggaggtcaaaggtcctcactggccagtgggccactgggaagcctcctggattgcctggacaaggctgacctgccctcccaggatgcaaattggcaggcccagcttcatgccttcttatggtgccccagagcccctggctaggcattcatgctttagatatgtgggccctgttagggacaacgtaggtgtcctgggcaggggctgtatctgaggcacacatccttggtagtgactggctagcaggaggaagtctggcagttagtctgagcagttagtctgtcaggcctggttggtcccatgggaggcctgaggtgccatcttagaaatagggccttgttaggagaaaaggaaagaaaaataaaaggtagagagacagaggtagacaggagtccaggtctgacctcaaaatccgatgtccccaccatccccagccccttagcctctgatcttctccataagtaatcttttcccatgtgtggctgcagcctcagaggctccctctgaagatgacactgggaatatcctgaaaaaggtacaggaacacctggcatgcctctcccagggtactctggatgtgcacccagagattctcccactttagcaggcagaagagcaacccagcaggggatatacacaaagatctgagaaagggattatttttagggccaattcaagggatttttcaaaggttaattttgactctgcctgacttatctcctaagtctttggcactgagcatttatacaagatcagactgcactgcaccctaagtataaaccttgccacagcagtgtcctgtggtgccctgctggggaaactgaggcagagagcaggggtgactttgcaaggcaatagagggtacttgggaagtagggtggtaggcaaggcttttcagagaacaaggagctacatacacatacatgcatgcacataatcattctgacccagtcagggttcttcccccaaataaatccctgcaaccccactgtggttataggtctgagccttctgccccagggagccaagccctggagaggaggtgggcagcaccaggcagccagcctgtgggccccgctatgcttcctcaggcagctagtctctgtatctggggtagaaagagtgggctaaaaagtcagctagcacccctgacttcaagtcctcgagtgtatgttgggcttgtctccctaccctggcccggtctgcactcaagcccagtatcctcccctggtccctggtctggactgagcagctgtcttctgcccacaggggacctttcttctcccacctaatcctccctctttgggcctttcaaagttgggcttgtttttcagtgttttctttaggttcatgtcctgatttgttaagttaaattgaattccttccagtccaaaatactcaaatgcttttttctgcttttctttttgaactgccccacgaaccccaccagctgggtgtgtgggctccaggtgggagctcaagggggcctggtgtggtgggtgcagaagcagtgtggtggggcagccttcacaggctgatatgattgagctcaggctggtatgggttaggggatgagagtacagaacagtccaccccaggggctctgaagagcttcaattgagatatccttccctaaggtccccacattccatggcagtgcctaggagctctgtgctcccaggcctctccattaccagcctgtcttccacattggaaggtggccttatcaaaccacatggcctgaattttgattgggaaagcatccctgtaggtgtcaggtgatggaaggactctgggtaaatggaagcactgagaccagatatgataggaccttgcccagtggacacagccagctgatggcagagccaaggccagatgtcaggttccagactccaagttctatgcttttttgctggtccagcatggcctgtctcctccccgcaacagatccaaccagtccccttcagaagggctggaccaagtgaccccaactctgggttctgcctgggcattttcttgagtgtcataccctagccacctgactgtcaggggagcagtatgtggcacttgaggccttgggctggccatgcaggcccaccacaggtggcaaggaatcatgaaccccagctgagtcccctgcaggccttgcctaaaggagaagccagtgaatcaatgtgttacttgaacaaatatagggtctagggctggccaaaagggacagtgaagttggcttctcaggccacagtaggccttcacggtactcagcaggagaccccagcaggcagcatcagggcaggggtgctgaccatccctgacccaagcacgaggatcagaatgggccctggagccaaggccaaaagccgaactgtgactaggcaagctgagtcccctgtagattctggggactgggtgatgcagactgcaaagcctcagccaccttctcccctagaagaaatcttgagagaaacaatcccacaggctaccaggccagcttttggaaacagtctcattagcaaacaaagggaagtgacagagcagagctccccttggcctttgtttagcccaccttctgcctaggcaccaggcctggaggttccaacttggtgttgggcctccttgagccggaacacctgaaaagccatacagactcctgctcatcacaaccacttgttgatgctgacagcctgtagaaagattgctctcagcctatcccctccctggccatgcaggtggaagaccctattacttgggctaaagagaagctaaacgtgaccagcctacccaccttgctactgctgatgaccaccctgactcatgtcccttgtctgcataggtgttttcctataaatgtttaattcctgaggttgctgaatctcagggcttggaaggcccagactggacaggggaaggggtacagtcccttcttgctggtatgttgggaagctctggtgcaaagggcagtgatggcccttcaatcccaggcccacaagcaccacagccaggagagtcaaggttggatatgaagagggacttcctgaaagcaggcacaggaagggatgggagctcagctcaccgggtgctagacaagggagtgtgtctctttccccatgagtgacagcagccacaaggggatgcccagcattgggggtggggtggggggagggccctccgtgctttctggctctttgggcctggggtgcagcccctcatttgtacttgctggctgccccatgggggcttgggctaggtctccctgccggtggggagggaggtgtggaagctggtttgccggggccacccagtgtgggctcaggaagggaaggaatgtgaccaaggctgggtgtggctggggagagcacagccagttgtgggtttttcttggggcccagatagatgtgagcagagctggaggcccctctctcccagcccccggcacacacactaggacctttcttcatcatgcagccgtagagctggaggccaaggacaccctctggaaatctgaattccattcgctcttggcaaagagcagcttcctgcttagggaaggtgcatgcgtgcgtgtgtgtgtgcgcgcccgcgcgcacacgaccacagaggctggggggaggcacgtggggaggagggctgcctgtcgagatgtgtaagatggccccagtgttactaggcactagatggcacttgcaaagcccattcggaggatttagacaaatacctcgagtgagtgaatctgaagcatgctagttgtgttgccttttaaataggctctggcttaaaacagtcacagcgaaacatgcctttgaattggaaagccagaactttttgcaaaataatttgaaaagtttgttgaaccttaaacctttcctgatgactccttccttctgaacttaactcgttaaagttgctccaatcccagcccagtgccagaccagcttcctggaaactctcgccaactgctggcctttggaaaggcttgtcaccctaatagctgttttttaaaaaaaaaaaaaaaaaaaaaaaaaaaagctcactgggcaccttggctgcagggtctgaaaagtcctttgtgttagctccagctgcagagtttttccaggcctcgcttctggggctgactggagctgtttctcttcgtttcctcttacagtggcgggcactcagccggcttcttcccgcctgacttctctgccagagcccaggtgggggacggggatgccaagggcagagcccctggagaggctagtgtgggcatgtcctgagtggacagacctgaaggtgggttcactagcctctttctcccatccttcaccctattagaggtagtgctctagcggggaaagattagggcccctctaggtcaatattgtgtcatttccccagaatagccagggccaaaccagctcccaagcagtactgtttcagaagtgaagataactcacctctcccaaaagcagagttttggcaatataaaacatgaaagtgggatgggatctaagtcatatttttttaatgagtttaaaacacgtgtgtgcattagaaaacatttaaacacagatattgggcaaattaattgaaaaatatattgtcattttgcgttaaaataaaagatgatctgaaaatggaaaaaagttacataaaaacgtaaatatttcatgagacatagcagtcacaacatgccatacacatttcttccagaatcactccactggaaattctgtaataagacatacgtaacagtttcacttcctaggagatcccaattgctcctcagatagggtggagagcaccccttattagagggtggttgggctctctaggagcccgcccagggcctgccctgactctggctctgcctttccctgtcaaaaacctctttgtgctggagcagcccctgctccacagagtgacatgaaccagagactcacagcactgtgtgcggggagctgctgcccgcagggcataccagccacgtgcatgcagggctgcacactgccctaccgtgcatccactgcctggccaacacctgccttctggggagccaatcgtgctttatgtattcaagggttgtgctacaaaaatcatacaacagtctttacacacatggtaaaaccaattcagagtacaaaaggggtgaaaaataacactctccccacccaaccctaattcccaagtttccttccctaaaggttaccactcaacactttcctattgcatctttccagacgtattttatataaacaaatatacgtgtgtctgtgtgtgcatgtacttagtagatacggctcctttttatacaaatggtagcatactgtatgtatttttctacactttgcctttgacttcttccataggtatgccatacttctttttgagctgtacatacaatgctgatttattatggtgcagtacatctgagaagcatttttattgcaaaatgtgtgtttacatgtatacagacacacgtgtgaacaggtgatggctctgaacagtgtagttgaagtgctgttttctcatggttgggcttccagtataattggaaggagcatagtctctgtgttcagctagagatttagcccaatgggctgggcttttcccagataggacatgctcactgttctgctcagattgttagctgtagtctttctggcatcagttccatttctggtgaacacttggacttggcaaaaggcatagaggtagtggtacaggaaaggtctaagaaggctaaggaccatcatactgggtattcaacagccagctctccaaagaggcctctaagaaatgggtagcttcacagattcacagatagatagttcattaaggtcttgagtatttccaagggagcactaactggactacagcctggcaggagataaccaagtcatatgcatagtggctttgggtacgatggtctgctgtatgaagcaaccctaggacatttgaagagaatggagtgatggccagtgtattgtgctgggatctaccacaggggtcatgttgtaatgacacctgtcagctttgactggggagccctttcatttcttagtaagtgttcagccccagtgtgcaccacttaaaaggaagacactggtatgttctggagatggatctgtattaagacatctagcaaatctccttttcattaacagctgcagagtttcattgtgccatgatttatggaacagatcctctgttgatggatatgtagggcagctaaaaaacagcagccattaaccattcaaatatattcactactgaaatgaccacttatgaaattagtttccctgaaacatccctccctattgaacactgttgtttctccctatccatcttatccctacttgtatctctgctgactgacctctttggctgtctcttgtcaaccaaagacaatataaagcacacacaaagtaaagaggaacttataaagaggaactgtaaatcttgtcaaaataggagatttcatcaagttaaagaaaatgatgtcaaatgatttctcaaatagagactgggcagagtagaccagttagttaatcagttgaagaggaaaccaagatcgatgcctagataagcatttcagaggacagcaggggagatgataattgatgcaggtggcctcttggtcaagcagtgaaaccatgccatacttctacaaaaaatgatcctctctgtggaagtgctgccaacatcctctgccaagtataaaagatgccctcagatgttaccatataatgctttacaaaagacaaaccaaaatcccctctggatttgtttttttctaaaacgtgtacataattgtaactctaacaactgttattgcatatgagataaaataatattttaactactgttatttttcaaattaacttcccaatcaaatatctctattgtaaaattttggtctccgttttcagtggatttactttaagagatcctccctttccccccatttccagcaggattaaaatgttcatttatgttgtgatagatactgccaaataagggctgtaccatttacatcactttgactgcacaaatgcactttcttcccccacccttaccaagtgtatactcaggtttttatcttcattcatttcatagatgagaaatggtacactggagctttaatttacatttcttttgttggaaatgaggtttttatctttccaaatgcttaaaatcatttgtttttctttcttgtgaactatttcttcataccctttggactttgtaaaataccttgtcttactgatttgtagaaacttgctttgtcatattcattgaaaatattttatcctcattttccttaggtgttttggctttttctataatatttttctggtggcagaatttttttaatttcacatagtcagctgtgtcagtcttttatggtttgaggtccttatcttaaattctgaaataacctctcatcctgaaattgttttaataaattcttccatgttttcttctatcattttttatttcattttttacatttaaatccttgctttatcgggattttgacagagtaattaaatccaatttggtttcccatatatttgtccagttgtccaacactatttatttgagtacatcatcatctctctactaatttcaactgctacctttatcatatttcaaactctcatttaatttgtgtccatttctagactctattctggactgctgatgggcctgttgataggccagagctcagttattttaattatgtaactttatgatgcacttatctgtgtagcaggactccccctcatctccattacttaagagccaataatgggaagctcattttcacaaatgcagtcaaccaggggaattcatggcatggcctaagatctaaacactcttaagatttaaacacaggattagctcttgagttagacaggaagctggggtgtttgggactgaggcttcatcgtggcagctaataatgtcagggagcatgagcacttgtttcttccaaggctcacttcaaggaaggcagaatccaggtcgggggtgcacaggagttgccagctggacccaaggaccatttcgtatacatgtatgatcatactttcagggcatcttggaaaaactgaatttgctaactcaatagagaacaaaagagcaaataggcctaattcaagaatttttaaaaacccgcaataagaaacataatctaaaacttgtagcccagcccctcctccataccaaccaccaaaaaaacccactaacaccataaagtgtcatagctagagctagagtgctgttataagctgtgcaggccaaaatggtttcatggcatgagttgggcagcagcgactcagtttccatgtctgagttaggccacctgtaacaatgcagccccatccatgtgaagctggtccagaggactacagctgcctgtcccacccttggctgtgctctcctttactaatccatagccaaagacaggggctaataacagggtctggagtctgaactcatatcctaattccactactttctacctgctacaccttgagtgagtcacttagtctcagtttctttatttgtaaaatgggaatcataagagtaccttcctcagagggttgttaggaggattacacaaattaataatataaagtatgcagaaaagtgcctgtcctatagtagtgacacagtgttacttaaatgtattgctatacctcatgatggccattccatccattgtaatcatgtgtaccatgcaattcacagtgcctgacaaagctgatggggaggcgagttggaatgaatagtatcagcatcagaaaaaatacaagtgcatcctcataagattatttaggatgcataggatcccagattagattttttttaaatcagccgttctctgtattcttgtccagatgctgtggacagtgatgatgggaaaatagtccctgctgcacactagggcctgttaggccagttgagggctagaggagcacaaggggccagactgctgctacttctgaattttataggacatgcatttttttcatataaacttagaactagcacgcctaattttttttttatttttattttttttgaggcagagtctcactttgtcacctaggcgggaatgcagtggcacagtctcggcttactgcaacctctacctcctgggttcaagcaattctcctgccttagcctccctagtagctgggactacagacatctgccaccatgactggctaatttttttttttattagagacagggtttcaccatgttggccaggctggtctcaaactcctgacctcaagtgatctgcccgcctcagcctcctaaagtgctgggattacgggcgtgagccaatgcacctggcctcagcttgcctaattaaaaaaaaaaaaaaaaaaaaagttgtctatctgtgtgtatattcatatcccattggcatttgttattgaaacttcattcaatttagattaactgatgaagaattgccttccccacctcaaaaaaaaagtctttccagccacaaatagaagcagtttacccacatgttcaaatccattgcaacatccttccatatttttttagatctttgtatggattttggacattctaaaattcatttctgggtatttttaggaggactactgatttttttttaatttgggcattttttaaaataaatttttattttgagataattgtacatttctcatgcagttctaagaaacaacacagagaaatcttacatactcctttacctagtctcccccgatagtaacatcttgcaaaactgtagtacaatattctgaccaggatattgcattgatagtctcactacaggacatttctaactcttcaagaatccctcatgtcccccttttatagctacccccaattccctcccaccctaccctgtccttagcccctgacaactactaacctattcttcatttctttatcattccaagaaaattatataaatggaaccacatagcaaatcacctttttgggatcggctcttttcactcagcacaattccctgaagattcacccaggttattgtgtgtatccttgcattttggtatgacccaatttgggtttgtatttttaaagctgatggacactatttactagtgttttcaagattgcactgaccatcataggtgaaataggtatgtgttcttttattatgaaagcctcctcagatgtggacattagtgaaatgtgggctccaaaaagagactttggaagatttcactaatgatgtggttattttttaaatagatgccccccaaaaaagcacctatgaaaaaattcttacatagcaattctacttctgaatgctaagagggtttggaaaaagtcatttttgcagtgtttgtgttctatgaagagtgggtagaaggaagcaggagagtattcctgcctccccaggagagagcttcactttctccctataccttcctgtcctaccagcccacctggttctctgtctctctccaactgtgaccgtcttttccttgtagctccctgctcactccatgtggaggatggctcttggggctggggtgactaaaggcaaagaatggggatccctgtgacagctctaggggattttgggaccagataaccttaatggcctcaggctccctagatgagaaatgggacttagtaaagtcaaactggtccaggttaagccagcccatgatgcctggaaggaacttacccttttctagagtaacttcccttttcaggaagtttctagcttgcttgctcactcgctctccccacccccacccaacctcccccaacctatctctccctctctcaggagaaggtgctccctcacccttaaagaccaggctgccgttgcttcccatgtgtctgttcctctattcagtattgtgggcactgatcacacaccagggcactgtgggggccctgggacctgggaggaccagaatgggtacagtccctgccttctcaggttatggtcatatcatccatgctccccaaacatcaaggtactccaaaggaggcccagcactaccatctaggtggggagaaaacacaccggccataatgaacacacgtttaggctgaagaataatcttcaaatgatactactacttacacttcctgtttgccaggcaaatatagacatcatttcactaatcctcacagcagcttttaacacaagaatattatcactcctgttttatagataatctcctaagggttgagggattgagtctagggcccagggtcacaaagctagggagccgtggatctgcaggagatgtcccagctcatcaaatattctttcagtattaaacatatcaagctctctcctgaccttctctccccttccccaggccaggactgtcttatcctgtggttcttagctgaaatgtcccttcctcagaggagccaatttctaaagcttaagactgggctgtaaaaaatcacatacctcccctcccattcttaatgtgtaactgtgtgtttatttgtggtaaagggtttactggctggctccttctatcacattcaaggagcatgagggtataggctggctgtttctattcagtgttttatcttcagtgcttaatccatatggagcctgtcacggaccctcagtgaatgtttgacgagtgagtgagtgagtgagtgagtgagtgagtacttgtgcccaggtcaaaccaggtgctaggaccctggcaggggttccataaggctatgctggggttcaggcaacccaaggctggtctggagagtgtaaggcttgagagctcttcttcaggctcagtcatccctgcttccccagggctcatgtccacatgctattgtccatagaagctggggtccaaagttgaccagaatatctctagtcataaagaatctcttccccttgagcccactcatctctgttgacattctagaaatgcagggaaatctgggcaccatgaaatgcagtgacttgcagtgatcctcctggggccttgtatagaagagaccatctcagttttgtagaccaggaaactgaggcttggggatagcagatgttcccagacagaaaatggtggcacctggagaggtgctcaggtctgtgtggaagaaaggacaggagtccttctgccacccagactgtgcattcagacatctcccttgtgctgtgcagccttagttctgcctcctgagagaggtgaccttctcccacttcttacaggcaaggctcttgctagcctgaggaccaggagccttcagattttcttgttcccaggatatatcgcaccaactcaggagggtgtggggatgggctagcattaggaatgggtattagcatctgcattaaaaggctcccactgacagctcatgcattgtgatggaactagaggtgagatacagagcaggagtccatggcacctccagaacctgtcagcctgagtatgggcaatggcgttttagtttgcaaaaccagacacatagaggccaggtttcccccgctcaacactaggccactgtgcctgccactgctgtctgcaaatgcaggttcctggggctctgggtggtttgtccaatggctaagctttccccaggaatgggtaactggaaaaatgtaggaattacatatgattccatcaatgacagttttcctattaaaacataacttgttaaagcatagagcttagttcagagtaaacatttctaaaaaagaggtagaagcccctacctactgactggcatcacaaacactgccctgaaatgccaactcatttcaaatactgctctagacaactgggccctgcatctgctgcaaggaacatcccttactttcccatctcaatacaactgtgaaaagcctagcctgggactcaggcctttccttactccctctggttacctagctttagctctgaggcagcccagatgacatgggcctctaaggctggctgctcttactctataccccaaaatcccagccactagcttgcagaatggctttgttggattcccctccctggccccacactcactgctacatctctcttccaaatcataaatgcaaaagatggccaaaggtgcatgctctgtgacacgtttcatagtcagacaaaaccagctgactgcttttacttttttttttttttcatttagaagaatttccttggcaactccgtctctccttagtcaacatcagctaacttcatcctccccctttatcaagacattgtttagagtaaataattcattaactggtacagcaatttcagaaccctttcacatagattcttaaggggaccgtttcccttgaagaatggggtacaccagaggacttaggaagagaagcgcccactggggcttggtcagactctgccaggagacaggcagctgtctgttaactgaccctacccagtaccttctgggattggattaacaaaaggggagttggttaggctggagcattgcaactcatttcttccctgcagtctctctcctgaggtggcccaggtatgtgtttgaggcctgggacttgctgccagcatgagacaagctccagtggggtccatccccctgattcctcagtgccccagcaccacctctttcatttgaaaacgtgttcttttggcaaaaagactatgctccagaactttctggctgagttctccttctattcctcctattccactgttaggtgttggaaaagcaatatatttgatgctttctccatgtcccataaatgactttctggcagaggagagtgactgtcctttgtctgtggccctggatttgaggctaagccttccttgaagaaggaacaggaaagaaaggcttgttggatgtgcagggagctagtggccaactgagcacttgctcaggcggaggggcctggagagaacccagggtaggtctgcctgggagaaaaggggtaagggaggactgcctcccagccttccctccccactggtctgggcacattccaaggcttgaggtctcctagtcaaggcctcctgttattggcttcctccagggagtctgctgagacaaaagttttagattctttcactacatcataaggtaggtaagtttgtgtccctgatccatgcagcatgttatctttgtacctggtaaggagtgaaatggcttccaattttacggactggttgcttttcattcatatcttcttgccatccctgtctcatgggtgagcacatttcctggatttaaaatgtatgggacagcctgtgagaattacagattccagggaaggggcccttttggcacggggggtctgatggtcagagctaatcaggtgtggaagaagctgcctggagaggatccccatctgcatggaatgcccccttcgtggggatggctggcacagctcacacacggaggcactacttcagtcctcccattaccaaactccagggcacacgtgccactgtgtcttgcccacaaacatgcacacagagtatcgatctgtctgatgtttcagggacccagccatgtcatggagggtacatgggcaggtaccatctctgcctggtacatgggcaggggatagatgtgtttccatgggtctccttcacatagaattgtcacctgaacgagaagcccttatccagaagcccagtgcaactcccatctcacaggccaccagcaagttgctcacatccagacaggagacgctagtcctacaggtgcagtgggaggatctgcagatgactacagctcttggcccttccatacagcacatgacaggaagctaggagggttgcagctggctgttgccattccactcagggttgaggggacaagcccacacaggtaccagaagttcaggggtcccatgtggacttcaggccttcggtctgggaccccagggagggtgctctgacagtccgccgaaatggccagcaggcaggcatcctcccaggtggcagtgagaaagggccctgcacagtcagcgttcctgagaatgcgattcctactagaacgaggctgtttcccaggctgcctcctgcttcacccaggactcagaccacaactagactagggaagaacttgttctccacggatgagcctgaccaagttctgggcccactctcccatcctcctgctgggtcacacggatgaggcctgtacactctgggcctcagactccacaccaagaagagtcaggggggctcactctaagccccgccagctcgcaccatctgatggggcaggggcaggggaaggacagggccagcattgagtaggcctgagttgatggcaaagtgtaggcctttgccctgtctcgcccccttgcttctggggtttgcttcgcctttctgagagcacagcaatgcctactcatcctgcccaaaaccctgctccaacctagctgtgtgacctttaggccttgggatagcacacagcaaatgtctgccaccccagtactgccactggcttgggaggccagaccacagaccacactagtgtcacctggcccgtcccacctgttccaagctgggggaggagtatgctcacttgggcttatcagcagagccagggtaccccaacccctgactaggatattgtggatacctatgcccagagcccctccactgccaagtttccacaattgttttgaaataattcccaacagatacccccaccctcacccagtgttgagtctcactcccgtcacggaaatgacagctcccagccctgggcaatgtgctcctgcaaggacagctgtggtgactagaatggcagcttggctactagcacttttcacatgagcgtggctgccctcaggcccaggctgcacagagcatggccgctggatcaagtgtgggtcccagttggatgacaaacccatgttcaaggctgggaagtcctactcggccccacttctacccaggaccagtagctttcaattgtaaatgtgcatcccctgtgatacactatgatgcacaagcagcccctgctcacccctaaagagcagcacaagtaactcagagccactgtcccctctggccagaggccctggtttgtgtctgcccagtgaccagcctgaagatagaggcaacccaatccaggtccatgcaggtctccgtgatgcggagcatgcccagcttaccatcctgatgcagaggcaaggacaacactgggccctgacttgctaagatgggagcaagagcttagggctaaaactcagcagtcccagctctgggggacaaggacccacaaagtgatgcaagatatcctgagttgggtgtgacaagtacaccttgacacacaaactgcacagggaggggaggaatctgagccagcttcctccacaaagcacagaagtctgccaaaagcccaggctggatagggagcatcacactgttgggaaatgtgcaattttcactcagccagcatcactaccagctccgggcttctctcctctggcctcccaccttgcagctttgagatcccaggcctctcagggctctggctgagggctgtgagccagaggctgaggtagccaggtctgccttgggctgtcactcagggctgagctctgctgaaggatctgggaggtcagtaggcacctgtgtccacccagctgtccatacagatccctgcctgcacaagagctgctgcagcatttcaatagggccatcccaggcaccctaggacttgagaccagcctcctctgtatggtcccttccctggtgcacctaccacagcccactctgatgaccccctgtcaaggaggtgtgactgagaaaggaaggggcagagatcccttctccattcctctcaggcccctgtaaaaattgggacctgtccttgccagccaggtctcagggagctcagggttcagtgttggaatgggtctgggcccagatttcaagccagtaaccagcaaatcatggggagactgagaagaggagccccttagcaggcctaaccacacccctaagccacccagcctggcccccctcctctgccccaactggctccaggccaaactctggttcctgaggagcctcaaaggctggacttggggtgtcccgcggaaatcctggtgggatggaaaatccccagcagttgtgaggctgcacttctcccacccgctgtgggtcagccaggccgctgcttcctgcttccctttgatgtctcctcgtgcgagggaggggtcagcacccctctaggcttgggcaggcacacactccactcagctgcagccatggagttggtgcttctagggcctgggtatgctggagtcaggcaggggacctggtgggggtggggatacaggctgaggtggagagaccccacgcagctccctaggcctctgcagacagctcccaagcaagggggcaggaggggctgcactgagcccaccaaaggttgtagccactcatacagggctgtttgatctgagagggaggcgccatgacctctgtttagacaaggaaaatgaagactctggaaaatctaagcacgtcacacacacagcttccatgggggtcttcctctcgtgtctggggaacttccccgtagaggtttcaataactgccatcctttgctgatcctctgtgtaggcactgggccccagcccctgcctgtgccatcactatttcacaggagaacaccacactgaggctctgcctctggttgccctgctctgggtgatgaggtagaggtcacacagccaggccagtggccctagtgtcaaggttccacaccacagcctcatagcagccagtgctcgctcactgaggccaggcactcatcttgtgctgtgcctgggtgagctctggacctgcctcctaaacatagggctgcctgcttcgttcatttccacacaccacgtgcctaggcccagctggggctggcatacaaattgggtggcccggctctgagctgctgctggttactgtggcagtttccacctataccacacctatatacttgccctcccccacacacagcccacctggcccatcccacaaagagagatggcactccaggtggagagggctgggccagaggtcatgcagcaaggtcaggttggaagctgaggtggggctagggccaccccacacaggcctgtctcacaggctgtcacccactgggcctagggctctgagagtaggggtctgatctggagagcaggggagcctgcaggtccctgggttggaatcctggagccctgggctgcagggttttgaggggcagttacctcctcctccccggtggcacatccggcctggaagttgggtagtctggcccaaggcctgccctggtgtgaaagcctgagaccctaaggagagctacaggtggctcaagggcctgctcctcctccttttctgtgcaaacagctcagcttgctgactttgatgcagtggtttaggccaagctttgaagtcagcccttggaggacgttcctatcagcctttgcacagatatctcccactccaaccctaagactcaatgccacctcaggactgcccctatccgcagagcttgaggcctttaggtcagccttgggaagaggtgcttgagtggggtggaagaagcccactcttgggaaatggggagcataggggaggaggaagacactgccttggaatgacactcccagagacctctgctctgcctacctgcattctgctgaaggttttgggtcaccttgttttatggtccctgtcccagcatgaagcttgcacaggaagaacagaatgaatgatgtggaaatctgttagcagtggtgtcttctagattctcaaggatccgggtattttaggaacaaaacaagccagcaggtgcagaggtcacaagcctcctgagagggccagggcagagtgagtagctgcaggggcagctgtcctttgcacctgggcctagagtgccagagacttagtctcatttgtttacaggagactgatgggttcctgagcagcctaggaggggaggggaagcactgcgttctcagtgtggtgcttggccctcccaggtgcctggttgtggcctgccacttagcacccacccctgcctatccagccccatccctggggaaggttcccacctgctccaacttctggtactcccaggctgcctcacccaacgatgacagtgactagcctcagagcctggctgcttggaagacctttgcccaagcagagaactgttgaggaaggtgagccttccgagggccagccctgcctctcctcccctctcctagcctgcttctgtctgggctgaaggcacagcagggacaatcgctcttccggggttagaactgggggagcagggacaaaaagcgggcagccctccccagcatgacaggatgtggaaggctggtctctccagagactgggctaaactctgctgtgtcaagtgcctggtgacctcaagcaagtcattccatgtggctgagctgctccttgctgcatctgcacatatgtgtagtgtcttcctccctgtaggattgtcacaaggattaaatgatgtcaagtctgaggctgccctgcagctgctgtttccactacttggcatggaacatgtgccagaccaaaagagctatctctctccctgcgaaaggctggggtcctgggagctagagctgggttaagataagagcagagactgggtcctgggaacagccactgggcccagtcgggggggtctcagcacctatcacaaagaaagtgccactgggcctagggaaggacaagaagtaacatgtcaaagatgggacagaacccacctcctggcagggagtggggcacacatatgtgcatgttcatatatgtgtcagaatgcgtatttgtcagtgtatgtgtgtcagtgcacataggtataggggctgtctctcagaattcctgagggctttccatttgatcccagtggttgaagatggagtatgatcccaaatcccttaggtggatgtggcctggcagggggtcagcaggagggaggtccctgtctccttggcttccagcttccaggctctggcactcccactgttaggaacaggtacctttagggacacaggagtgtaagccactgtttccgtctgggttttgtcatgtgtaggtcccagcggctttaagccaacctgaaaggttcatttgggagtcacgggtatgtgtcaacaaaagcccaccagaccatcaatgaagtgggcaaaagctctgggtgaactcttggctcaggtatcaggatatgctgggtgagggaaataatggaggcacctttgttctagatgcctgcagattcctgacaacagtaggggtggaggctgtgcagacctggtgcagagtctgtgctggcctctggcctctcacagccttgggaggggtgctcagagctcagctgtgtttaaaaattagcaagtggaggagttagaggatctgcagttaaccccttgagtctcggaaggctgtttgagccactaatcaggaaggagagctgacaagaaaaaggcgatgtctcacccctgagctacaatccactgcacttacagtgaccacccatcctgacatcttgggctcaggcctctgggtctgggcatagaagcccaggaactgctgtctgtggggagtccactgaagctccctgcccccactgagtctctgatgttgacagcctctttgttttttcatctcagcctattcaaggccatttttcagcttgcttggctttgcattaaagttggggggatttctctatcctgaggttatgaaatacctcagcaaggacgaggcctccctgagggagtcaacctagcttgttccctgcacgtactgtggggaggtcctctttaccgccacagttccaagggtgaaacagagaaccaggtggggaaggggtctctccccatctgtccaggggagaggcagcccacagggagccacacaggcaggggacattccactagggccatttgcaggccagtggccatccactgccagcaatcagagaatcacaagcactggatccaatgtgacctctgccaggaccatgacccctaggtcctcttttccatccctccagttctcctggctttcttgccatctttctggctctatcctcagtctccttggcaggttttcccttctggcatggccactaaatgccagtgcctttctctatgcaaaccatttccctaagctgttccctcagcaccaagggcttccagaccacctgtgaggccctgaccccccaaatgtctctccaacccagccagacccacattccagtcacctgcccccacctcctctccacagcctccatcattttatagcccactctactgaaggcccctgtcctttcagtgtcacccatcctttcagtggcacaagtcagaagttctggggtcatttccgatacacccgcttcctcaccacctgcccatcacctcaagcccatcaccaagccaggcttacttcacccatccatagttctagaggttccctgcttccctccatccctattgccactgtcctgataggccaccatttctctgtactgcaggcatctcctaactggcattctcacatcccctgccccattccaatcaattatctactcagtggacagacatcctttcaaagtttagagacctgtgggtcttgcttaatcctgcagctgcctttctggtagttcagatgcttggcttctttccatcccaggtgctcacaggctccctaccaccagagggcccttggcctgcccctgccactttccccaagggagtttttcagaccccaggctagttccagtgggttcctgctatacacctgctgtgctcccaggcctcagcactcccctcagggtgcaaacggtccttcaacattagttagtctttctcccctttgtccactaaccctgggagggtaggcaggtccctgctcctatcaaatccctccctctgggccagggtctagtacctgctgagtgtttgacaaatatttcttgaatgactgcatccctaacatgaggcaatgatcattcccctgcctgttagacataattcactgcctgggaaggcactgtgctgtgtagatgcagcaagctggctaaaatcaactgtagcatggcctatgtcccaagcaggttgtcctgcccatacgctcaataatgaggcccactgaactctcctggtttccagaagcctcataagcaagcacgctcagtgaaggaacaggaagtcctttctggagcagggggagagaaaggcatccagttagccatagaggggaatggctccttactctttaagagtcatttgccccaagactactttctgtcaatcaccagatagccctcagtctacactctgtgatccactcatgaatatctggtctggctctgcgttccagtcagacccttttctgagaggaccacaagtcatagcccagggctacctgtacagctaccaggcttaacaactcagatgcacaccctccacaactgctcttagcacccacaggcctgggccctctctccctgccctgaagccaaccagaccctgggtgggggccgagtctggccaagcagcagtgtgtggagctgggcctgggcctaagctgggaataagcttgttttgccaggcgctggccccccatcgagtccccattctctaatgctaattgctacaattagcaggagaaaggccttttagatccatttcttctcctggctgaggcccgggctgctagggaggttgagcccaaggcttttcggaggagcagggattcttccataaatgaggccacatttaaattgcaaacaagagcttcgcccagccgtaggaaaggctctgggagaaaggcttttagttccgcagacagagcagccagagactgggtgcgctccagcctcatgggccttcctggctggtgtgactggaaccctgggttatacaggctcctgccagtaacctggacatgctggggccggccagttcagaggagcatggcacaggctgataaaggcaccggaaggaaaggcagtattagaggccaccccttgccctcccatccaggcctgctctgagggaaaccctactcgtcctcctcctggagtgtactgcaaacctggatccggtatccgctgagaaccactcattcatcagtctgcactaactggagaaggtgagcaggcccagcccggcctctctaggccacctccaacttggtcaagccacaggtgcccatgccatagatggctgagggacggcagctgacacgtagttccaactaaacctctgggtggcagcccataggttgtgggactggaagtgcttgccaaacaaattatactgctgaccagggaagagggtactctgattggccaggcctgggccagggtctttctcaccgaggtggtgaggctataggtgttagatgtggcaggatgcaagccagggcctgctgcctttaaagagccacagcagagacaccatcccagtcccaagagctgttctaaggaagtggttgtcatctgcggtgccccccaggggacatatggcaatgtctggagatatttttggctatcatgactatgggagaattactaatatcaactaggtagagaccaggcagggtgctaaacatcttacaatataaatgacagcccctcacaacaaagatacatcctgtcccaagcattaccagtgtggctggctaagaaaccctggttgcaaggggtcagattttgacatgctatttgctttctcactgagttgtgaaaatggaggcacactttcctggcctggcctcttccttcgttcaataaatgaatgaaaccattcaacagaaatctgtgacacacccaccatgtgcggaccctatacggaagacagatatgctctcttggggcctctcttccggtggaagagataggcagccaacaaataagtagatgtctaaggaactagaaaagcgtagcctgtgctttgcagagactcgaaaggtagtcgtcagctagtgagtgactgaaggggatgacagatatggcaggtcagagcaaaatttcctgtgagatttaaataagaagaaggaattgtcaagggaagatcaccagaaaagacaagccaggcagaggtggtgaaggccttggggcaggagggatacttggcagatttaacaaagaagaagaaggctggcagagccaaagctcagtgagggaggacagtggtcagagaggtaagcagggcagatcttgtaaaaacctgatggaatttgaattttatttcctagaaatagaagccactagagggtatctggcaggagagtcatggaggcacattcattcgttggttcttggcttttgggactctgcacagagttgatcacagccctcagcctatgaaacactgtcaccctgtaagggtctgcataaagtcaccgctctcttcctctccatgcttttccacttcatctctagcctctatccttgctctcctccctacacaaacagcttctccagggtaatttatttatatcattgtgtgtgtgtgtgtgcactcacgagcactccctagtactgcgtgtctgggtggtgtgtaattttaatttaaatacacagtcatgtactgaggccctctttctgtttggcatttgtgtcactcagcactgtgtttccacgcgtctctatcttgtgaagtgtacatctagtcccctgctcctaaccacagtgaccagctccaactgcccacccctatgggccatgctgccctgagcatgcacacacacagcctctcgttgttctgggtgagaactgctccagcatgtttacttaggagggaaactgctgggccacaggtataaaatattttatttgaggaagaagtgttggccagctcttcagaacgtctgtgcctgtctccgtccccacctgcagcacacagggaggcttgttccttgccttctgccaacacttggccttatcctactttctaatgcttctcctatgaagaatagctgttgctttcatttacatttctctgataactgattagcttgggcaaattttcatctgtttgttaaccctcctgcaaactggcaatcttcctacctttttcttaatgatttgtggtgctttctggtatattttagctgttgttccctcctcagctttaattgtttcaaatatcttgtaatgagtcatggcaaagttacattcatgagtgtaaaagtgaaaaacgcaaattgtttccttagtattattatgaaaacagtcttgacccttgccatgatggatttatttaacagaaatccttaatccataatcattaatgcattcaagttcatacattttagtcttgaggtttgtgctttctggatcctgtttaagaaccccacggccaccctggccctggagattattcattttttctcctattaaacaaatggcaactaccttttgctttcaaatatttagtccatttggagtctacttttcctaggggctcagttaggaatccatattcctattcctccattttagggctggctttccaacatcatcttctgaacagtccccactgatatgtggtgccacctttatcacatgtccccttcctctagacttggagttacctctgagctctcttctgggcctctgtcaccacaccgctctgattgctgaagttggcgtgtgccctggtatctgccagcagaagtcctctgctctccttttcaaaagttcagttggcatttacaaatatttttcttccacatacattttagaatatgtttgttaaattactcaagccctccaactggaagtttgagtggagtcctgttgaacttaacagatttggaaaatcctgacgtcattctaatgccaagttgccctgttcaagaaaataaaatgtctctgcatatggaaagatctccctctatatcctccaatagagttttaaaattttttccataaaagtcgtcgtctttgttaattcctagactggtataaattttgctgctattctgattgctgtcctaatctctattatgcttttttttagtcagttgctattggcataaagaaatgtggtttgtttttgttttttgttttgagtacactgatcttatatccaaaacctctctgaaatctgaaatctctctttagttgttaagttccttaattttttttttccatgtagcccagtaattttcaaagtgtagtctggggattccagagagccccccagaccctttcaggaaaggtcaaaaacattttcataataatactcgacattatttgccttttctttcattctcacaaagataaagagttttccagaggcagcacaccatgaccccagtggaatatgtgcttgtatagttctgctttaaacatttcttagttttaacttctaagatggtaactatcaacagatagaatctctatcaagaaaagccctttgggggtttcaataacttttaagaatacaacaagtcgtaacaccaaaatgtttgagaatctttatggagaccatcaaccctatgagctacactaagttttatcacttcctacctgatcctcacatccccatttctttttcttgtattagggtatggccaggatgacatccttggcctactccttatcttaaagagaatgatacacttttaatttctctatcaagtttactgaaaagttaagttttggtttataacttgtatcaagttgaagaagttcctctctagtcctggcttgctaagtggtgtactccactaccccaaaatcacacataggcgttaaactttatcacatcatttttttctgcctctattgagggaaccatatggtttttctcctgtagcctcttaatgtgaattacatggataaagtttctgatattggatcatctttgcattcctaagagcaatcccacttgtttaagaattgttgtttaatacatattattggattcagttagctagcattgtacaaggaacttctgcatctacattcataagggaaattctttatagttttcttgtgctttctatctgaatttggacatgctctgattcgcaattttaaaaaatccctctagctggagcataaatcctgaaacagacccacttttctcctcagcatgttaggaaacacattaaaatacacccataatcaagcaactcaatccttaaatttttctcctactgagtatctggaaaacaggtgcagaaatggatcatttgagacaccatagaaatctggttaatcctgcctgcctgctttccttcaagtactgactgagtaaggctgtgtatcaggctcttggctgggtacagagcaggcagcagaaaacaaaacagagttcctcgttgggagcttttggtctagcaaaaggggcaccacagtaaagaaagaactggtaaatgcacatcaaatgtggatattatcaggaaagtttttatactttgtgataatctaagacagaactattctacctggatgaattattctctttcataaccagaacagtgctgtgggaaggcactcttactctcaattttatataaaaggctatttgacctgctcagggaccacagtggggtactgggatctgaacatagtggtggcccttcaagcctactacccagactgagacctgcatctgatcaactctcatctccaatatgaccaagagacttctaccactacctctcacctggcaggtgatcaccacccccaactcagactgcaacctttacttcgccccctaattcctgactcagaatccccacctagaggcagaacttcgacttcaattcctgactcccataccccactgagacctctaaccccaatcccaatctcttaactcagagccccccattcagaacctctacccaaagacagactccagaccctgactccagtcgccaactcggacctcccttggatctcaactcagagccatgatgcagactccagaccgggattcaggtccccaactcagactcccgatcctctgtccctaatgaggccctacctaaaaccaccatgcggactccagacccggactgactgggaccccaactactcagatcccaactcaggcaaactcccagccaggatgtggaccctagacccgaattctgatcccaactaggatacctaactcagaaccacaacggggattcccacctccgatcctaattcgggccctgactcagaaccactaagtggatttccgactccggtcccaattcgggctttgactcaaaaccacaacatggattcccaacttccatcccaatagcgcggactcagaaccacgatgcggattccagactccaatcccaattcagcccactctgaaccaccatgagaactatagacccggaatccgatccttgggacgcggccaggaactcggacctcgaccctggccacgctgtccataaggtgcagatgggagcgcactgcccaggccaggctgcactgctgacgcctgtgatctgggacggccgcggggcacacagctcacctcagcaacgccagtgatcacccgtcccgcgccgtccgcccaggtccgtgctgaccgtgttcaaaccctcccagagagatggggagggccgcgctgaggagagtctgggagaaccgcactgaggagccgccgggagagtgccgcgctgaggagcccccggggagagtgccgcgctgaggagcccccaggagagtgccgcgctgaggaggcccagggaggaccgcgcggaggagaaccatgctgaggagcccccggggagaacagaaccgcggcgagaggcccccggagagaaccgcgccgaagaacccccggggacaaccgcgccgaagaacccccggggagaaccgcgccgaaaagccccgggtgccccgaggagaacggcgccgaggagtccccggggagaactgcgccgaggagcccccagaagagcgccgcgctgaggagccccgaggagaaccgcgccgaggggcgcgccggggagaaccacgatgactgacgcaccgaggaggaccgcgctgaggggcgcaccgggagaatcgtgctgaggagccccggggaggaccacgctgagaggcaccccggcagaatcgcgctgaggggcgccctggcaggatcttgctgaggagctccctggaggtccgtgctgaggcgacgcggcgaccgttctgcctggagactgcggcagcgctccgactgcccccgccgctgccgacgtggcgaccgccccccacctgctgattgggcggcagcaggggaaggcttgcggcgggctgctgcacggattggctgggtgcggaaagtgatgtgccgtgtcctgtcattggccgaaagagtctcgttttgatgccacccgggctcagattggcccagcgggtccagcgccgcatgaggcactggctgggtgtgaggtggcgcgagccgccgccctccctgcccccacccgtcgtccctgagcaccaccgggggccggggccagcgccagcctcagcgttggcatcgccggggtgagctggagacacgggccagttctctgcgtgatgtgttcaccaccccggggtgaccgcgtgaggacagcggccgcaccccgacactgctgtgggccctcggtgtggaggcctgtgggcgtccaggccacgcccgagaccagcccctccgccggcgccgctgcagcgaccctcgaacccgggcaaggtctccaccgccgtggcaccgggtgcgggaggcgttttcccccctcccagcgggtccatgcaggggatcgggatgttctgaagcccccactgctgtgcctggaacacccgtgtctgccgctcacccctgaggacttgggacctcagggggtgagtggcaggggtggccgggacatgccaggccacccacctggcaaagggcagcgccgagggcgccccgcgcctgccagcgcccggccgggcccgccctgcccacctcccatcccccatccgggcgtgacacttgaccgcgtctgccggcccctccccttgtccgtcccctccgcgccgctggcgcgcgccttctgaatgccaagcattgccataaactccggggacaaaagcctgggtcacaaaagccccctctagaagttcacaccctgaggcttccctggcaaggctgggggccgtttggcccttccatgtggactgcaaaaacagtgttggaatgcaggactctgggtatgttctcgaaagttgttacaaccccaacccagggttgacctcaaacacaggaggaagggggaggctggagccagccaagcgagccagccgtccccccaccaaggcacgcaaggaggccattcatcttcactgcctctgccgaaaatatacgtctacgggagagccaggaatctctctccaagggtgaccgggttgggggttttgttgttcttcagcccagaagagaaagagaaaatggtgtcattttttcaggcagcaagtgattcctttcaggccttcagcaacgacgcccagatgagtccactccctgcctcctgctcagcccacaggcaatctgggcacaagtgacacatcccctgggcgcctgtcccttcgcactggcccagggagttcatgtgtctgatcagagggcgcagtccaccctcactatctagctgggaagtttttgtcatctgcctgtccgagaggcagctgtgcaaccagtgccatcactcagagccagtgctcaggtgcaccccagactcagggtttcacgctataatgtcactgtcttgaaattcttgatagttactatctttgaacttgtgttttagaagtgaagtctgaggggaaaatggagcttggaacttcagctcccaagtggctttcccaccttcctgcctcctcaggacagattatcagctgcctgtctgcctgcttcctctgtgcccagcctctctcttgacatccaaaggatcacaactcccactcagtgaccactattattctctgcccctgaccaaaaagagcagggcagggctggagtcctgaccctggcctggactctgcaatgcagagatacctgcaagtctcatttccccgcctgtaggatggaggtgatgctgacagcctcttggagccattgagataggaaacgagagagattatgtgagaagacagggtcaggaatgttgagttgagggtggcctcaggcccctgtcctgctcctttttgctgcttggggtgcagctcaattccagcctcactgtggcccccaggcctcctctggccttcctcagccttcctcaggaggccagaatcctcccctgatcaccctccctgcatgtccatttctacctccccaggaggtcaggggagcaggatcccaggtcttcagagtcatttcacagatttcaccagaataaaagtcccactcatgtggggtttacattctggtgggaaagacagattttcgaaacgtggccatttttctttgggcctttgttagctgcatcagatggaggaggtagcctggtggactccttcagtcctcgctcttggacacagagctgtctcccagcctttgttgttgtgttctccaaggatgtcgaacacaggctgaaaagctccctaaatcaatttcacttaaaatggtgtccaccctcctactaaagagtgacaaagggtgttggttaggatttttatcttgaaaactgatttgtaaagtcatgaaaattgagcttatttggtcttacacttaacaaaactgtgggttctaattgtgggcctggatggggacatatcttacaagtagttgattcatttatatagattttcatgttctgggcttgcctccaccctctacctaaccctggaacctcagaccccaagctcctgggcacttggatttttccctgacaaattccccgcctgtgatattccatgggcacctcaccttgtgtgcttgtgtgaggtctccttgagtactcttagcagtggggttgccaggccaaggagcctgtcactattgtttgtgaccagctcaccagacgtggtcaggaaggacagttctgtgtcctatgtcctctgctcctcaccccctcgccacacacggggtgccgtcaatcagccagcgccgcctgccagcccagcgcacctgttgtgtgcccccactcccgcctcctctagtcctttgggggaagagtggagaggaaaacaggccgagactgagaggggtttgttgtctcgtcgggcgacaagagacacgtgggaattggctagagaagcatgtgaggctgggcggactccaggccagccccagaggcagatgggggctgccaggcaggctgggaggtgagcccagggctggccttgggcaccatggcagaattctgggagggggctgcagtcacggccagctccctttctgaattgttctgtgggttgtggaaggctttgaaatttggcgcctgcaccttgtcaccttcttgggactcaaggctgcaggggtgggtgtgagacagagagcctgggcacctggtggccactccctgagctccccacgtgacagagggcaggtcccattctccttttgtgtctggtttgcctcatctgtacatggtaggggctgagctagcgttccttgcactccctccagctttactctttggggttcaaaaggttcccttgcaagcctgtgcacccgagagcacgcacgcacacacgcactcacagctgaagagaattaggctcaaaacgtccactcggcttttctcttgattccaaggtatttagagtgggggtgggggattaggggaggaagttgctgagctaattcttttgcatttgccagcacagaagtgcagatggggcccagagccccggcggtgtcccaggggaaacaccagtcctcttctgcagtgcaaggcaggagaaagaactgctgtgggagcccctcacccaagcagcaggatgtgtggcaggccctggccaaggagttctgtgggcctcaattctctccctaccctgcccccaccctcggagtctaagggtggaaccatcttcagacccagccaggttcccaagttgctgcttccctcggaagctgagaggcccagggccacgtggcagcctccgcagtccatctgaagaaaggccccaccccacgctgctctcaggagtggacaggaacgtgggggagtgggggtggttaggacctcagggttatccctgagtggctgatgcattgccaggaagcctgctcttaaggtcagcccttgcagttggcagtctgtggcccctcctcggtccccttcagtgaggctttttgcatgcattggtccacacacccaccactgcagctgtcctgggtaagggctctgtgatcctgcaacgcccaccttcttccttcactggtcataggtttctgctgaccctgcagcccatgtccttgttccagaatcttccgcctcctgtggcctgtgtgtcgcctgcacctgcattccactggggcttcccttccaacttgatggtttcaggtacatgggcctgttgtcaactctgttcccactgagcccatgagacggctattcctttgagacatgtttacttgacttcctgccccaggtctctgctgtacccacaggtggcatggactcatgtccccacccaaatcacatccccaccaggatgggcaggctctgggtccttttgggccttgtaggctgtcgtcagaggggaggcacagtggggagtctctaggaggttttgggcaaggcagtgccaaggatcagatctcccttctagaaaggtcactctggctgctgaacagagagagaactgaagagaggcagcagggtgagggggaagactacgggggacttgccgtcacccagtgagagagatgggagggttggagaaagcgagcatctgtggaggtgtgagaagtgccaggctgggctccctcaggcggcaactttgtctagacttctggctgaggacagggaggagcttaaggtagccctcagcatccaacaggggtagcagcctagtgcatgtatgaccacgagcgagcccaagggaaggacgggtttggagggtttctgaagatctggcttggatatagtggggtcagaccctatccctccacccagctgcagtgacaactctgtggctctggggcactgtcaccctgtggcatggcctgtttgtggtgtccattgccgtcttagctacccaaggcccagggagaggcacacggctcaggctgacagagtgtgacagatgcaggtcctgctccctcagggaatcccccattccaggacagtctcagcccccatgcaagagcagcctcagcatgggctgctcggggaatgccctcagacaacagtgctgtgttagggtcactcccagcctgtcctcacaggcagatttgcgttcctgcatttggggtcagtgataacgtgaggccagacgggtggggggtctggagttcaggcggtctccatgagtggcagcacggggtgtgggccagttcccattgggagggcagctgtgctgtgtgtgtatatgtttgggcattgctcagccaagccttgattagccgaacccaactctcccagagcccccacttcgacgcgggttaactcagcagctgtctcctgagcacctgcttggggcctggttgggtgccaggcacgggggggtgggaaaatgaagtgaactgggcctgccagacccattgcctgcagggccttttctaccaccaccttccagaggcagcttcctcccacaaagcatcccaagctcggggtgtgtgccccccttcctgtgcaggcctgccacttccacagctgccccccagccaagaacaatcccctcagcctgccagggaaaagtgggcccaggcctttgaggacattgccacagccagggccaacctgggaagttgtttctgattatctcttgagtcctgggagaggtgttaacaaaaagccccatccctgtcgctctggtggttatagtttgttttacgcattaaaaggccctggatcggtatttgtagtgagaacagatatttgcagagagcctactccattcccagctctgtacttgtagagggtgaggctgctgaaatgaaacccaccaggcctctggtgagcagtgggtgcagagtcattggcagtaaaggtccttagagaacctgaagagaatattctaatcaagctaggcaggctcagaagatggatgtaatttggaggaaaaagacaagaatgggaaagaaagggaaacctacctggggtaccgtgtggctgtggtggttttagtatgtgtctacaaggcctttgacaatccgttcttccggaagtggcacttaattcccctctaattaagttttggctggactgtgatttgcttctttcaaataaaatatggaagaagtgacagagcatgacttccaagactaggccttgcagcctccctgccctctcactgggatcactgattttgggggaagccagccaccatggtgtgaggacactagcagccctctggagaggtcctgtggtgaggaactgaggcctcctataaatggcctcctgtatgagcttgggagtggatcctccagccccagtcaaacctctgatgagacagcagccctggtctacaccttgactgcagcctcacaggagatcagaaccacccagccaagccacccccagatccctcgcccacagaaaccatgtgggatgataaatgtgggctgctttaggaatgaagctgtagggtgacttgtcacacagcaaaggccagctgacagagccacccactctcaccaggcttagtctgacccttgtcaggggcagcaaagtgggctcagcctacctgttggcttttactgatggttggtggctcccaggagaaagagtactgtgcccaggtagcatgcccaccccaggcatacatagcatgtctttgctcttgcagagtttgaactctgcccaccagaccagtggctcttaacctaggctcctcgtgagaaccactccccggtgcaggtcccactcccagaaaggagagcggttttgactcctgcagtctctaaggcagcagagagctgtggcattttgggtggagtgggtggagagggtgcgtgatgggtgggagaaactgacagttggaatgtgatttaggaaatgtaacgggtgaccttttctccccaagagaacaccaaatccatttccttgggacatggataaggctaagggcagcacccacaaggaccaggagcggggttctcaacagccacttctgtcccaaatttgttttctatgcccaggaatgtcaaagggccctcttggggtcagccacagagaagggggagcaggtgtgatggggtggtgatgggatgctgtaggtggatgagaagtagcaccaaagctcactactgtttttctcttatccctgggtcttggggacaggcctgtgccagaagcagggattgcttctgctgtaacgtccactggaataaaaagcagacattgcagtgttgagaaattcctttagccctcaggaggcaagttacagaacaggacagaactgccctagtcaggccctgcctgggcacagagctgccaccactcttccaagagccctcccttttggggactgtgcccccaccccacccccaggcagcccctgcctccaaccttactcctagctggtgttctgggccgtcagttcataggtccagctctgagacctgccaggctctcagagcagcctggacccaggagagcgataaatggatgtgcactggcacactccaagcagggaggctttgtttatctcccaattagtcctgtagcacttagtatgtcaggcatggttctgagggcttcatccacactaccacccactgtagagatgggaaaactgaggcatagcaaggtcaagggattgggcaggccttaggatgtagaagctactagagctgggctgcacctgggtatcctggagccagggtctatccctccccctctgccacacggccttggtgtgagggacacagcccctgtttgcagaggcagctcctttcatggagcatgggggacagggcaggtgtgccttggcccacatttggcttcttgagcgccgaacctgcatgtgccaccccccagagttcctgtgtgtggccgggtgaatgtgcacaggtcgaggaggtggtgtgggcagccaacctcccaaagcaccaggcccctcagggctgttcccctgtttcccaagatttcccaaacagatggccaagatcgggggcacccaggagaccacgctcatgaattgttccacttgaacacaacattgttttttatggaactgggctggggagtcctctgtgactctttcctcagtagggagagagctcctgaacccaccgtgcacacttcttcagcagccgctttggagacttgactttgacactcttctcaacaggatccctttcctcactggtgtctgcggcccgggccgctggcatggctgagcggaacttggcaaagcagtgaattgggagctcacttaggcacgtggtcctgaggctccttgctggcgtttctgttttgctccctgctcctttcttttctttgtaacttctcttcagggcacccacagcccccgaggagggtggggctgaggaggctggaggtggagcccaggcttatccccctggtgggccaggcaggcagcaaagggaccaaccccaagagggtcggtgcggagacccctggggtgcacagggtgggcagtgaccagaagactcaccccagggcctctaattttgacccttgatctgggtctaagcacctctgagcaagaggtgagggtttcaggcagcctcagctcttaggaggcagaagatacagtttatacgcgggttgcggggggcggtccatttccatctccctgttctctccccaggccaatggccagggctaaagccctccttgggacatgtcaatagcagcaaacattttaaagatgtgacatgttcgaagcctggcaacaggggcagctccagctgtgcgagaacatggctggatttacgtctgcggcaaagcacccggtcacctttctctgcttggagtgcaatctttttttggaagccctgctggaaaatctgaatcttgtgagccatcagctgtttataatcagagaagcatatgtttaaaagagctgaggggccttataaactccgtgtgcaaattacctttggggctgcctgctccaccgcccctccctgaggctgccatcactggcgagcggctgagtgtgctgcacagaattcgctgtaaccctgttgtggcacggggtctgtttagctttagtcacgtcagcttggccctggagcgtgggagcctccatctctcctgcacggcttccaggccccccccacccccaccccccagccccagctgcagaggacttctggctccctgttcctgggctttcagcatgagaaatatcaaacctgggaaccgtgcagcaagaagcgggcagaggctcagacgccaggacctgcgggggcttcctggaattgggagccactctcggtgtctgctctggtgctacggtcctgcagggctgttttttttttattttgtattttttggtgttcatttttgtttttgtaacagctttattaagataaaattcacataccatacaattcacccatttaaagtgtacgattcaacggtttttagtacgttcagagttgcgcaaccatcacactatctagttccagaacattttcagtgcccctaaaagcaaccctgcattctttagccgtcactccccacttcccttctctcattccccagccccagtcagccacggctctgctttctatctccacgggtttgcctgttctgaacatttcacatagctggaatcacacactaagcagacttttgtggctgacttctttcacttagcctaaggttttcgaggttcattcatgctgtagcatgtatcagtgtttcattcctttttagggccaaataatatgccattttatggatattatcacattttatttatccattcattcattgaacacttgggccatttttactttttagctattagtgaataatactgccaggaacatttgggtacgagtttttattgtggacatagattttcatttttcttgagtattcacagaggagtagaaacgctgggtcatatggtgactccatatttaaccttttgaggatctgccagactgttttccaatgtggcagcaccattttgcattcccaccagtagtgtatgtgagttcctatctctccacattctcaccaacacttgttactgtctgccgttttcattttagccatcttagtgggtgtgaagtgatatctcctagtggttttgatttgcatttccccgatgactaatgatgttgagcatcttattagccatttgtatctcttctttgaagaagtatgtattcaaattctttgcccaaattttaattgggttgtgtttttattatttagtagagttctttatagtctagatataagttttttatattctagattcaagttccttatcagatatattttcttcctttttgtgggttgtcttttcactttcttgatcatgtcctttgactcacaaaggtttttaattttgatgaagttcaatttatctgtttctttctttggatgcttatgtttttggtgtcataactaaataacaacatgtaatctgaggtcaaaaagatttacccctatattttcttccaagaattttatagttttggctcttacacttaggtctttcatccgctttcagttagtttaacatatggtgtgaggtaggggtctaactttattctttgtcatgtggatagacagttatcccaacaccatttgttgaaaagactcttctttcctcagtgaaggatgttgatacccttgtcaaaaatcagttgacagtaaatatgaaggtttatttctggattctcaattttattctattgatttgtttgtctatccttatgccagtactatatcgtcttgattgttatagctttgtagtgagttttaaaattggaaagtgggttttccaactttgtttttctttttcaagattattttggctattctgggtcccttgaatttccatatgaattttacaatcagcttgtcaatttctgcaaagaaaccatctgggataccaatagggattgcattgaatctgtaggtcaacttggggagtattgccatcttaacaatgtgttaagtcttccaatccaagagcatgtatttcattgtatttggatttttaaaaatttggttcaagaatatctcatagttttcagtatagtttttgcactactttgtaaatcctacagggttttgtgtgacagtgactggcagccatacttcctccccatgtactgggttctgcccatcctccagcccatctcccttggagtctctccccgactccagggctcatggcccctttcaggcccttggcttctggtaatgcttctttgtggtctcctgtcttgcgcactaattgttgcccaagtctttgcacatcctgcatcctgcctggagtgttctctctcctcccttttctgtgagccgtcatgaaacacctcctgtgggcttactgagccaccatcttatccaagtgctctgtggcagcttgtggaatcttctcaaccttgggtgtcgcctgcccagaacggggctctcggaggccagggtgactccactatcccaccaacctctgtaccccacggccatgcacaaggcacagggtcccacagagggtctgtgggtacaatggagctatttcccagtcagacctcacaatcggtaaactgtgcttaaactaagtgaggtatcttaaggctttaccaccagggaaatagaactttggcagcttacaaaggagttttatttttcaaatttcctttcaactcgagggtctcaaatccactcagcagacttaggagggagggtcctggcactgcttctgaggagggtgcctttgaggggaggcagagttggctcacgggaaaggctggccctgaggcatggcaggtggcaggtggctggggctgctcacctgctcacctgtgtccatccccttgggcagcacacagccaagtccttttggaccaaattggatcactgccaaatggtatgcccagccttgctgaatctctacccatctgtaaaaaggagaaatcgtttctgtgctccctgcctcccagagagccagggagaggccaggatccaaggaggtaacggctttctagccctttggaaacctgagtggggttttgtgcttgcatctcatttaagccatgaacacttgccggctctctattcatccacaccccctgcatttattgagtgccttctgggtgcccggccctctactagatgtgggagttaccgtgtgggatggactgacactggtgacccctgcctgggggaagcagactctagctgggcagcctggcctcaggagatcatcacaaccctcgctggggctggggtgcaaatggggcaggaacaggagtccggcctgggggatgttagactcaccagccatcccctggaaagctgtggggagactcagagcagagcccccagtaatcatagtgaggtatttagggatagagtggagatctcgcccacatattcccgaagccaccaggccagacaccgccccagctgaatgcatgctggcggcccaaatgttagacactcttctctcttaggtggtttgaggagacttaggggcttccatattccccttggaacatgaagaaggggctggctaaggcccccatccctgctcaggcctacaggagagccctgtggacactccagcctcagccttccttgccatccgcaaccacaccagtggctggaaagccagagtcccctggctcctgcactttttctgcacgggactccctcacagcctctgggttgggagcacacatggcatctcctagagagtttgggggctggacacagggaggaggcagcatgggaaatggaaggactgcagcccccgcctccctccaaggcagttgtcagagcaagatcagctccctggaagacacccgggttgtaaacagggtggggcaggggtcctggtaagtatgaggaaccagagacctggtaagtatgaggaaccaccccttggcatggggcacccagaaggcagcaggctaacgactccccatgaaattaacaactttgtgaagcatttggtatttgggggattttacattagggttaatgagcctctgaaatgagatcccggagaggggccaggaccatgcctgggatgtggcttccgtggactgagcagcctggagcccctacttgcttggtgtcccgagccagccggacctgcatcccgctcctcctccgctccctggaaacgttccctgaatcacattgttcactgcgcttctcaggccttctgggctcttcctctgctgctcgccataaaaactctccagtcatcttttccgctgtggtttttattgttttattttattattccagctatattacgttgggaagagctacagaaatggtttcttctcccccagattccagaacaagtcacagccattgtagattttgattaatcgccatccccattatttcttcactttctccagctgaatttttcccactgtgggaagggggtctggaggacaggcacccttgttggccgtggataggtttctgttctccctcgacccacccagcaagagaaaaaagtgagctgacattatgggtcggcccctgttctggaggccacagccacaggctctgcgggcctctggccgagctgggttgcaggagaagccaagtgccgggtgaaggcctggggaggaatctgggttctcttggctgctggtaagattatccattaaatccatattcctcactgtagagttcatggattcagaggatataccgtattctggccgtcttacattactgcaatattgcttccagatgggcaaacgcgcgctcggagcctggccctgcagacacgatggcccagcacgccgctcactgccgcgcctttgttctctgcttcctgctcggttcctgctaactcagggagctccaggtggctgccactcaggggtgtgtggggggcgccttggggcacccaggcctgcagccctcccccacacaggcagtctccacagagatagagcgccaaggatgcgggccaggactctttccgagcctctcctgttgctggggcctgctccctgaagggcacagtcctgggcaggcgcagtgcccaggctggagaggtcctgcgtctccatctcatccacaggataagtcaaatgggagcattccagcattccgcatctcatgggggggttgggcctcacctccctggcagcccactcacctcacatggcctgagccgcaaggtcagccccctcccaggcccgtgagaggcagcaggcactatgggcgagctgcctgctgggccacaggctctggtactctcctgggttggggctcccggggtagggctaagtgtggtggcagtggagtcagggcagctggacagcccctctgccatcagtgagaactgtcttctctctgcttcccctgtgcacttctgaatccccagggctgggcacagggctgtgacgccataggtgctctagatagatggaggagctcacagctgcagggagtgttgggtggacatatggggtgtggggggcgaggccaggcttcacagaggtggaatctcaaaggaggaagcggcatgccaggtggcggacatagcacctgcaaacgcctgggaggtgaaggcaccagctgtagccagcatcccagaaagggacacgaagcccttggggccggggtggtaggggtaggagagcatcttgagggtggctgcagcatcgtcgtcatctttccaatggtggcatcccttccccaagcaagggaatgatgcagacagaggtgcctttcagaaagaatggaggtcctggggacctgacttctgggtccctcaggacacatgctctccagctcgtcagtgttacctggatactctaatgggggcacaaagccaggggggagcctgcaggaggggcctagccagggccaggtgtcacacaagcagagctccagggtgcagctgggcagattgccggtggttggtgctggtgaggagtagcagggtggggtccggcggtaatgccactgatgatacttggcgaggatgaccgcaagtgtcttgacccaaacatgagatgcccctcacccatcctcccatgaacctcagcatgggcaccccatgccacccgctccatttacagccaaggagcctcagtagagacacagctagaaagtggccagctggggtttggtgctgagcctctgtctgactctctgctctctggagagctcaagggaacctgtaaagacctgcgggctgtgtcatggagggcccttaccccggaggagccaggaaggtggacagagcaggcaggagtggggcaggagggggctttgcagattacccagaccctttgttggccagtgtgggaatggggggaggccagggaggaccccctgcagcctggctcaggcaggggcatgtgtgaaggcccagggggaagagagcagccaggtagacttcgtttccagccggagtgtacctggggatgcctgtgcccaagccttcctcttccaccacccctgctggggtcccctgggacccatccttccaagcccctgccagccttggaacctgtgactccccaggtggtcaaacacagaaggacctcttgggggaaggggaaccagcaaagggggtatggggagccctctggggcaccctcatatcacaccctgtccctctggccacattccagctggccctgcctgtgagggttgaccagctggagcagccccgcatcccacatccccgcagccttgcgctggtctaaatgcctcccagcctcctgaggttgagggtggccacaccagccagagcttgggtgattgagtgggtagagggggtggccagagtgggaaccatggtgatgcaaaccataaacctgtcccccacgtcacctccaaaccctttgggctggcctcttggtgaggaatggccctgggagaggctgccctgcctttgacctctcatgcactgagagtaatgggcaagcgctgtctgcagagcactgaccccaccgccggggtcggagcccctattcctagcctcccttgagcgttttggttgccggatcctcattaatggctgtttgtatcacttaacaatttttcacttttggaggggtcgtgaataaccccaaagcaacatgtaccctctccgggccaggctcaagcggtcctctcactagggaaagaagtcagaaaaaagctccaagctgaagcgcccacacctaccctctgcatcagatgtgctgcggctctcaaggaaccctctagggcacagctttggggagtggagctgcgtggtcagctggccaagccacagtgggaaaaggtggcccattggccagaacacagtccccaagcctcctcagctaggctctcgaggaatggctgggtgtcctttctcagcagaaaagccttgtccccagcctccagggccaggctccagcttcccaggcgtgtgcttcccacccaggctcttgtgggttggcttgccaagcggtgttaggacacgcagcttcagttctgcagggcctggtggaattccattccctgcctcccagaaatcttatcttgagggccgctcagctacagtaggccccaagccccagagactccagattccccactacggaaggcagccgtgaaaggcacgggcagcgcggtgcttctccttcaggaggtggaactgggtggcccgcattgaacaggccaggagcactggtgttctggatccaaagcaaccatctcttcccacatttggagggagccgagggcaggcaggagccaggacccagtgcatcctgaatactgggtgactggcagacatcactctggcccaaggccaggcctgcagtaggagctctgtgcatatcccctatgtgagtacaggaacctcagtggtgcctgtggagctgttcagtgggccctgtattcgccagcacagccatggtcctgctgagtgacaaacagccccccagatgtcctgccctctggtgctgcttgtccaccatgaagtggccggggctctgctcagggacccaggtgctcttgcagacaacccaagtcttccttcctactcctggcagggcaggcaattccactgatggctgcagtgcgacacagactgggcctggcatggtgtccctcagaccccacggcttggtcgggtcacctgggccatttcaaaggctgttggggagcaggaatcacaagctggatgtcagcttgagggttaccccagagtgagagcctcgacagccaggccctcccaggcttctgtgatcgcagcccacacctctgcgcacagtatgccaatgttccccaaaatctacatactgagaaggtagacagcaaagccacagggagacttctgggtagcccaggtggaattcttcccttcctgtttcccagttttccacccttttccctggctttcttccagaaccttttaatgaaagtgcctctgccccaccagggcctggcttaggatgggtgagggagaggagctccgggaggtcacggccccacccaggaacgttcctgtcccaatcctcccatccccatattcaggaaagttccccaggcccgtatgaactggcttcttaattttgttttaaacacaagctttcagaagagcagaaacggaaagacagatggcaggaggtgccgcagggcagcactggggagcctgagatagagagcgggtagacaggaaagcagctcacagcggctggagagcagggagcacacgcctgtccaagaccttgggccagaggaaccccctctcccccgatggcccactcgccccagggcctccaggtttgagccccccggggtattagcccagcattttaggggctgccgtggtcatggagtaaagaccacacctggcatggcttccttggtttctgaaggctgcgaaagctgcgtctgtcgcagaagtgaaccttgttttgttttgttgatgggtgtagtctcagggcatgttcaatgtctgtggagctgcctcttctggaagagccgggttgacacccgcgtgccccgtcctggcttaaacactttgaggccctccctgccctcgggggagctgagagccccactgcagcccagaggccctcccctgacagctgccttcctctgctccgtccttccccacatccccctcacacaccttgtgcttgctctgggcttcaggggcctgagccccaggtagacccccacacttagggtgcctcaccacactccatccctagccccagactggcttccctgcatctggctgaccccctcctcacctgcctgtttccacctcagggcccctcctgaagccggaacttgatccccgcagcaccagcccctccccgtagcctcatggggcacagctctgaggatgtggatgagcagaggggaggacagggatgatgaaccccaggaattggcttccagtggatgcaaggctgactcgtacatgtcatggaggatagttcgggcatctgagctagctgaggctccttggagcacatgcatggcctggactgtccagaagtcgtctacgtgctttgtgtagacgcatgactccccagctggctccgtactagatgacctgggctagggccacttatatctgtcaggggaagggcagttgcagttaggaccacactaaaaggttaatgtccacgctggtgttgaccaagccctggaccctgctgtgccaggcactcccatcagcatccaggtgcccattttactacagggatctgagagctggctaggcaggcatcccgggtcattactgggcctgtaagggccttcatgtctgcaccctccctgccatgcaccttaaggtcaggaagtccattcaaatgcagattcctgggctattccaagagttactgaatccccaccctggggtgaaggcttggcgtctgccagggaccatagaccacagatactcatctacgcttgtgacccccctcccgcccctgagtgtgtgctggggcaggaggccctgtggcaagtggagccccaaccgcagagcaccatctccagccgtgtgctctcgggtgcagagctgacctcccaagtctcaggcttcttgtctctcattgggggtaacaatggctatgtacataagattaggagaacacacagaaggtggtgctggctaaagccattatcacaggctggtgcctatagtcccagcactttgggaggccaggcgttagagaccagcctgggcagtataacgagactctgtctctaccaaaaaaaaaaaaaaaagagccatacaaggtggtgcgtgcctgtggtcccagctgtttgggggctgagatgggaggatcgcctgagcctgggaggtcaagagtgcagtgagccatgatgactgtgattgacgtgttgaccaggcactcaaaaacaaacaaacaaacaaacaaaaaaaaaaaccattatcaccccctgcacacaaatcccagagttcagagaacacagatcaaaataagaagtcagagaatcctctccagctgaaaaccctcatttgttatcacccaaatgctgcctgctggctggcgagccttgctggtggtggaaggcccagcagtagcaaaggaaaccagggcaggacagtgtaggaagtcctgccctcggatcatttggggaaattggcacctgtgtttctcaccacacagtgttgggttggagaatgggcctgggtgcagagcttcggagccaaacaccgtgctggtttcagagaaacaaacagccctgatgtagctgtggcccttggaggtgtccgaatagtccatcattttcagtgacagaaagacggaaatggacacagatcaaacctgcatcacagatgtatagctaggtcagcgaaccactcaaaagaccccagggtctgaccccttgcacgcctgggcggaggtggagccgcttcaccatacatgcaaatgtagcaaactgcaaaatgtcccaaaacaagtcccttactgtccgtgtccctccatgccagctcactggaggggctcctgctgaaagaggtggggttcagttcccaaacccactggagggttgcaaggagacgcttctagtatgttagacagcacagtcttccaaatggactgtgggcatgatggatgtgtaaagaatcgagaagccaagtgcccttgccatttgttatctttaaaaagtatcggtgggctcatgggggcttgagtgtcctggcagctctcctcatccatcctatgtgtacactcaggcacgtactccctggctcagccgccttccggggcccggctacagtcaggcctccttcgtgctgagcatgtgctggccctgcctggggacagctgaaggccaggaggaagctgctggcctcaagaaggcctctcgaagcagaggcagccccctcgaagctcacctggcctctctctgtaaggggagagggacccagggctgaccagagcaagcagtgtgccattaacccctacctgtccagaactctgagctcctgtgggtccttctctgagtgtcctatgttgggggtgtcagcctgggtgtcaaggctgaagaggggagcctccttggccactgaaacggaaacagcattagccaccaccagccccttcccccttttgcagggcggctcccagaacctaggagtccatgctacctgtggggttcatagtgtgtccctctcagccaatgggaagtcgtgcccttggatcatttggggcaaatggtcctcgttttcttcattatatggtgttgagttggggaacggccttgctgggagttggggcctggcctggacctcgaggccactggggacttggctacctgagggagatgaggttgttcccagggtttcctcatcccaggggctctcagatttccagggactcgggcaggcacagctttccaggccagagccatggacggtccctggacacctgcagcagccaggccccagatgcaagaaagggtatttgtttcttaaagcttgtaaagagtttctaaaaggtggggaggggattggtgggggcctgtctcatgttttccattctggacgccggggggacatgttgctggggccagaccaactccagggagacaactcgacaagttacgaaacatccagcagcatccacgactaatttcttccccctgtttgtcctaccgtggaggtcgagttaaaaggcagcacttcgggggttgaaaagctacccgcaggggtctgctcgtgagggacccccgggcctctgcagcctttgttcagaggcagctaataagccgactcccgctgggcgctttgtagcgaggccgctgttcccagtcctagctcagcctccctgcctcagagggctggcagatcagcaaattgctgtctccagctcgcaagaggggcaggtccagggatgtgtttcacccccaaggtgtgagtggaatcagcaaattgtatcaagaaatatttctagggatttacattccggcggtcagcagcctttgggaggctttactccgcctgcaggggtgggaggcctcgcgtagagttggtgggggcagcagagcctgggtgtttcaggaggacccactcactctgggccacttctgatgctgcagatcacgccaggcaggcctccggccgtttgtctcttccgacagcagcggtggtgatggtcccctcggcctgcctggcctgcagcagccctggctggaggctgaccgagcctccgaggaggttcacctggagctgtctgtccatccatccatctgtcccttggcccctttaagaggccttgtcccctttgccagtgcagggagaccccaccgtggacttctcattgggacttccagtgagacccaactccactgcctggggataccctcaccccaagcccaaggagcctgtccctacgcacaccccctgcccctgggaggcacatgccgagctttcctgtcctccatttggtggccgcctcacctccatggggtcgcagggcccacacagacagcctactatggtcctggcaggcacagggtatgggaagccctgtgcccctgggatcaagcttggatcctgaggtcctgagcttggtgagtcagggctggggagccacaaagccagcatgctcctgccttttgggggtcccaggtgatgtgtcatcttaccaggtgttgacaggtggagagaggtaggctgggtgaagataggaaaggactatgggaggccagggcgggcctcgggtgcatgcctctctgtggcagtgacatttgtacagaacgaggcaaggccagcccatcctgggagctgagtgctggaccatgggggctgcagcctggaactgagcccagagactgcagcattcagaggtcagggatcaaggaggacctcacaaaggagatcgggaaggtggaggcttggtcacccccaggaggagctttttctaaggaaggagaggccagcatgtcagccacggctggtgggtcccactgaagctgagaatagaactggcagtggggtttggccacatggaggtcctaggggagctgatgagagcgatgccgtagccagggtcggcagtggcggaccgagagtgcttcccttctcacgtggttgggagtcatgacctgtttagtaaataggctatggcagcctcttggaacttagtgaggtggctaagctgcccctagatagctgtgccctgtgaccaagacccttcctccctccttccctctaccccaccaggctcagccaactgacaccagggccctgtgaggcagtatctgagccacccttctgagtgggagctatggcaagtgctgccttagcggagtgggggtgggggcatgtgtcactcccaggaccaactggcagatgaaggtctttgggcactgcagctgccacctggggtgcctcggggcaggctcacctcacacccttgtgggccagctgcggcccaaaagcctcctggcctccattcccgtgccagggtggtctgagcggagaggacaggggggatcccagacggatcctgaaaacaggctccgccttcctctgtggctctgccttcctcttggctccgccttcctccgtggtggcctgagaggggtgtggtgctgcttgtccgtggtgctccacacacctgccacagctgcttaccccactccctgccgccctggacaaggtgcccacggccctgtcccatttaccgttggggcaagtgagggacgaggaggctccgcagcctcccccgggacactgcaaccctcaagactcctagcaagcccctccgtctcagagccttggtgtccccatctgtaaagtgggatgtgacaatacccttcttgctgaatgggcagggagagaggagctgttaggtgagaccaggtggtacttggcagctgtggcacgtggaagccctacacaggcagccccacacctggtccgctgttctgtccttactgtagcagtgggcctggaggcagtggcatttagagaggaccctgaagtccaaagaggggatgccagcctcaaactcagcagctcgaagtagcaacagcctcgaatccctcacacctagcggttggctgggcaggtggactggtccgagctgagtggtctaggatggccttgctcccggagaagacccttggcagacagcctctcctctactagctagtggggcctcactaaccgctggtggccgcagggttcccagccactcggtgcacatgtactccagcctctctgtgtcccatttgctcatgacatggtggtcaaagcaagtcacggattccagggggacctcgggacgaggaagtcacacgttgggggatgtgccgcagggatggggcatctcagcctttgtatctgccgtgggcgtggaggcatttactcttttcaccgggggagcagaaatcagaacatggctctctgtgtctgacacagagccctgtactccatctatgcagcccccaccacctctgcacacagcccctccggtggtgcctgggggcccaggcttttgatagagaatcacatctggaccaggacgttctggtaagatcgccagggggccgcgacaaggagaccaggaaggaaagacagaaagaaaaacacgcacagatccaggctcagatgatatacagtcctcctcccggctcaggacccctttgcggtgtcacctttcggcatgtaaccacttattctgtcagggaggagagccctcccgctccaccaggtgacggccctaaatcctcaggagtgacagcgtcctcccgcccggattgggtttctgcacagtggaatggagctggcagccagggtccctgtcccgccagccctaggcctcgaaccctccctggcaagctaacactgcccttggaggaaggagggtgggagggcaaagagagagaagtggtgggtggcagcgagcaggctgtcctgcaaggccgtggctgcactgagggcagaaggggccttgtcacctaggaaggaccccactaggaaccccttcccgcggaaacacagcttctccccttgggtgccattgcagctgcacccaagccttgcccttccctctcacttcgctccccaggaggcgacactgtgattgtcctgggctcacagaggaggacgtggggacctgcccaaggagacacaggcaacagaaccagggctcagagttgggggaaggggccagttcacccacagagggtggagtcactgggctgaagcttctggccatcgtatggagctggaacaaggcactggaaggtaccaggcctcagcgttctcaactgtgaaatgggaacacggtggtctctgtcacagggtagagatgactgatccagtaacctggacagggtgccgagggcagggtctggtgtggctatcaggagccactggattggaacttggtgtgccaccagggtccctgtccgtttaagaaaagcctgtgggcccaatagagaagcacagggtctgagaagcatcagacaatgactcctaaacaagctcacgtcttgaagcagtgctggacccgtttcagctccaggggagagccagggcagggtggggcaggcacggattcctgacgtggagacaggaggaagccgacggccatctgtgctcagacccagtggtgagcctaagacaagttcccagaatccatccgggacagacggctggacttgtgaaacactccagggtcgggggctcagccacgggaccagcgcttgccagaaatgttcccagcttttttgagttcgtgagtggctggtggatacttagtggtttggctttcgggttcctgccttccaaaacaggagaggcaacttggcctgctttttcctcagaagagcccactttttgcgtggaggtgacctgccatttgtccggttgggggtccccaatcgtcttcgagctactgatatagaacctctgcgtttagctgtggtttaggaagtgcattcacgtgaagtcgccaagttcaaagggctgcccctggaacccaagtcagacttgccctcgcccccttcccgaacgtaccctttccatgaggctgggcgccctgccctgccttcagtgccaaagccccaggcccacaggctgtgcactccagccgagggcagcctggggaaggtacgagagatcactgggctttgtgaaacctgtcagcttgtgtgaaagctatctcccccaggccccacccccgcccccacccaaagcacaggtcacctgcctggttaatcatcctgggctctgagagctccctggggccccacaggccaagcgttttctgacttggagaggcaggaggccaactccccgctcctcagattctgctgaactaactgaaaccctaaccttcgggcttccccactaatttgtgataaggcctcgccaagaaaaacagcaggctaaagacccctgatttcttcatgaattccagagcacttggttcactccggcagagaaggggccccaggcagccatgcatacagagccacctctgcgtgggtgaagggctggggacggcctcttgggagcccactaaggaggaccacctgcctgctccaggcagattgcttccagctggccagggcagaggagcaggccaagggtgggtcccgggcagtggcccagagaagctgagctcgctcacgagatgtgtgctgacgtggcaagatgggcgggagtcttcatgaaggagtggctgcctggccccctgacctgaggatcctagggcccctggatgggtttgggggaactgcagcatcctcagatcacagacggtgtgtcgagtgagggtggtgctcttcctgggccagcagtaggtttccaaaagggcacagacacagctcaggagatggatgctgccctgtcagagtggggaaactgaggccccaggcggagacaccacccactgcaggttccagccgtcccccaccccacccctgccccaccatggctgatgtgagggaggtggccagaagtccagagggacactgggtgggaccccggtgaagatctggtggactgaggccagagaaaaaggggatgacccattcctagcagggaggaatagtagtttatattttcccccaaaattttatttttctgcattggcctgaataggagctgactttaatacgggggaaatagtgattttaaagccggctttcccatggaatgtgcttctcctgtgactgtgcccatctcctcactgcttggcagagaggtatcccccgtgccccactggcatgggcgccaggtctgcccttccagaggcccctcccaagtagctcccagcagaacacttgaagcccaaaagcagtgagaaagggaacacatttgcctccaatcctgactctccaagccctgtccctgcccccaggtgaagggttggccctgggcatggaggtcggcagcagggaggggacacttaagccacttggttgggggtttgtgctatgccctttcctctgccctgttaggtttgcttctacctcttaggtcctgtgatatatctgcccctgtaggagcgagacagacataagccagatttcaggaaggagcagccatggggcagtggggctctggagcaacagaggcctcaaaagctcagcgtctacagatgttagggacaaggaggcagcttgggggatgtgctcaggccctggaggcagacacatcagggtctgaatcccagctcaggggcccagggcagctcaagccctctctgaggttctgtttcttcatctgtaaaacagggacaatcacggtagctacgtgtggggcgcaggacggcacccaaggatcattcctgtgtgagtcaggtgtcagggaccaccaggccttgtgcaggaacatggggtagtgtccctgggggaaatcctaccccagactcgaggaataaagaggaggaggaggttgcctgagcttaacagaatgatggctgtctgacatgaggctcacaactggccccagcagctccacggcagggagcaggagcagacaccccggatccgctctcctccctccttgcctcctgccaggggtccagttggctagacccaatctgaagccctgggccaggagcttgtggacataacctgcagagatcagcctcctagggcagagtgagctgaatggagaagggctgtatgcagaagggcgagcagacagagcccaggattccacaacggtgtcgatgtacaacaccaagcacctggcctggtgtgggctcgtcttgcactatgaaggggcagggacgtggccaggcattcgttcctctgtgggcactgtggggctttgctgtggaggcagagggagcatctgatggcccccggggccgcgctagtcaaagcgcttcatttccatcatatgtggtgcaaaatctaaccctcttaccctgcgtgaggttcatgtgaccgctcccgctcacctcccagcctcattgcctccctgttcccctcctccctccccagccactctggccttctcctcgtccttcagctccttccagagtgttcttgcccagggcctttgcacaaatcccttccaggacttccgatggttctgtcctcccctcacacaggcctcacctcttttgccccctccacctctggagcggccactcgcccacccttctgccctgacttctctgtggcttcccaaggctcttcctggcacctcgtagggtaagtccgaccccaggtggctgtgctctgaggccagggccaggactcttgttcacagtgctatgcctgacccggcgccagccctcaggggaccacagccggctgaacgccaactggttagctgctttttctataggacctaccgagcgtttgactctagaaccgggggttggtgcttggtgacaagagctaggctggcttcctactaattctgcagcctctggcttgctagcctcccgcccactagggtccaggtcacttcctctaggagattctaaaacactctggcacagcccaccagcagagccgggccttgggagcgtgagggcacggggcctgagcctactgcatcctcccagaagctggcctacaggacggaggctcagggtggccagttgggcatggggttctgctggcccagagtgccagggggacaggaagtccctgagggctccagctgcaggaggagcatctcaggaggagctgaggccggagcagagcgtcctcctggtcctggcagcccttggcccctcagcaccccagagggccggccgcagtggatgctgctgaaccaccagaaacttaatctattattacacagaaacttctgtgcagtcaggggtttgaagtccccagaagtgtttgcctgatttggggcagatagcggggtgattaatgctcgtgataaggtgttgattggttctgggagccactgcagacacaggggctgttgtgcatgcagggctggcaactgtagtcacagaacaatagcccgtttatgtagcacactcccaccccccgcctgccccaggcgggcacaaagggcgctcgggccaggaacccatgagctgggctctcccggggccgagggtccagacctgttgccgagaagctgcttagcaaggcctaggggcaagggctggtctggcctagctctttctcccttgagccccctgccacagggctaaggccatgctgcgggctcgagtgactgccctggacgtgacaaatctctgtgcctcggtgcccacacctatacaatgggggtaataaagtccccacattgtagcactgccaggtggattaaatgaaagaagatagtgaagtccttaaagtgagatgtgttggcatttactccacaaatactgaatgcctgctccaggtgccagggacagcagtgacaatacaaaactgatacgaaattccaaagggatgtccaccaatgggagacgtataagggctctgcatccatggattcaaccaactgtggatggaaaatgtttggaaagaaagttgcatctgtgctgaacatctgaacttgtacaggctttttgtcttgtcgttattccctaaacaatagagtgggtcacgcagcatttgtgttgttaggtatcgtaagtggtctggagatgggaggatgtatgtggcctccatgtcagtatcacaccatttcgtatcgggggcttgagtacctgtggatttgggtacctgcgggaggtccccatgggtgctgagggacagctgcactttagtatttatctacagagtgcttggaagggaaaacaaagacaggcagggctggtttggggaaggggcctgttgtggatggggtcgtggaggaccttacagtgtccccaaagcgaggtgaatctcatggtgtcagggctaagagcattgtggagagagggtacagccacagcaaaggccctgaagtggggatgggcccacaggctggcaggacagcaaggagacccatgtgctgggaccccgagagctaggacacgtgaagccctggctggccccgagtgcggtgtggttggcgcagatggcaacagggtcactctggctgcagagccaagaatggaccactgaggggctgggacagacctggcagaccaggagggaggccactgcactagtccaggcggaggatggcagctggaccaggagggcgaggaggaagtagtagattcaggactgttttgagagggaccattttagcttcttacggctgctgtaatgaattcccacaaacttagtggctttaagtgacacgtttattatctaacagctctggaggtcagatgtccgacatgggctacattcaaggagccagcagagctggttcccactggaagctcaaagggaggccccacctcccttggcttgtggcctttccccacggcccccttgtctctgcttctgtcctgcgctcttcacaacctcccttcctccctctttctcttatggggagtgcaggggtgatctggaggagccggtcaatagcagcgtggtggggtctggcagagacagactgcagggggcctgggaggccccaggaggcaggtggactttgtccctaggcatccagtgcagaggtgagacctgtatggccacagagtctccctatccaggccccattaccctgggggaggcggattatggtatgaactgctgcaggtggtccaagaggggctgcccctgggagacgcagggttcttcagtaatggtggtttcgaagggcagaggagggaagaatggagggatgggggacagacgctggagccgttttggtggcaggcctctgtggctgtggccagaagcagggctgggcaccaggccagatggaccagaggctgcccccagctgaaccaactacagaaatgagagccccggcccagcctcctcccagccgccgctctctgggagcccagctttgctcatagaaaaggaaggcccttgttgccctgcattgggagcaaacacttcctttggcctcacagctcaaccttggacccaaaggtcctcagggacctgggggaaagagagggcagccaggcacctctgttcacggcaggggctgcgttgcccagcctggcagagggaggcagcccctaggtacagtcccctgtgcccactcgagggggtgctgaattcctcaaggcctgagtcagacctggtgcagcttcataaagccaagggtggcaggcggaatccaaggggcctcaccgcccatgcaccccactgttgcatggagagaacaatgcccaaatgccctcgtcccacagtcggcatgccagacccctcgggaattcaggccttggtgagtctggcacattccggctgtgtgtcagcgggagaggcctgggaaagggagccagcactgcaggccgcccaccacacgcccactcgggcaccggacacagggaaggcggacacccagggcggccatctctcgggacaggaggtgcggctccaggttctcacccaggagagggctttcctcccatgtcagagtccccttcgctgcttgaggcaagccctccggaacagacccatcttttgggggaccctgtggtcatggagatcaggttcctagaatcacccccagcagcgcacacaggagggcctgaggcccagagaaaggcgcctgaagcaagggaggggagggctggtccagagtccctgtcccctctgccagccacccaggaggctcctatggccccatctcccagctcttccgggtggaagacagtggtgggtaactcactcagctagagcgtctgatcacaccactgcagcggctgctcacagccttcaccatcaggaccacaattctgagggccctttggatgaagccatctcacagagctgtctcctgcagagaggagaggagagggaggccgccttgccagcaggggaccagcgaggtgtggcctgcaagccgtgggctcctgtgttccttcctcccccttcagaggaatgggaggaaaccaggcttgagttcctgatttttgccctttagggtttttaaattgtgggagagccaggagtgcctgcgtggtggcctctgtcgactccatttgctctgaagcggggctgcggccaggcagtgcctctcagccttctgtttggtgggtgaggacgatgcttggtcttgcctcaggagcattgctggcacctctcatgtgctcctgggcctctccccaaccctcaccttggcatcccccaatatccaaacaatagtccacaaaacaagctgccccgtgggcactgcgaagaccctcggggccagagccactccctcagggtgctgaggccaccagctggggcctcctctttccacactattcctgacgcctgggctgggcaggggactcctggcttcgtttcttccctcgcctttgctgggccatctttcagaccttgcctggtaccttctctccccgtgccaaggcctggaggtgatgtggatgcagccgggcagtgaggagcgcaggcgaatgttacagcaggcgcgagcgaaggggcccgaggcaccggtgcttccgacggggcccgagggccgtctgacctttccggccacggggcagcagttgcgtgagcaggaacaatcgccccagtgtgcaaggcacaagcggccttttcttcctcaccgggccggcgcacacagctcccagcctggcttcccttgaacaaacatatttattgtggccgccaccgaggcctcgccttgcagccggagcctgggggcctctgtcccacccactggggcccagggaggggacccctgccctggcggtctcccctgccccatgggccccagccccatcttgcctgaggcaggggtggctctggtcccacccaccctctggaggcccagaaactcgaggctcctgctgggggctggtgaccacccacaggcagcaagccagccagggtcctgggaagagggggtctgggacacagccacacctgagcccatcctccacctggagccagccccttaccttctggagcctcagtttccccctctgtaaaataggaggcatcacccagccttgcacgtctccagtgtccctcagaacggctctggccccgcagctggggtctgaagagcagagccctgagctctgagatccactcccacccccacccccacccccaggcctctctctgccttccctagtgctcctttgtgtgtccagagggaaggggcatcctccatcagcactgaccccactcaggcctctcagctgcactcaacacaggggctccccacactcgccctccttcactgcgaccccgaccctcactttcccacaaaccctcagtctcctttgctcagcttccttccagacaggctggcccaggccctccccacggcttggcttccctgggcggtgtcaggcagggacagcagccataggtggtacccctagtgagggggactcattctagttgcaaagatacaggtagagcatagggaccccaaagagtagcaggggacccccgaggttgctgctggcagctcctagggagacagtcgggcacggtgggcaccttgagaggaagaacagccaggcctgggcagccctgggggaggagccaggccaagtgtgctgccctcttggcctcagatctgaagctatagagcctcctggagggcagaggcagtggagaggggtctagcgggcaggagggggacttcaggccttccacacacacacacacacacacacacacacacacacacacactctctcactctctctctctctctctctctctctctctctctccccccccacttcagggccttcgcgcccgctgttcccctgccctgccaggcgcaccacccccgaaacatgcacacgctctcctcttccctgcttaatcctcttgagtcttcaggcctcaacccacgcttcccctgaacatcctcctcagagcagttgcgcgctctaaatcaggaccaccttgcggttctcccagccccagccttgcctttctagtggttctggcctctgatcacaggcacagtttcaagcttgtctagcactggcaggggtggtcctgctccggccccagggcccgcaggtgtgtgtgagaggtgcatggtggacgtccaaagaataaacgaatgaaccatccaaagcacaggccagaggcagattgggagggtcaggtcctaagaggcctcaggccggagcccagctgcagagcagggcaggggtggccaaaaggcgcctagaaggctggactttccgtgaggtggcggggagcaccaagggtagaggcaggggagcaatggatgggttgaatgaggaagcttcacagccccccggccaccgcaggtcgggggagcactgtccccggggccccgcagccagctgtgctgggcaaggcaggacgggatccttggtgatgggcagaatgtggggagcagggtaggacgggccccttggctgagagccagatgtggggagcggggctgtcgaggctgatctcaggatgcttgctgcggctgctgggtgggggataacaggggttttccgaggccctgaaggactggagagtaggagcaggtctcgggggtagcttcctgaagagatgagtcaggtcccaggcacattcagtgccagccagggaggtgagaggtaatcctggaagctgctatgtagacagaagcgagggcaagaccaccgctcctccgccataaaccgtgttggatgggcctcctgcctcctccagcctcagtttcccccactgtgaaatagggatgacctcctgtgctggggcctggctgtggcttcccaggccccggctgggaccaccgcagaggtgatgtctccaggaggcttctgggccagcagcatgttccagtgcgacacatgtgccccggagtggccgcgtgcccagccggctgtgcacgctgccccaggctggtggggtaagcgcctcggagggcacactaacaagaggcacatgtgccagggaagccctgccttgtcatcacctgtgccgtggctgtcagcgcgcatctggcttacattgaactcccccataaaacgtgtgaaacctgacagcagcgccgcagcaggacagggagggactgtgtgtgagagccagggaagggctgctcagggggctctccttgatggtgaccccctatgagacgccacttgccctgaggccctgggggacagcctggcccctggatggccagagatgcctggggccctggggtgggaggtggggacaggctaatggcaattgaggccctgcccggtggagggtgggccatggccgcccccacctcccctcccgcaagcttctccccttccttcagagcccaaccactgcttgctccttcccacccctcctaggccagggatgcctgaagccacactccactgcattcagccaccgtcctgaagtgcccctcacccacccatccacaccccgcaggcatcctagggcctggcccaccaccctctccctcctcaccattttctgttgagcacacttgaggagcacttggaggagctgggggatgacatgagtccactccgctgtcaccaccaagaccacagtggggcagtttaaacagcaggcattcatcccctcacagccctggaggctggagtccaaggtcaaggtgctgcagggctgggtcctcctgcagcctctctccgtggcttgtagacatcaccttccccggtgttctcatggggccatccctctgtgtgtgcccgagtcaccttctcctctcataaggaccccagtcaggtgggattagggctcacccttatacccccattctgctttaattacttcttataagaccccatctccagacacacagtcacagtcagaggcaggaggaggtgggtgagaggaccccacgcccttcctccagtgtgtctggagccccttccctgtgtacaaagggacagagaagcgagggggctccttggccctccagtatgtgtgtgcagaaggcccatgagctgcctggggttggggggtggtccttatacatactttagatgccagagggggctcattgggcagaacctacctgggaaggggcccaggcttcctgcctgcccttcagtttaccctgtgctcccaaatctgaaggaagcctttcctaaccagcagtccaggggattagaggactgggaccagttgaaactccattctaagtcttggggacctaatgggattaaaggcgaccgagcttgggccgtatctgggatctggggcccaccgggggctgtgaatagttggagccctggagtgccgagggcccaggtcccaggcctctggggagtctggattttttggagtcttcctgagacttgtgaccagtgggcttgggagagcctgaggggcctctggggttagacggtggcccccgtgcctggagagaaggtgcactttggggatgggaggcgctaggtgccaatggccctaggagggggctttggagctggacccttgagggagtcaatgccagctcatcgccatagcggcttgcttagggccgtccctcccaccccccagttacacagcctgcaaaccccaacctagccccttccaggtgtcccttgtgatcttccgccactgacataggtgtggcccagagcaaagggcggcttcccatttcacctgcgcatctgcagctggtatgcggctgccctggtgggttcctggctggctggcatgcgccctgcgcctctgctgggcctggtggggcctaagggtgaaaactcggtcaagataagatgcccacggctcagggaccccacagtcacaggtggggagtggcgcagagcctgggcctgcctcgggctaccctgaagtgccagccgagggtggctgaggaagcccagtcccgacccccaccgcctgccttcccaagacatcctgagtgcccctcgccagcactccctgctcggggatcccattattccaggaggaggagccaggggtaccactttccattagtgggtccagaagagatcccagcgggaaggggcagccttcagggtagggcagcggattagggaggactcccccaggagaggaggaggcaggcagggaaattctggggggagtgtattccacagggtaagcagaggctggatcccgagagcatctggacttgttcccagggcacccagcacagaagtgaaggggtgccggtggagagggagagccccgggcagctgctgccgtgtgggtggatgtccggccactgcccagccacctctctgtcccaggaagctgctctcctggggcatgtgcacctcaagtgggtgcagcaggcccagacccacgggggcccctggaggcctgctggatgcccgcgagctgcaaggagttaattcctggccttgtgggctggcaaactctgactcacagagcaataaaattcttgtgttttaaaaatcagtatattagcttaattttatagatttcagaagtgctacttgaaaataaaagtctcctaattatatttatgatcccaacgtgagtgaatttgactccgttcacggcgaagaagctttgtgtaaaatgccgggaagccttcgtgctgactcggccctcgcagaccataaaacacggctggtgggtccgagcccggcagggatatggggtcacagcaaagtccctattaatgccatgtccacctcgctgccagggagagtggggctgcagcagggtgcgaccgtcacagccctaactctgtgatggatgcctgctgttgtgatcatggacatgaggatgtgaggcggtcataatacaggagtgggctggaggcagggaaaggggttggtgccccctgcccaggggaggcacacctgggggcacagaatgacactgggtcctctcagcttcatccatttcctgctccaggcagggccctgggcctgggctgcagggattcaagggagaaccacaccctcctccactgctgggaggggccgagcctggcctggactgctggccccaggagcctgggcctgtggtcagggcaggaaatggagaagatgaacgaggaaaggagaaactgctccaaatggtggggagggaggagagacgagggcagaagtgagcccctggctcggtgggggtgggctgtggagtgtgggggcacagcgggttccttactgagcccagggggaggcagggtctggagtgtgggggcacagcgggttccttggccatgggggtgggcagacgtgttatcatgaagccgggagatcaaggaaggctctctgagggaggtgacatttgtaccaagcaaggaaagaggcagaagatccttcttccaggctaagcgccatgtgagaatgcagcaggtcggggccactggcactagcgtgtgtgacaagggaatctcaggcttctgctcacctctgctgggggcagagaccctggccagagccatggccaacctccccccactcccagccaggcctagagcagagtgcccttggaggctggaggaggccaagtcagcctgtcccatccctcctgggcccccgagtcaccaggagatgcagggcttagcctggagaggggcctgtgcggttcctgggtgttcaggggtggggtggatgtctgcttttcctgggggccccacagctgggccaggctgtcctcccagcagaacgtgggctgcagcactggccacacagacagaccctggggggattgtccttctgccacctgggcattggcacactggccttccgcagacactcagcaggccaaagagtgggctatcatcagacgctggccccaggcctgccctgttgttgcgggtgcagtgaggtgcctgcggccaggtgggtgagcgaggtgcaggctgtcactcaccagcagggttggggcttggggggaccctggtacaggtggagtccaggggtctgcagaggatggctcgagccctgctaccaccatgctgctttgaaaaaggactgacttctctgctgcctccgcctccctgtgaagtgggactgacatcccctgtcctggggtggccttgagtgtgtgcagtgcgtctggcacaggcaggtaccccacatgtgtgcccagcatgtctgggagggccagggtcgcagcagggcccccacccatcctggctggctcatacttggccactggccacaggtgacaccaacccagcccctgtgtgaggtactgagagcccatcacacagatggaccaaccaaagccacagatgacaggtggcaggcccgagattgcctgaggtcacatggtaacacatgtgcacccggcagttgtttctgccctatctgtggttcccagccatttggatgtcacagccccatcaaaggtccgctacatattcccccacccccaaaggtggatggacataggtgggcaacatttttattacgcaaaaaaggacatttcgtagaacaacattactctaatgaaataccaccatttcattctagaaaggctgaggactccatctcagaccaggggctggtggtgtcctggttttttaacaagaacttgttctcactctgccccagcgtttgtcagcccagccatggctcctatccacggcactgggcccgcagagctccaggagctgacatgctccgtcttaaggcaggtcggctgctccgaggactgccggccctgtcagtatggtgtccttgcccagctggtattggccaagttgaccgtgtccaggggacagagagaggggaggggcaggttgttggaagcctttctgcagatgtagcttggagcagtgtcctaagggaggccagcccctatgggtcgggacagaggcctcaccagtgggatccagtcactggggctgaggcctgggtgtgcaggtggggtggtgagccatgcggcagtagcccctggggactagagcaggctccttgtggagctgtgcggagctggccggcctggtccccgtggcttcaccctgagcgtgctgctgcctaggccctgaacagacagaggcaagccctgcatggcgcccagggtgccagtgactctggttgctctcaaaccatgagaaacgttagaacttctttacccctctgtgagatgggctgggcctggcctctgaggagcctccaggaatggcaggagggagggtgggggatggggagtgggtgctgctgcccatcgacgctgctgggcaactaacaaattcagcaaattcttctttttattgtgtatgttcgacaactgccttcacttaaagtcacttttttctggctctccaaatatacttagataaggaaacagagtctatttaaggaacaatgttaagcaaacaatagtacaggtgttcaaagatatggaatgagtgacagatggggcgagggaccccgatgcagccccacccagaggacagcgcacgcgggctttgaagtccttcctggcaggccccgaatgtgagcgggtggacccaggcctcctgggggcctcagctcagctggagccagggtctctggaggggcctgggttagtttcctgtggctgctggaacaagtcgccaaaattttggtggcctaaaatcaaggtgtcctcagggctggtcccttctggaggctctagggagagtccctgtcctgcagtttcctgctcctaggggcgcccacatcccttggatcatggcccctccttcaccctcaaaggcggctgcggctcatggcatcctcacatcacagactctgtgcgtcccctgcggccacgtctcctcctctgactctgatcccctgcctctttcccgtatcaggacccttgtcatcacattgggccacccagagaacccaggattttctccccattgcacgatcagctgcttggctgcctgaattccatgcagccttgattccccttcaaaggaaatcaagtggcaaaggggaattgagtgacgcatgcgtgagttccaaggattagggcatagactcctttgggggcgccctggggtggggggtgttcctgtgtctccctgcagcccctgcttggacacatgaccagctcaggcagtgctgcctccgggggaagtcaagagtctctggtgagtctcagacaggcctcagagtgtctcagggtggcctcagagacaggggaggcccctatgagctggagggagtgtgaggacagggcctcctgtgagagggcaggtttgacttttactctgccgctgagtgactgtgtggcccaggcagtcaccccagagaggtctgactggcgcttgccggggtggctgtgtgcagcaggcattggggccctggagatatttgctctttctttttgttttattatccagacttgcaaggccctgtgtgccccctcggggctgcacacgtgtacgcacaaacgcatgcccagtgtgacccctgtccacacctggtgcctgtcccctgtgcccctgtttatcccttctacctacagcctatcccctacccaggcccagccctcccagctcaccctcttccaacccaggcctgagctctgttcgggtctctatcctcctgccctttagcctcctctcttactgatagaacattccagagcattccaccaccactggcctgcaattatcaccccatcgctgtgagtgggggcaggctgaggaagctgtgctcgggccggagcacagccggcctccttgcaggggcagctgcgggcgcgcagacagctggggctgggagcctcttccagggatcctccgcctgtggttttcctccttgaccttcttaggagggtccagttccttctcctggccaaggccccactctctgccaccccaggcagggccagggtgggtcaccatctgcagaagccctcaggggcccccagcagcgcccctcctatccccctgccccagggcgggctgccgccttgtaacccccagaactcttggctctcatgtatatgagtcagcgttgactgtttaacctgttgcaagacactctgctgggtgctgcgacatggttaggttttctccacattagaaggtagaaggaagaaaaataagttctgaaagaaacagacttgccctgcctctgccctgaccttgaggtgaacagaggttttgcacagaacgaccatccctgcagcgggtggcttggggggtaccaccatgatttgagaccctgggtggtgctggccagaatcagcctctatgagatgggcagggcagtccagggcaggggaagccctgtgccccaagatcagatacatcagctacaatgagaggcatcaggcggcctcaggccctcaagccggtccccatgtgcccatttgcagtctgtctcatactcacggccacctggccactgcaccctgatacagcagtggggccttcatgcctgtggggtgtctgcctgcccagctgtgcccactcatgtggtggattcatcccaatgctggtcctgggggccctgggctccccccggccctttctcggggcagtttacactttgcagctgaatcaatcaggggcagaaatgcctggcaggggaatgtttaccgatttggttttctggggctgaggatgctcggtgtttgtccaggctctgtcctgctggctcctctaaagctttgcaaacaagagcctcggagagaaggaggccttcccctccccatgtgctgaattcggggcggtcctgacagccatgcgcgggggcccgctgtggcctcctctgcacggctgctgagggaatgcaggtcaaacaaagtaggccagcggcttagggacccccgagtaagcaggcagacccacaggaaatccagtgctccgagcccccacacctgtggtgtggcagccacccagcaagactggaccgagaggccacgtgggcagccacccttgccaggtgggcacagggagtgcaggtggtttgttcttgcctcagatccaggagagcagcttttttgcctgaacccactcgtgaatttttcatatttttggagagctccttgtgaggacagccggcctgagcaggctttgatgaacattagagcaggtggccacaattgggcagatctgggcctggagacccagttgtcatgtttgagagggaaggggcattcccagaaatcacagggatgactggtgtgagcccaccgcccacctagactcccgtaccatgcggggcccctcattgactccgagggtcttcaaggccctgtgctcctccagaaggtggggtctgaggtgctgctgggtgtctctcttcacctcttcagaagcattcatgaggtaagaccccaccccttcaggccctggcacaggcctcagagcaggcccaccacccaactcactggttcacttaggggtagaaattatcccagcttttacccagagctcagggcccaagatgtcagtttgcctgccggctgttgctctgactgtggcctccctcccagctccccggcatgcagctcccagagggagaacttgagcagggaagggaaggggctcgaatccctacgccagtccctgcatggccctatggggacttgcgtctccccggaggagagcagccctgcgcagccctctcttactgattcctggagtctgcacagctacatagggtcagattcacgacctcccagctttaaccagccttcttgattagccgccatctaaggcccaactgtgcttcgtgacaggcctttgagcctaaaaggagttgcccccagcaatgacatcggatgcctgtttagtcagcggactgcctcagaaaggaatctcacaggcagcgggttcttctggtagggtgggatatttcagcgggaggtaaacaggtgttgtcacagaacggcagactggggcctcccctggtgggccttgagggtgctggcctgcagacctgctcctgcccgttctggcctgatccggggcctcttgactgcaggtctctcgtgggctctcagccccaggtgcctgccctcacccacgtagcttgggacatcatcagcccattgccggtacccatggtaccttcaccaccctcttggccgcattctgaaaatcaatgtttagtccctccttgaacttaaaaagtcaaacttaaaaagagattattacagggagctggggactcaggcttgcaccctgcctgtttaggataaaaggccaccgtgtgtccactctagtgtctctgctcaaacaggagacgatgtggcatcgggaacaccaatgcggcactcagagaaggctcttagccagctggcccctgatgggctcactggctgcaccagcttgtgtagcagctgagctcctgcagagccttctgggagggaagaatgtgtttcttgctccagtactgcagagcatgtgatacctgcaggggtgcaagaggtgcctgagagcaggcatagccaagacttgtttgcggttgctcctgacgcagagccggcacatgaggtggcgttccctcactctctcattcattcatttattcgccagtgtttcctgggccccatgccatgccaggtaccttactaggccctggggataaaaaagaggacaaaagagatgagaccttcatcctagagcttaggatgtgaactgcgtccttctttaaatggaaatttctaaattacggtgtaccgaatgcatccacccttggcctcgtcacatgtgctgttgggcagtattttcctacattttcttctgtgaaatttataattcagcctttgtcattcaggcctgtcgtcgtgtccaggtgcacctttgcattcggaagaatccagattccttttcctccgtggagtgactccccttccccacctgccctgcagccattccatcctgtctatggtggtcgatggtgtcatctttgtggtctagtgtgttcccgagtatacaagggtgtgtgatcggggctccctctttgcactgatagtctgctggtcggaaggacaatggcggcaccccaagacctgatgctctggtttagaaacgggttctaatgcccagaagagctcctaaacccctatttataataatctctttttaagtttgacttatctgtttgggacctttattcctccatgccaactttaaagttaagtttattgcatttcttaaaaatttcaactggaagtttgcttgggattgcctcgaatttgcaggttaaatttgggaaaaactggagtctctctcatgttgcgttttctcctccaagaacaaggagtctctctgcattgagtcaggccctcttggacctctgttgccatcttttcctgaaagggctggtggggtcttgcttccattattcctggatgagaccttctttcccctgctattttggaattttttctcccaggagtttattgctggtataaagaaatgccattgatttgggggggttgatctcacacctgacaaccatgtcatactttctatcagctctattgattgatcttttgatcctgctgattgtctaagtggatcggtcctatcaggaggagtcagcgtgaccacaggcccccattccccagcccctaatgttcttgcctcatgtcttcaggtgcggggctggcagaggctggggttacctgacacttgtcatccttctgctgggcctcagcacccggcggaggcaggggcttcctctgacacgatacagggatttgctgacggttccttgtctgctcactaagcgtgccttggagaaggccgctcagcgagggccgccttcaggcctgagcccggggccaggaccaggagcaggcggcagcagcaaggcagctcatcctcggctgcctcttctccctcactactatttggtttttgttttgttttgttttgttttttgagatggagtctcattctgtcacccaggctggagtgcagtggtgcgatctcggctcactgcaaactccacctcccgggttcaagcgattgtctcacctcagcctcctgagtagctgggactacaggtgtgcgccaccacacctagctaatttttgtatttttggtagaggtggggtttcaccatgctggccaggctgatctcgaactcctggcctcaagtgatccatccgcctcggcctcccaaagtgctgggattataggcatgaggcaccatgcccagcctcttgccgtcattttttttattttaaataaactttgattttagaatagttttggaattacaaaattcttacacaggtggcaccaagagtccccaggtgcccttcccccagcagccctattatcagcatctcacattagtatgcatttgtcacaaggaaacaacagtgctacatgactgttaactgagtccatgcttgatgcagatttcctcagtttccctactgtcttttttctctccccgggccccacccagggtcccatgtgacattcctcatccgtctccctgggctcctctgggcggtgactgtttcccaggctctccttgttggtggtgacctggacggttcagaggaggacaggtcaggtgtttgtagggtgtcccttactaggatccgtctgctgctgtcctcacgattcgactgggctgtgggtgtgaggagggagagcacagagggaaatgcccttctcatcgccctgttccgagggcccatcctgtcggtgtggctcgtcatgggcgatgctgtctctgtctcctggctctgaggccgtggctgtcaatctcttcaactgtgatttgttcttttccccctttgcagactgtccttggacccgccagcatttggctctggggccctagagagaccctgggatgtggatcacactggtgacccctgtgagccccactggggacagatccaggaagggacctcctgggaatgaggtctggcctctgcctggatcaaagccatggcccccattccccggggatagggaagctgtgcaggcagcctgggtaatgggccaccgccccaggcaggcgtgggaatccacacatggcccttctcaaagacgggtgctgtccctggggctctggcggggtcctggagcctctctcattgggcacatccgagcccagcctggcccatggtggaaatgcaaatctaattagtctggcattgagcccgtcttaaaagtattaacagagccttaaactgtgctgttggacggggatgaagaaacgccttagaaagaaattaccggatggtgacaaagccccaatttattagtcttctccaatggggactgtgcaaaggacattaattactttaatgggacttattttgcttcgttgcccaaagtaattggtttattaacctctccttccctttagggagggagggagggaaagactggggcctgggggtggccccgggaggggctcgtccagccttctgctcctctgcccagcggtgcagccttgcaccctggggcagccggtgcttggtccctgctggcctgggctggggctgccccagtgcccactgatctattcttgttcactaggcatccaccgtgtgccagtcactggaatacggccatgagaaagacaggaccctcaagaaacaacctgttccctgaaggccataagttcactgttgtcacaggtgcccagaggaaaggaagatggctttgggggtggacacgtctgggcaggcttcttgcagaaaggccacaggctaggatggtgggaaggcaagagaatgccgggaaagggaggactggttgcccacagggagtgggggtcatgggggcaggttccagagatcagaaggaggtggtgggaagaggcacgcagggtgaggctggctggaggcaggtgaggcagcccagcctcaggagccaggaaccagcttccccgggctttaccagatggggagcgataagggctgtgtttcaaaacaatccctctggcgtgaagcaagccgtcttgaaaacagaccagaaccggctgcttccaccaccagcagaatacttcaagaagaccactcgggcctagggctctgcaagcaatatctgattttcagaaaaccatggctcacccacactctaccctaggaaagggcaggttcccagggctgggcttgtggccagtgcagcactatcctcagtggcctgggacacccagaactggccaggaaagacccctacacagacccccagctctgcagtcagccctgtctccttgtgtccccagacctcgggcgagggagaagcaagttcccctcaggaatgctggtgaagctggcatgcccccaccccctagctcaccctgggtccacgcagggcctgctcccagagtgaatcccagaggtgtgcctgccccacctgtcccagtaagggtggttgtgtgtgttgggtagatgtggtgaggtgtgctggtggggagggtccctatcagatgcccctgggtacctccccaggcagggccctcagcacctgatgccaaaccaggctccactcttcctccaggtgagcccgagggcccagctgggcgtccacgtggaggtgtggggcccgggtgggacaagcctggcaaccaggacccagcatgaaactgcaggtgcaggagccccagccagcctggaatgtgggggctcagaggccacccagagcccacagcagggactccccacgccaggcccggctggatcacagagcttcgggtccagccagctgctgctgcccctccctctgggcctcaagaccatctgtcacgtgacaggggcaggctaggcctttcttgaactcactgtgagctacagagactgtgttctggccaggtgaatggtgcccctgggggccaagatccccacctctggtctggcagctgggtgtgcaggggcagccccagacctccagagtgccctcttcccctctttgcggttgtcaccctgtccttgagtctaactggggctgtgctgcctttgacgtgagctattcaaaatggcgggaggggcgaggcctctggagcaaggaaagagagtggtggctgtgtccagcaagtccctgttgccactgatagcataaaaagtaactctgaaacctggtggccctacagttgacacacatggggccgcaggaggaaggaggctcaggccaggccaaacatcagagacctcaggtctgtctcctttaccaaatggggggctgttccgccagcaccccagtagggaggatgagaggatgccatgatttccagggtggtgtcagaacctgtctgccagggctctgcagggaggggtttggggttgagattgggagacctagaaatcgaggggtgtcgggggcctcggctggggggcaagcacagatgaggatggaagcagctcagtgtcactcagtctgcactgggaatgggggatcccaaggccagggctctgcctggtgccaactgtgtgaccctgggcacgctgctgagcctctctgggccccagttcccttattcgtacaacgggaatgatcgaggagttaacatgtgtttaaaagcaccgaggcttggccgggcgtgctgcctcacgcctgtaatctcagcactttgggaggccgaggcgggcggatcacgaggtcaggagatcgagaccacggcgaaaccctgtctctactaaaaatacaaaaaaaaaaaaaaaaaaaaaattgtccgggcgcggtggcgggcgcctgtggtcccagctactcaggaggctgaggcaggagaatggcgtgaacccaggaggcagagcttgcagtgagccaagattgcgccactgcactccagcctgggcaacagagcgagactccatctcaaaaaatatatatatattagctggatgtggtggtggacgcctgtaatcccagctactcaggaggctgaggcggggaaacacttgaacccgtgagttgagatcatgccactgcactccagcctgggcaacagagtgagactctgtctccaaaaaaaaaaaaataaaaagtacaggggctctacacggcgccctgagaattgtgtgtaaatgagtgaaaatggggtgagagggagggagtgggaacagccaagaggccaggaagcggagcctgggtgcaggggcatcttgctggtgaagctggggagagacctgcgcaaccccacctgagtgaggcactgtgggcccagagtccaggtcagcgccaggggcagcaggggctggatctctggggaagttgaggaatgacatgtattccagggaagaattgggccggaggctgaaacaggacgacagagccctcagcccagggcggaggacatgggagacgggggtatagctgttgggcttgtggctggcctggcctaaccagttgggggaatccatgggaggctttagccctgctctgtgaactgctgggccttccttaggggccctggggagccttcccagcagaatgtccaggctcctgctggcccaagctccaagttctctggctcccagggtctgtgtggaatccaccggtttcaccccacgtcttttcctctcctgcctggtaaccctctctgcagaggccctggctggaccagttgctttgcaattcacaaggctttggaaggcagtgctcacaaatcacttttctagacgaagaccagtaagaagcccatgtcattcttctgagacattaggggttttctctcccttgttttaatcaaccagttcccaataagtcatttcagtcaggccattaccaatggctcataatctcctgggctgctgggcgaaatgggatcccctggctctttcactgaaaacacttttcttgttttctttctccggcatgctggaagccggccaactcgccagttccattaacttaatgagggctgacagcctgcgacaaacgtcctcataatctccccaggatttaaacggggtcctccccagctgcctgcctacaccccaacctcgaggctctttacctctgtctgtgcacccacccagcccctcctgggaaaaagccaggacaaagatgtatttcttcgctagctccttcctggtggctctgtgcaggcagcctcagacctgtaggccctctgcccaatttgggtcacccacagcccccgcaccccacagcaatttcttgggagctgatcatccccaaagcttggaactacaaggcagtgactggttttgccgggctccgctcgtccctctgagcggagggtcaccctggtcaccatgaaaactttatcctcatccacacctttctttctccaactagcatgggaatcagtttagggtcctcccacaccctcatccaaaccctcatctcccaccccccacttgcagagaaagccccacgctctcagcagaaacggacgccagcgtttaggagcgggtgggctcccggaagggggctctatgggaaaggggaggcaaggctgagcagctgcccaaagtgagcatctgtcccacgttccacccccaggaaaccctctctcctgacgcggggacttgcgtctcagtgcagagggcagtggagggacagtgcagctccgaaatgagcatctgagttcactgctggtgggcaccatcccggccaacaggccactagtgtgttctccctctttcaaacggggcggcgaccctcgtctgacaggcggctgttctgagagcggtggctgtcccagggaagccctcggtgagcgtagcgttaccatggtttttaaattaaagcatctgcagatgcgctgtgtccctgcaagggcaggcagatcgggaccccagggactggtccccatagccaaggtgttcagccgccctgtcccctacacagagtgcctctcccactggctcagggtgagggcaaaatggcacttgcagaacatgaggcccggccagctttgccctattccccccatagcatggctgaccttcctctgagcccctcgtggatgcccacacacggcaagacgtttcctcaaagatgctcttctgcaaagctgcactttctcggttgccgctgccaccttggcacctctctggggtaccttgtactgccctgtcctccccacgccctgaggggccgtcctaggcagcactcaccctggtcatccctgtttccaccacaagactgtttgtagccgagcttgggagttgtgttgtgtagtgttgacttgagttgcatcgtgttgtgttgacttgagctgaactgtgctgagtgttactgagttgaggtgactgggttgattttagcttcacaggtgatctgaacccagctgagtggcttccatggagctgatctgaacccagctgagtggcttccatggagctgatctgaacccagttgagtggcttccatgaagctgatccggactaagctaaactgagtttcattgagcagcttgtttagctggtgtgtgccaggtggtctctcggggggtccgatgggatacctagtgtcttaatctgttcagtctgctataaccaaataccttagacctggtgattcatacttaggaattcattgttctggagactgggaagcacagggtcagggcgccagcagatctggtgtctggtaaggggtctgtctgattcatggaagtcagcgggctgtgtcctcacgtggcagaagaggcaaaaataaggtgcaaacaagctccctcaggcctcctttccaagggcacgcatcctcttcctgaaggctctgccctcacggccgaatcacctctcaaatgcgccatctcctaacaccatcagggctgcgggttagctttcgacatagggactttgggaagacacacacattcagactacagcaccttgctcctggggaaacagaggaaactggttcctttctttcggttctgggttatgtcaaaatgagttccctttgctgaatctgtttcagccacctctcccgaggatcctcgcacaatttcactgccagccaggaaggtctgccctggctggtctgggcttgaggaccagcacgggatcgttctcctctgtgggtcgctgatatgaaaacaatctcacaaagacgtaagaaccacacatgcttagtgtcatgtgtgatgcatcaacccagggggaggagagaacgtgcattcacgcagaactctctcagccacaagctctgtttctgttgcatttgggccaggttgcgaggagcctggcaggccacccggccagtgtggatgtcattacatgagcagtaggaagccatacagtatctgaggcgggggagtcacgagatcttcagtctgtccctcggaaagcccctcctgccgccactcagggggatgggttggaaggggtgaggctggagcccaaatagggagttcagaggcctccgtgtctgcccagggaaggagggaggccagcttcagctgctgtcctgagggttcctgcctgggtccctgatccccctgagaaagggctccctcccagaaaaggcatgtgccctgggcagagccaggaaagctggggatgtctcaaagcctccctacctgctctgtgtcccctccctctggagcctgcctctctcccgagcaaagtacctgccacctgggagtgatctgggacagtcagatgcaccttttgaagtatacacctcagtggcttttggtatattcagagtcatgcaacttcacgactctctaactttagagcattttcatcaccctcaaaatgtcccttgcatcccaggtacaaagccataccaggccccatggggatggcttgtgactgctgcacatcctgcccctggaccttactctagttcttctttcatccactggtgtattcctttggccggggacacacacatttgagaaacttcccagcttccctctatctgaggctcactccattacaacacaaggaactgagacatctgtggctggttttttttgttgttgttgtttttccaaattgtatatctgataagggatgtgtatccagaatatacaaagaggtcttacaactcaataatgcattgacccaattaaaaaatgggcaaaggacttgagcagacatttctccaaagagcagatacaaatggcaaatgatcacaggaacacatgcacatgaacacacgctcagcctcagcagtcattaaagagatgcagatcaaaaccacagtgaggtttacacccagtaggatgactaaaacaaaaaagacaataacaagtgttggcaaggatgtggactgccagagcgaggctagccatgccatgtatctggaggagggccctggaggggtgtgcccattgcatgtctgtgtgttcccatgcagtgggcacaggcagtggtgccagaaagagcctctgctgggctttctcaccaccccagcctctcacctgcagcccaggcatcctccagtgggtttttcagggaacttaacatgatgagtctaaaatttctatggctgaataaagaactgaataaaaataaccaagaagatcaaggaagggccctgccttccagatatcaggatgtggaagaggctatactaactaagatgttgcagtgtaggcacaagggtagacaattagcccattatcccagtggacaagacagagagccctgaagagatccatacaaatgtgggacattggcatgtgaccaaggaggtgttgcaggttgctggaatcaatcatcctccagaaggaaaaagctagagttgggcccccacctcatgcaatctataaaaactgactccaggtggatctaggaattaaatgttaaaagcaaaccttaaaactcttactggataatatacgtttattagtatcttttataactcggcatagggaaatatttattttacaagacacaaaagcattgactgtgaaagaaaaacattggtcaattcgattttacaaaataagaatccctcatcatccaaagataccttaaagaacgtgacaagttgcagactggcgattgcactagttttctggcactggtttaacaggtgacccccaacacacatcagaataacagacgtttactctctttcacttctgtcggtcagaggtccaaccccaggtctgatggggctggagggcgtcattagggctagaggtcctaggggaggatctgtgtccttgcctttttcagcttctaggggttgtctgcattccttggcctttagccccttcctctatcttcagagccatcatgttcctcctctctgacattttttttcgtaatcacagctctctctgaccacagccaggaaagagcctccactgtttgttgttgttgtttttgttgttgttgttgttgttgtatggttttgctctgtgacccgggttggagtgcactggcgcaatcatagtttactgtaaccttgaactccctggctcaaacgattcttccacctcaacttcctgagtagctgggactacacgcacgtgccaccgcgcctggctaattttgtttaattttgtgtagaggtggagtctctctatgttgcctaaactggtcttgaactcctggccttaagtgagcctcccacctcacccttggccttccaaagcactgggattataggcatgagccactgtgcctggccagggccttcacttttaaagacttgtggttaattgggcccacctggacaattcaatatgatttccccatctcagtgttcatgaccttaattacagatacaaagtcccttttccatataacgtaacatattcataggttctaggacatctttgggggagcccttattctgcctaccaaagaaatggatattcacaatacaatgaattgataaagaattggtgtatgtataactaatacataacatgtataatgtatttatatatgtgtgtgtataaccaataaaatcactaatagaaactaaaataacgaatcaataaatatacaaattatcagacagaaaaatggccaaagacaaagacttgttctgcccttcatggtcgaggaacacatgtggccagtgagtacgtgaaggcaccatttacagaaaccatttacaccactccattggcataaaccacagtctgaccattgggagcggtggcagggatgtagggcccagggtctctcctacattgctgatgggagtgtacagtgggactaccactttaaaagggtggcatcacctccaaggtggtgaattcacatacctgttgacccagcagtcccatatctgggcatacaccaaaagggaactctggtgtgtggacgagtgagaatgaacaggagtgtgtgttgcaacgctgttcacaagctccacgtgcaaccagccacttgcctcccagcaggagggagagtgagtaaacatggaatgcccatacaaaagagaattttaaactaattaaagcaaacaagccagagtgacagacaaccatgtgggaaggcttggcaatataataccaaggaaaagcccactgcattcttatcaagtttaaattactaaaattaaaaaaaaaaaaaaaaacatgacttttgggacacatatagtttcaataatattatattaaaaaagaaagcaagggagagaggaacacaggattcaggttgatggttacccaggataggggagacaaggatacagttggggtggagctgtcagggtccagcatttattttgtgttttgtttgtttgtttttgtagagatgtggtttggccgtgttgcccaggctggtcttgaactcctgagctcaaagcaatccgcccaccttggcctcccaaagtgctggaattacaggtgtgagccaccacacctggccgtctagcgtttattttgaataacgagtccttgggagctttctacattgtttttaaaaactaattatatgacattttataagaaaattatattagcacaaccgggagagatttattctaggtaatgcaaggctagttaacattcaaaacttaattaatgtgatctattatggaactttcccaacttgatcaagagcatcttaaaaaaaaaaaaaaaaaaaaaaaaaaaaaacccacagctaacatcacatcacacttaatagtgaagaacagaatactttccccctaaaataaaaaagaaggcaagggtatctgttctcaccacttctattcaatatagtactggaagttccagccactgcaataagacaagacaaagaaatgggacatgtagattagaaaggaggatctaaaactgtttctatttgcaaagatagaattgtctatatagaaaatcccaaggaatctacaataaaaatatctggaacttaggagttcagcacacaaaaatcacttgcatttctatacactaacaatgaacctgtgaaaaccaaaattagaaacaataccatttacaattgcgctaaagaaattaaaatacttaggtataaatttaacaaaacatgtaaagatgtatatactaaaaactacaatatgccaatgaaagaaatcaagacctaaatcaatggagagatattccatgttcatgaactggaaaactcaaaatagtaaacatttcagttctccttagaattacctataaatatagcataattcctaacaagaatcctagcaagatttcttatggacatggacaaacttgttctaaaatctatatggaaaggcacatgctgtagattaaaacaattttgaaaaagaattcagtgggagaaatcactctaccaattttaaggcctactatacagtaaggaatcaatatgatttgatattggaggaataagcatgtagctcaacagaacagaacgaggaatccagaaatagacacacgcaaacatgcctgactaattttaagacaaagatgcaaaattcagcggaggaagactcctctttcaacacacggtacaggagcagttggtcattcataggccaaataaataaattaaaaccctgacctaagtctcacactttatataaaaattaactcaagagccaccttggacttaaatatgaagtgtacaactctgaaacctttagaaaaaacatagaggagatagtatttaggatttaggaagggcaaacagttctcacattggatgctaaaagcatgatctgtttaaggaaaattgatgaaatggaccccattaaaacttaaaacacttgttttgtgaaagccccagtgaaggggataaaaatgcaaactatagacttggagaaaatatgtgcaagccacatatttgacacctggcatctagaacatgaagtactctcaaaactcaacagtaaaaaacagcctgtccaactagaagatgggcaaaagacacgaagagacatttcaccaaagaaaataaatagggaagaagtacaccaaaagatgatcaacttcgttagcaaagatggaaatgcagattaaaaccacagtgagcggtcactacgcacctatcagaatggctaaaatgaaaagtaatgatgacaccaaatgttggcgaggatgtggagaaacgggattgcccatctgttgctgctgggaatgtaaactgatgcagcactcggggaaaataatgtggtcgtttcttataaaagtcagcatgcgactaccacacatcccggcaactgaactcctcctgggcatttatcccaaagaaacgaagactcatattcatacacaaaactaaatgaaaatttatagaagctttattcctaactagctgaaagctgagaacaatctatgtatcattcaacaggggaacaggcaaacagtggtgcatccctaccctgaaacactacccagcagtagaaaggaacccactatcggtacaacctaagcggatcttacgggaattgtgctgaggagaaaaagcctcccccgaaaggtcgcatgctgtgtgattccgtatagataacattctcaaagtccaggctgtagggatggagatcagatggtggttcctggggttgggaatggtgagggtgggagtgacttgcacaggagacgcagagggggtctttctggtggggaggacttccattcctcgttgctgtgtgaatctgcacgtgtgaacacaaggcagagccacgcacactgtaccaatgtcaatctcctggcgttgatctgttactccacccatgcaaggtgtgaccgtcgcgaactcacgtagagggcatacaggacctcttggtactttttttttttttcccaacttcctaggagtctataattgtttcaaaataaaaagaagcaaaacaacacactgggaggtgcaggaaaccacacacgtgatgtgcttgtgtctgctgacataagtgctcaaggaagagtctggaaggcctgcaaggccctcatgcctacgaggtggctgctagggggatgtgacgtagagtgacttcagtttccctcttcatgtctcctgggtcctccagcactctgggtttcctctgccaagacccccacccatctgcctctcttcatctcacaagcctgcatgtgtgcagagggcaggggtccccaggggatgttccttccccaaggcgctgtggccacttagagggtcccccaagctcgggcctttgaagacagctctgtgtctcctaggacgcacaggtgtgggacctcactgcgcgggagggagttgcaaagagcgacaccccagcatgtgggaaggaagggagcgagctcttatttccttattttctttccatctccactcccaggcaaagctgataaattcttccttattccagagttagaggatcctccagaaggggccgagagcttgtccaggcagggtggatacaaggggcttgcatctgacttaattgtctggctgggggagaggggacagaggtcctgggaggggctgaaggctcagggacacaggtgaggccagcccctcctccaccctgggcatctccaggcccagccccaccctgagctgtactggacccaagccccaggaccccctggagtcacctccagccctcccacatgccagcccctaccctgggcctcaggatctgcctggatggaggccaggccgctgagctgctgggaatctgttccacaggtgggaaggtcggcccgccatgggcagcccagtccgggaaacttcctgcctctgctttcccacagtgtccttcgatggcccccagtgacgtgtgttgaatgtggcgctggccccttgggcagcccagcagcccccaccccagccagcccagcctgggcagcactgggggctcctggctttgaatttgacctatccagaaacaacggctccttcagtgggctcagcccctgagaccactcagcctgggctgtgtgcccagcggcacttcatgtacgtggacggggcaggcgggcaggcgggcgtggaggagctaatgggtaagttaggcagcacattaacaaatgaaccagcggatgggggtggggagctcatctcattcatctacaaattattaacaataacttgttcattaatgaatgaacaggtgagatacaggtcagtgggtgcatgaatgagtgaggagatgaatgaagcgggtcttttctcagcagctgacccacggccaagcccccgctgggcagcacgtcccttcctcctctcccaagctgggtggtgcgggcagggagagggtccatccgcccttcagtaggtgaggaagccacgggcctggagggtggcccagcccaggcaggagggcaccagccccgggccctcagtgccttcctgcaaccagggtccaggggtcacttccttcacggcccagtgagcccaaggcctccgtcctgccccctgtctcttaccagctcgctcctgcatcagtgctactgaaatgggaaaggtttccttgtcccccttgcaggacatgtgacaggggtgtggctcgcttcttcagtgccccactactcaaagttctaggggagcatacagtcggacaggttgtggggctccgaccccacagcagcgtctaggggtgaatgtttacagctgaagccccatgggtgtgtgttacagggtgctctttagtttagccgtccatagacagcttgcgttagtcagctcagttagaccccctgccttacggcaagggcagaggtctttctgtatcccgaggttcttgccttggcgtactggaagaatcagatcacacgtgggcttggagaatgagtgcaaggttttattgagtggaggtagctctcagcagatgggggagcaagaagggagatggagtgggagggtggttttcccctggcatcaggcggctcagcagcctgggctctcctgcgtccaccccagccaaacccttcatcgttcctccggtcaatggtctgccggcctgtcggtgcctgttggtgcctgtcggtgtgctcctacgctggtgtgttcctctcgacctaccctcaacgtccagccgcttgtgtcttcttctgccgatgtgttcctcttgatgtccagccgcttgtgtgtctgcccactaaggtctcgagatctttataggcacgggatgggagcatggcaggccagggtgttctcgggaaatgcaacatttgggcagaaacaccgaaatgtctgtcctcacctgggtccgtgcacataggccgtagggtggaaccctagccagggacccgcccttctcctcccagcacttccctgcccctcttccgtatcactaccaggaaaggccacttggccccatcccaggcctcgcccaagacagagagagagacaccaccccctgcaaaggagcaagccgggcccttctctctgagaccacagggtggactgtgttcagcagaaaagccaggtagccagcgctgtcaccagagcagtggctgacccacagcatggcctggacagagctgggggcctgggctggcaccctcagccctggctgcttgcagtcccggccggctgtttgcctgtgaaggctccggctgtgttctagggagttggcaggaggggaggcccgcagcagcttctagcggcctgtgaagcagccacggggcatggccctctgtgcagaacaggatctgaggagccccgagtgttctcactggatgtggggccgcatccagaccttggcggtcatggccacaggctcccaaggccctaagtgacagccagtggtagacccttcacggtcaggcacctatgactccccgttccctgcctgctcccaggctgtttggggtgatggaaagaggccaggacgtgaggccagggtaatagttcctctcgtgtgtcaggcctgggaggggggccttcatgagaccatcacggagatcttggggcctccaatttgtcaaatagttttctgttacagttcatactgtttgcgttcctttaaagacgtctttgcccatcccaggtcgtgaaaatattatccaactttcttcgacaggcccgattgcctcatagttaggcctgtgactctccctgggttaactttgtgaccggtgtgtggtaaggatcatggttgacatactttcacaggtgcatccacattgttccagcaccctttattgaaaagcgtatccttccgccagctcgacggcaaaggcgtcttttctatgaaccagtggccacaggagggtttgtgtgtctaatgtcctattccacgggtccccaggccacagaccggtacccatccatagactgttaggaacaggaccgtgcagcaggaggtgagcggttggcaagtgaacgtgatcacctgagctccgcctcctgtcagatcagtggtggcattagattctcgcaggagcgcgaaccctgttgtgaatgcacatgtgaggggtctaggctgtgtactccttatgagaatctaatgcctgctggtctgaactggaacagtttcatcctgaaaccatctccccccaccccaccccgtccacggaaaaagtgtcttccacgaaactggtccctggtgccaaaaaggttggggaaccactgccctattccgtcagacccccactgttcatctgtctgcccacacgctcttaatcaagccctgtggcctcatgaaaccctaggagtgtcagacctctgactttgttgttcttcaagatcgtcttggctattcttggcccttcacgttgttaggaatattttagaatcaccttgtcggtttccaataaataaacaaacaaacaaaaagcactgtgatattgattggaatcatatttaatccacacctcaatttgcagaaaattaacatcttataaatattgagtcttcttatacatgaacatactatatccccaagtcaagttagggcttctttatctgtctctccaatgctcagtgcttttctgtgtagcagtcttacacatctttaaacagatttattttagagctgggtacgatggctcacacctgtaataccaactacttgggaggctgaagtgagaggatcacttgagcccaggagtttgaaaccagcctgggcaaaataacaagaccccatcttagaagaaaaaaaaaaaaataagaaagaaagaaagaaagaaagattgtgaaagcaagacagtaaagaagaaacaaaaaacttttttgaaagatttattcttaagtttctggtcaagtttatggttattgatgctattgtaattgatatgttttattttctaattgttactagcatatagaaatatacatatacatattttaaaggcagggtctctgcattccaggctcagagcttacagcagccttgagctcctgggctcaagcagtccgcccatctcagcctcctgagtagcaagaagcacaggtacacaccaccaagcctggctattttttaaatttattttttctacagatggggtctcactatgttgcccaggctgatctcaaactcctgggctcaagtgatcctcccaccccaccctcccaaaacactgggattgcagatgtgagccactctgtcaggcctagaaatataattattatatatcatccttaaaaccggcgttcttgttaaattcatgtattccaacagtttatctgaggattcttagggattttttttacatgtatggttatgtcatttgcaaataacaaatgttttattttttcctgtccaatccttgtaccttttatctcccttttcctacctttttaacataccagctgggagtttctggacaatgtgaaatagaaacgataacatccttgccttgcttcctgtctcaggaggaaagcgtatcacatttcactattaagtatgatgtctgcttagggtttgggtttttttgttttagtttttgtcttttttttttttaggtaatggagtttctattcctagtttgctgagagttgtgtttttaattatgaacaggtctcgctttatcaaatgctttcttacaatctgttgtgttgattgtattttttctgacttattctgttgatgtgaagagtgacgctgcttggtccttagagggtaaactcagcatgcacaagtggattaaaccacattcgagcatgtgtttgggcacagtgctacatgcagcttgctggtggtggttaggatatttgcacgtatgttcacgagagagattaacctgtgattttttttttctttcttgaaatatccttgtcagattttgatatcaaggttatgctgccttatgaaaatacttgtataaaattgacattattttttccttaaacatttggaagaatttactggtgatgtcgtctagatacagagttttctttgccagaagatcattaaaattccaaatttaacttatttaattaatattgggcaatttggattatttttgtttttgtgtctacttttacatactgtgtttttaaataatttgtatattttatctaaatcatcaaaagtatttttgtttgtaatgtcctctgaataaatgtttctgcacctctaggtctatagtgacattccatctttaactcctgatggcggtcatttgtgtcccctcccccatctgatcagtcttcccaaaagtgtgtctgttttattagtctcttctgagaaccaaattttggctttgttgattttccttaaataatgttcattttttatctcatagactgtgctcttaactttatctcttccctcctactatctttggtaggaggcaaatggtaatttgccatttttttaaccgcttgagatggatttcagcctttcctctgctctgagatatgcatttaaagccacgaggttcactgtctgtgcttatttcactgtactttcagtacctatttggctatgaattttaataccttacatttttattactatttaatttaaactgttgtttgattctcattatatatttttctttgacccctgggttatttagattgtttaatatccaaaatacatggagattccctagttatctctttttatggatttctaatttaattgtactgtagtcagagagcataataaatatgatttgcctgctttgaaatttgttggaacttgcttctgaagtcttgcatatggtctcttttggtacatgttctgtgtgcactagggaagcttatgtagtctccagttgtagggagcagtgttctgtatatgtcaagttgctaatcaggctgttcaaatttgtctctgacttgacaaagctttgactgcttttctatcagttactgacgaggtgtgttcaaatctcccaccattttctcttttagcttttagttctgccagtttgctttatgtattttaaggttatgtttttaggtgcatacaaatttagaattgatctcgtcctgctgaattgacacttttataaataggacatattcttctttagtaatacttaaagtctgctattggttttcctttactagttttcatttggctacaccatgacctatctttttctatcctttcccaacatgtttttgtatcgttatattttaaagtggatttatatagttgtttttaatcatgacaatcttgatcttttaattagactattaatccacttataatgtatgcaatctaccatcttatgcttctttttcatttgtttcatctcttcctttaagtctattttcttttcatgctccaagctggctattttctttgggttcacagctattcttttctactctgtcgtccctgctatccaactcacctattgcattcttcatttccattatggtccttacttttctggaacttcctttttatgtatctataaattttatttctctggtaaaattgtctatcttttcatctattttcttgaacctatttatcatggttattttgaagtcttcatctaaatattctgaagcaaagcacaatcatctgttagctcacaaatctatgggtcagcaatctgggctgcccagttgggtggtctcacttggattcgatgacatggcagtacttgcatggtgatgtggtggtggctgagtggtctctgttgtcctcacgtgtctggagccactgggttgtcagccagggtctctcagctctccttcacgcggctgttccagcaggctagctcagacttgtccatgagccaacagaattctaagagggtaagagtagatgccacaaggtccttgaggctgagcttcagaagacatgatcatttccaccatggtggagatagactctagcctgcaatgggaggaaccacaatggattgtgcccatctttaattaatcacagtctgccctctggccataacttttcgcattctcccctatgcaaaattcactcacccccctcccgacgatacctaaaattctcacccaattacatgtggcatcatgctcaaagtccgacatcttgtgatctgccccttccagcctctgtccaattccttgtcccaaaattaatgctgtaagttttaggatattgatatgacattacctatttcttagtccttatttctgtatcagttacctattgttgcgtagcaaactagacctaaatttagtggcttcaaatattttctttgggccgggcatggtggctcatgcctgtaatcccagcacttttggaggccaaggcggacagatcatgaggtcaagagatcaacaccatcctagccaacatgatcaaaccctgtctctactaaaaatacaaaaattagctgggcatggtggtgtgcacctgctactcaggaggctgaggcagaaaaatcacttgaacccgggaggcggaggctgcagtgagccgaggttgtgccactgcactccagcctggcaatagagcgagactccatctatatgtgtgtgtgtgtgtgtatttttttttttctttgcttagctaggaggttggacttggttcagctaggaggttgttctgttggtgctggctgttagctgaggcctctctcttctccatgtggcctctctaatcagcaagcttgtttgcagggccacattccaaaaggacatgaattatataccgtgtacattccccagtactctttcatcagtgaagtcacaaggtgaccccaaattcaagtaataggaaaacagactccatctcttaatggaaggagctgcaagtatttaaggctgttggaagtaccacacctttagatctgtatgatctctcttttcccttgccttttagtctttcgtgtataaaattgtagatgctcgagggtattatctccctacagataattttattttcttctgccacgcgcaaagcaccttactccagtaggggattgagagaggtggggttaatgtgatggaaagttggcattgcttagtttctggggctgccttctagatagcttctaaaccccaaagcttctctccacagtgccatgcgtctactgagtactctgcttagcttttaccccttcagcaactgctttttgctcagtttctgtgattctcacccacccgtgtggcttaggaattcacaagtgtttccagaggaagttgtgtgaaaggtggctagaggaccagaatctttttccctcgtgtcctggctgtcctgtggccctggactccacatttttatcactagcccactgggcccccaccctgttgggtgtcagtgctccccaaactgacaagtgccctgaggaggaaacgctcggatgcaggcgcagctcagttcatttcctttctatgtgggatcctcaccttctatgtctttcttggtctccaaagcctcacacagctgttccttgctgttggcatcacttagtctcgcagtccctggtgtttccatcaggaaagtcaggcaggcgttagcttcactgccaggagggaatctcctgtggcctccatggcgctgtgttttcttccagtcttttttctatgcacagacacatcatcccctttgtttccttttgtgatgctgtttctaaaaggatctttatttctagaagaaactttaggaggcaaaaacagcgcagcccccttaacagagtggctctggtggcaactttcccttgttaatttgtcctgtagcccctactttcccaagcgcttgctgtttgtggggctacaggacacagcagctgaaaggggctgtgggcatcgccagcatgtaccctcttatcccatttgctgacaaggatcctgaaggcccaagcatagaaagaagttgctatggctgccatgtgtcagcagcatagccatggccaactcagggccctgactcctacctgacccccttctgaatgacactcaaggtaagggtccccttcccactcacagatgaggtgaaacatttcaccttgaaaagcctcttgcccccagcctcccctcgagcccacactgggacatggcctaagtatctccatcccatggagttgaacactctccttgtttctggaaggatccagtctgcgtgctcctcaggcagtgcaggggcagtgaggggatgaccagcacagggtggccactcacaatctcctctcctctctccactgcaggctgcgggaacaccatcgggccaccattaaggtcattcgacgcatgcagtactttgtggccaagaagaaattccaggtaagccctgtgctgagccttcctgccctcagcctgcccctcgcagcctgatgcagctgcccacacctctcctgggttctctcctgcccatagtggagggtgtcaaggcctccgcccccaagccacacaggcaggcctatctgagacctgacagtgcctaccccaccgaaccccagacagcaggcccctcagaggacctatccttggaggcccggcctggaaccagggacacatgcagtgtcttcttcaccaagtagaaggcagcagccgtgtagctcactcagtcctcccgtggggtgggtcgtgcaaggcagcattagtgagagatgtgagggtgacatcagaatgactcagagatggtgcggagcctgccctgagtcaccaagctgggaaggcaggtcccccagaccccccagccctgtcctccactggctcagtgctctcattccctgctcctccaccctctgtgagttgggaggatggagggaggctgggccctgctctgtaagaggtggggtccccttggccaggtgaggctggagctccagggcttccataagctgccctaacttctccaggggcatgtcccccctacagaagccccttagagcccccagagtccatgccccgcagagaatgccattgatggcaggcatgtctcccctcctgccttggggacattcctcggatgaaggcggtggtggggggtactgagtcctggcttggaaatacatgtgtaggtgtgggaaccccgtatcctctgtggtgggtgatccagaaggcaaaaatcacaaagcagggaaggctggggggtgacttgcctgagtcccttggagcggggggcgtgtgacgtgcttgagtgagtgcgtgtctgcaggagcagggcagggtggggcttctgagctgggggcccctggcacctcagccacagcctcaccagtcataaggcacagcccaggaaggctcagcaatgtccgccgaccaccaggacccacagtcggtggcatcccagcccaccaagacttatcctggagccactgagctccctgctagggtctggtcagggcttatgggggcctttgtcaagaggtcgttgggtcgggctgggaagatcatcttgacttcaggagcctgagatgagccaagataatgcacagcccatccagacggactgacagtggcattcaagtctggtccccctgcagccatgtctttcacaccaggccacaccttccactccaggccccaggattgacacaggcccgcccacagtctccttggtggagcccccacccatctgggccctggagccacctcagcctccagacttcacagggcggtctgggtgcagaccctggcacaggcagccctgggcaagttcttccccagctgtgaggggaatgagagcctaagggtttggcataagatcatatgcacgtgcctcacccgggccttgcccccagcaaccccaggccagcacccgctaggctcgtcgtcactctgagccccaagagcagccctcggccaggcccttgccaagagcagtatgcgggccctcgttctggccaccgggccaccatctccaggggggtttcgcatgcacagccctcccacagtggtgtttctcagctggccctcccacctgcatccccccagggaagggggtggttcatgactcaactgaaccaagttgtgtcaaagctcccagcagtgcctgggacctcttgcagtcaaaataaaagccatggcaaatgccactgctggccagtgcccggagatctgcctggcatgttctaggggagatctgacagcccctgtggaccagggtgtctccattctgggaccgtctcctctctctggtgctggcatggagggccttgctggagcagggagctcactcgggggcaatggaagagagaggccagcctcctggcagcaccagtgctctcccagacagggaaggggctgcgtgaacccctttgggactcagatctgggcagggcagtcccccgagggcagaggagaccatgggaagggccagggtgtgtcagttcgctggagaacagcatggtcgtgacagccgaagcagctgacgtcaccccagcagtagagcagagggacacagggagcctcccagggtggggctggtgtctggcctgagggtgcagagcaggtcccagcagggcagagccagagcccaccaaggcttgcagaactgcgccacttgggcatcctgggggctgcttccaaggtctgggggaacccagcagagcatgcagaccctgatggctcctgggcaggcctagctccaggggtggtgtgggcagcttccagctcaggtcaagagatcatccagccatccctttctccatcagccaggaaggacactggcattgaggttgatatcaaggatatcccatcgtgataataactaccatggcttccagtcttgtggtgaaacctcagatgcgtagcctcctggccaagcgtctgcaatttcatgttgttggagcattcgttgaatacctgggagttgcagctctctgtaagtttgatgtggctgaaccaagaaaaaaagcacacgatttctacagatattatgatgccgtcaaagattttgaggtgatgaggaaggctggcatctttcagagtgcaaagtgattttggaatataaagaatttctttgggttgaattacctagaagcttgtcagtgacctgtgttcctgaactgtgaaacatgaatatatgggccaagaaatggtttctcttggtaaataagcaattaacaaatacaaaaagagagagagggagagggacagagagagagagagagatcatctgcgccagccccagcaggccctgtcgctgagccacaggtgaaaaagctggtccctggggaggaacacagtgagccctgcactcccttccagacaggagggagtgggtcccctttcctgtcttaggacacaggccgggaccctgagaatggcccaggaggcttcctgaagcagactgggaaacccccaccccactgtctgcttctccactgctccctggccctgggagccttgcagaaacctggcaacagcaggatcctcgcagggcacagaggctcctgcacaaagccgctggggctccctccgacctcaccagctggctcttattgctgggagcagcatggaggggtggggccagggtgaggggagcagtagcccgtggcagtgaggagctgtgtgtggctccaggggctcccctagcccacctctcaggatgcttcccttcctcgacgcctgcctgtctgcttgcttgcaccccaccccacccccgctggcctcaggggctgctgacatggcaggtgacccctctgcctaccttgctggctgataagtccttggccaaccacccctgtgtctggcccaaggagccggagcctctccacccttcaagtgtgccttgaactccctgtccaccatcagtcagtctggacaggcctgcattatctcggctcatctcaggctcctgaagtcaggatgatctttccagcccaaccccagaggaccactggacaaaggcccccgtgagccctaaccgtatcctagcaggcatctcagtggctccaggataagtctctgtgggctgggatgccaccgggccgtgggtcctcatggtctgcgggcattgctgagccttcttgggctatgccctacaccaggtaaggctgtggctgaaggtgcagggagctctctgctgataggcccacccagccctgctcctgcagacgtgcacacactcaggtacataatacttccttgcccacaacaggcctgtttggaagcactcgcatctgcagaggctgctaacacacacacctacacccacctggtcacagtggcccagagactcctagggcttggttttcccctgccctgcctcccttcacctgcccacaccgcacccagatggctggaggtgccccatgcttcagcttcacagagctctgtggtctgcaggaggctcaccaccatgactcatgccatgttcaatgtgttctgaagagaggcttcggccacagctggctgtgactctggctctggcatggtgctggcttaggattccctgacctttctcaactcccatcctatgtcatcctcactccctcccttaaggcagagcaaggcagtgctcagcatcccatcttagagaagagagcgtagaatctccatcatacagaagggacatacggaagggagaaacagagttcaacaacccgtcctacagaaaggaagatcaaggctcagtatcccatcttatagaagagagaggcagggctcagcatcccatcttgcagaaaggagcttagaatctccattatacagaaaggagaaacagagctcagcaactcatcttacagaaaggaggatcaaggcttagcatcccatcttatagaagagagagacagggctcagcgtccaatcttacagaaaggaggatcaaggctcggcatcccatcttatagaagataccaacagggctcagcatcccatcttacagaaaggaggatcagggctcagcatcccatcttacagaaaggaggatcagggctcagcatcccatcttacagaagggagctcagcattttcatcctataggaaggagaaacatcccatcttccaaaaggggggatcagggctcagcatcccatcttacagaaaggaagatcaaggctcagtattccatcttacagaaaggagctcagtatctccatcttacaggagggagaaacagggctcagtgtcccatcttccaaaagggaggatcagggctcaatatcccatcttacagaaaggagaatcaaggctcagcattccatcttacagaagggagcttagcatctccatcttacaggagatgctaccaggtacaagagatgctaccagatgctaacagggctcagcaacccaccttacagaaggggaggattgaggctcagcatcccatcttaaagaagagagagacagggttcagcatcccatattacagaagggggaatcaaggctcagcatcccatcttatagaagacagagacagggttcagcatcccatcttacagaaaagagaattaagactcaacatcccatttcatagaagagaactcagtatctccatcttataggaaggagaaacagggctcagcatccccttttacggaagagagagacagggctcagcattttatcttacagaagagagaagaaggacttagcattcccatattacaggagaaactgagacctgaggatgttattactagcctgtacataagtacggtttttacgggccagagggtctgcctagagtccaaccccatgcctgcctctatcacagttcttggtgtgtcatttctgggcaatgccggcgatcctggtgcccagtgtggccccaggagcagcaggcccttccttccatggggcacagctgtgttgtgaggacacgggccccatcccagccctcctgatctcaggatctcccgttcagggcccagagagtggctagtgttgccagtgagggccctacctgcttgtgtcaggtggaagaggaaccccctgaacttctgaggcccagcctttggtagggaggaggtctctgccctgtcttgggattcctggggtccaaaacaatgttgggcgggctgtaagaactccaccaagcctccggcattggtggcagaacccctgggcatgtcagaagtgtgtctagagctgaaagtgggtacatggagacctgacctcagggtctccccatctgggaacttgctgcttcccagggtagaagtggctgcatcctcagattaaggtcaccctggtctcaggagtaggaccccaaagagaggtagcaggtgggcagggagggcatgttcccagacccagcccgggccctcaacggtacctgagcttcctcctttctcatcctgggcctcaattgcctccctctgacttgggctggccctgccccacccctccccaccaagccgcttggctcgtctcttgggccttgcaaattccccagcaaaaggcaggaaagccactagctcagtgctaaggtggctatttgagcactaatgatgactaccctgggcctcacccggtcacccagtggcctctcgggatagaggcagtctgttgtcctatgtgctggcttgcctgcagggccaaggccttcctaggccatcaaacccctgctcagcctggctgctccacctgagtgaggcccttgggagcaaggccacaaatgtggcttggggtttcctgatatcatgagatgctttgttttctctgttgtggtttcaagatgtcacctgagtcccacttataggcttagagctggcaacaagcctgggagccctggggtcccctgccctgcctcacatggccccagccccactgtgggagcccaagcagatgctcgtcacccacagcaagtgctgcaggctaaggccgtcatctggggccacccctgctgcctggcacaaactgccaggaacgatgcagaggagacccgctccctaccctgaggacagtggcggctgcagccagtgagcatgtcaagggtcagtctggggcccaggtaggtagtgggcatgcagagctgtgcctcctggtcagtgcctggcactgtgctgctccttgaccccttgggggggccagctcttcctgaagccattgagaaccagaactggtagcctggggtggtggggggtggaagggaggagacagcaggcccctgccggtgagtagacaggaagctgggacccagagaggccgagctgatggcccaggactacccagagacccatggccaagctgatggggacaagcttcgctactgtgcacgcttggaaccaggcttatgccatcaccacataggcgagctcccaggtcttcacaagcctcccgagggcagacactgtcactgcctgcactttgagccacatggctggggcacagggaggagaagtgatgcgtgtctttttgtcccgcagcaagcgcggaagccttacgatgtgcgggacgtcattgagcagtactcgcagggccacctcaacctcatggtgcgcatcaaggagctgcagaggaggtgggcacggccaaacggcagcggggagggtgcccaggtcctgcccagcccggccccagctgcatgatcagcggtgccggaggagggaggggctgagaccctgagttcttgcctctcaaccacccccttctcctcaccacccccagccctgcagagggagggcagctggccacggccacggttcacagccagcccaccaggcagctctaccttgttccccgcccggatctgagatgatgggggaattggggtaggggaggcgcgtaggggaggcaaacacccgcctccgtccctgctcaggtagcaacaccagcttcacactccccacaacttcaggacactcggcagccagcccacccgccttccctgtcacctctgagcaaggggccaggcccagccctgggaagacactgcctggtgccaggccccaccgcacgggtctcccccagactggcctggagctggagaccctgactgtggggagctaatgtgttcccatggagctagcaccatcctcccgggcctgcacagactcagagcagctgtgcctccgagatgggctcgcctgggaactagctccgtgtgttacagggcatggctgggagcccgtgtccatcctggccacaggcgaggggtcaggctgccttgcccatggctgatccactgcctcccactcctacccccagggaggaagtctgagaggcagcccaccgactccccctttccgagatccctgctcagccccctcgggagcatggccctctggggggttgggagtgacctggcaggccttagggtcgggggtgtccccagagtgggtggacagtccactgtcttgccgggcacgtcaagctgtctgtcccacagacgacagtgcatctgcgcagtgccagggccaggtgtgaactggtgtctgtgtccttctctccaggctggaccagtccattgggaagccctcactgttcatctccgtctcaggtgggtttctgtgtcagttactctgggcccagcagcctgcaatggactctcccgcacctctgccctcctggctctccccatgatgtcagaatgggccattgcacctccaaagtgcatgacatgaaatgaaagccagggagtaaggggaggtagaccccacccttagcaaagtggctccaaagtacattttacaaaggaatattcaggtttcataagaacctacctgggtccctttaaattccagggcgttgaggttaggctctaggtgtggaaacatgaacccagggcaactttgcagaagggggtgatcctggggtggggtttgggtggggtgagctgccagcccagaattcaagagactatgggtgggggccttgcagggctcaagttgagagggacagaagcacctggctgcagcctgggggctggttttctggctccttgaccaaattccttgggtcccctggacacggggctgtgagtcattccggggaatgacagggaaaaggcacattccctggggtttccctagcccagatgcaaacagcagccacggctcatagtgtgggctggtgtaacggagcagcggaatggctgtgcccccagcctggagtcaggcctgtgtcgccctgggagtggaatggcatgggcttgcacagctggcagtgtggccagcttaggcagccccctagggctctcagaggtcagaggtggagagcgtggagcaggatggagcccaggtccccagctgcagccatgcccggccaccgtaccacccctggtatttttgtcatagcatgctttttaaaaatgtcctagtaggtttaggcattttgactctcagctacctcccccagccctaccaccccacttcccaagcccagctggggtccccggcccaccccagcacttggccctgatttgggtgttttatcccccatagaaaagagcaaggatcgcggcagcaacacgatcggcgcccgcctgaaccgagtagaagacaaggtaggctcacgcgccggcctgcggtggttctggttagcgtcctggggccagcaggcacctccctgtggtctgcgtgtgaacgtgaagctcctgcaggcctccccaccttcccgccagtgcctactgcagcctgcccagcaactcccaagaggggcccaggcccactgcccacctggcggggcattggtcccccatggaaggagccaggccaggctggtttctcatcctctgacaagtggcgtctttactggcaggtggcaccaagtgccccctccccccagctctttcccgctgcctctcgtagtctgctttgtgctctgcgagcctcctggctgtgtcctgagtggagggtggcagaagctggcctcacatcccagccttctcctgggcccagctgtctggggcctccacttggggccggccgagggctcagggaggtgcagggcccagctgggatgggttcatgggaagagaggcatcttctgttcaccccgaacccaccaggcccccactccccaccaggctctgtgcccatcactcggtccctcaggccggagcctctcccccaggcaccctgggagctgccgggggatctgggcggtgggagggcctttctcgggcccatggctgagcccaccactgccctttgaagtctctgtggtttgaagcgggctgttatcttgccgaacagcaagtccgtctacatggactttatctgaaagtagctgagaggctaaaaatagaggagtttcagttgggcagggagtgcgtctgccgcccggtttccctggcaacgcctggctctggcctgcttccatctcggctgcagccgggcaggcggggcaggcacagcccggcccaggctcctgctcctgccccacccgtcctggcccccaggacctgcagcgtcaccctctccccacctggcaccatctgcccatggcctggggcggccgtggggccctgagaccagcaaattgggtcatgcagaaagagcgaaggctggtgttcaggtgcctggccccatggggctgtgtgaccacagtaccctgagtcccatgggcctggccaccctctgtcagcacagacctgagcagggctggtgcagacctttgccaggcagatggcccagtgggagatagcgcccatctggcaggacaggaagcaagacccgggagaggtcagctcacaggattggcaagctcagaggcccagaagccttggcctctctgctgcccggggaacacggtgtttccctggctttctctttgcgcaagggctgggtgactcctggctggcacacccagtacagcagggccgggtaccctgtgttgttggcatggccaggagtttctagacatcaaggaaagccgtggtagagacagggagtggcacccagttccccagcctccactcctgcttccatctcggctgcagccaggcaggcggggcgtgaacatccctgacgtgcaggagtgtcggtggccctttctggacagcacaggctggggacagcccccgcctttccccgccactccctgccaagctctggttccattgcctacactactgtcccagacctttcttacggctctgcccctgctccatgggacaggccaccctctaagcccagacctggagtctggcatcctgcgggggtgatggtgggtggcagacagggcctcctgaagtgcaatggccccttcctgacgtgcacagcagccgtccagcagcctgctggggcctgggaacaaggacacagtcctcagtcagccaaggtcggtgtgggggcctgcagaggggccagcgctggccttgaaggcacaaaattatgcacccaatttcttcacatctgagcaacaaagggaagcattttccggagtccctgatccctagggcaaggtttaagaacaaggctggggccacatcctggtgccctgtcaggctctgagccggggccacgaggattctggtagattctgcatgcacagccctggtgggccctggctccctgccattacattcgagtcctctgcctggggtctctgaggtggtgagtggcacccacagtcgacactaaatctcagccccgctgaggggtctacctggaacctggctgcccatcaaggagttgacagagctgtgctgacctaggtgggtaggtggtagcctacccggtccttgccctgccactgactggtgcacccctcagggacagaccctaggaaagggcctggctgggcctggagggcttggtggcacagcctggctcgagttttctccgttatcagtgcagccatcgggaccgtaaataccccaagcgcaatcctgctgacttcgggaagtaggggcaggaaatccagcagccgcccggccctcggaggcccagcaggcgtgcagcggtgccaatgcccgccggccctgccaaccccagccagagcccctggccttccctaccagcaccctcccccacctcatcccgctggtctggctgcctgccggaagggagtcaaggccccagcctccaactgttttctcagctcagctcagcccctcagctgggctgtgcagtgagtcccaccccaggccagcttgcctagccataggatgagaggtctccgggatgcacagctggctggcacccctccagggaggcctagagtgtccccctgcagggagttcaccagtgcaggccagctgagcttgttcagggctgcctcagtttccctggcagggagccctcttcttccttggtgtcctggccagggacccacattggagagaggggtctgggggtctcccttctcgtcacagtcctgcgggctcgtcaaaactcttgcttgacagtgcagtgtctgctccaacacagacctcccaactaccttgcaggacgtccccattccagggatcccttccacccctgtgcctgtcctggtggcttaggttctgcctcactccagggtgtggagagcagaaacccacccacacccgcagatccaggggcctcctcacagcgagtctacttcctgcgggcctccctcccctgtcaaatgagagggtttgactcctgcttgtgtccttagggtcaaaagtcacaaaagctgcctcatgccctttctgttttcatcttagattattgtcttctttatcctggagaggactcttatttgctcaaatgcccacataaatcctcttttacagatggggaaaccgaggctcagagaggctgagtggtcgcctgaggtcacacagctagttaggtgaagagctggtcccaaggaggacacagacaggggtgggagatgaggtagagagagcaaggaggggtttcatatcacccaaagtccgtatggagaggctgaggagggttgaggccaggggcaggctgggggcaccagcagcagggcccagggccttcagtgtgggccagggaccaatgcaggcggtcgggagaggtccggagagagctggccctgcccactccccctctggccccactgggcttcctgaagtcccacacagggctggcagtctgtgtgggggctgcataccccagacattctgaggaatcgatggcagaggccgctccagccctcctcccccagcaagtattcttagcttggtctccaggacctgccacactgtttacgttgggccctgtttattttgcaagctaagctcatactgcttttgctgatatgaggagcacagtgggctgggagagtttctttcttctctgtttttgccggaaatgttcatggctgagagccggacacaggggagtcctgggtttccatgccgcagttcagaaagcgttgggcgggaaggggcccccaccacctgacactcctttcactgcctccggtcgcagaatccaggcctccaggatgagaatgccccccaacccaggactcccaaaaccacaccctgcccatgcctttaccaagcttcgtgcatgaccccaacctccaggatgcaggcaggcccagcctcccagaattgggtgtttgcccccagacactgctaccctttccctcattccagtgtgactcctccatcaaccaggccacaagctggaccccaaggcttttttgtcttgggcagttccccgagctgcacccccagagccgccgtgctgctgttcatcctctccctttagcccaacccctgctgagttcaggcctttatcatctcttacttggattatttttccagccatatatgcggtctccggcctctcctcacacccaccaatccttcacattgtatattatttcttaaacactgctgaaatctcacttactaatatttaatatatcagaatttttgtgccagtatttatgtgtgagatacatacatgacataattttcctgtcttgtatggtcttcatcaggctttggtgtcaaatgtatgtgagcctcacagactaacttaagaagtgttccctcttttcctatattgggatattttgtataagattagaattttattttcctcaaatgtttggtggaatttaaaggtaaagacatctaggcctggtgttttctttgtgggaagattcatcattcctgattcaatcgctctaataattatggactgttcaggttttctatttcttcttgtatcagttttgataagttatatattctaggaatttatacatttcattttagtttccatgttcattggcatttattataattttaatgtccgtccattagcatttagtcccattttttattctcaatattatttatttgtgccttcactgttttcccccttagtggtcaaacttgacactattcccctgtcttattaaatgtttcgtggacttctggctttgctgatcctctctattgtgattttgttttgtttcattcacttctgtttattttattccttctatttacttggccttaatatactgttctttctctaacctctctaaattaagaagaggataattcttaattttcaggcttcctaaatttccttttcgttttaatttttctaaccactgtcaatctcatggctttctaaatttttaaggtatgcatttaaggttataaatttttcctttaaatatcatccaaactacatctcccacattttgatatatggcatttaattttaatcttcattcactttagtatttttctaatctccattatgatctcttgtttatcctaggagttctgtagcaatgtggtttttgtcattgttataattgtagcacagctttctcataatgttgccctcttgtcagagaaagcaatccatatgatattaatcctttagaatgttttgaaatatgatttacggcaaaaatgtggtcaatttttgtaaatgtgccttctgtacttgaaaacaaggtatattctgacattgttgggtgcagtgttatgttcatatccactggaacaagcttgttagttggtctgttcaaatcttctatattctcattggaatgtttttatctgcttgatctattattactgagaaggcatagggcaaatttctgtttaactttctaagaaacttctaaactgtttccaaaggatttataccattttgctttctcaccagtaaagtataaaggttccactttctccacagccttgcaaatacatggtcttttctattttagcccttttagtgagtatgtaatggtatctcattgtggttttgatttgcatttccctaatgactaatgatgttgagccacttttcatgtgcttattagccattcatagtcttctttggtgaaatgtttattcaactctcttgcccattttctaattaagtagtctgttctattattgagttgcaagggttttttatatgttctggatacaagtcctttatcagatctatgacttgcaaatattttctcccattctgtggctgtcttttcatttccttaatcacatcttttaaatcacaaaagtttttaattttaatgaagtccaatttgtcttttcttatatggctcaggcttttgatgttttatctaagaactctgcctaatccaaagccataaacattttctcctgttttgttttgggtttttttccttctagaagttgtatagaattagctcttacatttcggtctatatttactttgaggtaattttggggtatgatatgaagtaaagtctagatttgttttgttttattcttacttatggatatccaattgccccagaacatttgttgaaaataccccatttcctcctttgaattatcatggcttcttggtcaaaaatcaattgaccataaatttataggtttatttctggattttcaattctattatgttggtctatatgcctttctgtaagtctatatgcctttctgtaaacccatactatactgtcttgattattgtaggtttacagtaagttttaaaattaaattatgtaagttttctaattttgttcatctttttacaaattgtttctgtctattctaagtcctatgaatttccatataaattttaggttcaacctgtcaattaaaaaagaagggcctgctgggattttgataggcattgtgttgaatctatagatccatttggggaaaattgacaacttaacaaaattgagtattgtaatcaatgaacatggtatatccctccatttatttgatctactttaatttctttcagtgatattttgcagtttggggcatataaatttggtacttcttttgttacatttactcctaaatattttatttgtcatgctagtgttaatggaattgttttcttaatttcattttgaattaattgttcattactagtatatagaagtaacattaaatttttatatcaatcttgtaaactgacttttctattcttggctttagccatttttgttgttgctattgatttcttaagattttctacatataggatcatgtcttgtggcaataaagacaatttttacttctttccagtcagatgcctttaatttctttgttttgcctaattgcactggcttgaacttcaaaaaaaatattgactagaagtgctagagcagatcttctggggaaaatcattcaatcaatttccattagctctgagttttccatagatgccttttatcatgttgagaatatttccttctatttttagtgtgttgagagctctcattatgaatggatattggattttgtcaaatgctctttctgtgtctagtgagatggtcctgtggtttttattccttattctactgatttggtataatacattaattttcaggtgttaaaccaatctcacatttctggaatatatcctacctgggcatgatatataatcctttttatatgatgctggatttggtttgctaatattttgttaagaatgtttgtgtcttcaacctaggaaagctgattgaaagaaaaaaaaaagaatgtactttatattcataaaggatactggtgtggttttcttttctgactttgatgtcagatttttaaatccttttctttttaatcctacaaccgtaggatttcaggtttgtcttttgtaaacactgtattactgagtttttaaaaaatcatttaatacatttatatttaatacatttatatttaatataatttctaatagatttggattgaattctagcagtgtattttgtgctttccacttgtactaaatctgtaatatttatttttctcctctttcttgcctctcattagattattacttctcattctacttttctctctactggttttgaagttatgtattctactaccatccttggaaaggttaacctagaacattttaaatgaatatatatcagaagtaattgctatatctacccatatctgtaataaaatagggatcctagaacactttaacttcaattattctccccctgacttagtactttgctgttgtatattttagttgaactgtgtttaatttttaactcactaattggtagtgttttatacaatcaatatttgtttaaatttactcacccatttgcctctttgtcatttgttatttcttttttatctcagatcttacatctgggattacctttttatgtgactgagggattcatttaaattttcttcagtgaaaaactctcagattttgtccgcaaatgaccattttactgtcatgttaaaaaatatttccaccaattataaaattataggccttaggttatcaaaattcttttttcttagcacattaaaaatgttattgaactatcctttggcttccactgttaccgttgagaatgaagatgatgaattgttgctccttggaagacaatctgtcttttttctctggctgcctttaagatctttcctttgactctagtctgcattttcactaggatatgttaataggtttctttttttctgcctgagctaccttactcagtggtttggtgtctttcatcagttctagattattctcagttaatacttcgtaagatttcacttcagtctcattatctccttctgaaatttttattggccagtagtagaccacctcactccccttcatatctcttaaccttttttttttttaaatcactttgtctctctgtactgtattctggaatccatcttccagttcactagttgtttctttgactgtgtttaatctgctgttaaaactgttcagtgaattttaaacttcaattattattattttatttataaaagttctgttgggttcttattcatatctgataagtcattttaatcgtatcttcctctttacttgcctgttcaaactttaaaattttcttgaagtgtattaaatatggctattctatattgagcttctcttaattccagtatctaaagtatttctgagttcacctccctgtttgattttttcttctgctgactctcattcatggtgtttcatttcgtttctgttttttttttttttttcattgtaaacttatatatcttaaaatttatctgtgggaatttttgaagtctggtgtgaagttggggtcctcagggaggaatcatgtttaccccttccattgccacatatgtgggtgtactgccagcctggacttttaattctaggctcaaagttttctaggccacttaggtagtatgaattcaagcctccaagctgagcatggactaacttgtgaacatgactttccaggacagaacttgttctccttctcttagcagtaatgcagttttctttacaatcttctcagggagtaggagatttttcattggccctcacaatgaaagcagagccctttgagggtcccagctttgtgtaagtctctgctatgagacttcctggggcaggcctgggctttgacacataatcatctattcctggtgaaaccaaagctcaagttcatctcactcatcaaataccttcagggcccctattacctctggggttccactttcactgagttttcagcctctaacctcccttacttcctggtcagctcatccatgctagccacagatatcattttaaattttctaatagccacttttttaatttaaaagaaataagtaaaattgattacaataatatattttatttaacccaatagatccaaaatatcatttcaatatataattaatatttttaaaactcttaaaattgttgacattcttctttttcatactgggtcttcaaaagccactgcatattttacacatttcaatttagacaccgagttttcatgagaacgacttggtctgtatttagatttcataaaatttaccattgaaaaaggagattcccatgcctaagtcatttcaaacatactgaagggttttctaataaccgaatgaaggatctatctttaaattttaattttaatttattaaaatgaaaattccattcctggatctcagtcaccacttttttaagtgctgtgccacacagattcagctatgggacagcgctgctttggacgggcatggccgtgcgcgcgtgtggggaggtgagtgtggctcccccaacgtttacccaggccagccccaaggaaatgctcagtgagtgcccatagaatgtggtgaatgtggatggcagggaccatacgggagagcacactccagtagttgccatctcatggccccagcgcccctctccaccccatgcccccaacagagatgcatccctgcagacccctcctgggctccttctccacagcatcctccccaagttcccctgcctcgagtccccagagctcatgacccacgcctccccgaggtccctaaggaatgtccgcttgggattctggttcttttccggttctctgcagccaggtctgttccctggcgtagcttcgcaactggaaggtgctgctcagcagactgtgagaagtgtgtgtcggtgcaggcaggacacacttccaggctgtcccagaggccagggagcaccttgccactgaagggctggttgcatcagaaagttaggcagcctggactgccctggcagccccagacctgcctctcctcggcagctccccctcccctctgcaccaccccccgccccccacacccaacccaacactcctctctctgctgctgggctgctcttgagtgacagggccgtaaataggcaaaggcgggggctctgactgatcaaagggctccctttagaagccgtcattagtttgctattctgggaactggttattttaaggttagtgtattttttctttcctgaggagccgtcttagtggatggcggagtccggaggggctgcccttcagtcaaaccacacaagccctgttttgtctggggttccaaagataaacctataatgaaagcagcgtttgacgctgagcaccgccaccctgttcctgcacaggggtgggtgtgtctgccagggagtccctgtgcccagcaagctccggggaggcttgcaggaggcccctggggccaggttgagtctgctcccagggagcctgaggtgggaggtcttcagacctggcattctcacagccatcatggcttgcctggccagggaccgaggccccgtaccctcccccaacttcaggctacccccaaaggccacccctggaaccaggctcagcaggcacctctgaaccgcagcccagctctgcccagcaccttctttggaaagacagtggacccaccagtggccaggggaatgcacacccctaaagtcaaaatgtaaggaaatgatgataccctgtgctggcatgggtgcggaagagcagacgctcttctgtcttactaggaggtgggaattaatgaaagtaacaactcctggaagggactctagcactgcctgtgaaaactagaaacccgtcatcactcctaggaaagaaaagcaccagggtcgggctttgcatgcaagctttgtcatgtgacaagctcaaagccatctgtttgtccatagagaagcgtggtatatactgagacacctcgacgccgcagccccagtgcccgccacagacgagcttttgccggcagtcattgctcgggagggatattattgatgtgttgctcagtaagaaaccaaagttgccaaggaacgtgatcgcatctctgtgcagccacagcacccaggacgcagctgggaagggaggccaggggacagctgcgctccgggatgctggggccgtcggcctcccccttcccaggcccagctcctgggcactgggaccaccgtgggcttggctctgagatccaccatgagttctcgctttgtccaagattgagatgcgccaggtagttggtgtgctcatttcgaggtgtttctttttccccccagtaaagtgatgtcacgtggaggtgagtgtgatgggaaagggaacctcagaaacaaggtcccaccttggtcctctggtctcccctgggaggaccacccccaatcctaacatcctgtgaggtcctccccactcagaggctcctctctgtgccacccatcctcggataggttgccatgaggttgccagaggctggcaaagggcacttgtcagctgcagattccagccctgccctgggacttggaggggatcatatccctttgaccaccaggtcatgacccccagatcatatcccaatgaccctctgccataccatgagcccaaatgaccctcaacctgccacagagacagcccccactaactgccactgggtgatgggaccgtggagagtgcccagctcagaggagaagcctgtctgatgtggctcccgtcctcctctgctggggttgtctacactgtccccactcggtgacaccaggagctggcattgcctctggttctactgctctggacagccctggcagcagtgccctagcctggcccagcacctactgagacagccgggccaagccccatcctgcaggtgcagtctcactttgtcactcttggttacccatgggaccctgaaccccataggaggggctcatcactcagggtcctcatccaggtgtggcccatccacacccagcatccagctgtgcacacagggccacacacagacccctttcccatccccccttcccatcccacacagggcaaaagcctgacctcctctcacgcctttggagccagtggctggggtgcaagctctgccccctacacgcgatggctgtgagactcggcgagtcacgtgggctctcagcgcctcagcctcctggcccccagtggaggggacaggcaccattatgccgatcgctcgcgtgcaaaggccctgtggcgtgggcagtgtcacaagctcctggcccaggaggcctgcttggctgatggcagagctcagagggtgtgagcatgaggatggcatcaggggtctctctgcaagttcaagttccgcctcaaccctactacgtggccctggccaggcctcctgaatccaggtcttgctttccccagctatccagcggcttcctgcttctcttaccctcagcaatcccccaagaactgttcttttccccacactagcgtctctctttcttggggtgtttctctcttagcctgcctgtgggggacagttgccaccctcaagcctctcctgaatgactctatttataggcctccaatattggccagagaggaaatttaagtctttttaaaaattcagctcaagtgtgtgtcaacttctgtgagtgcaactgcttcagagagaggctgggataggacagcaggcggcaggggcgtgtcaggtgcccgagcaggacggtggccggagcccgcagcggccgagccctcactgggcaccgtgtgcggatctataatcgacagcatcaattgcgggagtccggctgggctggccgcctgcaggggccagggcgtgagggcggtgcggagccttgtctgtgcggcaaaccctgcctggctgccctggccaacctcagaaaaacatgtattttggtcaaaatgggccccttttcaaacttgtcaccccgtgggtcagggcacagcctgcccccagccggttctgcatattaagcagtggcttggtcaccatcaaaaatagatgtcccgacccgagcctcccctccctcccggggaggggacctggccgtgccggctgggctgggaaaccgcgggcggggaaggaaggacggggcgaaccggcggcacaggcccagcacgtcccgggccctccccgtcaggtgtggaccccgaggttgtgcgggggcttggcggcagctgcgggtgggggtggggggcccgggcctcccgggctcgggttctggccccaggtcagaggtggcgctggcggcaggtggatgcccaggtcctcgccgcgccgctccgggcggtgggaccggcttcctgccctggctccgagcccgcaggtgggggcttccgcctcactttggacggtggcgtccacaaaatggctgacgcggcgcacggccgtccctgcacggagccggtgtttactttgccgcgcgaacagcctttcgttgcccgggttccgagtgctccagaggcagatggaaatttttgtggattaaacacggggccgaggcgcgctgggctgtttgggttggcaacctgagccctccccaccccgttccgcgtccgctgcttcccgccctggtccggcgcttccattcatgccttcccgggtccctccgccacccctgcaggcccggcgtcccctcccgcactcccgcggcctccagggggtggccctgcaggcccagagcagcgtgggcctgaacccctctccacgtgtggaagacgctgcagcaataggaaggggctgctcctttgagggcccttctcaaacctggagcccctctggccgccagatctttgtctgtgaaacagcagccagtgtgtggaccaggcaggagtggatggggtgtgtgcccacaagtccagcacccagaaaacccccagcacacggtcccttttacagtggcctctgctctcaggaaggtggaaagcgccaggtggataggagggacggggccgtgacccctccctctgcccaagagaaactctctccctcaggtcagacccaggcctttcaagaagaggttgcagggtgtgcgggctgccaggaaaaggtctgtgcgggtgagggagcgcatcctatggatatctagaggaagagcgttctgggcggagggcacagcggttgtggggtgcgggctgaggcagtgcctggaccaccttggcaacagcaggaggcactggccagagccacggacaagggggagcctgggggcgcagaccaccctgtgaggcctcaattagaggagatgggggcttggggccccggagggctgagatccagctcatggctttggcagcattgttcttgcacgttcaggattagccgagtaaggtgagcctgacagcggggccagcacgcagccccctgcccctcgccccctccctgcccccagtcccccacataggtgtcaaagtgcacagcaccccctctcttccccgccccccgggagccgcaggtcaggcacacaagagccatctgtgtgggcggcaaggtggctgcctgtctgctgcccgcaaagggatgcttgtccagcagggtgaacaccccgtcagggcaggagctgctgaggagatgctgatgcctgggtgactcatgctacctggccacccatcctcgctgggctacaaatgggttcagcctcatgggcatcaggcagggcccgcctgggtgcacccgacaaacacaagggctcttgttctaaggctctgtgatagcccctcttactgagagggaccatatccaataacgggtggaaattgcactagcagggtcatgtgagggctccgagctttctccagaacccaggaatatcctcaaaactgaggctgggcacagtggctcacacctgtaatcccagctctttaggaggccaagacggggggatggcttgaggccaggagttcacgaccaccctgggcaacatagcgagaccctgtctctatgaaaataaaaataaaaaattagccaagcgtgatggtgtgtgcctgtggtcccggctgctcagcaggctgagttagaagaatcgcttgagcccaggagttcaaggctgcagtgagccatgatcacaccactgcactctagcctgggcaacacagtgagatcctatctctaaaaataaaagtaagaagtattttttttttaactgaggcccttctggagggatggagggaccagaagtcacaaggagcagaaaggaaaaaagcaaaggaatccttctgaagcactgtgggcatttattcattcaccttgtgccactgcctggggctgcagtgtgagtagggtgggctggcccctgctccttagaatgtacagccccatggctgggcagggggacgcacatagtgacccgtaattacatatctgtctgtgtgaaggagaaagtactcggttttcccagtcagtggagtcaggagcccagagccaaccaggagtgagtgaggaggaggagggtgacacagggtggaagagtgtccagtgtgtgcagccttgcaaaggccctagggcacgagggcacatcctcctgaggccatgagagcaggtgaggcagagctggtgagcgagggatggcccggccgggccaaggatccaggggtggctccggcttcgtgggaggagggttacaggcaggtgaggatgcagttccaggagtggtgaggggctgctgtgggatgagggagagcatcagcactttggactagggtggaggccttggggccagcccccagtctgccagccccaccgatgagaacaagcagactgaggggagaaaggttggagaaggaccccgagcttctgctgtgagcccccacgtggggatgctttgctcggaggggtgctgaggtaggagggtcaggagggtctggagctgtatttggacttggcaggcaaccaaaaccccagtgcttagagatcaagtggaaaagaaaagaggaagaagatgggggagtgagagagatgggaaggcagtgagggaagccttggggaggccgtggtcaggggcggcacaggggagaagcaggctcatgtgactcagccctgagcccagccgggcccccaaagatgctggaccttaaagacacaaagatgtgatgcatgtgtgttcacagattagcggggagcagatgccgcatggaggggcgtcagggagtacaccgccttcccaggtgagggtgtcctggaggaggcacaagttctgctgggctggactggacccagcaagagagcctgagcctggaggacccctctggcccccatctcccactttcagcttcagctctgaagccaccacccagaaccacatacctgttcttcccaagtttgctctccctagcggagggaaagacgggaggtccacagattaccttgtctcttgaaagcaagatgccaccagtggggaccaatgtacagagaccaggcccagcctagagtgggtatagctcatcacacccccagaagctgtgcggggaggaaggcaagcaggcagcacagtcaagacctgagtttgatgactcagagggtcctctgcctgtggttggcgggggtccaaggggtcttcccatctaactcgccacctcctcccacgtcccactcagctccaccccacagcagccaagaagccagggcatcacttgaccttccgctgcgtcagtctccgcatctcgcctcccctacccccgacctctcgggtgctgtagggatgaggtaggagtggtggctatgaactggaggccttcgcctcgggctggagctcagagcagtccctgctgctgccagacctgcagttggggcactgcacccatgtctggggaggccacggacagggccccagggtctcaggtgacctgtcttgtgtatcccacttcgtttctctctttccctaaaggtgaagttctggagcaaaaagagcctgagctgtgagccgaggggctcctcctcctccaaactgacacccagtcacagagcaattgctaaagacacagtcatgcttgggcccagagtgggccccacggagcttcccccaacccagcctggcttgagcaggcccctgatctaaaccaccctaccccacacccactggggctcacctggggtttggccagcatccctagaaatcagaagcccgcccctaattctgccagcttctggctttccgttgccatggtgacacccagcccccagctacagatcccgccaactcttccctgccattttgcaagaaacaatatttttctgctccacaaacttggcgggaccctgcctttccccgggtccatgaggaaccccacgggttccttgccctggagtctctccagctctcatcccctgagtgcctccacaagcaggggtcccatggggcgggggccgggggaacagggggtaagtgtggccaaccccttgcacagggcttggagatggaggcccctccccaggtgagaccggcctttggccccctgccccactcacacagggacaccctttgtgtttttccacatctgagagccaccgacatttcttagatgacgttttcttgaacccaccgtgcttggtgcccgttaagtacttctactgcagcagcctagaaccgacacgtgtgaaaccattggcttatggcgcaatgcacttcctcccggcatgcatgaaaacataaatgtaaataccaaaatacacagggactattcggacaccacctgaaatcattccatgtcccaccagaagccagcacggcccctggccccctgccaggtgacgctgccccatggcagccacagtgctgatgaagctctgtttgagatcaccgcctggctaaggccaaggcggccacgtcagttctcacggctcctcccaaactgaggagcatggaggaccctgggcattgatggcagggtggcaggaagcacccatcgctttcctctcccggatcttcccagcacccttccaccttcagcctttataccccgagaccaggcgaggcctcccactgccgacccaggcctatcatggggcctgagaagtagtcctcatttcctcactctcacaccccgacacaccctctccatggggaaggaaaacgtgccccgaaggggcctgtgtccaggttcctgcccactcagcccctcggggccgtgtctccctgcgtcagagctgggcctgaagataatgggcccactgaggtgcaggcggtggacagacccaggaagacctcgtgggtttcccaggaagacagagactgggagccattcttcccggcggcagcggctctcggcctgtccttgtccccacacaagcccccactgctgcgccgtccctcctgcgccacctgacagatgtggcggtgagaaaacgatggggcagggaaacgttcgccattcggtgccaataaaggccgcctttatcccgaccgtaaatggtttctgtgtggagtgagactgtgcctgtcccgggcctaaccccccaagggccagagaggcgaaattagatccgtggggagagattttacaacgtatgggctggtggcaagtggcggcaaaccgtccccacggggccacaacggggcattgttcacggcctcacctgggctgtctccagcaccccaggatttacgaggactcggcccagagcctcgatgccggccgctccgggcagacctgggggggtggcgggggggaggccctgtgaagaggaggacagtgctgggggctgggccacggagaggccgggcagcgctggccccagcccccagctcccagctccccagagacagccagccaggaacgggccccaacctgcctgcagaccaagcggtcacatcgcgaatgagtcctcatgctgtgcgtcccccactgggcagccagaggtgtgcctgacggggccaggaggctgaagacaacctttccttgggctctcagcgatgccagctccagctgctgtgtcatcaaggtcgggctgggctggcctcttcctagcagaccttccaaaaccccgcagactcccgtggctgtaccagccctgcacctcctggccacctgcccctgcgtacccaccacccttgctccggagctcgagggccctttccccactagcatctgaccgccttcttgtatgtcttgaaggttctttgccttctctgtgcagcagggccctttacagtgtagtctggcccctcctcctcccccgggccccgtacttcctccattctgccccttctcaggtgtgcgggacctttttacagccccctgcttgtgcctgcactccctcccctgggagcctgcctcaccctgaccacatggccttcggcacccagcttgagtgtcccatcctgtgaagccagccggttcccccaggcacaggggatacctcttccctttgggcacctgccctgcgtactgtgccagcctccaggttggcccaggcagcccaggctgctcagggtcatggccaacccagggcaccgcggtgggcagatgcagcccctttccaggccaagttcagccctctcaccctcacaggggacccaattgcacagccatccacagcggccttgggacaatactgagtcttgagttaggggtgtctctcctcaaccctgagagcagccccttttcccaccctcagtgcccccacttgtggcccaggcccaagcaagcctgcatggtgcaaacccacatggcagcccagggcccaggaatggctgtccaagaggaaggggctggaccgtccacgccctgggttcccaaccacccttcccctcctggtcacctttcggcttggcatcaggagggcttgaagaagactcctcagccccacctgcagacctagctagttgccaaccacctggggttgtgcccagtcctcagaactcacctgcccatggtcatctgagccgttcccacaaaagccttccttgggatcctcagccgtctggggggcctccttactggggtcacctcaaaaacagctgtagaggggtttgcggcagcagcagcagacgtttttaaactaattcattggtgatggcaaaattatgccgagttccctgaaaaaaaaaaaaaatacccactctatttcctcattaacataattgcaaacagaacgaattttcttgatttcgtgtaaacaacagcttgaaatagtttataatccttgcaggtatcaaattaagttcttacttatggtctggaaattaattacccttgcagcgagacaaatgtgaaaactgtgtatttttgacaagaaaatgaagcagctattggggaaaatgtaacttaatcgtagcagagaaaattgtttataaattggtcgcgttgtttgaactctcgcctctgtggctcagggctgggttgatctatgcatgtacatttgcctaatttgggacaggggaaggggctggaggagcaggaacaggacgggggaaggagaggaagaagaggaaggagagcagagggtacccgcgtgaagggtacccacgaggaaggggacattagacaagaatgcaggtggtcaggcggcacttacctggcaggtgaaatctaaacaggcaccttcaaaggaggacaaagcagctcccttgggtaactaggaagaggacaccagctggcgaggggcaaagcaaaggacctgggacaggcacgtgcctggaacagaaagggagccagtgtgtctgcatcaaagtgagtgagagagcagcgcaggagagaaactctcagaggcaggcaggggccggaccacgggggcggtggtgctcagattccatgtggctgtccatccatggtgggccaggaggtcactgttgtggtgacaaccagcgctctttggaatggactgaagtggaatgtgatgtttaacttctgtagctgtaagttcgagtgtgtgtgtgtgtgtgtgtgtgtgtggtgtggtgtgtagcatgcttgcatgcctggacacagtgtgtgttggcatgtgtggtgtggtgtgtttgtatgtgagggcagtgtgtgtgttttgttgtatgtggtgtgtcttctacgtgtgagtgtggtgtgtgttgtgtctgcatgtatcgtgtgtgtggtgtttgtgtgtgtgagtgtggtgtgtatatgttgtatccaagacagccaaagggaagttccaaggggctcgtgcactcggtgtccagggagcagcatctgtgctgtctgcaggtagtcaccgttctccatcctgttacagcaaataccctcctctgcatttttcccttgtgtttgatttgccaggagcagaatttctgggttggaatcgggaacatttagaggagcttctcagtagagttgtacagagtggaaatgagtcggcaggctgcatggggggttccagtcacagcacagagggtgtgtgttttcggtgcctgccctcctgagctccaagtgtcccacgcctgcccgtcagtcctcatgtctacctgggcgaccccattttgaagatgcagaactgaggtccggagaggcctgggtagctgcctaagggtggggtagaagcatggtgccggctcagccaccctcaggtctccaggctcccagccaagggctccgataaggctgctgggacctgggggctgtgagcagatgcagacgtccacagttcccagggctctgaccctgccctgtctccagagcccacagccccacccaaaaggccaggaggtcacagatctgggatcctttcccgccaccttcaagaagggaataaagccacttcctgctccatcccagtggcctgagggtgtgggagggacagaggcctcccccagcagggtaaccctgcaaagagggggctgacagccgttcctgcttcctactgggcagaggctatagaggaggtttccagcgcctcagtgcaggcagctgagcccagacccctgggctgtccttggaaccactcccagcccctgccagctttgtagcctctttcttccccaccccacttgcctcacctcggcccaaacctgggtactcccagctgcagccctccccactttgcctgctctgaggctgtgtagggcccagggagtgggggaaggggcctgggtcccgcacaggattgaggtggcgtttacagaaccgggggccagagcagctgtggccgtgaaggttccaagcttgaagtggaaagggttttgatgccaaggtccaacgcccagcttatcattgtgtaaatctgggcaccacacatagcctctctgtgactcagtttcttcaaccctaaaatggggacatgcttgcgggggttcaggagatccccattgagcacggagaagagcaggtgctgtccactcagtgaccatctgccgtcaccattccccaagttatgggagaattcagctatggtaagagcagagaacaggatggcgctggggcaggaggagaaggtgtggctggcaggcactcatgaggacagggtctcagagcccattctagagaatgttccagaaggcatggggaggcaggagaccaggtgtgcccagggtggggacactggtaatgggaggtgccagagctggtgacagaagcaatggaggtgggtgcagggctggggcagggccaggcagtggctcctggggtgctggtggcccagacagactagagatggtggaagggtagagtgcagtcaggtttggagtgggtccactctttgcacagaccagccccctagaggctccccagttccaacaggatactgggctccatggctgtcacgtggagctgtctgtaggtggactggcttctgacccactcggggtgccggaccctgccctgtgcctgtaggggcgggcactcacctgcccttgcagtcccctctagctctccagcttcctgctggccagtcgtatcagctggctcagcagcaaaggcttcagaccaggggacttaggtgagagaaatttattcctcacagttctggaggctggaagtccgagagcaaggttgtggaagggtcggctcctggtgagggccctcttcctggctcataggctgggcccttcctctgtgcttacacatccctggtgctgccgccttctcttgcaaagacgtgagtcctatgggaccaaggccctgccttcacagtctcctttaatatttatcacctcctaaaggcctcgtctccaaacacagtcacattggggattagggcttcaacatgtgaatttaggagggcacagttcagttcataacacaagtcctccgtcgggccactggagcctggggagatgcccccactgcatgctgaagggcaggaagtgagggaggggagagcttgttgcgggggtgtccttgcctctcagggccacgcccactgcctgcgccagggaagaccagcagtgacagggatggtgtccccgcagcccctgggttaacactgcctcctcccttgctcttcttggcagcacagacctcagaaggctggagccccgggcaggcccaagcacagaaaaagccagagcagggtctggggtctttgcctccagtagggtgttgggggagctttgtattctctgtggctggaggcgatttcgccagctgcggagcggggcgcggtgggcacattcacccagactcacaccggcccaggacgtgctgagggtgttggggcccatccaccctccactccgcttttccaggggtcaggcagggggaggccacagggtgcccagcttcagccacacccgccttctgacaatgcgaagcccacctggtctgtgagctgtcgcctctgtcctcacagtgacagagctggctttgagggcagcaggacaggggtttagccctggctccggccctgtcgccagccggcagcactggggccaccagcacagcctcccagccctcaccagtattaactgtcatcccaagggggccactgaggcagcggggagcctgccctggaatgtgccatcctcgggcgcaggcagcccttcatgggcctgcccaatgtctattaattaagccccctggagactccaggagctgggggccttggctcagtgccctctcataaagttctgctctctggggaccgtggctctggcagccaccctgcctctcaggagccagcctagtgcctcctgggtccccagggtatagggccagaccccaaggcttagtggcaagaggcccagcagatgctcattctcccggtcaaacccctagatgacactcactggggaacagaggggctgggtccaggaaggaggcgtttgcagggcggggttgtctcctgaagactgcgagctagaggggagaagccactgcatgctcccagcccttcacctcacagtcccggaatggggaagctgagtggccacccacccttggacgttccctgagcatttccccactcagagtccagaagcccccagccccagcagaccctacagcgctacctgcaaaggccagaccggccagccagggaggtgggctagacagtgccctggccaccacagggcaacccctcagctccacttcgccacccagaggagctggccctggccactctctcagagcaggaggtgacatgaagggaaggtggcaggatgggagtgcccatcagccggaaggccacgggagtcaatggtgaggggcagagtgagcaaggggctcagggtagcccagaaaacccagccgggcccccccccccacgggcacccaggaaccgccctggctttgctggaggacctgccatggctttgccagaagaccctgggactgtctggagcatcctcccaaggactcgcccctagtcaggaaaaaatagggccccggagtcagcaagggcttcctgggggcccaggtcagcctggacggtggcaggactcggcgaggtggggatggggcttggaggatgtggcagagttcccatggtgtgtgtagaatgatattccctccagaccacggtgccttctgggctctggagaatgcacctgtgttcccaggagctttaggggtacccaggtggtgtgatggggagcaggagccagttgttcccaaacctcgccctttctccctgcaggcactggcagagctgggggtgatggggcttcagtggagcccgccaggactggggacacaagcctaggcctgtaccgtctgcagccccatctccaggtcccggcctgccccagcctgcccacccccagcctgtcccccaaatgcccagggctgtggcctgcccagacttgccagggagctcctgtgcccttctttctcctggcctctcagaagcactccctgatcctctccccacttccctcctcccctctcatccccacctcgggcccaccagctcccaccctgctatgcccatggaccccagggtcagcttttatgcacactcaggtactcaggacaccccacaccagccattggatggggccgcctctgccacctgctccagccacctggcagatcccactcggctcacacagagccttggccagcatgtggccgcagccccaactgcagcggaaggtatcggggagtcgaaggcagaggggaaaggacgggatggcgggtgaaccacacggggaggagcctggagctccttctgcattttcttaggaagtgctgcagggacccactggattctctacagcgcccagtagcccattagaagatacagaggcagcaatattcacagggccagaaacaactgcagttcacccatgctgtgcaccagctcccacaccacccatgccacgtgcctgctctccaccgagccctgcaaatgcctcggcacatcagcaagcacaggcctcctgcaacgtcattttgcagaagggaaactgaggcacaaaatactccactgccaccaagtcacccaactcagtggtagagctgagatctgaatgcaggccgcctggtcaagcccatctgtgaactagaaccccgccgccctgggcagaaacaaggctgtattgacggtgctgggagagatgaggggagggagggatggaggccggaacagagccggctgctcccctcagagggctgggtgtcaccccagttttgtctgtgggtttgtggagagcatcactgaaatttctaacttgacagagtggttccagggctcatatagaagcataaagaggtgaaaatagctgatatttctaaaggcaaaagctaacgagtggggttgcactgcccagcgtgaagctgcagccaccattctccacactctcctggcccttggcacaggatgagccttgcagacggaggcgacaccaaggccttcccctgcgcccacacccagcgtctggagctgctggaaatatgtgtccccaccatgaaactgatgctgctgttcatcccattttgtgtatgaggagactgaggcacgggcccacagttgccagctgggatttgtcccaggccacctggctcaggtcaccggaacatgtgacaacacatgtggtcagggagaggcagcaccacagtcagatacaatgctgacagggacggcagagttccacaggcaatgaggcccccggggtaaaaatgaagcagtttgaaaacaaaaccaggaagagtgtctggccatcccgggcctgagtttctgcccatgggcagctgccggacaagccctctggtgtgtcagcgggtcaggctgagccagacgtggagatgaggctgagagccggaagcaagggctttgtctctagaagacgcaggggtggttcacaggccgctggggacccaggtcacagagcctttcccccagctccagcctggctggggagagcaaaggctgcagctgcacagggcccctccctgcctgcccaaagctgctaccagacagcaagctggggagaaaactgcagccgacgacggagagggacgacattttgcaagtgaaaactcaaatctatgagaaaagcactcgccccgcagtaggaaagcaggcaaagaactagaaagacaatttacaaaaggatctgaaggtcctcactgcactcatcctgtaaggtggacttggggcctcatctggccccgctgcctgtttttgtaaataaagttttaatagcacatagccacgcccaccggtggacacatcgtccctggctaaccttacaccaccttggcagagttgagtcgttgtaacagagatcgtgtgaccaacgaagccagaacgatttactctctggccctttagagaaaagcgtgctagcccttgctctaagagtttcagtgaagagacgcaagatgcagaaatgaacctaattgtgtggtcttccgtgctggggaagccgaggagaaatggaagtatgagccggttccctgctccagaaatcgctctgatgacacgtatcacggggattaaaaaacattcctccccccttgacctcataatcctccttccaggattctctccctaaagaacaaatcagagttatgcacaaacaagctaatcacagccttatttataatagtgagaaattggaaacagaccgcatgtgcagcatttgcgggatgttggttcttgttatgcacattagggacaattatgcagctttcagtcatccctcagtgacccaggaaaatgccccatgtacaaggttactggagacaaacatggtcccagtttctggggtgggaggtggtgcccaaaacatcaccttacagaaaatgcccggaaacgtgtctctggagggtggacttagagatatgtttttgaaacagattttttcatatttttcaaaatttctcccgtaagtggttcttacctccataacagaaaaagagtaaacaatcaatgtggagtgaggaagaagagaggggagggagagaggaagggagggaggtacgcagggaggcagcaaggggacttccctgctgaggacgctagcccctccgtaatttgtctgtccttcccagcctgcctggggccacatgggccactgtgcccagtgaagcctggcttccttgtctgtggtgccagccatgtgggagggtaggcgacccgccttgggctgtgtaacgcaggcttgcctcttccttaccccggttgtgccagtggctaggcaccaggtaacctgtctgtgctccccaccgagcagctgggccgtgtctgctttccgaggaggctgcaggtaacccttctctaacctgctcagcccccagctccatcttccacctgtcctgggggatccccattcattctctccgtgggcatcatcagaggctcagctgtaccagaccactgcccgggagtacgttcgggctcaggtttcccttgagggtggcccccacctgacccctccccgcccctctcttgtgccctgagagaatagcgtgcccccagagacagtaaaagcctggcttgcgtgctggctccggtgacacacaaaggcctctgcttctccactctcaggccagcccgagagggacggcaccaccgggacagcaccagcgggggcatggggaggggtgacaggttgggcggggtccctggggctggggcgtagcccctctctgcaggccccacagtctgtgaccgtgcagggagggtgctgggagtctcggctctttcggaaggcgccagtgtttccttgtcacagaatgaagtaaatgggacgatgaaggggcagtgtttaaatggctgctttagcccgtttggaagtctgctaattattctcttgaggaaagaaatgcaggttcattattataatgagctttgggcaaaatatttcatcgagcctgacaagccgcagcgacgcctcgaacgtggccggctctgaaaggcctcctattctgctggaagctaattggcccggggtcttcccagccctgtgctgtttgtgtgctattttaattcgcttatgaaaagcccccgctttgatgtccgggaccagataaggccgggaggggaccctccatggagagcgggactgtgccgcccgcggtcgctgcactgggcctcctcgcccccccactccgggcccggggccagcgcgatgtcatgaggtaactgaacaaacagtcctgctgaaaaatatgcttttgtttcactaataaatccctcctcggaacactcccgggccgggccctcctcgggcccagcctaccaggccttcccgcccagtgcctccgcaacccgcgccaggacagccggcggtgggcacaggcgggcgaggggcacccccaccccctccagggccccccttccctcagcctcctccccacccacccgagctgcctgcctttcccgcactctcctccctgacttcctcccacctaccggcctcttccgacctctctctgcctctttcccccatcacgatactccagtggccaccttccctgcccaccatgcctcctggcccccaatccggtcaccaacttgaggctgcccctgacaagccctggctgcagcatgagggaagcagcggtagagaaggccaagtttgggcaccttgcacagcctcctggagcctcggtttccacatctgtaaggatgagacaggaacggtctctctgggggcagggccggtggtacctggagccctccccactgagcacctggcccagtgcccggcacgtggcaagtgaaggcggctgcttcccgcccctctcatggacaccactgtgggcaccacttgggcaccctgtgggcttattttccctgcccactgccaagcaccagaccaagatctgatgccatctgcccagggcattgagggtgaacccatccaggctggcccgccttccagccctcccccagcacccaccaagcccctgcgatatcccagtggaagataatggaggtgttacggggatgggctagaactcggtcctggcatcacagagctaccccggtcaaaaatataccatgtaattacagaccaggaaaattactgtgcaggagcaaagcagggcactgtgccggagaggaacaggggtggtcagggaagacctccgagggaggggcatttgaaaatagcattcagagttgctattaataggctctgatgcagaactgagcagagaagaaaacaaaagaggaccataatatctccacagagaactatcattaattttttaaatgggagtcctcaggtaggttggttgattgagtgattgattgattgataatcttggttctatttgaatttctagaaaattccaacagtacagaaaggtctgaaatgaaaggtaaataccttcatgaccatgccccctttccctaggataccccttgttatcctagaaatacccatccttagtgtgaggagagcagcattccagacgcttctctgtatgttgcatagaaaaaggatggttagatacatgggcagattaatggatggacagattgttgtatggaggattaggggagggataaatggatggatggatgaacacatggacaatgggtgggtagatgggtgaatagatgggtggacagatggaaggatggatggatatatggatgcatggagagacagagaaatagatgcagagatggagggagggagggaaggagggatggataaatggaggaatggaggaatggatggatggaggggtgggtaggtgggtgggtaggtgggtggccagacaatggatgtgtgagtgagtagatgaatgagtgggcagacagacagacacaccatcagaagcaaatataaatatggaatcaagggatgcctgcagcttttgaattgttgatttttttctttttttaagaagaaaccaaagtaaaacagaaggaattgctgaattcagataaatgtttcttcaccaaaagagaaattcatttctaaatgtcactttcaggttaaggaaaataaaatgtgggacgctggactcatcgtgggtttttgcggtcttctctcagctttgtgtggtagccagcgacgctgcaaccccgcccccgcagcctcctggtgcagcacgtgttcatttatgggttgttgttaccgtggcattggtccaggtttgtgatacttgtgcacagcttgggggctctgcttccctctgtttgttcgtcttggtgctgtgtatgaaggtggcaacagactccccatagtcctctcaccacagacacctcttctcagttcttcgtttccagttggactcatctcctgactggttgggtttctgcctcggtcgctgactccagagggccccacggctcatgcctgcttccctgctatcctcctgtgcactgttggcctttatcatctccaccacgtgctcaacactccaggccagagcccttctctcaaatcccctttggttctagccatgtttccctgagctcttccctctctgtctctaattgatgtgttttcctcccaaaccctccttccttgcataattctgcaactgaccttttttctggccatcctagattgggtttactgttccctggtactcagacctgcttaatgctcatttcttcagttttctggggaagcctcaggggccttactgataagaactgtgtggaaggtaagcattcaaagttcttacatggtgaaaatatcttcattcaaccatggtgccctattgatagtttaagtgggtatagaatttggagctgaatgtaattttccttcagaattttgaagacctcgtcctatggttttctagcatccagacttactattcagaagtcttatacttgctttagtctcatacttttgtaagtggcctttcttttcttcctggaaatgtttagtatctaccatctggactcaggggtttcaatttcccagagaagttccctgtggatggctttgttcattgactgttctgggcacttggtgggctctttggaaactttagtccttgagctctggaaaggtctctgtatgatttctcatcatggaggccaccatctctgttctctctttctgaaattccttttaagtcagactgaagacatttttaatgacactttgatgtctcaactttcttccccttttttatggcattatattcttaactttatctcttcagagttctaggaaatgtttttagcagtcctgtttttaatatcccagagcacacgcttgctctctgaccgtggtcatggcattccgccctcatttgatgggcacgacagctcctaggatctttctggagactccagatacatcttatatcttaagttctgcttaattccttgatcttctgtttatgtttggccagccaggcccctctctctcatgttctgaatgtttttcaatgtttgctcgggatctgtgcatggatgggcctgctggcatttaggatgtgttgacaatgactgggggaggtgcctgtcattacactgaggaaccccatatgttagagctctgaggctgctgcatctgagagcttgggctcgaggtacagggctggcagccgggagtcccacctgtaggacgctctgctgtggcagagggacaggacatggacctcatgctcagccccttcccatcgtcttggtgctgtgggcctgatgtgtgcctccacaaggactcccgccttcccagcatggcattcagagcagcagatggcttagactcacccccgcccagtcttggcacccttacagccccggcgagacccgggtgggcgtggaccctagcgtcccttcaccctcaggctgtgcacctccgcagtgccgtgtcctgtctggagcctgtcacacccctgtacagctaccccaatccaaatggagcctcccccaggaagcccctggtgggaatccgtccccacgacccctgtccggcttccctggctcattgtccctgttacaacccagatttcccttatcgcaactggtcctagcctgtgacctcctggggtggggaatcatctctgcaaacacagctcctccacccttatcagtgctttgtgaaggcagcagaacgttctcctgagccagtgtctgggtcacttgagcaatggctgccaagtccatgggcctgcacgcatgaggctgtgcctgtgtctgtgccgctggagaccttcttgaggttcactgccctaaaggccgcatgaggggacagaaggtgaacacagggccctgcttggtctgacaagcccaggcggggcccttgccgagcgtcagggtggctggcagccaccttctgtgatcgtcctccttctgggctgcggtctagggctgcacattcaggatggggatgtcccagtgggcgcgcagcacaagggtcagcagacccctggctggaggaggtcagtgtggggggctgcgtgggagacggtgcagcagtgggcctgggagctgagcaacggtggctgggatgggtggagaccaccaaagaggaggggccggcgaaagccaggcttcctgcaggctcaagcctggaaaacggtgctcagtgagcaacacattcccgttctacagtttcctgagctcccgagtgcccgccgcaggatgacagtgggacagtcctcacaggggcatgctcaggccctgccccaggcagaccccacgccctggcacgcagccccaccggctgtgccgcctctcgttcctgtcctcctggcaccgccggccacccctcagcccagccctcatggttctctaagccgccgcctcctcaggaagcctcccaggcacccatgctccctgcactgacccccagaccccagctttggccatgcactcccagacggctggtccccacacaaactttctgtttcaaggaacagaaacacccctgaaacttgtctaagaaggaaatgtgtcaactcacatacatgaaaagcctgagtccctcctcaaagtcctcccctccctccttctctctccttccttctttcccccttccctccttccctccctctctgcttccttctctccttcctccctgagacctgggacgccgaggagggttccgttccctcccccaccctggcagtgctcgggggctccagttgaaaatgatgggggacacatttgcatcacagcctgcccggccggctctgtggcccctgatcttcctactgcagcctctgccggggccggaagggcatttccgggaggcgggaacagcatgtatgaaggcagagctccttcccggagaggagggccagccccgtccccaggggctcccggctttctctctccccctacattcctgtctccatgcagcagccagagggactttaaaacataaaccagaccacagcactgcctgctcaagccccccatggcctccctcttccctaggaagcaatccaggcacccttccatggccgtgggccccacgcccccgaggccccacgcccccggggccccatgcctgcccttgcaacatccccttcctgactccacccagcctcctgggggcttccgcctcaaggcctctgtgcctgtgtgagtggcaccctggggttgtgccatggccagccctcaaaccatctgaagtctgctgttggcacctgccctctcctggctgcaaagctgccccctcatggcctcaggtctctgccccagcctccaatccctcattactgccccagcctgtgcctgtgcctggaggctgtggcctggctctccagctggaacagaagctctgagaagacagagctggccagcaccatctctcctgtgagaaccctgtgcctagaacggagcctggtacagaggaagaacccgacagactgtgagccctgtcttcctcttggcaccatgagtcacctgtcaaactgaggggctggcagagctggagggagttccatcccagccccaaggtgcctggagtagcttatggaggtcactgatggcctcaggatgccagcaggccctctgatgcccagggctcattcaagggcatctgccctgtgtcctcatgcacctccattcagggaacctgggctccccactctcacaggggtggagacctgcacctctttttcacccccaaacccgcctgcccgtcagtgcttagagcaaatgcccctcccccgccatcttttcatgactctcccccttcctcaaccctgcgcctggtcaccaagtcctgacaacacctccagcccctgtctctatggtcccctccttgatctggagccattcagccacatggagtatgtcctctgtcgagggggcagggactcaaaggatgagagaaggaacagaggggaggaccaacatctcggctgatcctggtctatttttagtcggtggtgggctgtcactccggaggccagtgactgcgtcatcagtgccttttgatcttgttgccgcaagatacacaggaggcagctgctcactgcttgtggaaagaatgagggcgggcacataggcctggggtgtggggagcattaatgagtgtgagtgagtggcggatgagtaggtagatggacggggagctgcagggagggagggttgcagaaagggatgcgtggaaggatggttgatggatggatggttagatggatgaagagatagatgaatggataaagaggtgaaaggatgaatagagagatggagggaaggagggctgaataaagaaatggatggatggatggatgatggatggatgggtgtgtgggtatgtggatggagagatggatgaatggttaaagaggtggatggatgaatggagagatggagggaaggagggatgaataaagggatgggtggataatggatggatgaatgggtaggtgggtgaatggatggatagatggttgagtgggggggtagatggagagatgcatgaatggatagaggtggatggataaatgcagagatagagggaaggagggctgaataaaggatggatggatggtgggatggatggatggatggatggatagatggatggatggatcgatgggtgtgtgggtgggtggagagatggatgaatggataaagaggtggatagataaatggagggaaggagagctgaataaaaggatggtgggtgggtggatggatggatggggaaatgaagagatgggtgggtggatggatggatgagtggtgaatgaatggatggatggggagatggagggaagggaaggctggataaagagacggctgggtgggtgagctgatggagaaatgatggataggtggatgggtagattgagaaatgatggataggtggatgggtagatggatggaaggagacaaggaaggaaggaaggaaggaaggaaggaaggaagggtggaggtaagggagggagggagagggagcaagcaggcttggatgagtagctaaagcacctcaagcaagggtgtctcccttagaaatacatgtgcctccaagtcctcgaggctggcatcccctcctgctccatctgcctctgcctgctgggcagaccagtctgctgtcctaccaaggcctaggtcttgactctggactcttccatgctcatcagagggtactgttggagcttcctggtcaggctgacccagctgcctctggagcctggcctgggatctggagagaaagcacctgtgcagacggccccagcgctatgcccttctgaggcctgctctgcacacacagctttcctcatcccggcctcatgcactgtgggcaggagttgtcctagcaaccatcatccaggcacctgctgcgtgctgagcaccatgctgggtgcttcctgtgctctcaacagccttatgtggtcagtaccaatccctccccaaattacccccatgctcagggtgtcactgagggtcccaagtctggggtggccaggtcacagcttgaacctgggcagcctttattctctaggggccttgggggtgtctaggctgccaccacagcatccacactccccactagagcccacataggtcttatgggtgccacagcagggaccccactggacctctgtgctttctggtggggggcttgtcagggagctcatgggcacctctgggttctaagaagctatgctgaggcccacagggtagttctgagttcgggggaccctctcctggccctgtggggtcggaggaggtcctgggagcccacctcctgtagatccaaacacctgatctcagctcaggatcgccactccagtgccccatcccagagcctttgagagtggggacagggtgtcctgttgtagttgccaagcccaagaaagatgaggcacccaggatgcctgacagtagagttgcaggggggcaggcaccatcgcccccagccccaggctgaccccagtccctccctatgcaggcagaggggcaattggaagaggctggagactattcaggagagggtgggagcagacacgggagtaggatgggggccctggaggtactgggtggagctgcccccagcccttcctgctggcctccccagagctccaggctctgaggccacaccctcacccaaggcaagttgctcagggggtctccaggctgtatctaacagctgcctgtgccgaaaaattaagcaccgctgagtcgccgcacacctgtcagggtggaggggacttgggggaccagccagctggatatgttcccttgcaggcgggcagggctctggggagtccaagtgtgcgcacagtcctgggtgagggctccgttagatgaatgtggacggctggcggccggggcttgggagatcaagaagtccctgaggaagaggacagtagccaggggcaagacctcacacgcctctgcccatcctgggaaactcaccatggcattgtggttgaagggtcagtggccaccagagagttcctgctgcagtgtggaaaagacaaacaggcgagtgaagtggataaagattcaggttgtgggagggagacttgaagggcaagttggccaagactaaaaagtggagtcaagctcagtgctggtgacgatgttggggagaggggcctccagcgccgtgggggagaatttcaagagccttttgtgaaaatggtcaggctgctgaaagtgagaccacactcaccctgtggtccagtgatctccttctgagaatccgccctggagcagtaacacccttgggactgagaatggcttctgggttgtgcgtcatcgctgtccaggagtggtgaaaagctggactctgactgcctgtcatccagagggagcaaacagccaccctgtggtgaagccacaccacatatgatgaggggctggaggcagcagaaagggggctataggaccctttgactcaagggctaaccatgatgtttcattaagggagaaatgcacttgctgctcctggaacattctggctcactcccgcctcaggcccactgccctggctggactccctgcactgaacgctcctcccagctcatgctttccaaagtcccctgctcaggaggccttccctgagcccctgccccctccatttcagacatctccatctgatgtctgagccctgaacagacacaggtgtctgttcagggctcctcaaatgcacaaatacatgtctgtgaccacagcccaacccctgggcagtggctgcccctctgcctctggaggtcccctccaaaaccttggtccctgtccgcagagggtgtcagggcttgaggtcaacagggaggtctcagggcaacagagcccagtggcactcctgaccccaggagacagagggaacccaccctcaccctagtccacatgcccgacccatgacccaggcctgtggcgccagcctgcacccggctctgctccacaggccaactctgcgcacgctcctttcaagggttaacggtgcaagctcctcacggcaccagtgcgcttgcctttgacatgaaaatgtttttgcagcaggctcggatgccagcatttttgtggttgcagtcagatgtttttaactacgttggacagaacccacggcggccctttccgtggcttcagccagtttctgagcgctaccttgaacccctgttgcaccccaggaggagaatcacaccagtgccccctgacccccagccttgtgcagacactgatacccttaggatgaagctgaccccagtcgtggcagccaccccagcagtcagggaaggacctgctggggcatttcagatcctgagcagcatgtaccctgtgaaagaacaggttccccaattttggttcatggtacctgagatgacggcttcagatgatgtccctggccagggaggtggaggacgctgggcagagccctgggcattaactcagggccatcacagaggtggtgagagctaccccgggtctggggactgttagcacagacctgagccgaggcccccttctcacaggggcctacccacttacgacccacctcctctcctccatggcaaaggtgatacattagactcaaagagacatgatatccccttgggctgcaacttaaattccaaggagagatcctgaatccagagtcacatgtatgttagaaacctctggcactctcccctccccagccagcacctaccagctttgcgcaaatgctccacatttgcattttaaaagccctgagaaggcctgcagtgaaaaaaactaacttcgtataacccaactattcccaaactctatctacaaaatatttttctcttttatcattaaagaatatgcattaacacctaaaacccactatcctggcaaaaaagtggcaggattgtctgaaaaacacatggccagccaccctgcaccctgagttccacaacatctaaacccagtgtctgctggccctcagagtgggagcgcgtgccccaacttccgagccctaggaaagggtcttgtctgctcttcccctcagtgtcaggtgacccaagagtgtgggggtcaggaatggcgtccttgtgcccttgtcacccactcctgtgggtacacagcttccctttctgcaaagtcacaccccaagccctggcttgagcatgtacacaggctgcagcccgtgttcctggagccaccgtcccaggtgtggctaaggcccccacagagtgtgcatcctaaggtggttcagaggtcctcagaaagtgccaagaggccttcctcagaggaagagcaagggtaggtgcctctggcatgagccagatgatgggagctgtcacaggactttgccacccggggtgaggggcctagaaacccctctccaccagatgccttacaccccccatccccacacgcacacagcttggaggctggaagcccccggaatgcggcccaccctgtctccagttgttccctaccagcccagctgctggtccctaaccgggcccacctgttgggtccttagcaccagctgcccagagcccccagcccctaccctagtctgatgacccaggcctttccccctgcccaggctagccttgtgctcagctgccagcacagcccccaccacacactccccaacaggtgtctccacaactgccaggagacagctcagcttagctgctcttcccccaacccccaggcccagcagaatcacatctaggagagtgggccacatgcctcttggaaggcaggtggcacaagaggttcatcccaccctccagcattacccagccccacaggacccacatcctgctcccagctccagcctgaaaggagctagtcctctccagcccctttgaaaagaccagctggacattctccagggagattctgccctacaggattagggagtaccctcacctggcctttgttcattggttcattcattcattcattcattcaacaagtatttgccaagcatccctatgctccaggcatcagtggtaggccagacagccaaagtccctcctcccaagggctgtggcccactaggaggacagacaatgacagagcattgtgtgctctatgcctgcccatgtgctgaggaaggagcaggagaggaagacaaaccagagtttaagtgaggagtgggcaaggcttttatgaggcccagcccaccctcccctgggcaagctggggatttgggaatgggagacatccaacacgtgtcagcccatacatgagggtagaagtccagttgaaaacacacctgaaacagcagggtccaaacaccaggtgccgagagccttcctgacattgaaccttccttgaattcctgaggtaaaccttatgtgatcttgactcaagtccagctgctgatgcatttttaggttttagcatctgtgttcatacctgatttgggcctagaattttcttgtgtttgcttgagcagttatggtgcctggggttttaccttgtcagataagttgagcaacctccccttttggctagtgctctgggatggatgggatggatgtcgtctgcttttttaggtaattatagaaatcacccccaaaaactagactggaaaccttttagaggagggtaggtaactggcatttgtgtctccccaatgggtttatgtttcttaggattttctaccacataagccacttttggtattttttgccttgaaacttatccatcatattgtgttttcaattttattgatatgaaagtatatatcataatcacttacaattattcaattccctcggtagcagtagtattcattcctaattcttatttgttactttatttgcttaaggtttatctactttactggctcttcaaacaacctgcatttggttttattggtcaattctttttcataaaatatttttctattttgctaatatcttcctttgactttgttcattcttttctttgtatttgttttggtgttctttttctagcttcttgagttgaaagcttagcacatttattttcaatcttttttattttctaaaattgccatcgatacttctccaaataccctataggaagcatcccacactcttggcatgtaatcagctccttgtaaatccatcctaagattttctctctgccttattttctctttaatcaaagagttatttagaagggtactttttaaacttcaagatgtatccatctgttgctatttttattaataattttctattttacatcaaggtacagatttttagaaatttatggagttttcctttggtgcctaataggatcatttctgtgacctttttgtatatgtgtggaggcggtggagtcttttctgttaattgtgttaaacttgttagtggagttctgcgactcctccacctcctgacttaccttgctgtttgtttgtttgtttgtttgtttgttagtttcacccactgtggtttgtcagtttctgagagacaggcactaggatggccaataatattgtggatttcttgatgtgttggttttgttcatttgtttttcctgccccatcctctgggcccttaaagcctgggcacatgtgtcctctccttacgtctggggaaatggtctccattgagggtttgagtctgcgtggcttccgcctcccttccctcctgctagagcccctctggaagctgctggaagccatgtcctccacatcccctggctcttccttcatcccatactttcttctccctgacagagctgtcaaggggagtgcctacaccccacctccattgctgctcaccctcccctggcccgtgctgggcctcggccatctctggggctgtttctaggcccatctaagcgaggggttccttaacctgccttgcttttgcagctgcctgaacctccctctaaggacatcagcactcttcggaggccaggtccggcctgctctgctgccttggtgggaagctttcgtccctgcagggtggggtgggtctgtcaagtgttcggtggcccctggctggtgctgtagcaacacgggtgtcagagggcggacaccgaagcctggtgctctgtgcgagtcccgtttcctcgcctctcagctgtgtgactccaggtgcagaggccccgcgtggggcaggagcactgcaagcgagaggatgggaaggtggccgtgggcctggcaagggttggggaatatggtgagaatggtgcccatggggtcacgccagccacacacactttctcgagaagtttcaagtggagccacagggccattgtgtgtcctgaatcattgctctggctgagggagtctggggacccatgagggccagatggatgggctcagatggagtgggaggccattgggaagtggctggtaaaaagcctcatgagggcagagccccactgaccccacacagttacccatggtgtccccttccccacgtggtaattctggactgttcacagtggcttccaaggcctttgggatgggccttgcgtgctgcccttctgctggaaaccctcccagccatttgaggtcctgccctctgctcaccttgttccctgtgcccatgacatctccccaccttttcctggctgctatgtactggtcctataggggttccttaaagggtgcatcttccaagccactcctgttgccctcctctgcagccacatccctgctctgcacacccccaccccagcaagtgtgtgtgagctctgtagtcgtgtcatggccccagtgatgtcctcattctatccctgtcccttcatggcagagtggactttgcagggtgactaagtgaaggatccagagatggggagatgatcctgggttatccaggggccccgaatgtgatcacaagggtccttctaagagggaggcaggagggtcagtcagcggagaagacagggggatggaagcagagctcagagaggctgaaggtgctgtgctgctggctttgaagacggaggaggggccacagcccaggaacgcaggcagcttctagaaaaccggagaaggtgaggaatgaatcagccctagagcctccagcaggtatcagccctgctgacaccttgttagcccggtgagactcctgacctccagtgctgcaagatgtcacacacgtgttgcgctatgcttgtggtaacatggcaccacagtgcaggatgctgacacaagcaccagcacagcgccaggccctggggtatagtgtggataagatggactggaccctaccctcctagggatgtccctctaggaggtggaggtggggaaatggggacagatattaggccattatggcagaatgcaagtgtttagttagaactgtgctaagtgcgtaaagagagctaaaggctacataataagttgtgagcctacctagggtattagcagaggtgtcccaaggaagctccctgtgagccgaaccccaaaggatgggtggaaattagcttaactaagtggagaggtgggatagtcatgggccaaggccccaaggcaggaaggaataggcctggtctgtgggtctgagaggatggagagggctgaacacgggccaaaggagaaagttagggagggaaggtggagtccttggcaggggctcagctcagaacagggggagccccaaaggatgtgaggcaagggagcaatgaacaaatctcaccattgtaagatctgaaattcagaacggtggcataggccagagtaggacattgtgaaaaagaaacaattagagaagcagaaagagtgcttggaaatgtcaattatgctgctgaattaaaaaaaaaaaaatcagtaaaagatggaagtaaatctccctgaaagtggaatgaagactgaaagacagaaaatcagaacacccaagaaacatgcagactcaatccaaggacatccaatatcctgctattggaagttccagaaagggagatgagaggaaatagagactaaagaaagggcccactgagaacctctagcagaaaagagcagccactgtgtcatcatgcccttcaggaacagcagagataaagacaacattctagaatcttctcaaagaagtaacaggtgattttccaaacatgggcctctgaacagatcagtctttggtagagaaaatttatgaagagagatgccttcaaaattgtgaaggaaaataaaattctatacctagccaaagtatctatcaagggtgaggatacagtaaagacattttcagatactcaagaacttataaaatttttccaagtcactgcaggaaaaaagtatagaatttgctttctatcccttttcttagaaggttctggagaatgcactccagcaaaacgtgggaggaaaccagggaaaaggaaggcaccaacaacaaggaggcagaagaccctacacagacagaacagggaggtccaagcccagcagctggctcagggctacaggcctccagcccaggcagcccaggcaggagcagaggacaggatactcctgaagaggccacccaggaagagaaaataggtgggactgggaagaaaatctgcaacggagcttccaaaacagcggaggatctccctgagggaggtgttgttagagaagagagcagagaagcaggagaacccagaaaggaaatgtgagcacagtataccccctggctctgtgggggacccaggcagtgggcatagatttcatcaaaacaatggggaagctgtgctggacagttagagggtggacaaagccgagggtggggtgagagcttaagcctcaccttcatacaaggaagattctagtagctaagattgacaagtcgagaaaccatgtggccagcatgtcaccaaaagctgataagaggaccagtgatgggcttcccgggagtggagctgggcatgcacactaaggcctggaggcttgtgcttatccatcatatagcaggcctgccctttccacagcacaaacaccttgacacacaccgtcacacacacccatattcgacacacacattcacacaaacacacccagacacatgcatgcacatggataactaactcttccagcaagagccaccccctggctgaagtgtgaggctgtccatggaggggccagagtagaggggaggtgggtgaggaggctacgcagaggccctgggaggagggaggctaggcccaggggtggaaagaagacagatacgagaggggatttggagacacaatccccagacttggggacgagctggatatggtggtgaaggaggggagtcttcaggaaagacccccaggttctggcttggccatatgttggaggctgaaacgattcatccagacaggagcagggaggaggacacgcagggcctgaaaggttctgaggtgtccacgtggaggtgtttgcccggcagtttaggctgcaaggctcagcagggagattggagctgaaaacagaggctgcaacatggaggtggtacctgaagaaggggtgtggatgaggttgcctggcaagagattgcagggagaggagagagtgagaatggggccactcaaggggtgaacagggccttgcagtacaggaagcagctgggggtggcgggaagaagacagtcaggagcttgggcatcctagaggcccccgggacagctttgaggaaggaacgtcccctgggttccacaccacagagccatagaattctgtacttggcctgtctcagtgccgtgccgcatccatcctgcccctggcaccggagggtacactgatcagggacacgagttcccctgccgggcacagagcaggttcccagtgagttctggggcctcagtgactgggcaaggacaggggcgtttggacaggggaggccgggtgtggatggaagctgtacgatggggcctgggccagggattgtgggccagctccgagctcagacattggtctgcacatgtggctggtgcaggaggcgcagtgtgctgggcctcagcctggacacggctgtcccatgcgcagagacagggtcacggtggaaagagagtccagagaacatgggaggtgccgtttccctgcggcgggactggggctggggcccggcttccccgaccctgctgtcgggcgtgtgccttcatagcccaggaagccagttcctggcagggtgggctctgcagccaggccgccagggtgcagacccagaccaatgggaggccaagggaggcccgcagcccagaccttccgagccctcagcctgctcagctcagtgtccttccagggaaatgggcgtttcctgtgggaaggtgccaggggccccgggtgctggaagagcaagcaccacgcgggggggtaggggcgccccagccctctactggccagtgtccctccagtcgtccagcccttgctgccaggggccccgcccatgtgcctggaatcacaccctggacgcttccttctttgggttagatgtcgtcgtcttcaacaaatattttctgaatgtctgctatgtactagactctgggaacacaggggaaagtatgtggacctgcccatgaggaagtcagtacagtggggccatgaacaataaacagacaattaattatccttcgcggagctgcgcgggggcagctctcccaaagcagtcagtcattcacacttcagtatgaatgagtctccgggtactttgctcagtaacggactggaccagcgcggcctccacgccagggactggggcaagggtggagtttggagtaaagagagaggcagggcaacccctttccacagacactttaccacctccccacattgacaagctggctccccagggccacccggagccccttcctcagatcctgtccccattggcatggtctcagcccctcctgccccagtaccctctccccgaggcctcgtcctccccgccatcctggaaacgattttgttgtctgcagagattatgtgtaactgcctgtgagttataagcctccacagcaagcagcctgttacctaaccaggcctggctcatgccaatgtcttgagtaattattggggggcgggggctgtccagcccgcagcagaacctctccgagggagtgctattgtttttcatgtcagctgcattttaaggctacatttcacgtcagctgtgacttggaaggaaagagggcccggcctttgaaaaatgaagaaattgagccggggttgggggcggggagggcaggttaacccttcgggctccagtattccccagcttcccagggtctcctggcagtaaccaggccagctgggggtcagaacccgcggccaggcccagcagccgcctcttggcagcgctgatggaaaccgccgtgcggttccgcgcagacagtcacggaaactcaggcagacccggcgttgggtgcgccaggccggtgtgggagcactttcccccgccccctcctgctgctgcttccccgaaggcctccccagcagacctgcagctgggcacccacagggtagaaatgccctggattggctgtggcacaagagggctggcccagcacacccagcccaccactgtgctcccagagggagaacagagaggggtgcagagggccagagaggcacggggctcccctgggcacccctcgtcttggggcccctgccctgcctccactcagaatcccactatgtgcttggagccatgctgggtgctggggagacacactaaccacttccccatatgctcacagccagagagacacacaggccagcagcctgtaaaccactgggtgtggggtgtctggtcctggagtgacaaggacagggaggaagaaagccaggcaggtggcccatgagccgtggagtaggtggggaaggggacatctccaaggaggtgacatcggagcagtcctctaaggagtttggagtcattttcagtcactcacaagccacaggagggcttcagcctgaagctcagaggtgatgtgcttagatgtcacagagccgggaggggaacaggctgggctgcagagaggaggccaggcacagtcacctcgtgttgctgtcccccaggtaggagataagggaccagagtcagggcaggtgggagaaggggaggttcttggttcagctgctgctgagacagtgaccctggggacagcccaaataagagagaactttgccacccgcagggtcccagagtagcagaagcttcagggctgatgtgtgcctggtgaatcagcctggccccagacctcctctctctgcttgctttcctgtccacaatccagtgcttctgtcctatggtccccagcggctgctcctgcattcaccatcacatctgcattccagcagcaggagggaggtaaaagacatgaaggacaggccccactcctgtaaaaccctacacagaagcggcccacgtcatccccctttctgtccacccgccggaatgtgacgcacgcctgagtcgctgcaagggcccctggggacggagtctctattccaggcaggcaaacactcagcttaattcagggttctgttgattaaaaaaaaaaagtggggtcgggggggcgggggagagcggctatggagacaagtggctgttttgccagagggaaaattccacatgtggcttggaggccagaccagaaggactcagataggagttgggcgcttgagggaggaaatgggggtacacttcagcggctcaggccagggtgtaagtagcaggtatgtggtggtactgttttccggaatgaagaggaaggggcgggcagaaggcagcgagagctttgtttggggtgtgtcgaattcaagatgcctctgagacatggaagtggtgaggtcaggggccgggaaccctatggtggtgttggccctgagtccaagccaggcaccaccgggcacatagaggtcttgaaagctcgaatgtggggaggccagcaacagagggaacactacctgcaaaggggcgagggcaggacaaaggctggcagcaccacacaggagccagcagggaaggggccacagccgggactcagaggaggcagccacgtgcagaaaggcacccatgggaacatggctcctgggagctggaggacctcagcaggcagggactagcacccaagaagaaaactctgagaagtcaggacaggagatggtgtcgtcagggggctgctggaaggtttggtgaccggagcagcaggtgccagagctgaaagcactggttaaacgtgatgggtaaacacatgtctatttcagcttctttgaatcccactaaggtgacagtaaaggcatgaaaaacatggaaacatgtaaatcaactagggtaaagtggtcaggagaaaagaggagaccaaaaatatgttgacaaaggtttggaagctgggaagcaggaggacagatggagactggcctaggagactggagagggtagacaccaagccctgcaggaagaagagccaccaagaatgaggcagttcccaacccaggaccctgacaggcaggtctcaccccagcccatgaagccagatgctactgattctcaagctcagctagagacaggttgagtctccagaaaagctgagcctgagaggttctgaacttggagccaccaggagcagttgtgggtggggcaggagctctcgtgatgaaaacaacagggattcagtaaatgcattcaagctaaaaaggaagacctcctcccccacttccctcatcaactcccagaatgcccggtggggcacaccattgttttcagaacaccagcaataaagcagacactccacatttccagagagaaaaagtaagtcacacacaagagaatagaaaatcaaaacggtatccaatttcttaacagcaattcagaaagctagcacatagtagagaaatgccttcaaacatctgagggaaaaaatgatttcccatccagaattctatacctagtcaaactctcaggtatgagaatagaataaagacatttccaaacatgcacagtcaaaaattgtatctaccacatgccttttctcagaaagttacttgaggacgtgctctagcaaaatgagaggaaaaaacaaagaaagagaaacacaattcaagaaccagggagactccaacaccaaaaacaaaaggccaagagaattttcaacatgagtgaaagaagttctagcattacagctgctcagcatgcctacagtgcaaacagtcctgctaagactccaggaagaaatcccagaagaaaaaaaaaatgaaggtgatagactgccagtattctcaataggatgaaagaagttttacaattcttacagaaagttcaagaatgaattagtgacagatgcagtaaaaaacaagcaaaacctaaggccatttgtaacccaagggaaaacaagaagatgtaatcataacagaccacaggacacagctaaaaacagtgattacatagtgacataaagagttatatactgtttgtgtaaaatgcaaacagtaagtacttatttagcctagaattctaatttaactgtgttggaaagataagggagtggggagggcaggggcatgagaacaaaatcttgatcacttctcttccatgttaggcagtcactagataatgtctaaagtgacaaaatttcaaggaacagcaatgtaaatgtgtagtttggaaatgccaaggtaaagccaagagatagtcggtagggttgaagggctgcctctgggaacagaaattagagatagaagatctagcgcccagggaaggctgtttaaagatgggagagcttcacgggttttctcactaagggtaagaaaatttaagaaggaagtgatggtgccagagaatagggaattctgccaataccctggtggggagggggagggggagggggaggaggatgagaaggaaggaggagggaggaggaaggaagagggaggaggaaggaggaggaaggaggaggaaggaggagggaggaggaaggaggagggaggagggaggaagagagagaaggaagagattggccaaggagctctgagaggggaaggtgggtgcatgccaccctggctgggaacagcaggtgtgtggtgaaggggaaagaccagcaggccctttacaccgtgggcacaggctcaggactggctgggtgctacgcaggagccctctgactagctggggctggggctgtgcaggataaggccagtgagagaagaggactcactggtgggtgcctcctccccacctttagcaagggttgacagagggatctgggctcttccctgggcaggcatcccagagctatgacctgaatgatatcttagatgatctccaaggccccgggatctaagtccctgttaagtcccctgttaaaggacctaggtcctcccaatggcctgcaaaccacacccagtctagtcagcatgtatccccacaccccagtcccagtgtcccaagaacctcttcctccagccccgggagcaggaagggcgggctgggagctgcaggatggggcctgaatctctcatcaactcacagggtcagcctgggccaggcaggctgggggccagcccaggacctccttcctgggtggagaccttcccacccttccactcaccttccgagcattgtgggccttcccaggaacccccacatctccgtggccctcagacctctgacctcccaagggcaccccacgtgtgtgccctccagcaccctggccacagagccacacacctgggccttcccctctccccatcatcaggtaacccagcacaggctggcccaacccctctctaggcctcagctttcctgtcaggaaaatgcagggttaggagctgaccagggagtctttgaaaccgcaagggtacccttgggagaccccgtgcaggtcttgtcaaggcaggacagggaagtggtgatgatgagaggcagctggtctgggtgctcagccccaccccagcacccgcccaatgggccccctgagggaagctgcccatgctctctgcgccccattttctggcctctggcatgcagagggcagccctgcctgcttcccagtatggctgtgaagccaaaggcggcgatcaatgggatgttctcagaatgacaggtgctctgtgatcagcagcagctgctacagggatggccatcgggtgcagggcaggatgtccctgaggaggcacctcagcagacgtgatgggtgcctgtgcccacagttgggccatgagaagaagtatgtggcccggcctgccctacaccatcagggggtgcttggaccagtggcggctggaaataacccatgaacaggggagagaaggggtgaatgccttgtaggcctggaacactgtggggctgtcgaaggtgcttctgcctccaggaagccctccctgactgtggagacacaagaagctctccaggtctctgggtccctctggtactctgtgccctgaaccaccacccttaggcccagatctattcctgatccttctctagacttcagtcagtttcctcttgatgtcctggatggccacaaccatagtgtcccctccgctcctctctcccccgcttccttccacattgcccctcctcccctttccccttccccaccactgctcccctccttcctccagcacccttctccccgctgccctcccctcccctccccgctgccctcctctgcctctctccgttgccccctcctccctcccccaccagagccctggaaggctaggtacagcgaggaagtggccactccatgacccccagtgatttcacttctctgagcctcaagagtctcacctgtccagggtccatgggatatgcctgactcagcccctggcacatggtcttgcagtggcctgagctggacatgcccctggtaggaagctggaaaggaggccctgcccgtgtaccaggagcctctgctccaggggggtggcctgaggcccaggcagacctccacctccaggcagccctgcaggtggacagctgggcctcaggcttaggacctgggacaactgcctagactacccccagccttcctgacaggtgatagcttcattgtccccaggacacacaccagcccggtccccaccctaccctttcccagcacccctgagggaaggcctggcccctcaggcacagtgggggttgcccggcatcttggcagatgggcagcgttagagaagccttggacctggccctgcaaatggaggtaccagagggctgaactagatgagggacttgaaggctcagatgcctgtgcgggacctggcagggtgggggcttccgggctgggagactaggacagggtgcctgtgtcccctcctgggagtggggccgtcagagctccgaccgcacagggtcatggggagcaagaggaaccaggatacccacaagctgctcgctcagacgggctctgcgactccacaactcaccttcccctactgcaagatcagggagatgggacgcagtccccgcccatgcccagggccttggcagggtcaggagagccagtgcaggcaaagcgccaagcaccctgctgcctgggagaccacagttgcagcaggaagccctcctcaggtctgcccgcctccccggagcatgttccctctgtagctcccggtagggcctgtgtggagaaggttgctgatggcatcactgagcggcccagctgtggggtgaaaggcaaggctggggctgatgctccccaaggcaggaggagaccatggtctggctggggctgccccaggtgacaactgtagggtgtggggaaggtggctgccaccgccgtggtccacagggcctggccagggctccatggggcagaagccatgcccagctcagggggcttcactccactctcccactttgacctggtccctcccctctcccccagagtgacctggacactagcctcctcccagtgggagacagatgtgggcaatgcagctgctgttccctgctcagggcaggctggtgcccaaggactgcccaccagaccaggggataagaggttggcagcatcgtccatggttatcccacagctaggaggctgtgggtgtgggagaacatgctgggtaggggtgcctgtgtgcctctggagtcgaggcaattagaggccctgtggaagcccctgcacgcaaggggcccacgcgccagggcagaggacatagccccttcttgcttccctgagggacgggaggcctgtggacttctggacacaatggcagagtcagggcagccaagccgggccagtgccctggagccgagtcctccccccacctgcccacatgccccacccctctccaagcttctcccctcataggatcccagagccccttgggacctctgtgaagactgcatagatgtgagggagtctcagccttagggtgggcacctgggcgcagctgtcaggccccaagtcagccccaggcacgtggacctgggagccagcctcaagggcaggggtccccgagcatccccactgctgccccgccagcaaccgtgtcactgggaggcaagaggctgggttcctggggtgggcaggcttccccgcttcactccatttgcagcccctgtcttgcagaggcaaaatggaggttcagagaggtgagcaaacaccaggtcccatgtttgcacctggctgtgaccgtgcagtccactgggcccagcagcaggaactggggcaagtgccccgagacgggaccgagacaacagtggggaaggtgggacaggcagctgggggaaggccagagtgtccagcaccagcgccaggggccgttccgacaggctgaggagcggcggggagcggggcttgccaaatatgtccagatggggctggagccccagcaacttcctgccctcccagcctgctcccccacctcctcacccccttcccaggctgtcagcaggggctggggggcagcagaaccccacttagccacaaggagtgcagccaggggctggctcccgggaggacatgggcagaggcttaggtccccttacacacacacactgctgcattcgtgcaggatgggctcagcgcctgctgtgcctggcgtggctgtgtgcatggcatggtggtggcatggtgggagtggtgtggcacatggtgtggcacatggcatggctggggctggggctgggttgtgtagcatgtggagtggcaaggtgcgtgacatggtgtatggcatggtagtgtgcccctcgagccatgtgtccaggtggggcagatcatggagggcgcccaggtgcggtgctgaggctgagcatgcactggctggggagggtgggcagagcaggaggaaatcccttgttctccggagctggagagccagaaagagccctgcagcctgggcctcatcatcacacctcgccctcaaggcctccaggcacagcatccactgccagcctctgctcctgcctctgagggtctgtctccaaggtcttttgggggctgccccagctcccccaacacagacagcaccagagctgggcccacctgtgaggtgctgagttccccatctcagagactgtgcgagcagaggcagggaggcgcttgatgtcggatggagaaaggacaggggaggggtgtggggctcagggccccgccaggtgaaggaacaagcttggaagggtgtccttatgtctgagagttggggagacacccccaagccccagatgggcctcgaatgccaggcagggccaagctgggcccagaagtgggaaggatcccttggctgccccaggaatgcaggttccggggcaagaatccagccctggctggttgaagtccatcccaagtctccctccccacgaggctcctgcagatgccaggaatggggctggattccagattccaagcctggccgcccagcccctatctgggaccccagcccagggcccccaggcctggcctccaacctggccccagcctcaggggagctgaattcagagaatcctgtcctaggagccagaagcgggggagggagggagggcggccctgtcctgggtgcaggcccgggggctgggggctgcccgcccgtctgggtcagccgcagctgcaaaccggccctggctgagtcatggggcctccatctccaggcctggcttgaggtgggaatagcagtgaggttggacatccaggcacctggagggtgggcagggctccctgcggctggggtggccagtggcacctggctgttgcccccctgcaccccagccctttggcccccaagtctctgccacctccctggggttctgctcccatattcctcacacccagcacagaacccagcatgtctcctgtagacacctgcatataaaccctgactcacacacacacacacacacacacacacacacgcacacatgcaggccaggctcctcggccagtcaccctaccggcagagctctagacatttctggcctctggtgactattcttcaggcagctcaccctgcaagtctttattgagcacctactgtgtgccaggcagtggtacagcaagggcagaagccccacctccaaggagctgaccccctgccgtggcagagacagaaaacaaaggcagcaccacagcgacgagggcctgagaggaaagtggagcaggagcctgcagcatgctggggcaggggtgtctttagaaagggtactgggagggccctggcaagggacttaagtaattacttaaaggagggaaagggtggcctggggctcacagaggaaaagccttcctcatggaggcggcggggcagcgggctcagcctgcagtgtccaggagcgacgggaagcctcgtggggctgttgggagacagcaagacctgggtcagcagagcaccgtgtggggtaagcagatgacagggcagtgacagggtgatcgggcccggtcagtggtcccaggggtcggggacaggtgggaatcgaagtcataggaggcggggcaaaggccacggggaaagggacagagctgctcccaaggacgcaccaccatggggtgccccgtggcgtggcgggggtgggggtcaggacctttagcagaaggtaaagatgagaccaagaggcagatgggtggaagagttgaaagcagccaagtgtcaccaaggcatttctgagggagagggacacgactagtggctcaaatctttagaaatgaggggatgggtctggtagagcaccccagattcaaggcgggtggcttggggaaagcagggagaagggtctggaaactgctgctgagcaggagcccccacacccacagagcaggtgcagggaggcccatctgtccatccgtctgtctgtggggaggcatggtgacgtttcaggccggaggtagaagttttcacccaggaggtagagggtgaggccggactgcactccaaggggaggaggtgggagagcacagcctggctgctgccaccaagctccccagaagaggggacccctccccccgaacaccagcacatgtaggcagaaagacttggcctgtggagccctcagcctccacgcccaccagcagggactgggtggtgatgtcagcaatccccacagaaaggagggctgcacagccgtcccaggagccagcactgtccccgtgattctacgtgcagcctccacaagtgtgtcgcatggaaacaagcagtggagagccacatgtgtgtcacatcacgcctcgcctcactcgtgctaaacctcgctgaccaggcagaaccaggcacgagctgcgtatcaaagttgctggaaggagaaacatcagatccctaagctggttacctggcaggcaggggccctagagggaaatggggcaggtgaaatggagatgtgtctttgaaatgtctttatttggcgggagaacgtcttcatagggtacttataccatgaaaaaccctgtacacagactaattttgaagcaaacatgtgaggcgttcacagaaagggttcaggaagacaagcaccccagccgcagagagcccgtgggctgggggcacggggcatggcagccctctcctggggatgggcaggatggggcacgtagggcggaggaagaggctcacatggtgtgcgtgtttgggagcaccctgggcagcctctcgagtgtccagagagaggacaccgtcttgagccagcagggacagccaagagcgcccggggagaggcctgggtggagacagaacacagcaggctgtgggcgtggccaatgttgagggacggaggtggccagaggcctctcagtggtgcccagggagctggggacgaggggcctcatccttcccctgagcccctcccttcaggcccagggagtggcctggggcccaggagagcccgctccgcgctcacagcctccgttcccagacacgcccgggcctgagcccccaggctgcactgtgccacagaacagactccccggcccctccctgctcgagaggtgaccaaggcccagggtctcccagcgagcaagaggccattgaactgttgttggctgtgcagtgccctgccctcggggaggcggcctctaagaagcacacaccaccagcaggaaccgggcagacagaggtgggggatggaaagcaggggaagtggccacagccaaaccaggagggggaagggagggggcctcaccaaggagaccctcacctggggcctggagaatgagaagggtctggaggctaaggagaggggtggatgctccaggaggcagggccagcccatgtgagggtcctgaggtaggaaccagaggaaaccggctctggggcgagaagggcggcgcccagggggccacaggggccggcggcgagggaccctcagccgaggctggtatctcgagaacagcagggatgcctcaaaggttctcgcccagcaagtggacattgtggtgtgggagatcagcaggtgccggtgctttctctgtctgcaggaaggagagggggtcatgggccccagaggcctctgtcttagagaaaaatggtggcaacgtgggacagactgaggaagccagcccagaaacgtcccgtcccaaattcaggaatatttagggtatacctgctgcacgccaagggcagtttcaggaaggggacctacttctgagaagcaaacaccaccagtagggaccaggcagacagaggtggggatggaaggaagccagactgacctcacgtggctcacagccactggcagggtcgggggacaggtgccaaactatccacatgcccgtcaggcacctggaggagtgtgaaacggcatgcagaaagaaggaagcaggcttggggctgggggccagggaccggcgcgccgggaagcaggctgcagagtgaggccagggatgggggctgggccagaccacagggttgtgagcggactctggcattgatccggagccactgagggttagagcctatgactgacaggggtctgacttccagtggtatggggccaccctgctgggctggggaagggaggcgagaggaagtatctaaggtctgcttgtggacttccggggacagcgaggggtattgctggggtcctaggggctggtgcgctcagaggttccagatggcccagcaagtggctgagggcccagggtaggggaggatgtgggggcagcagggccgatgtgggcagacctggagcaatgacacgagaacggccaggcagccctggcttcccctgcccacctgcccccgtggccgggctggggtttggctgaggcagcagagcgctcgctggctgcccgaacaaagtgttctgcctggtgtcccctggcctccgggcctctgcgggctcgccagagggggcagctcaggaggcagcggcagagaatcaaatgcaggtggggcctgtgcccaccgccagcacaaacacggctcctgggcccccagcctgcccgacgttcctgcccgcctggcccccaaacagaggccgatgggacgagccctgcccggggttgcactaggtgggcaggtgggcaggtgggcaggtgggcagctgcctcgggctcttggacagagccgcccctgcctggcgtctgccggcaggaagctcctgaggccgggctagggataggccagcccttgggggaggctcgagaccccatcccagcctggggcttccccaccccctcccacctgcctggcagtgaggcagctccctggcctctgggtgcacctgggcctcctgcccaggccccttccaagggaagagggcaaaggggctccagtgccacccagggagtgttgtgccacgtgggcccccctggctctgccactgactccctccatgacctctgtccccaccctgaagttgacatgaatgtccgcacggagcagcctctgcaggtctgtgaggctgtggatgtgacagctctggctctggcacaaacgtcagccccaacccagatgcagggagggaggtggctgcgtgtccaggagcacggggccatgtggcaccggctcatgtcagcagacacggcacacatagaccccctgggggctatgacgaggtgagggctgagccgagggagaatccaggaaggcgtgcgggccgagaggaagaggaagggaggctctggtggctggagccagctgggggagggaaggcagcaggggctgggatccctcagcccccacagccgtggtgcggactttgttgtttgctcagagtacaaagaagaggccttctccgggttcttagcagacgagcgcgacctctccgaccagggagacagacaagaggggaggttatgaggtcacctgggagaggtgtgggttccagctcccgtcgccactccccgactggatgccagaacgagcctgtcgtctttcacctccagacagcagggccctggctcccagtatcaaagcatgtacaagagcggtctctagggcagttctgcgtagacgccaaagtacaggaagacgtgcaggaactttgtgccgtcgacccttgaacaatgcagggttggggcaccgacccccgaactgcccagtcaaaaacccatgtataacttttgactccccagaaacttcactaatagcctcctgttgactggaggccctaccaataacataaacaatcaattaacacattttgtatgcttcatgtattacaataaagtaaagtaaggaagagaaaagatattcattcagcataagcagatcattgtaaaggtcttcatcctcgtcatcttcacgttgagtcagctggggaggaggaggggtggctcttactgtctcgggtgacagaggaggaagaaaatccacgtagaagtgcacccacacggctcaaacttgggttgttcagggtcgatgatacacaaaaaggacattctaatccagtggggaaaaggtccatcattccataagtggtggggtatcagcaggataacctgcaaaagtaagtctgtaggtcagaaatcaatcccaggcgattcaaagatttagggggtaaaacacaaatcaaaaaagtattaggaaaaaagattttggcgttggaatggaggaggcccttccaagcacgcacaggatgagaaggcataaaggaaaagatggatggctttgaccacgtgaaaaagtgaaaacataagtaagacctctgtgtggcaaaacaaaaaaataataaatgccataaacccatacacgagacaaatagcacactagggaaaaacatgtgtgatgtgtacttgacatctttcttaacatagagtccttacaaatcaatgaacgtgaaaaggcccagtcccagcctcagcttctctgctcagcacccaccctgggagggagtgggcttggggggcttctaccccctcactccagccttggggccccgggaaattggccggggcctcacttactaattcaacaaacatttgtgcagcgccaactctaccctccatgtatttactgggcaccttctaggctccaggctccaggctctgggagactgtctagggttaagatggtgactgcctggcctagagctgggcctccagctggtggcaaaacaccaagcaaggagatcaataaaccgggacatttcagggagtggtgaaggcttacaggaacatggggagagatgagacgaggaggccgcccaggattttgagctaaggttacaaagcagcagaggacagcgggtgcaaaggccccagggcccaactgagatgggcgctcagatcaacacgggcatgctcagtgccggagaggggccagcggagcctctgggggcactgcaaaaggagactggattttactcccagtccagtgggaattctgcagaaggatttggcccaggctgggagggaaggctcagcctggctgttgcctggaacaagcggggaacaggttgggggcatagccaggcagtgaggtggttgtgacagtccaggcagaagatgctgccagcctgggcaaggggcatggggggcaggctcagagcacatgctccagaccagagagccacagacaccaggtgcacaccagggaccctgggtagttggtcgtgccctgtggatacaggattcgggccggcttgggaggaatctgagctcccgctgggacacgctgagctgtggggctgttggcctgcaggccttggagcccctggagagagcaagtagctgacggggacatcctagctagccgaggtcccaggaagggaacgagggtcgtgtggtgacgatcttgagatattcccccacagtcgtcagccagggacatggcgcccctgaggcccttggggggccaagcatccgtcagtgggcagaggctggtaaaagtggatgtcagcagcagggggaagggtctttctttcaccatcttgggcctctctcagagggaggcaaccccgctcctggggggtggtcagtgagggccagccaggcagcggcagccccaggaagggtgttggggtggagctgaccaggcctctgccgcatggttgcgctgtgccgaggacccgctgaggacataaccgaccatgagcggtgtgggtccccagccgcggcagagcttcctctggctgctcggcagacaacagacaccagggacagagacaaggttgaggatttggtctgcagcctctgagcggacacactcaccctcagtgcctgccaattcagccccaccacaggcgccagtcccgagcctgagcacaggggctgccacgacgctcgactctctgggccaagactcacacacagcctggacactgcccgggtgaagggctctgggggacagggggagcagctggtatgtgtgtgaccatgggtcccagactcagtgccatctgtctccccattaggagaggacgcctggtacctgcccaagcacccaagccatgggagttgctgcttgctctccacgcagctttgtcccagcagcacccccaactcctgtgatgggttgcagggggtgctcacctctgtggcacacacaaaggcccaggggcctgggggtgcaggcaggtgcactccaacccttgggcagcccagagaacaacctaatggaaagtgaagggaattgtacaagtgtgtacaagggtgcagggtggttcctgccttcttgcacgcacagtctcccacactcatacagccacaggttcgtacgaggtacacatatgtgggctcacctagcatgcctcccgtgtgcacagcagtgctcctttggcctcaggccacaggcatacatgtgcaactgtacgtgcactctaggaatccctaatgatcatggccatcgggtggctcgcagtgcactgagcaccatgctctgtccctggtgtcttcatgcctcagtccacttgatcccctcagcatcctcctggggaaggtgctacagctgccctgttttataggcagggaaactgaggttcagagaagcaaagtgacttgcccaaggtcacccggccaggaagcggcagaggcaggatctgaccccagacccgctgcggcacacacacgcctgcctgcacgctcccgtgaggaggtgctttgtgcccaaggccctgcagcagtgtggggggttctgaggccatctcccactggccacagcacagcaagctccagcagggcagctgccccaaggcctggcggtaaaacctcagcagcgagaaacacggtcgacttttgtccaagaactgaagcactaaagcaaagtcaaacacaatcgctccatgccctgccacgaaccgcgaccttaccacgtgctgtgacctattgccacttgtgcccagctccacacaggagccgggtctgacatccgattgctcagagcctggtatgaaacattctaggtaccgccctgagagtggcttagtaactgctggttcctcaggacagacaggaggaaggccaaggtgacctttgccctgcgaccctacagagggccctggggaggccctgcctggtctttagacactgcccaacaaggatgctagaaggggcagtgagttttctgcctcctggggaactgcagcccaggcagagaacaggacccccaccctgggagcagcgggtgtgcccggcctctcccgcctgtccctggccagtctgccatccacgaggccagggcctttggcggtcctaggcggggatcaaggccgggcaggttctgcaaaaatttcccttgaaagactctttttcaagattttcttttgaaaacaaattcataaccacatcaaacaggaatccccgttgccttgggtttgatcgccggccgcccggggctctctaactagctgttattctaattgcttttttctcttccgagggctgcataggtctcttatggttattaatttggtgagtgcaggccgggcacaaagcagcttttgtctgccttgccttttaatcactatcaaattgcaaataatggtggaggctgagatccccaaaattgatctgtcccagcagttcttggggaaccggccccagtgcctagagcatgcactgccttcccccagggcggcagctccccgatggcacctgcccggatgcacctccgcatgggtggggtctggcctcggccatgggaggtgcttctcaggctcctccatcgccaaaaaaaaccaaacgtgccagcgagatgaaggcgccctgcccgcagagtggtggggtgggactcttcagggacacgtgctgtgacaagtgcttgagtcagagctaagactctggggctgccgaggagccacctgtagcccaggcctgggcccttcccacaaggggggcagcagcatgatgcatcagactgtggacccgccctgggcatccagcccacatcctggcccacccccggggcctctgtcaccagcagctgggatgatgagagcatgtctctggggccagagaccctagccagtccctcaaagccccagttggcacaggcagcagttgaggtgagcctgggaccagccagagccaggcatgggctgacgctggcccaggcagcttcagggagcccttcagtgtccgtcggaggcaagctcggccctgtggctgcctcccgaccccaaaggtggctgagtgcctctctacacggtgccgggactccctgccgggaggagctgtcaccaaagtggctcaggactgagcgctgattccagccacaccctcagcctgcactgcctgcctgcggccctgacacccactgtctctttctgtcccaagaatcccctgtgaaggcctccacacccattagcacatgtgggacttggacagatgttcgagtgccataatgtgaaaatttatgaaaccacaaatgttcatctgtgatgtatttggtgctttaattaatgccaaaccaattgatacccaagctggggcctgcacagttagtgacagtaagccacgcggggcaaacctcgttccacactaccagtatgcggggcccagggagctgaggtgagccctaggacacaagcccaggctttgccctcaaagacccacgctggctgcacctttgatctgctacgctctcgtaggtctctgggcctcagtttcctcatgtgcaccctgaaggctgagagacctcccatgacccctaccaggcatgagcaggtcgtgggactgagagggctggtcctgccggcagcaggagccacgggggtcagggtgtggctgaacaagaacgagacctcaggccggtccccctcccagaggccccgccccaccctgccctctgctttcgccggctccctacctgacacactgtgtccccccatatggcagctccgtggtctcgagatggagccttggggtgggagctgtggggacaggatgggagacatggcactttcagccagtgactctgaccctcttttcctgggcctcagtgtctgcatctgtgggatggagtgtgggcctctgtggctcgtccccaagtggctttgcagagcactgaagtgctggcgggtccttgggtgtgagagaccccggtggatggccctgggcccctgcccctgccaaaccacagaagtcctgcacccctttcctccatagtctgggcctcacatcaggtttatctgggaaaaataaaacatggggctccctctggcctggaccgtcagacctcggatgtacacctgcccttgtgttcaggacagttgggtctcagactcaccccatacctgcaaggcagaaccacaggggagccagggagcctccacactgcagcccccaccacccagggctggaagtgggtcccctgggctcctgctctgggcagggcacagtcccaccctcccaggtggaggctgcccacctagccctctagacagacgctcggccccactcaggcaggcgcccccctctcatctcagcctctcacagcaccctgttggccgcctcttccttagcctgctcagcctccgtggtaggtgctgtgggtgacgaccacagcacccagcctttgaagctggcccgggtccacccagaccctagcaaactggttgctccctctctggccatcccggggcttgtgcccacgtcacccagcagcatcttccctggggttgtctcacccgcacagaacccagccctggcccacacctcaccccaagcctatccggctggatcagcagtggggccgggcgcatgagggaccaggcccgcccggcgcagcctagggtgcagacccctggagtgcacggccaggtggaccgggccagctcccgcctgctgcctgtgcttagggccagtggttgacgttgctgtggctgagtcatcttcgtgcctctctctggagccatacgtttccctgaagcagctctgctgttcagcccttatcgcgtgctgatctgtttgcccctcccccaccacttctaggtctttccaggcctccaggtacccacggtgggggagggtctacttcattctccacagagcacgctgaggggctctcctgcaagaacaccgcaggctgaaggaccagccctgtctcctgtggccaccaacagagctgtgcgccctccccgaaccctcactcatgctagggcccccaggtccaacctcctagggagaggggtccccaacctggactccctcacctgccctagtctgcccctggggttggccctgctccacccagcacctgctctgagggtgccagggtgccggcctgccggccagggccttccagtctccccatcaaggctggatggccacttcccacccggggcgggctccagcctcattccccagcggtgctgtccttccaaggagctctcagatcacctggctgtccactcgtttggggcttctctgctgcctccgcagcactgcgaggcctctgatcacctactctctgtgctgggtgcatttcgggttctgtcctgccttgacctccctgccagctttgcagggcagccaccctggcacatagctcactgcagaaccagcccctgagaaggtggaggccacatggctagccagagggcacgctctagggcactgctctgaccacagaatgtgggtgcagatggtgtctgggaaaatagtggtgtccccgctaggttaaagacatggcataatggttcctgggggatgacaaaaaaacccacccccacccccttgcagaaagcatcacagaggcacaagccctgtgccctgcaagcccctcctggaagtggcccagcaggggcatcccctgcacacccaggcaaagcccaagccctctgcctcctcaaccaccccaggccctgcccatgagccagccttgctgaactctgccctctgtccagttctcctccagacacagtagacatagcccccagcctttcttgacccttaacccaaatgtccccaagcctggcctcaagaagccaaaggctgccgcaaacccaaatatttcaggtccgggtccctggtgcagaccctgccatgcggggatgtggcacagaaggccggccagcctggggagcagagaaggaggagaggagagctcctggccctgagcctgaatgcctgtggacacatatagggactcccagcacgcacgggatggactccaatcggcacacatgcacattccttgcacacacacaggcgcgaccgagggccttgcagacatagggtgcacacgtgcgtgccgcctgcatacagcatgcacttgcagagacggttggcaccttcccttctctggccccaaacctgggccctgaggctgtctgcacacctgggtgcttcccaccactgactctctcgtctgcctttgtccccgcaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacaggctgggctgggcactgctctcaccttggttcctggggcatccatggggtctctcacagacaggacccctgcagttcccctggaagcagtgcccaggtggctgtggaataggaacgctatgtccgtgtactgaggagtaggtcagggttcagaggggctgcaagatgccatcgaaggctctagcttagcgacgtcgctcctgttctgggccctgggctggccctggccatgaagtgcagtcacagtgtggtcactgcctgtcttccagcagactctatgcccttgcggcagatgggctctgtctgggcctctctgtctgcccctcccaggccagggtggcccttcatcaaggacccacatgctccactctgggagcaggccccacccaggcccattccccaggatgccaagggctaaactctggaggggttgtggtgcaaggaaggcctggggcccctgaggctcccatatgctcacccctggcctcctccgggcctctatttccccattggtaacacgatgctcccttagcctgtccagttctctgagtgggacagaggggccaccaccctgctcgccctgaccctgttcctgcagctttctgtgaggcccgcctctcctaaggtggaaagagtgcctcactctcggcacagacacactcaaccggggcaggtgcatctgctgtgcccccacctcagctattggaccgtttctcagtccttcaggactgcagccgccttctgtcctctttccagagcccatcccgaagtctcaggatatgagggcttggggcatctgagatatcaaggatggggctgtcctgagtccactgggggcaggaggcggccagcagcaggtggcagggacaggggccccaggtttctgtgtggagtaggggtggaagcccttgttagagggaaaggccctgggtcccacctggtgccaagcccactgggcccgtgcccccaacccatgggtcttggcatctggcctggccagcactgaccgggatggacgaggtggaggggcagcacggggcttcccaggcttccctggcctgcacccctccgggaggagcgggagcagcagttactgaaaggcaggaactgttgtttccttgttgggtaaatatttgtggaaacccggggatgccggccggaaagcagggccctccacagcgcccaggccccccagccccggccgcccaccccgggaccctggcccacagggagctccgtggggccgcccatctgggccgggcgcggccccggcacccagcccgccttgttgtccatattatggactgcgcacaaagtgcccgaggactcctctcctggacgggccattgcagccctctcgggtgtgaaatgcaatttacctgaaataaagcccaattatggaattagctaattaaagccatggcggaggctgggcctggccggccgagtgctcaatgcccgccggtgcccgtggactgagggaacagatggcgcctcggcccgccgtgccggccgcattccttcactctgtcccccgataagtgacctagacagcacacgaccatctggtgtgtggcacgtcctgcgggccccggacaatggcccggcagacctctctgcgagagggccgtcgcccgggcaacggtggcatgtgcagccccgacccattcacggcccctcccgcagcccctttcttcgggccctttgtggcctcaccgcggctgcctggctgctctggctgaggatagccatgagtgtttgtccccagagccggcctttgtctccaaattgggctcccttattgaggtcctcggggtccaatgggtgccaggagcatctgctgggggtgactgggggaggggctgctcctgcttcctggggcacccacctcctctgccaggctctcctcccccgttgcctgcccccagatgtcccctcgtgggtgctgggcgtggccatggggaagcccgtctctagggctggcactggccaagcccgaggttctcccatcttcgggccagggagccaggaggaggaggagtcaagggcggggccgacctgcagcccctcagctcccaccccagtcctgtctgcgaaatggggaacagtaaaagtgccccctagaaggggcgtacggggcaggggcttgatggagatgagacatgtgagcacacagtaggtgcttaataaaggaagccaaacaaaccacctgggtgggtgatactgggctctgcctccttgctgctctcctgcctgttgcctcggagctcctttctgaggcccctcctgcatctagccttaccccaccaagctccctgcccctcggtgccagggagagctgtccaaacccaagctggcagttccccatcctgctctcaagccaaccatgactccccactgctgagtgggcctgtgaggccccacaggctgcaaccctgccactcaccctgggcatcccccgccatgagcccagcttccccatcctcaccctgtacttgacgtccagcccccctccctactcaggacctcctctgagcaccatcttggcaggcagtcccccaccagcgtggtggtcaggagtcaggcccaccactgggagaggggctgtgctgggcctttgaggccccaaaaaggagccggggctggcagtgcctagtacaagcctggccccagctgggtgctcaggaagtgccagttaaattaaggaataaaatgaaaagttggaaggaggctgcccagtgctgcatgtgcagcagaggtaccaggacccaagcagggcatcaccaggcgtccctccaatggacaggagaggggtccacaccctgcgccctgaaggagggatcaggccaggtgttttgatctggggcagccagacagctgggggaaggagcaggaaggcagacaagagccagggctcctggggccaccacacacagcacccccatctccaggggatttgctgagtcacctgcagggatgaagactgccctttctcaactatatcaagtccctaatttggagtgcccatctgagctgtgccaaagcctgctccccccagcaccccagcctcctctcagcacagccctccgggctctaggacccaggggttccttgcgaatcttttttttttttttttgagacggagtctcactctgtctctcaggctggagtgcagtggcacgatctcagctcactgcaagctccgcctcccgccattctcctgcctcagcctcccgagtagctgggactacaggcgcccaccaccacgcccggctaatttttttttgtatttttagtagagatggggtttaaccatgtcagccaggatggcctcgatctcctgacctcgtgatccgcccgcctcggcctcccaaagcgctgggattacaggcatgagccaccgcacccggcctccttggggatcttaagcgtgtctcagcctcaccattctcggcccccaactgcaccaaccccgctcttgcctctggccctattcttgtggccctggagggccagctagttgggagatcaggcctgtggcctgtgtcccagcacccttcacctttcctgtccccacccaggtcagccagggtcccaggcagccaggcctggaggatgcttggggcagccaaagccaaacagagcttcagtttccactggcctctgagtgcagacagccggggccagggccccctggaagctgacaggtcccaccccggcccttcccaactccactgtggagccttggtgaggaagcctagagggccctcagtcgggcagtgcaggagggctgggggctgccaccccagcccaaggccttagaggccaaggccccagcctgtcccacccaggcactggctgggtaataggaggcggggcatccactctgccctcaagatccttctccctcagtaggtcctgctatgacctcctggccctcctcttcagcaccccgtaccaggcctcctacaactcccctcccctgcagcccccacagctcaaggcacctgagtgaggcagagcgtaaaggagatggacagcctggcccagggcagccctgctggactccaggagatgcttgggcccgctccccactcttccttctagaccctcacccatggctcccagaggggacgaggccgcccttaattcccagagccaagcccagccccaccgcccacctatccccaggcttgggtttcgcacacgtacaggcagcgagcccgaggcccaggaagacacaagccgggcccagaggtggccatggatggctcagtggacagaatccatcctggtgccttctggggcctcaaacacacagctccttccacttcccgggagtggccccaaggtgcaggggtgggggtgtcgagatggagtccagggcttgtcacttgggcacagtgatccccacctgcatgacccatgaccctggaaaccccccccaccttctcctctccccactgccggcccctccacaacattccccgtgacatgctcctttccagcctgcaggacgcatggggtctttctgtggcattgcagctgagcagcatcagggcaggaggtgcaggctctgggaaccaggctcacagcttcatctccctcctgggcctgcgccctgggaagccggtggcagcggcaaacccacggagaggagttaacaggtgcccgaggacagagaagactcatgctgaggggagagaccccagagcaaaaaggcctcagagctcgtgaagccccccacccggtacagacagggagaccaaggctgggggaaggccgggcctgtgctgcgcctgtttgtgtgactttgcattggaaaagcctcagagaagaaatggggcttccacagcagagaaggtagctcagccaggaagccagagggcaggaatgaactgactggctgaaagcaagagctggccttgccagacctttggccagagaggccagatctgaggaagagatgttcaaaattccagggtggtctgagcacagctcctctgctggcccacacaggccaagaagccacaaagcactgtgcctgcctgatacagccaagggtcaggtgggccttcagaacacaccgactggctccaagaaggctgctgttgcacctgccacacagaaaatctcaaacttcccagttagatcctcaagaaactctgttacagcctgaccgcaaatgtgattcaccaaaccccactgaatgacttttggttgtttcttaaccacatccctcccctggccaatgctgacacacagctacacacacctgcacacacacacaccttcacacatacctacacacacacctaccctacaaacctgcacacacaatacacatacttacacacctacacccctacacacacctacacatacacctacacacctacacccctacacaccgacacccctacacaccgacacccctacacaccgacacccctacacacacacacatctacacacctacaaccctacacacacacacacacacacatctacacacctacaccccgacaccgctacacacacacacatacctacaacacaagaagtgcctccactgtgtgtgtggcacgaggcagtgggaatgaaggaaaagctgaagccagaagccagggatcccctcattcacagcctggctcagcccctctctcaggtgccctggggcaggagccaggcttctctgagtttcagtcgctcactgcaaccacagctccacagaactgaccccaggatcctcagtggaagagaagatattgcaaaagccggcgccaacgcaagaccaaacagcaatgacagagctcactgtgctcagggagaaccatgtactgacgtcctcttcagtccagcaacctggagctttgacacacaaacagcccctgagacagaggtctccgcagcaaatccacccacgggacacttctgccaggcagagcctgagtcagcacaggtgaccagagagggaagggccccaaatgccatccagttctcccagaacagccgagggaggtcacaagtggcccaggtgccatggggaagagtggccccatagcaaggccaggatgccgctggtgtcagaagccccccgagcacccagaggggcagaggatctgtgggaggagccttcaggtgggcactcagggagcactcaccccaactgtgcccccagccaccccaagaaggcctggccggaagcatctctgccagggacaatgggagcaatgggctagaggtggactggccaggctctggaagaggaggctccagctgggagaggccacaaccccggggtggggcccctccagggcacttgagggtggaactgtgcagcccctgagtgttgatgggcctggcctgggccgaccccagagactccagcagaggcccagggagctggaccgtagcatcgcccagggaaagggcccgtcctgggggtgggcaggaggctgcttgagaaaggcttctaaagaggggttgtcaggatggtggtgaatgccattaaataatttcaaagggtcttaatcaaatcccctctcggtccacgagatcatgtcaaaggactctggagaggaaaagaggggcagacacttcccgtgcgtcttccacttgactggctggccctgcggcgtgggggcctgcgggctctcgctccgcctgtaactccgtttttgaccccagccaagcctgtctcctctctgggcctccacctcatccttggggtgaacccacactgcccagttcagggagcaggcaccacctcagagggggtctgcaagggaaatgtctcatctcaccgctttaggaggaggcctcagcggcatctccaaaccatcgacgcagctgctgagaaccaccacttacagaaggggaaattgaggcatagaagagccataggatggggaggctctttcacagcttccagagcctgaatttcctgggaacttgggcctggtgcttgaccgtgcattgccttggtttctcatctatcaaacaggctgagaccacatcctacctcacatggttagggtgggctgtgagccaggcaacgcagcacatgtgataggtgcttccagaatgttctacggtgacatctcaagcccacggtcctcaatggtcctgttgggctccttcagaatccccccagatgccccacatcatctgccctggactttttttttttttagagacagggtctcagtctgttacccaggctggagtacagtggcctgatcacagctcactgcagccttgatctcctaggctcaagtggtcctcccacctcagcctcccaagaagtggggactacagtacaccaccacgcctggctaattttgcttatttttttgtagagacagagtcttgctgtgtcgcccaggctggtctcaaactcttgggcccaagtgatcctcccacctcggccttccaaagcactgcaggtatgagccaccgctcccagccgccttgggaattttttcaaagtatagacacaaaaccttcgtattgtgtgttcccaaatgtcccacagccgtaggctggacaaagcagggccattcacctccacaaaaccttcctattgtgtgttcccaaatgtcccacagccgtaggctggacaaagcagggccattcacccccgccacagccacacacctctcccacctgggtagttaacctgcaagtgctaagggctctgaaaccacacagcagcggcctgtgatccgaattgttctgcagctgtctgtcctcacccatctgatgctatggaacccatctgtggagaccttcctgttctcctgaccttctgcaaagagtttctcagacagctgtgacctaactgtgtccagcctccctatgcaaatggaaattcacccattctgggttgagctgagattcaaactcacacccagccaccccacatgcaccctaagagccaaaatcactctcccagagctgttcccggccccatcaagcaggtgcacgggcaacagtccgggctcagaagctgcctcctctcgggctcccaggcccggccactcctctgacaccactggctacgaccactgttctggggcaaagacagccaggtgggcatacccaggttgggggctgtggatggaacaaatgaaccagtgaaagctgggaacactcccaggaagagggctttgtgtgcccccagccctggtctcaccccttccctggccctgggatgaggagagtcaccccacagaggccttccagtgcaagtgccagccggggcccctcatcgactacctgatgctaccatgcccccagctgatgggacagagatgaggccctggaagctcagccctcgtccaagggcacccagtgaccaaccgcacccgctggacttcaaacttggagctctgtgccaccaggaagccccctcacccccaccactgaaggagctcgagaaacgccagactatgctgctttgggatgtagaccacctggagctgcaggcaggagaggcggccgccaggggcatcggcccagaaggcccctcacctcctccgctgagggctgcccagaggcaatgtgggtcccaggggacttttcatctgcatctggagaccaccgtcactcatgctccctccctggccctcccacgactggtgcagcccccaccccagaagccccagcccctattcctctctgtggttgggaggacatataagcttaaatcaccttgcccttctctgggtgtcacgctttgtggccttccctcgtacgtacataatgaaaattatttctttccttctgctaatctgctcagtttaactcgtggcccaaagaacaagggcggggggcaagacaatttcactccctgcactaccaggagcacctgtgcctccggaggagccagcagagagggccggccccagccctcatctcagcagaagccaggctgcgctagggagcagagaggccagtgggggtcagtccccaggcccctggtgccacgaacacactcctccctccctcccccatggcccccctgccaccatccttgaggtgaagcaggcagaactgtgtcccgaaaacgctccacagcccccgcgtgtgtccaggtggcttcagttacccggcgcctggctggcccagcctgcagagagccctgccaaggcctggcaccgctgtcccgagcggcccctcttgccgccagcgagcccaagaggcctcagggcacaggcagactgctttcccctacgcggactggcccctgctccccaggaaaaggcttcattgtctcccaccccccggccaccgcctggctcaggagacacgggggctccaagctgcgaggtcacccggccttgcagaatccacctgcagccgcaccagtccaggaaaccaaatcccagcggcagatgacagccgagggtggcaggacagagtgcccattcagcctccgctggagccggcctggcctgacctggcggccgcctcccctacctgggccctctggtgcctgagcccaggcctcacttagcctctgctgaccagagagagggctgggacgtgccccaccctggggcacccacaagtgtgaggatggctggtgaaggtggcagagaccctgccccacaaccagggcctcctgcagcccagagtgggctcaagggagtctccaagccaagcattaacagggatctcctttgaacttgccaagcattgctgccccatcttacgtatgaggagcctgaggctgggaaccaactcacctttcagctgggtgcagccaagctggagcctcgctgactcaggggtccctcctcagtgagcagatggagaaggtggcctggaaagggccccaggctgcacagcagcctgttgtagggaagaggagacgggccaaggcatggggacacatggacccatttcacagacaggcagctgaggtggcagcctcggcagcaagctgacaagaagacaccaggacagcccttgcgtgagttgcatcgaagacaggagacccgcccaccctcccctccttaccatcctgcaggacctgagaccaccagccatagctggtccctcatcgcctccccctatccccagccctggcctctgcatttgggcaaaggctatg

SEQ ID NO: 298 - DNA, 358680 bp, Homo sapiens
tggggctgcagtgagctgtgattgcaccactgcaccccagcctgggtgacagagaaagaccctttctcaaaatagaaaagaattaaataaacaaaacattttacattttaatagttatatatttactatacaggatgtaagaaaatatgcaactgttttatcaaacccagaatctaacaataatatagatgagaggaagcttaatattttaagcaagtcagtataaagttaatactaatataaatggtaagaatttgacccaattacctcttaaagaccccacctttccacattgccacacattagtgattaagtttcaacatgagctgtggcggggacagacattcaaactatagccgaagagaaattgttgaagtttgggaaacaaagtaattttcactgtttccttttcttcaggttttattctttccccaaattcagcctacagttgactgttttatgtgcaaccaatggcaatttttaactatggaattgaaacctttgaaaagataagacaaagctgtgtgtgtatgtgtctgtttttaaagatgaatcaaactgtgtttattatttattttatttcataagtgattctgtaaactgaccacgtgaatgtcctgattttcatagattatgactggctcaggtgacaagaaatagacatactaataacctaagaaccttgggttattatttatatttggaagtaaggaaaaacaggaaatggctttcccaagcctcctgagcagcatttaggagacattttatatatttttatttatatatttatatacatattttaggataacatttaggatacagcagtagtggcatcaggctgacagaaactctgggaaacccacagtacactgtccttcccccccatgcacccctgcccaggcttcaatgtctccactcctgcttccttctctacctcctgctgctacgcggtctgctctgctgatctctctctttctccttttctctctttctttggtttgtgttgcctcatggcttttggttgctgtcacttttttcattattttttaatttttttttttttttaagagatggggcctcgctgtttcctaggctagagtgcagtggagctatcagctcactgcactctcaaactcccgggcttccggctaattttctgaaaatatttttgtaaagatgaggtctcgctgtgttgcctgggctggcctcaaacttctgggctgaagtgatcctcccacctcagcctcccatgtagctaagactacagacaagagtcaccaagccaccatgccactgagccactgtgccactgcaccacctggctatgcttgctgtctttgtgcacctcagctttcgcctgccatactgcctgcatctggggtgaccaactcaacccagttttcctgggacttttccagtttcagcaccaggccacacccaaagtcataggtgaactgggatgtttggtgacgccacctgtatcccttcgctatatatttcatattcgaattctgtaaaggagaagaggggaaatctgactggatctctttgtcccttgtccaacccggggagcatctgagctcttccagctgagcctactgattgcaccagtcaagcttgggggtgatgaaaggaagcatccccagctgcctttctcagaaggggcctgtgagcagagtgagcctgggaatatcatcaggtcctgtagtccattttccacaccagtttgtatcagtgctgctgctgaacatgttgggtgaaggtatgtgcagatgagaggtggcagtagggggcaagcagaaacaattttaaaaatcattgcagcagctgggtgccatggctcacacctgtaattctggcactttagggggctgaggtgggtagatcacctgaggtcaggcgttcgagaccagtctggccaacatggtgaaaccctgtctctaccaaaaatacaaaaattagccagacgtggcggcacgcacctgtaatcccagctaccacggaggatgaggcaggagaattgcttgaacccaggaggcggaggttgcagtgagccaagttcccaagactgtgctccagcttgggtgacagagcaaaactccatctcaaaaaacaaaaaaattcgttgcaccttttttacttttatgaactcaagcgttacacaaattaggctcctaatatagtgttatggaaaccctggcccaaccagtcattaaatattttatcccactcaatattgtccagttcagagattgtaaattttgcaaaagggagtgtttacaaagcaaaacgatgtcatctgggaaatgaagaatgttaagctctagcagccctggggagaaacacaaaatgcacttcggcttagggcagagaagcttagccatcaatactttgtaaatcctggagggcttcctctacctcctgcatgccagcaccccctctacccacttggctccagaaattagtccttctgtattaaaactgtttttccatctgcaaggaacagaagtccccaccctgccctaccccgcctctgcttccgccccaccttcaattctgtggactgaggtggggagagaaaaataaaatcactgtaaaaatacttaacttctgaagcacgtgactggctttcaagaattctataaactcgagggtgaggcacttgaagaagttggaggcatggctcagggcaaagcaggggctacagtgagccctttgagtctctggacacccctctcgagcgcccccaacctcctgatcacccctgatcctcctatccagcaccccattcccaattcttcctggtgttctgagacccccgagggagtgcaggctgcacgcaggcaggcggcccagccccgggtgctgggtgaccccctcagctccaggtgtggctgcaggactgtcagcctcccgggggtgacatggaaaggtgaatgtatttgcactgcgcctttcattctgtaacatctgtgtctctgtttctcttaaagcctatggccatcactcaaccggaggctgagaactgatgaaaaagtggaacaaaaacaaaataaaactagctgcgttgttgaaacaaagtcaatttcagtgtttatttggcagagaagccagtagaggtgatcaaagtgatcagggcaattcacttgtttcgctggccctgggagggaaggtgaggagctctgaattccaaaggtagggggagaggagagcaaagctcaggggagagagcggtcaggaaactccctgggcacaggcaatccctgccaggactccaagacaccagtcacaggcttctccttctcctgcatcagggtgacctgcagggccctgttctcggagcctccaccctccaccctgggctgcaccacggcccccaagccttcatgagcaccgttgcccaaaggctgtgctctggttgcacccttgctcccaagctcccctcacaggcgctttcccctatcctagcagctccacgtctcctctgctctgagggtggtttccatctttggcctcatcctcctggaagccctgccccccagggaggtccctggcatcacagtcttagcttacagactagaggtctcagtgactagagcaggcgcccagctgcagggagactttgataaatatctatggccgaactgcatgatgccttagggctcttacagcaatgccccccaaataataccagacccaattctatagttgaaagaagaggaattttagaaaataggtataccgggccaggggcagtggctcatgacagtaatctcaacactttgtgaggccagggctggaggattgtttgagcccaggagttcaagaccagcctgagcaacatagtgagacctaatgtctacaaaaaaatataaaattagccaggcatggtggagtgtgcctgtagtcccagctacttgggaggctgagggtagaggattgattgagcccaagaagttgaagcagtgagctgtgatcataccactgcaatctagcctgggtggtggagtaaaaacttgtcaaaaaaaaaaaaaagaaagaagaagaagagagatacctccccttttattcttcatttccatctagcaaaataataaaaataatattgatgattgaggggtcgccttggacaattgccttggacttcagtagtgaaaaaagaggataaaagatcctaaggtattcatcaagtataacagagcaaaggctgaacaggaccctggagacgagaaagatgggagagatgagagccacacgttcgagaatgctccaggagtcagtttgttcagcagcaaagttgggggatgttggtgggggaaacagggagaagtgtactccatgatcctagttttggcaacttgattggttccccttccttcttgctccccctaccccccaacccccacctccacaggtcactgcagctttgagaaatggcagaggagaagctcaagggcagaaaataagccaggagagtctctttcccccaaatactctattgaaagggttgataatgaggcactgtgggtaaagcaaggtagcaacccaggtgcttgtatctgtagaagctctcatattctcgtggattccaccctggcccttcaggaactctgggaaatatgccatggttttgctccctctgggataaaaggggtgagcagatacatgttacacttttcacttataagttgccacctggaatccagactttgtctgcagtgaccagagggcagagctgagcggggctttcaagacggtatgctgcacagatgccagctctggccacagtgctgtgcacacggggtctttgctgcccagcatctatcttccaacttaaaatagataaaagaaaccataataaaaaccaacatcaatgggttctcttaaaaagaaagcaaatatgcttaaagtattaacacattggatctatgtgtagtttcacatcatatgaccacatgaggaatttgtgtggagtagcaggagagttccaagacatttcatagggagatttgagtgttggtgggtggcgaggggctcctgggcacctcacttattgtctggcaggatctccttggagccactggaattttaaggactttaagtaagggaagattggttaccctctggagagaatgctggaggttacctggtgaaattgttgctcttaacgcagaagggaaaattctgttttgatctatgagtcatatagaaatgtattatactatggaatctgcgaaattgtttgttagtggggcttgtaatacggtccgtgtgaggctcacacctttgctctaattattgtttaagattaattattttttaattattgtttcagattcttttatagggtctttgttgggaaactcaaacagtatcattatgttcccctcacatttggaaacctaaggcgcccagagggcttatcttgggatcacacataggtggccatctgtgctggtttgccagggacagtcgtggtgtcttattgtccagttgtaattattaatagtgtctactttccctctcacaaatgctggtttatactaagtataaggtcaccctaaccacctgacacattgctgtcaaaactaggattggagagcccacatttcacatgcgccagatcatccatttaagcaaatgttatcccagttgttaaaaatcctttatttctgacttacagggcctcataccatagcagcctgtcttttagaaacagttaatgtggaacacatcaaacacgaggcctctggttgaaacacttttgttgacttctttgtttttcactttgttttaattgactctcacagttatgaatgcctttgaaaagtacattttaaggacttcagcaagcattaattatttcttttgtgtcctgatgtcaagtcattttcaactatctggttcttaataggatttaaagtgaaaaaatattaaatatgtatcagggcaattccacttactcttggttcttgcaatgatttctctgttgaaaaacttacataggccaggcacagtggctcacgcctgtaatcccagcgtgattactttgggaagccaaggtgggcgaattacctgcggtcaggagttcgagaccagcctggccaatgtggtgaaaccccgtctctactaaaaatacaaaaaaaaaaaaaaaaaaaaaaaaaagccaggcgtggtggcacatgcctgtaatcccagctactcaggatgctgaagcgggacaattgcttgaaccctcgaggcagaggttgcagtgagccgagatcgcgccattgcactccagcctgggcgacaagagcaaaactccgtctcaaaaaaaaggaaaaaatgccgggcgcggtggctcatgcttgtagtcccagcactttgggagcccgaggcaggcagatcacaaagtcaggagatcgagaccattctgactaacacggtgaaaccccatctctactaaaaatacaaaaagttagctgggcgtggtggcatgtgcctgtagtcccagctacttgggaggctgaggcaggagaatcacctgaacccagaaggtggaggttgcagtgagccgagatcatgccactgcactccagcctgggtgacagagcaagatgctgtctcaaaaaaaaaaaggaaagaaggaaaaaaggaaaaatttacatgaaggaagttgacatgctttccacaaccctataattggcctgctgagaaatcatatgcaattgtttacgatttttgtgattaattctctttatggtgaatgccatttacgttgcgttatcaacaccaataatggtccagttctgtaacgggttagctatgactgcaaaatcaccatttgtctttacagcactcttttatctcgtcacttgtctttccttttaaatgacatttgttttatgtggtagctcattttgagtcatgaattgcaacatatggaaccactaaccaagaaatagtcttgcacctttccctgttaacagaaacggagttgaaaacttagcctcctggtattattattattctagttctttatatgactggaggaaaatcagatttcaagttcttcccgctttccttatgcctttcacagcaaatttcaaagtatagcagtaggcagattgcaatgtaatagcaatttttaagcccagaaattaaattaaaccagaaagaaatacacctacttctagttcaaatagtgtttcttccagaaagaagaacatctccacagtaacagcagtgacaataagagtattttcatgaagatcggagttaccaggtttatatagattgcagaatacagctactgttttccagagacactgacaatcagtgctaaattgttaggaaggtctctgtgctttggagaaagatatggaatagtcggtgcaagggcaaatagagtgccttctcaaattgttttcagttcctcttcttaaggaggaacaaaaggccagtaagtaatccaatagaagcttttccctatagaatggtcagaaagtttgatcattcaaaagaacattattttaccataaatacatgtctaggtttcatgatccttaatgattcatgttaattctcttcccccaatgcctttttctgttgtgcatatcacagagttttgtttcctggaatatcagcagagagggcagtgggcttggcccgtatgggggaggggagggtcctagcagctggaaagcaaggtcggctgaccaagggggttccttgggctgcctggaaaatggtagttcagacctggtgggagacatttccctatttttgtccatctaggggtcaacagaggcctgaaagactgctctgacaccttccaaacagcccccaggaaatcttaatcagcatctgccaatggatcttttctgcctgggttgagctagccaggagggccctggggcagggtgctgtttgtggctgccaacggctgtggcagccctctgctgcctccttcatcctggggtttttgcctttgtgctacaccaaatgacaggtaggagctgttaagcacgggctctctggacaccagagcaaggggattggggtcacaaccaaaggctgcgggacatctgatttgggctgctgcatctcctgctacagtgtttctctctctctctctcacacacacacacacacacacacacacacacacatacttttctcccaccctcctccccactcttcctagcattaatactttaaagacaaatacacaacagtatacaagaatcaggatgatctggacctgaaaggctgaacacagcagggccctccttcatgaacattttgcacctaaggaaataataaggttaaaactagattcatctggcctttgcccaggggccaccaggacagaaactgtgtaagattagttcctccttaaagcaagattgccaggtaattctgttgcaaagtcatagagaccttaagttatctgccctgcaaatcccactgcctctattcaggctgccgaggcactgctttaattttttgaaagattcaccgcgtcttcttggatttcaagaaaaatcccgttaagaattgaggggctctcttcttcccctcctgacgtgagtgtaactcacttcctggtatgtctcctttccttttggcctacatcctttgtctgttaggtgcttccacatccttatgtcttaaatggccaaaatacgtcacccccactgccaaaacacacaggtcactcgaggtcacaatctggaacataggctggccattgttcagcacacattcttgatctaaatcaatctcaaaccttgctggaatgccctgtaaactggggcaaagtatggtcaccagactaaccattgtccttttttacccctcctgtgacggggctactacaggttacaaaatcgcgctcttcctcctagctactgtgttactctgagatatctgacatcgcagagctaatgttgcctaaattattttcccatcctcttttttttttttttttcggacatcatgcctcctattttcactctctgggaactctgccagtttttcaaggactgggtaaagaacaaaataaatatttgtaggtggtttaaaaggagaagtatgttggttgtaactctgcctgtccaaagaaatgcattttcactgtctttcagatttttggagtcgttaactgggagagcttcagaagattgactttactagtttacctttcagatttgtgattaagggctgggtgtgtgtgtgtgtgtgtgtgtgtgtgtaagtgtgttgggggagggaggagtctgagaaagtgagcaagtacgtagaaacttttttttaaaaagtccagattaagtgattgaaatcgactgtgtgcaaatgacgctatacctcttcatagatgttaatcgggccctaaaaagttagtgccggaaagtgcttacttacaacactcagcatatactctttctttcaaattgtttgggatttttttttaagggagttcactgaaatttgggaggttcaacaggttgctgttttttaatatgtggatcacccgatttgggaggctcactctgcctctgagattaaagagatgagggcactggctcccagcgaaggctctcggccttaatcatgtgtgaaatgttttccttcctcggctgcagagcctcggtggtttgcagcagtggaaccaggcaggcccagttgtgggtaggagaggccgtcacctgttgaggcctcccccccacacccccgcatcgccctgccctggcagagcccagcccccagtccccggagagcgcgcctgaggacggacggacggacggacggacagacctagggacggagggccaggggcaggggagatccaagaggccccgcgctggaatgcagttttctcgggcgagggagactttgcaccggagtggaaaatagtttggggtggggtttcgcaccgtcccctcctccccagccccgggccccctcccaggcgctttctgggagcttttagaactgcgctctgaagtttccagagagcgaggagcttttgcggcaggcagagacaatggaagaaaatgaaagccagaaatgtgagccgtgccttccttactcagcagacagaagacagatgcagggtaagtaacagacccattcaaagatggagttacagggacgcgtgccccttgccgcttgctgctttttataaactgcagctctgggacccggcaaaggaaaaaaaaaaaaaaggcaatttcttgggatggtacattttccaaactgagtagagcatagagaactgtgatttcttaggcttgactttatctctggcacgattttcttaagcagcaaaagaggtggtggggtgatgtcacatttgtagtgcagtgagccatcagcatgagctgtatctctaagcaatgacaaataaatcactaagcagcttttaatcatttccccccggggctccagccacgggagaaaggagctgtttttgtgaaactgtctctaggaccgcagcttccattcattggttgggggattccatgtggcagatgcatgctggctgcaaagtttgtgcagaattttagagttaaatcacagaaaccaggcatgttttattttacagatccgagcagcaggggagggcttgagcatctgggtgatagatagaactctggatcttcttttatgttttaattcaaaacttgggagttgttggacaattttggtaaattttctccaggcagtttccctttaattgtgtttataatagacttgtcttttccgtagggaatttccagaagcttatgttgttccaaagaaatttcgcaccgggttgggtggccagaggaggtccctgctctctggcatctgatgcctgtgatgccaagagctgattctgtgggatcctataggcagcatgttcataaaccacacagccctggaccacccgccccaccctccctcaggttcatgcaggggccagtacacaacaaaaagacgtgcgggagtgcagtgctgtgcgtgggagtagggattatgcacaggggaaaaggtgtgtgttttatgaaaatgtgaaagggaagtaacacatgactcatccacgctgaaaatgcaaagctaagccagtcaggagaacttacaatgacaagagatagaaatcccccagtgaaatgcagaaaacttgaagttttgtaatggctggagaatccctgagtctgaacagtcatctgtcgaagtgtctgccttcgtgctgccaaagcacagcactctccttcaggctaccggggtcagtggcatccagtggaagataaggctacctcgtccccctgacccccgcaaccccccacccccattttctaggacaggatcctacttcaggaattcaacctctgggcctgtcctgaaagagatgactcagattctagaggggccattagaaagggatccatttaagaaatgactttccaacaatcagggcaattcagaggcttcagaggctaggatggtcagcctgagacagtgtgctcctttgctcactaattcattcattcagtgaatattgagcatctgttatgtagacgtcactgttttagctgccagacatccagtggtgaacaaagcagactaaaaatacttgccttcatttaacttccagtgtaaggaccaagtttcagggggtggggagctggtagagacagacaatgaacaaataaataaaatatatagcatgttagatggcacggctgctggatttagcaaataaaaatacaggaggcccagctaaatttgaatttcaggtaaacggtgaatttttttttttttagtataagtatatcccatgccatatttgggatatacttatgttaaaaatacttctccattatttatgtaaagtgcacatttaactgagcagtcctgtatcttatctggcaaccctatttgatggaaataaggttacagagaaaaataaagcaggaaaaggaataaggagtgaaactgtaaataggattattagaaagagcttcgctgaagtgatatttgaacaaagacaggagaggtaacagcagggatgtaatgttttcaaagaacagcaagaacatgggagaaggatgggaggaaaagagattgagaggtaatcccaggccagatcacctagggcccatgaaaccattgtaaggactagagcttttattttgaaagaggtgggaatctcctggcaggtgggactactttttttttttttttttttttttttttttagagagggtctcatttgtcacccagactggagtgcagtggtgtgatcatagctcactgcagccttgaactcttgggctcaagcaatcctctggccttagcttccaaatagctgggactactgggacatgccaccatgcatggttgtattgtattgtattgtattgtattgtattgtattgtattgtattgtattgtattgtattttattttattttagagaaggggtcttgctatgttgcccaggtgagttacaaagggatttgtctttttaaatggggtaatactgggtgctgtattgagcacaatccaagtagggttgagggaagggcagggaggcctttaggaagcttctgcagtcaaggaggcaagaaccagggctagcttggaccaggcggtgattagcaggcggtgataagccagcagattctaggtgtatattgaaggtaatgcccaaagcatttcctgtagcctgggcagcatagtgagaccccatctctagaaaaaaaaatttagctaggcatagtgccctgtagtcccagctacttgggaggctgaggcaggaggatcacttcagccaggaggttgagactgcagttagccatgattacaccactgcactctagcctgggtaacagtgtaagattctgaaagaaagagagagagaaagacagagagaaagagaaggaaggaaaaagaaaaaagaaaaaaaaagaagagagaggaggggaggagaggagaggaaaaaagaaaagacaaacaagacaagacaaaagcaattgctaaaggattcaacttgggatgtaagagaaaaagaggagtcagagacaacttccaaaattttggtgtaagctgctgggagaacggagttgccatttgcctaagttggggagtatttacgaagaacagatgagagggtgtttatggtttgaggttctgaggagcaatcttttgatagattaggattgagaagtttatcaggtatccaagtggagatgttgactacaatttggatattaatcactagagctgaaggaagactgagaactgagagatcccctaagattgaatctgtgtgcagaagaaaaagtccaaaggatgccccccgaggcagtccagcatctagaggtcagggagattggaaggaagggctggaaaaaatagcaaaagtggaataaaaatccaaattagatttttaaaatcctgttcagttctgggtgaatatgatgctgtagagaagcatggcttcatttttagttctcccggtgagcacgagtgccgcaagggagagcaacatctctgatgctaacatcacccataacgttcatttctatcattgcattctctcttgtgtctgcctgtgtatctgttttacccaatgacaatgtgatattccacagcaaggaccatgttttatttattcacgtttgcatttccagcacctaacagagcactgggcaacctaacagagcactcactgggcactgtagaaggcactcaataatcatttgttgaatgaaaggctaattttaccactttgggactttgagtttattatcctgctatagataaggatccctagggtgatcatgtaacttactgtccaaatgagatccttttgaaagtgaaagggaacactcaaataattttactgggacaacagttgtaacccagagctgttttggcaaactggggtatatgatcaccctaagaatagctctaatcaatgaagcttccatggctgaatagcccggctaccaggtaaataacaatggggaagtgtagcgcatagtgtgctttgcggagtaggcactcaacaattattggtggaacatgaatctaactgtatcatattctctttgaagcccatgggctctacattgtgaccctggggcataggcattccttgggatgactctgtccacagcagtcctgacgtgtgtgcttttgctctggttcctaaggtcttgaaacctctatgcaagtgaagtgctattagcccacctgcttgccttccccactgtctgattggcagcctcccatcgagtgcaagcctggggaatcagatatgcagaagcctcctctaaaacagccccctcagtctctgtacccttatcccgtttcattcttcaaagcacttaccgttacatgacatttagagtctatatgatttgtttgtggttggcctatttcaaatgtggactcctctatgagggcattaagtctgacttgatctacttcacactgtatctcctaactcctttcagtgtgggagcaggcagtcaataaatatttgtatgaatgaatgaatgaatcaatcagtgcttgacacagaatgcttttctgggaagaggagctcctgtctctattttgtctaagatctataccagaaatcctcttcatcactggtaaaattttaaggtactatagaggaatataatgacctggtttcagctgtaatttctgtgctgatttgtatatatattatgatagtaacaagggagctaaccccatcactttgggatgctgaggcaggaggatcacttgaggccaggagttctagaccaccctgggcaacatagtgagaccccatctctacaaaaaaaaatgtttttaaagtagccatgcatggtgactatgcacctgtagtcccagccactccagattctgaggcaggaggatcacttgagcccaggagtttgaggctgcagtgagccatgattgcatgactgcattccaacctaggtgacagagcaagaccctgtttctaaaaacaaacaaagaaaaaaaacaagggagcttgaaaactgagggatgctgtaggattctgcggcctgctaaccgattatgtgtattaatcagataggctaattgttgtaaccaccctctaatcttggtggctttgcatgattaaggttaattgttcactcagacacagcacagtgtgatttctgtggccaggtggatttcctgggtggccgatgaggctcctcctgccttgtcactatggcatcccccacggcgttggagggttctgctggatcctttgtattcaactggccaaagagtaaagagagagagaacgtggaaggttatttgggaggtctaggggccccaacaaaaggtggcccacatggcttctgcccacaatacattgactggaattagtacaaggacccagtgagatggagatggctggaaaatgtggtcttcctctgtgtgcagcagaagagcgttctggtcgaacacatagggctgtctctgccacggtacacccagagaggttgtacaaccagaccaaacagcaactccctatgatgctccctatgacaagagagcttctcagcacaattgagaaggagacagctaaccagaagccactagaaagaagtgagggatgccttccctaagagtctgtggcctacctaatcttgacccaggaataggatctcagggaagccatcagcactgttgctggctctggagcaggtgtggaatgcctgagtggtgcaaggccccaaatcccttgctgcaggtcagctgacccagccagagtaacccgagttgtggcaaagaagctggccttggcagcgcctgcagttgcctgcctgccggacttgcagtgcggctttctccttgaggaggccccatcttccatgagcctctgcgtgtttggtgtctgccccagcccctactttctatgctttctttccagaatgccaaatcctagcctgggagctccttggattcctgaagagtgtccctttagcatttctgcctgccttgtcctcacttctccagggaatgttccagggattttgctcggctttaagctcctatgttgctctttgccctgcttgaagtgagctcccaggaggagttgccctgggctctgcagaggctgggaggggcaggaaagggaaacaggactgcctttcagcaagcccaagccttgccttcatgctacagcttcattattttgtttgacaaggattcccagaatagcgaacagctagacacacccatatttaaatgttaacaccaaagcgcattccaaacaagaaatcgaattgtatttctgttttgatgacttggataatccacacttgagcttttctctattcatgtggataatgaggagttggccaggctcagatctctgacaacatggctgtggaattgtgactaaatgtcctctgcctgatccctctctagtttgtaatcattcttagtttttctccactgaaaagaccacattctccttaaatggctggaatggcagagttgttgcttctcccccaggtgtggggcttgacgcttccaagagctgagccttgtcgaggaaaaggctcaagtgacagatgtgctgaagtgcctttgtgtggaaagtggcgttaggtggctctgagtgctggtgacaggagagcaggtgcctcgaggtaggaggggaggcagacaggatgatagagcattgggcattgggtggaaggcacaaggcaggaaattgagacaaaaggaaggagtgagctccaaaggcaatccgatgtttgccaagtggctgcattgagccttctagccttgctagtggttgatgctttttgtacctttcctctaaatcgcatcaatccttgttaagcaactggagatattttggaaaaatccacaagaaagagaaaaaacagaaaagcaacatgaggtgaaaagtgctaggaaaaaaacaggggtctgatgagtctagtccagtaagtcagggctgctcaaagattaatgtggactgaagattggctctgacccccaaaactctccccttccatctcccttcccaactcatttcaaagaagaaagagggtttattgtcccggctgtcttgaactctcttgatgctctttggatgaaacagaatagatcatatgagcctgtgcagcatagtaaggcaggatgcgactttctgccgttattgccgttggacatgcatggatgtttatctgtatggctgtatgtgtgtatgtagacagatgtgtgtatgcctgcataagaaatcacctttccagaggctcaatcctgttaattcatctagctgtcctggataacttaaaatatattttcttaataatgtcaaaactaatcttccaattccacttaaaagtcaatagcattgctgggtgtgatggctcatacttgtaatcccggcactttgggaggctgaggtgggcagatcacttgaggtcaggggttcgagaccagcctggccaacatggtgaaaccccatctctattagaaatacaaaaattagccgggcatggttgcgcacggctgtaatctcagctactcgggaggctgaggtacaagaattgctcgaactcgggaggtagaggttgcagtgagctgagatcgcaccactgcactccagcctgagtgatggagtgagactctgtgtccaaaaaaaaaaaaaaaaaggtaaaaaataaaataaaatacataaaaataaaaataaatagccagatgtggtggcacacatctgcggtcccagctagtcaggaggctgaggcaagaagattgcttatgcccaggaggtaaaggctgcagtgagccatgatcatgctactgcattccagcctgggtgacagagcaagaccttgtctcaaaaaaaaaaaaaaaaaaaaaaaaaaaggcaagagtgttagatcaagtatacaacaattttggctgatatgaaacacatgcacagcactcaaaagataaagctaaacctcttcagattgcacaggtatttatcaacctgagagacagcatttttggcatctagctttgttcagtagatcctgttatttctctgttattaaggaagagatcattttaaaggtagccatgatgtgagtctaagtgttggaagcgcaacctaaataaatgaaatgacagtttagcccccaatatcttttaaaccaatagttccatcttcttctccttgtaaacttactgctgaaactaatgaaaagtagaagaattgactaatttggctgtgcttttccttcccttccccatcagtgtctgatggagatgctataattagcaatgtaatgagaattgaagggtaaacaagaagaattattcccagaacacacatcaagggttagaagactggaacaggaaaaccagcctgagatgaaaatattttctctgcccaaccaacgggcatctatacctagagttctatatacagatctttctaggcaaagacaagggaaagagtggtggtcacattgctttcaggaaactggtttatgcctagactcttaacacctgttgctttgcaaaactagtgtgaaggattggttctctgtttatctgggattcaactgagcagaactcccaaatattaaatctgtatttttctgcacttaacttgtaaagataaataattggcaaatatgcttctattggaaacttatttttaaaaaaattagaatagttttaaaagatttagaggtagaaggctctttgcatacctaatgttagttcagtcgtcttcattttattcatgaagagaatgacactgagagaggtcacatcatttgttctaaatgtcggattaaagccaagattcctgagatccagcctagtactttttccagggaattcagtggacaaggaaacattattctgcctatatcagcaatactttatgataagaactgttcttcgtgaagagcctgacttcatgaagagagcctgtctaactcctgaagtgcttctgaatgttttactttttctccctaatctatttgttttttttaaaaaagtaactcttttttctgagctagctggaatattcatacctgacaccccatctcccaaccatcgaggatgaatggagattccctttacatgctccccactctcagcattgacatcatatgacttggttgatctgttcttagcagaaaccaacttgtcccttcaaagccagctcagaaggcaggatgtcttaggtccaggctatcaggatgtaccattgctcttccttttcactgtgttttaggtaaagtccacctcaagtaaaatttgtctaagcctttactttataactcctcgattgttactttttttttttttcttttgagacggagtcttgctctgtctcccaggctggagtgcagtggcgtgatctcggctcactgcaagctccgcctcccaggttcacgccattctcctgcctcagcctcccgagtagctgggactacaggtgcccaccaccatgcccagctaatttttttgtattttcagtagaaacggggtttcactgtgttagccaggatggtctcgatctcctgacctcgtgattcacccgcctcggcctcccaaagtgctgggattacaggcatgagccacggcgcctggccctcgattgttacttctgatggtattcttatgcttgcttggtttatgccaatatgagaaaataaaattttcaaatggttcacatgtgtcaatgattacttacgtacagggtgatagctatttttgttcttggtgatgaagcaaatgtttcagaaacccgactgagcttatataagaatcctgttaccagaatgcaactgttattaaaaatacagaaataatcagaatcactggagttaactctttctataattacagacaaggataaggaataaccctattgcctgcacacaagtagcctaaccaagtgttcttgagggttttcttgtttttgtgttttgagacagggtctcacaactgtcacctacccaggcttgaatgcagtggcacgatcatagctcactgcagccttgacctcttggactcaagcagttgtcttgcctcagcctcccgagaagctgggaccacaggcgtgcaccactacgcctggctaattttaattttttgtagagataggggtctactatgttacccaggctggtctcgaactcttgggcttaagcgatcctcccgccttagcctcccaaagtgctggggttacaggcaggagtcgccatgcccaatgaacatctttatttctaaagtacgatttttcatatttctttgattgtggattttctcccctgactgctgcaaagcagaaaaagaaagaaaaagaaaaaagatttgcgaagttaacattcatacattaacaactgccgcaaaccctcttggtgttctgcaaatgagacttctagtgtgaaatcattaattgtgaaccgaatttttttgtctttcagaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccaggtacgaatatgctctcatttctccttgtgtagctcgctctctaatgaacatcgaggaaagcaaacttactttctttgtaaaaggtaaaggatagcttagtggactgtgcatactatttagttgttctggatttctttggggccttgggaggaggaagccgggtgtagaaaacttctgcctgcaagctcagtcttctttgccaatacagcaagagaacaggaggccaggccagagaggaagggcctagagagtatgcagttccccaaaagagtgttcccatgttcaaccacaaacacatctaaacacatctaaagtgcagggaatgaaggggtattatctactgaggaaagcatggcaccaactaccgtgtaccctgaaagcacggagtgcttagcactgtgaatgaatgaagtaatgaatgaatgaatacacaaatacataaatgtattttcagggtaaaatagatcttacagatacagacttgtggtaactccttttccttaaaaagctgacattagggttttgtttctgctcttcttttttttttttttttttttttttttgagatggagtcttgctctgtcgcccaggctagagtgcagtggtgcgatcttggttcactgcaagctctgcctcccgggttcacaccattctcctgcctcagcctcctgagtagctgggactacaggcactggccaccatgcccggctaattttttgtatttttagtagagacggtgtttcatcgtgttacccaggatggtctcgatctcctgatctcgtgatccgcccacctcagcctcccaaagtgctgggattacaggcgtaagccactgcaccccggcctttttttttttttttttttttttggagatgggttattgctgtattacccaggctggagtgcagtagtgccatcatagctcactgcagcctagaaatcctgcactcaagatcctctcatctcagcctcctgactagctaggactacagacatgcagcaccatgcctggctcattttttatttttggtagtagagacggggtctttctctattgaccaggttggtcttgaactcctggcctcaagtgatcctcctgcttctgtctcccaaagtactagaattacaggcatgaaccactgtgcctggcatttttttcttttgaatcacagatgtgctccttctgcatgcgttgctttgtgctagctttctgtcttcacctacctgtttcctctggttattttgacagtcatatagacattacccaactgtggctagggatgtttttgtttcttggctgtgtgcaattacttttagcagatagagcaagtttggggtcacaggagatttgaggcctcctctaccgacctcactggcgagttaccagattgacctttgtgtatggagaatgtagggaaggaagcagaaagcacttaaccatatatgtgacgggtgggggtgggaaggagggcaggatgatattgatttccacacaagggaggaaagctcagtgttttaagtctgctgtcttcccagttaggtgcaaaaattatgtctaactcactcagcctttgattatccatggaaatggagattggcatcagcccgaataattgaaatctatactttattctcaatctcatattcttccttaaattcaatcttctcttctagagaatcattatctgagtggctaaaaatgtgaaacgtgctttatggacttcatgtttgctttttgttcacacttccaacagtcagtaaacccagaagaggagaaaagaaaaagaatcctggttgctataaggatgggctaatgattaattctttgataattttaaaaagactctgggcacagtggttcatgcctgtaatcccaacactttgggaagccaaggctagaggatcagttgaggccaggagcttgagaccagctgggtaacatagcgagaccccatctcaacaaaaaaatttaaaaaaattaactgggtgtggtggcacacacctgtagtcccagcttctcaggagactgaggtgggaagatcactgaagccccaaaatgagaccccgtctctaaaacaaaagtatcaattttgctgagaaatatagaaattggcctgtcaaaaatggtatatttttccatgtcaaaaataatgattattgttactcttcttatttgtagtgttataattattgttattgctgtaataatggtggctttggttaaaacaattacaagggaagcctaattataattaaggttgaaaggagtaatgaatatattttggtgttctcaagctctgatctgctgttacatacattgctagttctgccatggctggccagctgtcccttctctgataatgagggatgaacaagtcacattctatctttctgcctcttttgtactcgaagctgaccatccaaaaggagagagtttttaatgcatgaatctatgtatacatttttattctcttattaacaggaaaggggtcctgatccagaccccaagagagggttcttgggtctcgcacaagaaagaattcagggtgagttcataaagtgaaagcaagaattttgtttgtttgtttttgtttttgttttttgagatggagtctcgctctgttgcccaggctggagtacagtggcgcaatcttggctcactgcaacctccactcacttcaacctccacctctcaggttcaagtaattctcttgcctcagccccccagtagctgagattacaagtatgcaccaccacacccagctaatttttgtagttttagtagagacggtgttttaccatgttggccaggctggtctcgaactcctgacctcaggcgatccacctacctcggcctcccaaagtgctgggatcacaggtgtgagcccccatgctgacaaaaggaagtttattagcaaagtaaagaaataaaagaatggctactccatagagcagccctgagggctgctggttgcccatttttatggttatttcttgatgatatgctaaacaaggggtggattattcatgcctcccctttttagaccatataggataatttcctgacgttgccatggcatttgtaaactgtcatggcagtggtgggagtgtagcagtgaggaccaccagaggtcactcttgtggccatgttggtttggtaggttttggctggtgtctttactgtgacctgttttatcagtagggtctttatgatctgtatcttgtgatgacctcctatctcaccctgtgacttagaatgtcttaaccgtctgggaatgcagcccagtaggtctcagcctcattttacctagctcctatttaagatggagttgctctggttcaaacgcccctaacactgtcattgcccttctgcaagcaaaccccaaccagcattgtaaacaccagagatcggtgtagacatggcctatgaaattgctgcagacatcatctcatcttctgtcttttccactctttttctcctaccacccatttcctctttcctgtcttcctctctgcaatgccatttgttcctcctggaccttctcagtatggactatcccaggcttcctttgcaggaagattacacagccagctgtgagaaggaagtcagataacacacatctgatgctctcctccagatactgaggctcttaataccagatgctcttctggcagctgtttttctggcttcctctcagagaagtatccttgataagaagagagccaatcagcaagatagagaataagatgttgaaagtgatgtatctgccgtctaacatgaaatctcttaaaatctaggttcttttttttttttttttttggaagacagggtcttgctctgttgcccaggctagagtgcagtggcatgatcatggctcactgcagcctcaacctccgcggctcaagcaatcctcccaccccagcacccaccacccaccccgcccacccccagataactgggagtccaggagtgcttcatcatacccgactgaaaatctaggttctaatttcctgctattaaacataagaagaatgagagcatgccttatgtttccaaatctgacttcaaacactggaagattcacggttgcaaaacttctgtttgtctttaaaaaatatgttggtcaagagttttctttagtctaaaattattgaaaggctaagaggtcaccttaactcccttctacagtcttcaaaaaatgcgggtggcccttattgcaacataatgctgatctgcataatagtagctgtgatcgttaaggactcttatcagcataaccttagttgtgcagggcagtcaggctgtacagcctcattgcctggcagctaagggcttggtttggatgcaggtgggactcatcaggatccagccttcacaatatgctaattctatgatttgggctaatagcttaatctttctttcttttttctttcttttttttttgagacagagtctcactctttcagtcacccaggctggagtgcagtggtgcaatcttggctcactgcaacctccacctcctgggttaagccattcttgtgcctcaagcctcccgagtagctgggattacaggtgtgcaccaccatacaccatacccagccaatttttgtatttttagtagagatggggctagtctggaactcaagtgatctgcgtgcctcagcctcccaaagtgttgggattacaggtgtgagccactgcacccgaccttaatggcttaatctttctctgtttcagtttcctcgtttgtcaaaggaaaatagtatctacatcatggagcactgagaaatacaacgatggaatcttttactgtttcactggcagcttttagcgtgataatattctggtttttagtgtcccaaagaagagtctcagaggctcttatttttaaattagtacttaaaatcatttgacttttttttttttttttttttgagatggagtctcactctgtcacccaggctggagtgcagtggcgcagtctcggcttactgcaagctccgcctcccaggttcacgccattctcctgcctcagcctcccgagtagctgggactacaggcgcccaccaccacgcctagctaatattttgtatttttagtagagacggggttcactgtgttagccaggatggtctcgatctcctgacattgtgatctgcccgccttggcctcccaaagtgctgggattacaggcgtgagccaccatgcctggcccaatcatttgacttttttattttttcaagacaagatctcactcttgtttagagtgcagtggcgtgatcacagctcactgcagccttgaactcctgggctcaagtgatcctctcaccttagcctcctgagtagcaactacaggcacacgtcaccacttctggccagttttaaaaattatttgtagggacagggtcttgctgtgttgcccagattggtcttcaaagcctggcctcaagcgatcctctcgctttgacctcctaaagtgctgggatcatgagccactgcacctggcctcacttgacttttttgtcaacaaatatttgagcacctgaagaggttaattttttccattgttaaagaataactttattacatttctgaaactggtatttttctttcattcagtgcttagtattcatatttcttttatttatttatcccatatatatttatttggcacctaccatggtaaaggtatttgagaagaatgcaaaccattggacttaaccctgtcttcaattcagtaaaagaaataggcattcacatataaagaatagtctttccagatccagcccagatggcatgccttctgagatggtcataacattgcagtactgcagtacttacattgtagcatctaatcaggttgcattacatatattttttacatttctttttctcacctagaataatcttctggaggtagaaaccttgtcttaccacccatttcttctttcgcctctgtaaactcagcatttaaaggaatacacaacctagattaggctagatccaaaatttctgttgcgtgaaggaatgagccactatttctaatacagttagaatgtgatagatggtacagatagagaggggtacagagccacagaattcaatgattgattgcagtttgagcagtcagaaagaagagatttcttaactaagaagttaggaatggctaagtaattttcccctaagttaagaagtcaacatttgaaccagggccagaatttcctgtcctcagaggaggtctccaggaaaaaaaaaaagaatttccagtttatggtcttttcattcattatgggcctatggaccttggttttcttaaaggttttcttccacctctaatttttccaaagtttgttgacatcatgtacatcacattgggtcaagcaatagagccatagacatgacttccattgccgtttctttaaaaaggcaaatctgactgggtgcggtggctcacgcctgcagtcccaacactttgggaggctaaggcgggcagatcacgaggtcaggagatcgagaccatcctggctaacacggtgaaaccccgtctctactaaaaaaaaaaaaatacaaaaatacagaaaattagctgggcatggaggcacacgcctgtagtcccagctactctggaggctgaggtgggagaattgcttgaacccaggaggcagaggttgcagtgagccaagatcgcaccactgcactccagcctgggtgacagagcgagactccatctcaaaaaaaaaataataataataaataaataaaggcaaatcttactccattccagagcatattaaataaccaataaccatagaaaatagattcctatctgtattttatataaaaagaaagttgcttcttttaaaaactctgagttcagaaagatctgtagtccagcaatccctcacagttgtggtcactgtgtaactgcacagtttggaaatgctattttttatgtcttcattaatgaatagatgttgatggcttcttacttgcagaaaccaactttccactcctagtctcagaaaccattctgaaattaatttttcaatctttactcccagttattcacagaatttctacctaacttacttggtatatagaatctactctgtggtttcagttagtctatgtggattcttttatctgatgtgctcagatcataaaagaaacgaataatacattttaacctaaaaatctgacatgtccaacaaagagtaagagagatataaagggattattattattattattattatcattattttgagacagagtctcgctctgtcacccaggctggagtgcaatggcgcgatcttttctcactgcaacctctgcctcctgggttcaagcgattctcctgcctcagcctcccaagtagctgggattacaggggtccgccaccacacccagctaattttttgtatttttaatagagacagggtttcactatgttggccaggctgatctcaaactcctgacctcagatggtccacctgcctcggcctcccaaagtgttgggattacaggtgtgagccaccgcacctggtcgggattattctttaacatgaacattacagggggcaaaaataaggagataagaaaatgaacaccaatatgagcactttttttttcttttttttgagtcagagtcttgctctgttgcccaggctggagtgcagtggcgcaatcttggctcactgcaagctctgcctcctgggttcaggccattctcctgcctcagcctcccaagtagctgggactacaggcgcccgccaccatgcccggctaattttttgtatttttagtagagacggggtttcaccgtgttagtcaggatggtctcgagctcctggcctcatgatccacccacctcggcctcccaaagtgctgggattacaggcgtgagccactgcgcccggccaatatgagcatttgaaacagggtcagtgaggccaagaggtcattcttctggtttctcccatcagaccagggctttgctgctgtctgagtgcccctcaggcttccttagggtcccctcctcaaccatcccctcctttgaatgtgtttgtgtaaaaactgctctggagaccaggagagctggctcacacctataatctcaacacctagggaggctgaggtggatcacttaagtacaggaatttgagaccagcctgggcaacatgggaaagcccctactctacaaaaaatacaaaaattagatgggcatgatgactcgtgccagttggggggctgaggtgggaggatcaattgagcctgggagatcaaggctgcagtgagctgtgattgtaccactgcacttcaccctgggcagcagaacgagaccccttcttaaaacaacaacaacaaaaaatcaaatataggttatcataagaaagctgcaaagagaagtatgtcttaaagctgatgtattaatcaggattgtctattaggttggtgcaaaagtaattgcagtttttgccattacttttgcaccaacctaataggttatgctacttaacaaattaaccctgtgatttattaatatttgtggtattttctgatatgacagagaaacattttatttcttacacacacaaatcttattctcacaatgacttaggaattctggctacttccctcttgcgatcatgccatctcaacacatggattccaggtcaccatgacagagagagacagagctgatgggttgtatacacgctcttaaatatattggcctggaagtggcatatgtcacttcacttcatagtagcttcttggttctagtacccactgggatatttgttgtattcaggttttggctgtggaatctagcttaagactaaaatcttcctgctctagtttgtttcatcagctctcccaatgtaattgattattttatcaattttgttatacctagcactttatctgtacaatgacgtcattggcatttttacagaatataaacatattaacagatattcctatctgtaagtaatggcatctatgtctttgtgacttatttttgatgaatttaattgtatcaaatcaaattgcagaactccagcatggactatgctgtatgctgtagatctcagggagtcagtttatacctcagggaataaacgtactaccctctgttatgtgtgaaaaactccaaattcattagatatgcatctgtcatatttgtcttggctctgatctatatctgtctattcaaaatttacgtacatgcatctatatttatgaaggtaccttccagtgaaggctgaaaagtaaggctaattgaaattaagacacatgtatactatacactgttcagtaagtcgcagcctttggccacagtgaaggtctggatacaaggctaatgttgtagaaagtgtatgttttgaaaaactaggcatgttttgtaaataaataaataagtaaaaagtttagaaatggaactagactcagctaagaatttcctcttcagagctattaatttattctaatccaatggcgaaatgatgggagaatagccacatgtagtagaagcagctacttagttgtgtgaactaatgactgaatatgagtttacagagctgtttcttttttatttttattttgtttatttatttattcttttgagatagagtcttgcactgttacccaggctggagtgcaatggcacaatctcggctcactgcaacctccgcctcccgggttcaagcaagtctcctgcctcagcctcccaagtagctgggattacaggtgcccaccaccatgcctggctaatattttgtatttttagtagagacaaggtttcaccatattggccaggctggtctcaaactcctgaccttgtgatctacctgcctcccaaagtgctgggattacagtcatgagccactgtacccagcctcagagcagttttttacctaaacttttgggaggaaaggacataaattttttagcaattaagaaatctagtatactgtgtgcacagcaaataataatagcaccaaaatctcacaaatcaccggtgaagaacttactcatttaaccaaatactacctattcctcaaaaacgtatagaaataaaaaataaataaataaaatattaataagccacaataggaagagggaagaaatatccttatgcaaactatgaagaacacagagaaagccagtaacatgctcagtattttttttagcactgttttctcaacaaatatttataatggtggaaaagactgtaaggagaacgtattatttgccatcagctaaaattgctgtgctgtttctctttacatgtattacaggttgagtatcctttatctgaaatgcttgggaccagaaatatttcagatttcaatttttttggggggtggattttgaaatatctgcattatatacttactggttgagcatctctaatttgaaaatctgaaatccgaaatgctccaccatggcctttgagtgtcatgttggtacgcaaatatctcagattttggagcttttcagatattgaatttcaagattagggatgccgagcctgtagtgtagtccatcctctctacaactctgttgggtaggcactactatttgttttgtttttttttttttttttttttgagacagagtctcactctttcatccaggctggaatgcatcttggcaggtgcgatcttggctcacagcaatctctgcctcctgggttcaagcagttctcctgcctcagcctcccaagtacctgggattacaggtgcctgcaaccactcctggctaacttttgcatttttggctaacttttgcatttttagttgaaatgtggtttcaccatgttgcccaggctgatcttgaactcctggcctcaagtgatccacccaccttggcctcccaaagtgctgggattacaggtgtggggtaggcactactattaactatagttaacagaatgggaaactgaggcacaaagcagttcaggcttgtctgaggagacacagcaagtaagtggcagcaccagtatttaaatccagttatcttcctgtgggagccttgctcttaaattctagatcagaccacctctctgatgggggatgaaacagaaagatgttctgaaatgctaaggaaaagaaagactggactggggaccagtctgcctcgtgtcagtaagtgtgaatgagatttaacgctcatcctgcaatggatgaagtgccagcgtcctggttggatttgcctttaataatttgaagaagaaaaggagtttggcactgaagaagcagtagtgtgcctgcctgtagtcccagctacttgggaggctgagctggggggatcatccatgcccagaggtcaaggctgctgtgagctgagcagtgatcgtaccactgcactccagcctgggtaacggagtgcgactctgtctcaaaaataaataagtaaataataaagaagcagttgcatacatagtggtgagtacgcagaaagtgaaaactgagaaaaaaccattttcagagcaagcactgcacgtgaaaggagtatggtgtcataacagaatcacaagtcatagctggagaatttacaatattgtatgtgcgagtgtatatttaatggaatactggaggcccgtgagcaaagaatatgataggatcgaatcagtagaaaaacatctcttgtcctcagagaaattccagataatgttagatatgtctaaggaaaatcaggatgtggtcaatgatcaggaacaatagtcatttacatttggatatgatgaaaaacaaaagtaaaaaagaaaaaaaatgaacagaaagaagagcctaagatctaagagagatgatgttcctcaagggatgagatgaaggagctagcttggatgtgatacctggaggactgatttatttttcactcttgggtttttttttttttttgagatggagtccggctctctcacccaggctggagtgcagtggcatgatctcggctcactgcaacctccacctccggggttcagccttctgcctcagcctcccatatagctgggactacaggcatgtgccaccacgcctgagtaatctttgtattcttagtagagatggggtttcaccacgttggccagggtggtctcaaactcctgacctcaagcaaattcacctgccctggattcccaaagtgttgggattacaggcgtgagccactgcacgtggccgaggactgacactttgagttgtgactcaaaggtcgttgaagtacatctcagaagatttggaccattacatagtaggacatcttgcggcagagactgaacaattgaaaagactaaattcaggggttgtagttttacttgcaaaattgacgtacagttgacgttaatcacccagaatgcagaaaaacagcaaaggaatcctaaatggggatcattcataacacatcgcttttgatccatgtttaattgggtgccaccaacctcagcattagctttcattttaattagtgacatggaagagcaagagaacatatcttgagaacagtgctatattaaggaaagctctgcaagaaatcaaaataagattctactagaaaacctgctaaggagtgcccgggggtaggtggggaagtatggaaaggcaagaaccgaagtctagctaggcagtgtcaggagacacctggaaagtggtagtcagctagaggaaattgccacaaaattagatggaaattttcagtgttgagggatctaaaaaagaccaatgtgattcagtccagtgcatagatgcagaactcatactgcaaatgtccaaattgtccttcctgtcttttcttgtcaaacttgagcctttgccatttattcattcttcctgcagttatgttcttggattaattcattcaaatgcttatttatttattagggatctacatttcgaggttggcattgaacattatataaaaagtacaaggccgggcacagtggctcattaatcccagcactttgggaggctgaggcaggtggattgccagagctcaggagcaacatggtaaaaccttatctctacaaaaaaaaaaaaaaaaaaaaaaaaaaagaataaagaaaaattagccaggcatagtggtgtacacctacagtcccagatacttaggaggctgagatgggaggatcatttgagcctgggaagtcaaggctgcagtgagtcatgatcattccaccatactccagcctgggtgacaaagcaagaccctgtctcaataaaataaagaaataaaaataaaaagtacaaaacccaacatctgccctctcttagtccatttgtgatgcttccactcatgaccaaaaggggagcctctgtttgcagagatcacattgtctgagaggatgcaagagtgttgaagaggtgccaggctctttttaacaaccagttctcatgggaactaataaagtgagaactcattcacccctaagggagagcattcatcccattcatgagggatccaccagcctccataactcaaacacctcccattaggccccttcaactttggggatcaaatttcaacatgagatttggaggggacaaatatccaaaccatagcatgcactgccaaagagatatctctttagtggaaacagtacaaacctttgggtatgatttgagtatgggatgatccaggaatatttaatttagtattgaatttgcaagtagttgaggctatcattactcatttataattttgttagatgtgatcagagagtgcaatctctaaaattcttacttttaaatttcgcttaaagattggtttacaaagtttttcttagaataaaatacacaatcagtattgcatagatattcatggacatttatctattctgtattctatgcacatacatacgcacacatatatattgggtttgttgattgtattattcatttcttctcagtctttattttttaaggttgttcacttctgagcaaagtataacaaagtctcccatatcattgtatttttatctttttctccctgcgttcctaagaatttgtttcacaggtttttagttatgatcacaccttctctataagttatgtctttaacattaccagatgacctcttcattctgtttagtgtctgttaactttttaaaaatattatctctcttgatttacatttgtttgcatctgtcaggtatgccttatcattcattttcaatgtttttgtattaatacaggttgagtatccctaatctgaaaatccaaaatgaaatgttcccaaatctgaaactttttgagcaccaacatgatgctcaaaggtcatgctcatggaagcatttcagattttggatttttggattagggatgctcaactggtagctatgtactgcaaatattctaaaatccaaaaaaaaaaaaaaatctgaaacctgaaacacctctggtcccaagcattttggataacagttactcaacctgtaatgagcgtgtttattagaaactacatacatatatatcggccgggtgcggtggctcatgcctgtaatcccaacactttgggaggctaaggcaggcggatcacctgaggtcaggagttcgagaccagcctggccaatatggtgaaaccctgtctctactaaaaatgcaaaagttagctgggtgtggtgacgcatgcatatagtcccagctactcagagctgaggcagaattgcttgaacccaggaggcagaggttgcagtgagccgagatcatgccgctgcactccagcctgggtgacagagcaaaactgtctcaaaaaaaaaaaaaaaaaaaaaaagaaactacatacaaaaaacttggctttgctttttcagcctaattcgttaagtctgtttttaatgggaaattccgtccactagcatttagtgtaacaactgatggacttaattatattcctccatcttaatttgacagcaagtactgtatgtctattcttcttctctcttaaatgtggctcatgctatttaaatgcgaaacaatggcttgagtttaggtcttgacaagctgtatctgaaatgacagtggttgctccaagtgaaaatgactgttagacaattggagataaaataggactggaccctatgccaggaaacaagactagacagatacatgttggagggatcagctctattagtcacagttcttcagaatatcagagccaatagcagaattcctttttctttgggggacctcagtctttgcttctaaggtcttcaactgattaaatgaggtctactcacattatggtgggccatctgccttactccaagtctactgatttaaatgctaatcacacctaaaaaatacctttacagcaacatctacactggtgtttgaccgaacaactgggcaccataacctggccaagttgaaacatgaaattaaccatccccctctgcaccaacagttgacagaatgtgaatggataatttctaaaaacaagtaacaactacaatcaaacacagagccaaagatcaagggtttagcattagagaattaccacagttggggtccatgtttcattaaagaatccaagcattcttatcttttggtgatacttgtagtgtggtcttgacttacgaaatgtatatgtgttgttttctacctttttcatgtttgacagtttttctttagaccagaacttcggattgcagctatttcttaagagttgctatttcattagccttatcaacatcctagagatctgtttgccctggggttttgagggctaagccctgagttgtaatgcattaactctgttctgtgcagtccttctaggactaaatacagcctgcagctaaatacatactgcttctccaaggctgctgctgtgctgatgtttctgtctgaactaccccagactccagtaccgtctgttaactccgtatctcggaggatctgcagaaggtccgcgttgaccctttgcaatccagtatgcactttcaggctcatctactaaataaatcctttcagcatggcttcgtttagttaggctcttagtatcccaattatgagcaattttattaaactaggagtatcagtgcctggtagttaagtacaggtgttttgggtttaaatctcgggtcagcctgagttcaaatctcagctccaacacttaatagccatgtaaacttactgtaattacctaacctctctaaagctcaatttctccatttgtaaaatgggaataatgattgttcttacatcatactattgctgtgaggcttaaatgagataagggttggttatttgaatgataaaaaaattgatattttgcttgaaagaaagtattccttttctacctgacaacttccaattcatatttcttttctcttttcttttccattctttttctttttctttttttcgacggcgttttgctcttgttgcccaggctggagtgcaatgggcagtctcggctcactggaatctccgcctcccagattcaagcaattgtcctgcctcagcctcccaagtagttgggaataaaggcatgtgccaccacactcagctaatttttttgtatttagtaggtttcaccatgttgggcaggctggtctcaaactcctggcctcaggtgatccaccctactcagcctcccaaagtgcttggattataggcgtgagccactgcgctaggctcatgtttcttaagaaacaaaaattcaggccataaatagttaagtctaacctctttccccagctgtttgtgttcttttatctttgtgagctttttcagtgaggagtttttttttttgttttttttttgaggcatgttcttactcagttgcccaagctggaattcaggggtgcaaacatagctcactgcagcctcaaccttctgggctcaggcgttcctctcacctcaacctcccaagtagctgggactagaggcacacaccagcacgccgggctaatttttgcactgtttgtagagacggggtattgctatgttgcccaagctggtctcaaactcctgggctcaaaagatcctgctacctcagcctcccaaagtgctaggattacaggcatgagccactgctcctggcccgttttctacctctgctataaaacaggtttgttgaagcgaattcaagacagagagtcttatttgctctccaagtcaatcataggtacccatgatgttgctaaatttagaaaaaatagctcatctacatgcatttattgagctctgatttgattagtatgatgctaaggttgccatcaggcaaatcacaatgtcattaaggcttagtgagatgtttttctcattcagggatggtaggaaaaatcgtcactggactggccacctctaatcaactcttggcatttctgcccagccttcgtgtgttgtccttattgctgggatccttgttgccaaacactttcccagctctaagttgttcaagatctctctgtcttgatcataataatgtcaatgctggttacaaatttttctcttgggtttacctctgcctgtccactgaggaaacggttaatggagttgctttcccatctgaattctttctggactctctccatttgcctttacattctgactcttctcgctctcttttccaagcctgaattcaataagcaaaagctgagatactgtaatttcctaaataacccaaagggaagatctggcataatttataaccactctgactgctgaatcaacttgcacttgctcttctctctaatggaactttgaagaataactgtaattgaatagtgcctccaccccatcttcagatttgactgaatcaagcctagatctggttatatctggtttttgtttgtttcatgttgtgtttgtgccccactgagtataaagcccaagtgtgggcttcatctggatgtattttcatctcacagagacattaattgaatctctgacaatagtcttgcctccgaggagtgctccaactctggctgcggtattaaaccaaggtagttcttggttgccttcaaaggtaacctcccatctgttgacagtgaactacggcaatgcaacgcttacagaatcattggaggagaggatccaaagcgtttacaattccctgctatgcaaagagtcattctgagtttttttaacctatgattgctctctgtaaatacctgggtgcacccagcaaggtgtagaggttaatgtttgctctctgacctttgaagacagatgcactgaatatgttgcagtttgcaatgggatccgtggcaagttaacagcagactgctccttcagctactgctgtttccaaaactctgcagtgtcacatcttgctcgcggctgcctcctcagaagtgcttctcagcttccattcagctccctgctgagttcctctgaagaactttgtactgtggcatatgacagcgacctgataacattatgataaactcctatgggtttgaactcagtcctattcaaattttctggtgcctagtggtcagcagtcttagacctggggagtaagaggtgtgtctgcagtgaatttagaggtgagaagaaagagggctggactcagatattgagtatcttagagcctacggaccatttcccaaagcctagaatagatttcagcgtaattctggtaatttacataaactaggatagacatgcaaaatatctggatatgttaggaaggagttaaaaagttctccacaccttttcctaccacctctgcagccatagaagccgaggggaaatgcacacacacacacacatacacactctggcagggaacctgttttgcaagttttgctggtaaaaagttctaggaagggggctggtggagaacagagtggaaaagaagtatcaattgaaggtttttcaagacctgagttttcaaggtaactttatcctgcagagagagacacgcatggccgctgtaggtttttcttccaccaattaagtgcattgttagacagggaggggcagattaacgaacgcctataattttgatcattgttttttgcaaaacagctcaggctttgaaaatgaagccatcgttcccggctaagtttctgccaacagcacaaattatactgtgcagagatccaaagcccctaagaaggtttcattaatgaacaatttcagacgattgtttaagtcttcgcctgacaggtaatgttggcatgtcggcaggtggggttagggtttccatggagatttatgatgtcatgcttgaaagagcatgtcaagacagccgatttaacaagtagctactcaaaaagtcctataggctacaagtaggttttatgcaaatgacgagagtttcactgggaaaaactgcaaaagaaaacagcccagacatggaggggggttttacctgacagctccgaaggaagaccctggagtccgttccagacaaaaacttccagaagaattagattttctgctttaactgccgcctcacctgtggagctctgggtacaggtaaatatgcggggtttttttcttccaagtttttgccaaaaattatttggaaacatttcgctctgtttctcggcattgttctcttggcaggaagaagtgaatcaataagcccagctttcccatagcaatgttcgtgctaaagggctgtttttaagggcttttttttttttttttattgaatgaactgagatttttgaatagagctgaaaacaagcgatgcattgtgcgttctgctgattgtgcccggtgaatactgctataaaagtgccacagataagggttagatggacaatctgaaaattgagatgctccatgtatttcttatttattcccagatgtgtgtgtgtgtgtgtgtgtgtttgtgtgtgtgtgtgtgtgtgttcttttactcttacgacaaacctgaaattgagactatgggtagttttgtattttcacattgtaaaaatgccaaaaataaaatccatggaatgttgcagaaataatctttgaatcaggtttatgaacattgcacttttttaaaagtatgtatctgatgcttttctcaccgaggcatttttcccagactagaaaaaaacagtcctgatagagacatccagtttttgagcttttagggaagcaggatttctaaattccaagaagatagataaagacttcttggaggaaggtggggtgtgggtgataaaggtagtttttaaagcatggtttaaaagaaaatactggtcacttgggagtatgagggttttttttgtttgcttcggctgccagtgaggataagtaaacagtcttgccagccatttggatgtgatagcaatcactggatgcggctgtggatctgtgagttagctgaaaggggttagttcagaggcatcagttgccctgtgagtagttagttccaccaagcttaaaaagaacacaaagaaagcctattgtttcttccacacagtgcatggcagcgtgtgaggttaaagcggagttcagaatcatcgaaagatacctgtgaaatgggaatttggacttttgaaactaaaactacttaggaataagtggataggctttcaaaatgttttaagaactgcctcatgtgtgagaatgagacctcctgaaattttgcagttagataatgtggattaatgccagaactcacattcatattaaattgttaccacagttattgcaaaacagtgagtgacaaagaactgtgcctccaacatcggaagttctgggcgttgagttctggcttcaccacttagtggctgtataactagaggaaagtaaattcatgtccttaggcctcagtcatcatgtccataaaatgggatgccagtagctagctgtgttgtgaggattaaataacaaaacagacgtagcacagttctaagcattcatgttccaaatgttaatgattgtttttattgactgctgaaatggcattggatatttagaaagtgtttttatattctttacttcctcttatcattacaagtaatgactagcagtcaagtaaggctagtagtctttttttttttaaaaaaaaaagacagggtctcactctgccacctaggctgaagtgcagtggcgcgatcttggctcactgcaacctctgcctcccggctaaagcaatcctcccacctcagcctcctgactactggtgcatgccactgtgccaggctaattttttgtatttttggtagagatggggtttcaccatgatgcccaggctggtctcaaactcctgggctcaagtgatctacccaccttggcctcccgaaatgctgggattacaggcttgagccactgcacccggccttggctagcagtctatttccactttacagatgcagaaactgtggctcagagagttactgggaaatacgacataataaactatcctatactgcctgcactttttctcattttaggaggcatagaaaaaaaatgaatgtgttattgaaataactcccagcagcagcaatgattctgtaaagtaattaaaatacaaaatgttaagtatgccaaaggagccagggtatttatatttttatattaattatgcttttgccacttttttctagacaggctacagaagtgatattaatttactttttactggtacctactgataggagctccagtactgcacagacttaaaattttaaattctacctgcctgaaatttttcttggccatacaagtagagtcggattttaatgttacaggtattttcggagtgagaacccaagtcaccaaggggctgtggttgctacagggtgcagaaggagcctaggagtcgaatatactgtcctttattccttctgtattctagacgttggcacttcctcccttgcctctatcccagacagaaacacagcccataattatatcctacatccattgtatgtaagagacaaatatgtttttcattgtgctatttttagccacagtgtttctagctggggaaaacactctcttcattccagggttttcttaacaatttttccagtttttccatgtcagactattcagaattattcaggttccacactcctgggagaaggctcttaatgaagtattgagtaggctcatcgagggggattctagagggattttggcatctgagctgctgagcctgaactcattctatgacagatgatgtctgtggtcccatgaattaggctgcattgaggactctcattcccagcactgtttgggggcactgggaaaaggttgagttaccttatcccaagggtagatctataaggagaaaagcaaatatttatttatttgttttaaatttctgcttttatttttagatataggaggtacatgtataggattgttgcatgggtatactggatccagataatgagcatagtacccaataggtagttttttaacccacatcccacctccatccccactctagtagtccccagtgtattttgttcccatgtttacatccatgtgtgctccatgtttagcccccacttgtaagtgagaacatgtggtattgggttttctatttctgcattaatttgctaggaaaatggtattcagctccatccatgttgctgccaaagaaatgatttcattcttttttatggctttatagaattccatggtgaacatgtaccacattttctttatccagtccaccattgacggacacctaggttgattccatgtctttgtggatagcacggtgatgaacatagaagtgcatgtgtcttctcggtataatgatctatattcccttgggtatatacccaataatggcattactgagtcaaatggtagttctgttttaagctctttgagaaatctccacactgccttccacggtggctgaactaatttcactcccaccagcaatgtataagcactccctttcctccacagcctcaccagcatgttattttttgactttttaataacaaccattctgaccggtgtgagatggtatctcattgtggttttgatttgcatatctctgatgattagtgacgtggagcattttttcatatgtttgttggcttcttgtatgtcttcttttcagaattgtctgtttatgtcttttgtccactttttaatggggttgttttttgcttgttgatttaagttctttacatattctggacattagacctttgttggatgcattctttgtgaatattttctcccattctgtaggttgtttgctctgttgatggtttcttttggtgtacagaagctcttcagtttaattaggtcccacttgacaatttttttattgttgcaattgaaagcaaatatttatttcattcaaagttttagtttcaaatatgaatcacaaagctgcaattttagggtagaaaagagttttgaactcaaacatggtgccaaaactccaaataggttttgagtcactgatgaaatgtttcttaaattttattttattttcttttagattcagggggtacatgtgcatgtttgtttcatgggtacattgcctactggtggggactgggcttctagtgcacccattattcaactagtgaacatcataacccataggtaatttttcaaccctcacccccttcccaccctccctccttttgcagtccccagggtccattatttccatctttatgttcatatataccaattgtttaactcccgcttaataagtgagaatatgcagtatttgttttttttgtttctgagctagttcacttaggataatggcctccagctccaaccatgttactacaaaagacgtgtttcattcttttttatggctgtgtagaatattcacatatatacaggaatatatatatatatatacacatctatgaatgtgtagaatattcatatgtatgaatacatacgaatgaatatatatgtgtgtttgtgtgtatatataggactatatatacacatctatgaatgtatacaatattcatatatatgaatatataagaatgaatatatatgagtttgtgtatgtatatatacatatagatcctgttttagaagcccagtgaagctttttattacacttaattgtcgtagcgttcagagattatctttgatcaataagtagcgatcgcattgagcagagcactttacacctagtgggttttagcaaaggcttgtaaatcagatgggctgcgtgcagtgactgaagaagtctcctgcctggattcggatcctgccttcattacttgctcgtagcacaggctttccactgaagagcatatgaagttttgttcatattccaaataaaatagagcatctgaatttccaatgcctcttgataaaggaattagtggtctttaagtattacattattctctttgaatgtcatttttggaattttcacagaaatgatttcttcagaaagaaaggcactgaaaatttaactggaagttcctctcggctggctaccggggaggtagagagcagagagttctcctgggtgggagggatttctagaagctctttacagctgaggcccttttcatcgctatttattaatttgacttgatcagaagcaatccagttttgaaggtgtagtttctaaaatctctttatttcaaagaaagtcatcctgaagaatggtgtcatcccagatgaccttgctttttctcttcagatgtctggccacagaagggatcagcaggtagaatgggaaggctgttttcatccttgggcattaattgggcttccctcttttctttctttcttttttttttttttttttttttgagacatgtcttactctgtcacccaggcgggagtgcagtggcgagatgtccgcttattgcaacctccgcctcccggattcaagtgattctcctgcctcagcctcccgagtagctgagattataggcatgtgctaccatgccctgctaatttttctaattttagtagagacagggttttgccgtgttacccaggctgatctcgaactcccggcctcaagtgatccgcctgcctcatcctctcaaagtgctgggatgacagacatgagccagtgcttccggccagcttatcctaacggcaggaagctttgatacttttacttcctgaccacagacttagtaggcagcaggaacagtcttcaacttcctggttgtataattacaagagccaatgtgaaatattatgcatttggagaagcccttctctagagctcttatagaaaaggaatgtacagccaagtttatgggaagcatgaggatggtgagtccaaagtcaaggtaggtgatagcattggtggccccttgcagcaccgggagtctatatggcggtctaacttcgcaccccctatttgtcacttcatagcactcttcactttcactccgtttcacttgctcatgattaagcaacaaacgtggtaatggtgtttcctactctgagtttcactagatttagtaaacgcacatgatcatgctggtcccgtcgaagtgacgataggagtcctcggagctgtggtctccgccctggctggttgcacctgctctgtgctctgctcagatcatacaagatggagagagcagagaccccatcagagagaggcttctgttggctgcagtgtgacactgtagacttgccagaaagggctctctttggacctactacttgccactcagaagcaaatgggctgcagcctcatacgtttttggagtgaataagagaactaagattctgatggacccttggtgattttctctcttcaatattatgaatgttcatgaatgcccctcagaaggtcacagggatgtcagatctcattttctccccttccccttccccttccttttcctttccgagacaaggtctctctttatcactcaggctggagtgtagtggtacaatcatgtctcactgcagcctcaacctcccgggctcaagcaatcctcctgcctctgtctcccaagtagctgggactgcaggcatgtaccatcacaccaactaattttttttttttttcttttaggtagagccagggtctcactttgttacttaggctggtctcagactcctgggctcaaacaatcctcccactttagtctccccaaaagtttagatcaaaggtgtcaaccactgcacctggccaggtctcattttcatagcagtcactggtagtaaggtaaatgtgctgcagataatcgtttggcctgtgttttggagggacctttttgttttttaattgtctctttgaattttgcacaaagaagggttgcacgggctccgttcatctttaacttattatttgcatccttttttatgataagttttaagactactgaagaaagcagctccggtaaagagcctcacaaaggccaattttcaatttctcccttgtgggctgtgtgtgtgtttatgacggtcagaagaagacagactctcatttaaaactattctctcttcaaagcaattataaagtggccccatcatagataaacttgaccccttttaattgctggttagattgcttcttttttctctccctgttgtgaacaggactgcagtgaccatccttgtatctgtgcatgtgggaacgaatctgaaggacaaatttctagaatgtcaagttggattgctagttttggaaggtattgcccaaactttttctcaaaaacactcagtttattctgtcgatatgaatgttgcaggggatattatggtacgttcagagaatacagttcactacagtgatgccaatgtgtgaaatacacttgacatgtgggtaggaacacataaccaagttatatttagtaaacaatctaccgagcagtagagttaatatgatcccatttattattttattttctaacaattactagtgatactttagtttggttcttgcttttctaaactgttaaccgtgaacatgtaactatttaaaacttatgctgggtttgctgggtcatgtctgtaatcccatcttggaagccaaggcaggaggatcagttgaggccaggagtttgagaccagcctggccaacatggcgaaacccgatctctactaaaaatataaaaattagctgcacacggtggtgcgcatctgcaattccagctacttaggaggctgaggcaggagaatcactggaacccgatggcggaggctgcagtgaacggagatcacaccactgcactccagcctaggtgacagagcaaggctctgtctcaaaaaaaaaaacaaccatatattattcattaaatgcatgttcatgcttacttaaccaacagtatggccctttggcttagtctcatagtctatctgacccttattttcttttcttttttttttttttcaaatgcccctttcattatgaaactcttttttaacttttaatttaagttcaggggtatgtgtgcagatttgttacataggtaaacttgtgtcatggggctttgttgtacagattgtttcatcacccaggtattattttattttcattttagttttttaaatttctttttagaggcggggtctcactgtgttttgcccaggctggtctcgaactcctcctggtctcaagcaatcctctcgcctctgcctccccaagtgttgggattataggcatgagctactgcactcagcccaccatttgttttaaaaagggtggatcctatttgtataaaaagccatgtgcattttctgtgtacttgtctacacattaatttccaggctgggcgtggtggctcacgcttgtaatcccagcactttgggaggccaaggggaggcagatcatgaggttaggagatcgaaaccatcctggctaacacggtgaaaccccgtctctactaaaaatacaaaaacaaaattagcagggtgttgtggcgggcgcctgtagtcccagctactcaggaggctgaggcaggagaatggcatgaacccgggaggtggagcttgcagtgagctgagattgcgccactgccctccagcctggacaacagagtgaggctccgtcttaaaggaaaaaaatttctggaatgatgtccaataaatcagagagagggactagaagactaatgaggacagaagcttttattcttaacacctatattttgctaccatttatattgtcatcatatgcatataacattttaacatttaaaaactagtttaaacagaaatggttgccctggaatgtggcctgtgttctttcaagggaggccagcagtttctacagtggctgagatggtaccttcatctcacacacctacgcaggagtgcatttgtgctttgatgtggttgtcccttgaagaaggaagcagttctctttttcttttttcccttttccattataggatcagtcacttcttggggcattagtagtctcatttccagtggcatcttcccttggcaaaaggaatcccagataggacctcatctttctaaacaaatgctgttttgggtcctaaccatcccatgtttgctttgaatatgtttaagttgcctggaattatcaacaaaagaattaaatttattgtaggtcagggcatcttttgactcattgtataaaacattcactttaaatgtataccgaaatgtcctttaggccgggcgcagtggctcatgcctgtaatcccagcactttgggaggccaaggcaggtggatcacctgaggtcaggagttcaagaccagcctggccaacatggtgaaatcccgtctctactaaaaatataaaaattagccgggcatggtggcgggtgcctgtaatcccagctactaggggggctgagacaggagaatcgcttgaacttgggaggcggaggttgcagtgagccgagatcactccactgccctccagcctgggcaacaaagcaagactccatctcaaaaaaaaaaaaaaaaaaaaaaaaaaatgtccctcatacctaaaccttacctcttgctaatttgctgagggttcattttagataaaaggtgtttaggttttcatattatgtttgtaactgtatagctatgattcagtttcctaaatgaaaaaagaaactgttttaatgtacagactatttagatttgaaaagactgtgagagctttttcttttatagcaagacaagtcaagaatagaaggcacactgcgagagggatgtcttttgaaagaaaagaaacactactttttatattctcaaatcactgaagaaagctttagacataatttcaaacactagctcctgtttaattcagatgcacagaatgcattaaaaccacgagtgtagtggacgtgatttatacattctcttagcacaaatcagtacctatcttcactgtaattagacttttcttcctttctccttctcaaaagctacttttgaaaccttatgttttccctggacatattttctgtacttcataaaatagctcagttctgcaactaactgcaaatatttgcaaaagggaacaaatgtaaaataaacgtcccctaatgcagtgtttggtgaagaaacatatgtctgacattagttggttaacctgaaaaatagtaagaaacaactctacttaggggaaagggggtagaattgagcccgtactgtgcaaatcaagagaaagctataatttacgcaatttttattaaagagaatacaagtgctgtaggcttggggtggtgctaggtcatatttaagcctaattgagctttttctatatcattagaaaaatgggccaagtttcctatattatagggtaaatacaacattttcttcctgcaaatattaaataccactggctttttaagacgtaaacatccaaatctcaaatgtctttattcatgccaatgcaatacaataaaaatattccccatatacacttaaatcactgcaagtaagccttagaatccccacaagtattattacttactatatctcagaaactttcacacacattatttcaaatatagttctcccaaaaaaaccctgcggagagatacctgtaaaccaaggctgagactagcctagacagttcgttctttagacaacaggagtggagatttgaacccagctattgtgactcaagcaagcctagggcatgtttctgagatctctaaggtgtgcgctgtgaaaccggtggctcattttatgggttggatttccaaacacgactatcacaatcatgccaggaatcaatgactgacttcttgcctccgtggcctgaagttctcctctgcacctcctacctttttgccatttcagtgatgcaccaaagggtggagttgaagaacatcagttttgctgctgcttgttggcaatactctcaaaaaggcgtggggagggagaggtgtaactcacccctgaagtcaagcctggagattacttgtcaggaatgtcaaaagcatttgttaagcaaccttcttcctggcattttaagaagaaagccgcatacatagatcaaatcccttccttcagaaacctgtactctctgaacagagccttggaattcagcctagagaaagaatacttggtggttcatagaacttggttcacaaaagagtgcttgctgcccacgcattttgcacaatgactcccaaacacacagaatgcacattggcaacaattttacgcgtgtttccaaaagtgctgactggaattgaagggacacatttggcactttttttttttgaaatggggtctctctctgtcacccaggctggagtgcagtggcgcaatctcggctcactgcaacctccacctcccaggttcaagcgattctcctgcttcagcctctggagtaactgggactacatgtgcctgccaccacgccttgctaattttttttttttttgtattgttaatagagacggagtttcgccatgatggccaagctggtctcaaactcctgacctcaagtgatctgcccaccccccgcccctcggcctcacaaagtgctgggattacaggcgtgagccactgtgcctggccacatttgtcaactttcattggtcaatgattgatgcaagccagaataagaatagattgggccgggtgcagtggctcacacctgtaatcccagcacttaaggaggtcgagagagcagattgcttgagaccagcaatctgagatcagcctgagcaacacaggaagaccctgtcttcacagaaaaatgaaaaaaattaggccaggtgctatggctcacacctgtaatcacagcactttgggaggctgaggtgggtggatcacctgaggtcaggggtttgagaccagcctgggcaacatgatgaaacctgtgtctactaaaaatacaaaaaatagctgggtgtggtggtgcacccctgtaatcctagctactcaggaggctgaggcatgagaatcacttgaacccaggaggcggaggttgcagtgagccgagatcacaccactgcactccagcctgggcgacagagtgagactatgtctcaaaaaaattaaattaaaattaaaattgagcctgatgtggtggcacatgcctgtagttccagctatgcaggaagttaagatgggaggatcccttgagcttgggagatcaaggctgcagtgagctgtgattgtaactactgcattctagcctaagaaacagaaagagacactgtctcaaaaaaaaaaaaaaaaaaaaaacaagaaaaaaaaagaaagaaaaaaacagatcagaggccctggcctggggtcagtttctccagaaaggcctgcacaatggagttttcatgtaaaaaatttcttacatcctgattttaaaaaatcagatgatcaggaaacattgagttccgattcctttgttacaacctccactaaagctaagtaacagctgctgtattaagatggggctccccctctccatcccacacctgcctcccttacatgcctaactcctgttgtaaatagggaccctaatctgatgtttttgtagtccctttcctaggggcactgtggggaggtggaaggaatttcacctttgttgttggacagacttagatttgagaactggttctactacttactgtttgtgtggtctgggacaagtcacttggtccaagtaagcttctgcatctgttaaaaaaaaaaaaaaaaaaaaaaaaggggcggggagctaagaattcctgcccagcaagttggtttgcagatcagaggcagtgtgtgagaagtacttaacccagcacctggcatatagtagatgttcaggacatcgtagcaggaataagggagacatctcacaaaacattttgtgagaaaggatcagtttctatctagtcaatgtcttaaacattcataggttgttcatggtgggagctgctcgaggaatcatcctagttttatggaggaggaatctgaagctggaggaattgtctccttcaagattacttagttaaaggcaaacaggttcatagccagtggctcttcaccaacccacaaaaaggcctcagattataattttgaagattaagtatatgaaagtgctatttgagtgattaagtgtaagcatcagatcattttgaactggtgagatggctcacacctggaattccagcactttgggaggcccaagagggaggattgtttgagcccaggagttcaagaccaacctgggcaacattgtgagagcctgtccctacaaaaaataaaaaaaaattagccaggcatgctggcacacacctgtggtcctagctactctagaagccgaggccaaaggattgcttgaggccagaaggttgagcctgaaatgagctctgattgcgccactgtgccacaagctgggcgacagcaagacactgtgtccaaaaaagaaagataattttgattagcacaaagatgggacagctacatgtgatcagatttggaaaaaaaaaataaccattcattcattcattcatttactcggcactgattgagtctagtttggacaggtattgccctagtctctgggatgacagcgagaggcaaaacacagacactcactgcctgcatagagctcagaatgtaatggtgggaaggcagaggaggaaacagatatacagataattttagatggagatacctgccatgaaggaagtagaggaaggccaggtgcagtggctcatgcttgtaatcccagcactttcccagcactttgggaggctgaggcagaaagatcgattgagcccgggagtttgagaccagcctgggtaatatagcgagaccccgcctctacaaataattaaaaaaaaaaaaaagaaataggattacctgaaaaggagccagtcttgcaaacagccgggcaaagagtgagcaagagttttttgggaagaggtgcacacagcaagtgctgagacccagaggaaggaaggggcttgtctgctgaaggacccaggtgccctgggagaggtagccagaggcgcttagtaagcttcaatcaggattttaatcttaatatagtgctgagggttttaagcagaagagtgatagaagagagttagcttttgtgcaagcactattattcatggaagtcccctttcgatggggtagtggggactcctcactaagctgtccttctatctctgtggctgtctcagagaagcactgtggaactccagggtgctacgtagctcaccacggtgacccccaatgcaggccacttacagaagcttgaagatctgtgatttgctcacccaggctcccatgccgagtgttcttgtcattaactcaaaagccaaatgctggtatttctgttcttacttgcttgattgtttgtttaccagttctcaacatcttcagtgtccacttggttactaaaatgtttactccttagcccagtgtgtaggcatgtgcctgtaatcccagctactcaggaggctgaggcagaagaatctcttgaacctgggaggtagagattgaagtgagccaagattgtgccactgcaatccagcctgggcaacacagcgggactctgtctccaaagaaaaaaaaaaaagaaaaggaaagaaaaaattatccaggcatagtggtactcacctgtagtcccagctgctcgggaggttgaagcgggaggatcacctgagcccaggaggttgaggctgcagtgagccatgatcaggccactgcactccagcctgggtgacagagtgagactctgtctcaaaaagaatataaaaataataaaaataaaataaaatgtttcctcttgatcacaaaaaaaaggatatagttctatgcaatcatgtctgaaacaggatacgtgtgtcatgcatccctgagttcgggttacctcaatgacatgaccatttacctaatctttgctttttcatctgctctcaattgaaaagaaagaaaccattaattatattgaaagatgctgacttgtaagcttctcccctctcctggctcaggtcagttgctcagaatgcacccagcaaagattggctgaacaaagacagggagatgttgtgagtcccactgatgcccttaacaccgggcattgttcaacttggggtcatttgtgaaaatgatgggaatgcaacttcctcactttacagatgagaaaacagcctcagagaaatgctgggatatgggatatgagttggtctcatagcctgtgagtgccagagccagctcgaatccaagtttctgactcacagtgactcttatccagcaggacgtattcttcagaggccatgtgttgaaaacagttaggtgggttgggggctgcaggccataccattaggaaatggggggcatgtcctctgggtggttcctaagcatttggatgttacagccctgcctttctttattctgttgttctagaagctccaacctggtatgcttttaaggcagatatggccacaaatgaagcacattcacatgactgcactgcctttctggatgaaacaatttgaccaaacactggtgttgagacagttggtgatttgggctttgccacgtggtgggaatgacacaataaatatattttgatatgaattaggtaaagatctgtctctaaccttgggctatatgtgaacattaactgcccattggatactggggaactataaatgtctccgtccaactctgttcaactctaatttttttttttttttgagacggagtcttactctgtcacccaggctggagtgcaatgacgtaatcttggctcacagcaacctctgcctcctgggttcaagtgattctcctgcctcagcctcccaagtagctgggattacaggagcccgccaccatgcccagctaatttttgtattttttagtagacacagggtttcaccatgttggccaggctggtctcgaactcctgacctcaagccatccacctccctcggcttcccagagtgctgggattacaggcatgagccatgacacccggcctgtaattttctttaaagactgccactgggtggaacccactgggcccagtgagaactacggaaaagagacccattcttgccctcattgttagtgtccacatccggatttacctaaaccccacccaggtggcatttgcatagtaatgaaaaaccggtattttctagctgtgaatcacacttcaaatcctgagcggctgactgtcaggggtgcgtcaggcctgcttgctgggagaatggacgagctggttgtggagcgggcgggtcccgccacccgtgggctcagcactggactgctcccagaacattaaaggtctggctgatgttccatgccacatctggacatgaagacccatgtctgcccttctgtagaagggccaaagaagaaaggaggcatcacatgtttctgctgtggggggcccttccgagcagcagacaggagcaaggtacaggagtggcctgattctggggtttccctgccccccctggggtccctaaactgctgtgtgatatgtttctaactatctggacagctcacccaagagtcagttgttcccagtcgcttcttgctgaggataagccaaaagagggccgggggccaatctggtttctttcaagtgaaattatgcttctcaagcagagaatgattgcccacagcagttaaaccttgtttaatggtaattaaattgcttttcttcactttgaaaaatctcttaattttctgtacaaaggcaggaagcatttttctttgattctacaggatgtttctaagtatggtgtaatcagttcatcttaccttgccgggctctgaaagaatgagtgtgtgggatcagatttagaaatgcctcaaaggttagaaagccgagtgctgccgattaactcaagctcagatgaccaaaaaaaaaaaaaaaaaaaaaaagctgcttttcccctcacttctccctctggttctgcctcagtactttgcttaggagtttctaaaagcaggcacagttgcctgcggggctggtgtgtgtcaccttcgcaaagtgcagatgaggtctggcatgtcccatcttgttcctgcctgactacaactctgcacacagacagtgttgatctggcttggagcccatagtggcaatccttggagtggaggcagcagagatctcagttcttcctagtgcttgagaagttaactaactgtctttcccatgaggaaaatgttttgagactgtagaagcagagaagagacttcgccaaagcccatagaaaataaaaagcaaaccctcaagcatgaaaatccctggccctggagtaagtgcaggtgataaggcttgctatctgatgcctcattccatgtctctggcttcccattgcctaaattaagatgtcctgaaagaaaccttgggaaaaaaaaagcacagtccccacatttgaagtagaaatagaattaaggagaaattgtgattttcctgaaggaacagaaccaacactggttttcaaaagccttagttttacattttagtagaaactgttagcagtaggaggatttgctttgtgtgtgtgtgtgtctgtctgctttgccttattttggttctgaccataccactgctatctcagtcttagaggctgattttgtggcccagagtgtttcgttcagatatctttgtgttgaggtgatattgagccagcagccaaagaaatgcatggccaagatatggaatatctggtcaacagagaataacaacaaagtgggacgcatcataaggtcataggtcagtgaaaacagctgctagccatttatatgcaggagagaaagaaggcccagggagttggaaagactgaaggtattttggactgagcagagcaaagggatttggggacatataaatgtatgaaacaagatggtcaggaaaacaatttttttcaaaggtagcatgaatagagtgaggtaaggaaacccatggccatggtactggtggcctaatgggaaaaggcagtgtaatgacttctacatggagacttcagttctgcccctcgtactgttgaagaatattctgtccagagaggctcttcagtttctacctggttttctaatggctttaaaaaactttggtgtattgggggaatggaaacaaagatatttactagagaagtgtttggcaaaaagtgccaagcttattcctgagaaaggatggaacggcgtggggggtggagggagggttggaaccatactccaaattcccctgaggcccacacgtgttcaccagacatctgtggggagcccggatgagatgtggggcccttcccctttctcattttcttttttacttttagatcctggatcaaaatgagtccttgattccctcatcccatcccaggacccttttttagttgcattaccacctagtgaagtctaccaagtcttgatttgagaatcaaaacaaactcagatcaaagtcaacctcagggaatcagagaacacagaagctgaaagatgtatccagccttccctaaatggcagatgaggacactgaggccaggaagctcaggtgacttatccaggagcgtgccagtacttagccaaagatctggaactgggactgatgcttcctgaaaacagattcctgcctggagtgcatgaccctgcttgagaaagtgcagagggacagtgacaaggcgggataacgtagcagtcccagcgacttgggcacccatcctgatgcttcccctaggccccagtgttttattttctggtaaggccagacctgagtcaggtcctgcctcctaactcctttctcttccttcagtgggcaacaaagatggccacagaagcagagaggggttcctcccaggtacatatttaccagtacttgtaccttgcgcttttaaaaactctttagccagggatagtggtgcatacctataatcccagctacttgggaggctgaggtgggaggatcacttgagcccaagaggtcaaggctgccgtgagccgtgattatatcattgcattccagcctgggtggcagaatgagaccctgtcccctcaacctaactctgatgaggactatattacaagtgttatataccagattctggatggagaagggaaagtgattgtagacaagagaatattatacttggttgctgtgttctccaaacccaaacgcatagatacacacagacccacagacacacacacacagacatgagcgggacatatttgaaatcctcactggttttgaaaatctgaggctaatagttggaggaagtgaggggtgactgtgagagaacaaatgtgtaacagatacaccctgagaatcagggctcataaataaggagtagagtctattgcacctaagccttactactagcctaagccttcatactagagcaaaaccgtgggcagacagcacacaaaagcagcccctgtcactcaggggcttacttcttttttttttttttttctttttttgagacggagtctcgctctgtcacccaggctggagtgcagtggcgcgatctcggctcattgcaagctccacctcccgggttcacgccattctcctgcctcaccctctcaagtagctggcactacaggcgcccgccaccaagcccggctaattttttgtattttttagtagagacggggtttcaccgtgttagccaggatggtctcgatctcctgacctcgtgatccgcccgcctgggcctcccaaagtgctgggattacaggcgtgagccaccgcgcccggccggcttacatcttaatgagcccacagctgcctgttgacctggtgtcatcacgagggtgatcactatttccagcaagctctttgtccctcaaagcccagggatcaggggcagcccgtggaagacgagccactggttccagcgaggcacaaggagagaggttaagctgcttctaccctgttcaactgtgatgagattccagcgaaaatcagcattgagggcctcaggtgtttgcagggggctctggtatgttagaaaaactagagggaggggtctgcctttgtgtctgtttgtgagcgtgtctactcaagtaggaaaggggagcacagatttttacaaaatagatgtgggcggtttcttgtagtcttgcctaactgaaaccatgtttgccagagattacttggaattaccctaataggtgctttgtcaaaatacttggtgctggccagatgtggttcatatacctgtaacttcagtgctttgggaggctgagacaggaggattgcttgcggccaggagtgcaaaaccagcctaggcaacatagtgagaccctgtctttacaaaaacaacaacaaaattacctggctgtggtggtatgtgcttgtggtccccactactccagaggctaaggtgggaggattgcttaagccctggtggttgcagatgcgatgagctatgattgcatcactgcagtccagccagggcaacagagcaaaatcttgtgtctaaaaaagaaagcaatacttgacggtgaaagcgagtcctgctcaggggtcccttctggaaagtcctggagcctggaactgaactccgtgattcccctgtgccttccccctgggagcctgagcccccttgaaggtgacagacacgggggaacctgtgtcctgtgggatcactcctctcagtccttctctaccacatagagaaagggatggatggcaaagtaaagccaacaaacctccacttccttcctcctccccactgccagagtggagattcttctttattctgtggaactggattctgaaatgccaaaccattccatctgttgtgttttggcacaagtgctcaaaagagctcaggtgtctccctttgcaatttccccatggcttaaaattcagtcctggagatctgtctcttgtaggaaatggaggggctttccttatgcttgtttttctctgtaaagaagcataaaggtttaagttttcgttgggagggcctaaattaggaaggaaagattatttaaatcaaagcactctcattgtagagtcataagcttggattttgtgtgcatgccatgctagctcaaaaaacaaagttgagagtcagagctctttgaaggatgaggaaggggacccgggaatgagtggctctgcttcaggaagcatgttttaatgtgtgttcctaaaaaagcctctggaaaagtggtttaggaagcttctgggctaggagagacaccatgaaaaacaaaacacaaagtatgtgagtcagttatgatcaattgtgccataatcgacatttcagttgtatagtagttacactatgaaaagcacagacatatttaaaaagacaattttgaggccaggcatggtggctcatgcctgtaatcctagcactttgggaggctgagtcagaaggatcaattgagtccagaagctcgagacgatcctgggcaactttgtgagacctcatctctacaaaaaaaaaaaaaaaaaaaaagccaagtatgctggcacatcccagctccttgggaagctgaggcgggaggatcacttgagcccaggagttcgaggctgcagtgagctatgattgagccactgccctccagcctgggcaacagaatgagatcatctcttaaaaaaaaaaggagaaagataattttgagattcaacatagcccactaacagcttcatttagacatcataccttttgtctagacttgacagaatttgttaaatactggaaagttgtattttttatcttgtttcccctgttctgtctgtgaatagagacgtttgttctttacctagtttataggactgtcatgaggaaaggtgacataataatgggttcacagtattggaagggggaggacaaaatgcctgtttacaagagacccagttacagagctatgtgaagtaaatactgaatgtcaattctaggtaacgatcctcaatgtcacaggtacttcacgtattaatacctctttgccattatacatatgtccttctccaaatgatggctctttgctgtaaaagtttgtcttctaagctggttgtgtggaatttggcccctaccttccacattgtcttataggagtgcatttaggccaggtgtggtggctcatgactctaattacagcactctgggaggctgaggcaggtggattacttgaggtcaggcgtttgagaccagcctggccaacatggtgaaaccccttttctacaaaaatacaaaaattagctggacctagtggtgggcgtctgtaatctcagctacttgggaggctgaggcaggagaatccttgaacctgggaggcagaggctacagtgagccgagattgcaccactgcactccagactgggtggtagagcaagactctgtctcagacaaaaaaaaaaaaaaagcatttaatctggtgctgagctgacctcttgtactctgattttttcattgtttagattggaaataggtcctgagttctaattctgtatttgggacttggtgactgcttctatcccagtctttgatggtttagacagtggaaccctccatgggggcatgtgggtgatcctcttgtcggggaaaaaagagggtgagtgactagggggtgggctaccgtaaccaggactctgaggataggtgcagggtcactgatgactgggaagagttgtaggtcctgccaccatctattttgcatgggaaggacatttgcctgagctaagccatgggaaaaatctaaatttagatacctgagctctccacagcaactaagccaagacacagtagacagaatgttttggcctttcagaatcagtattttacatacaaggactcgatttcacagaaaacccttctcaatgcttatgtgtatatgaaaagaaagtttgacctgcaggaatcattgtaatgtatcagatccatatcacagctcaattattcccaaggattcagggaggaaaagccaacaaaaacaaaaaaaggaataaaggaattgggttgttatggaagagaaagctaaaggggatttatttgaggtctggaaggctacgacgggttgcattcagatgtcatccacatgtccacagagaaccgcacaaggacttcaaggtgaaatagtggctgatcaagtcctaggagtctgagcaatcaaacattggcatgtgttaccaattaagtagagaggtggctgctgttttagaggcttgatgattgtctgtctttaagagtcaatattggccgggcgtggtggctcacacctgtaatcccagcactttgggaggccgaggtgggtggatcacaaggtcaggagatagagaccatcctggctaatacggtgaaactccgtgtctactaaaaatacaaaaaattagccgggcgaggtggcgggcaactgtaatcccagcttttcgggaggctgaagcaggagaatggcgtgaacccaggaggcggagcttgcagtgagcccagatcacacaactgcactccagcctgggtgacagcgagactccgtctcaaagaaaaaaaaaaaaaaaaagagtcaatatttgtgggagtctcaatttaaggtgctaggtaaattgggagttccatctgaggtttctttcaagataaaatgccttataaaagtactgtaagtccacctggccaacatggcgaaacctcatctctgctaaatatacaaaaaaattagctgggcacaatggtggctcatacctgtaatgccagctacttgggaggctgaggtgggaggattctgtgaatctgggaggtggaggctgcagtgagccagtatcgcaccactgcactccagtctgggtaacagcaagaccctgtctcaaaaaaaaaaaaaaaagagaaaagtattgtaagtcacttcagtattagggatgggggccaaagtccactcacgtataaaaatatccctcagaggaagacttctatgtgtgtctcatgcaaccactttatgctgtctctgaggttgttcattccagttttcctgcttttctgttccagacttgggctgataccagagagtgtggattgcctgcagggcttcatgcgcatttctctgtgtatttaaatactcacggaagattagcaactatgcataaactttccagttgtacttccttaataatgattactgctactctttgttggtagctaagggaagcgtctgcatggaggtggcttagaattgacaatgtgcaaaattctgggtcgtttcatgggggctgggggaaggcttggaaataaaggcttgggtcattcccttgtgtttagctcttgcaggaaactcttgcaacaccatgctgttgtgttatcatctgcctgggtttcgtccccaggacagaacggcatgaatgatgtctttagtgtctcacagaaggaacactgggttcttgagtgcctgccatctctgtctcatcttgactccaaggacattttaacctctcaatgccttgttttgcagccaaaggtatattatctgtctcccatatgcgttctgggagattaaccactaagcattttgctttttaggtgtgaggcgctgtttccttctaagaccagtattgtttctgactaactttatccagttgagtggggttgtgtctctatttcatgttacgagatgcctctaacatttttattatgaaaataatttttgtgtccattgaaaaggtttgggaggagtatttaagttttgtaggataattatagatactctatcagtcatacattctatcttttttatttttttttgagacagaatctcgctctgtcaacccaggctggagtgcagtggtgcgatcttggctcactgcaacccctgcctcccaggttcaagtgattcccctgccttagcctcccgaggagctgggactacaggcacgtgccaccacaccaagctattttttgtattttttagtagagatggggtttcgccacgttggccaggctggtatcgaattcctgtcctcaggtgatccgcccacctcggcctcccaaagtgctgggattacaggtgtgagccaccgctcccagcccatcacacactctaaatccatacaacgagtacagcgggacttttctttctgtgttttgtggcaaataagttggtagaaatattatcaaataaaggccaaaactgtgttcagagacctggaagttcattcttttcctggttttgttgtatgtctgagacatgcagagggacagacaaaaagatgcatttaaaaaagagctgccagggaacacataccaaaatggaaatttgggaaggggatggacaagatgagacaaagcagacagacacagattttctcaggtcaacaaagttgtgtcagactagtaagaccagctttagagtttaaaaaaaaagaagaggaaaaagaaaagaaaaaatacacacacaaacagaggtgcacagaacattccaggaaaccattgaactgtgagtgataacgtgtttccttctattccttcaaagatttgttttagaggatagctgggtaagaacttgtgctgaaaaaacaatgcaagggatttgtaaagaaacagggaaatgaatgatctgacaggccgtttgttaccaccaacatttttcttaatttaacctgaacttacttgctcttgtggtggtcggtcggtctttctctctctctctctctctctctctctctctctctctcattctctctttctctctctctctccctttctccctttctctctttctctgtctctctttctctctttctttcttgtctcattctgttgccctggctagagtacaatggcacaatcctagctcactgcagcctcaacttctgggctcaggtgatcctcccacctcaacctcctgagtagctgggactacaagtgtgtgccactacccaccacaccctgctaaatttttgttgttgttgttttgaggagaccaggttttaccatgttacccaggctggtctcgaactcctgggctcaagcaatccgcccaccttggccacccaaagtgatgagtgctaagattacaggcatgagcctctgtgcccagcttggatatttcaaagacattagccatggccttcatgtttatctggacttgagggcttcatatctttgaccatagatgatgcttaagttggtctttcacgtggtttcagatccacagacattttgattaggtcaaataacaatcgtcttcataatgccaccatgtatgtatgtagtcctttggagactattttgacatcatttataactgacaacactgtgactttcatcctcctcttagctcacatgccttaatcccacatgtactgccctgtagagaaatattcctccttcctcttggcttgctttcttagctttgtctctatcccaggacaataactgaacaaaggctcttcattcttggtgcaactcagagttggaagagtcaagggtgaaggggcattgggcagccggccatagctgtcttcttcctctcttaatgtctttgtctctcccatcttcatgtggacattttctctctccttcttctctttttcctcccctcgctgaaaaaaataggattactgttttgaaccgggcattatgctagatgatagatgtacaggggtcagcaagatgggcaaggtttccatcttcatgtatattaaagtttggagggaataaaacattaaaataaatagttacaagggtggtgagtagtaagaaaagataaggaatgcttagcaagggggactgaaatagtgtagaggtgggatgaggagtcagcgaagtctgagtaagtaaattcagagagaaacaaaagaactacactctagatttccctttaaaggaaaggaaggggaaagaaataaaattccaaagagaaaagggcagaaagatactttgttttatacagaacactggaggccccagtgtaatcaacatcaaatttgtgtatctgcaaaggctgatcttttttttttttttttgagacggagtctcaccctgtcgcccaggttggagtgcagtggtgcaatcttagctcactgcaacctctgcctcccgggttcaagcaattctcctgcctcagcctcctgagtagctaggattacagacatgcactaccacacctggctaatttttgtatttttagtagagacagggtttcaccatgttgaccaggctggtctccagctcctgacctcaggtgatccgccagcctcagcctcccaaagttctgcaattacaggcgtgagccaccatgctcgacctaaagactgatcattttttatcagttgtccaaagacttcatcttttctccttccctgataccattgcattcagccatggtgctgagaggtgaagccagctggacttcctgggtagaatggggacttggagagcttttctgtcttataagaggattgtaaaacacaccaatcagcactctagttaggaatgtaaaacgcaccaatcagcgctctgtagctagcaagaggatggtaaaatgcaccaattagtgctctgtaaaacacaccaatcagcgctctgtaaaatgcactaatcagcactctgtaaaacgcaccaatcagcaggagtctaaaagtagccagttgtggaggattaaaaaaagggcattctgataggacagaaatcgaatttgggaggggacaaataagggaataaatgctggccaccccagccagtagtggcaacccgctcggtccccttccacgatgtggaagctttgtcctttgcttttcgcaataaatccttgctactgctcacgctttgggtcggtgccatctttaaaagctgtaacactcaggactgcgaaggtccgcagcttcattcttgaagtcagcgagaccacgaacccaccagaaggaaccagacacagtgccacctacccacatcttcccctatggctagatggcaggaatccacaaacacctgccaagatagtattgtgatcatgttaccagctataattggaggtgaggagtttggagtagaaatttgtctgtttttataataacgaggttgaattatttatagctttgtgtctttcctcttctccataagtataattaattttattaggcatctattcctaagagccaggaattcacatagctgctgggaagatgaagacttataaagaccacttgtggtctctcaaggagtctgttggcagagactggcatacataaaacaaatggaataaatattctatcaggaatatgggtaaggtcttacagaaacccagaagaggaaagagttctcccaaggtaagggaacctagaaaaagttacaaaacggaaagagctatccatctatctgtatctgtatctataactatatatctacatctatacctatatctgtagagatgggatcttgccatgttgcccacgctagtcttgaactcctggcctcaaatgatcttcctttctcagcctcccaaagagctgggattacaggcatgagccaccatgcctggccccaagaagggatatttgagttgatcctaagagaatgatagactgctgataaagctaaatagacttttttagagtgttccattatttttgtattttgtagttaatgcttaatatgagtaatcatgctttagaaagagaaagcaccaatcaaaacaagcctattttcttttcacctaggcatagtacttggtatgagttggcctagaaacaactgcatattctactcacactgctgcatggtttgcctaagagtactccatagatggactattgaaatttgggtgtgggttaaattttcataaatcaaatttcatttcccattatcttacacctaattaaagagataatgtgccttctgatgaccctgtaattggcagttgtaactggccctttaactttgtttccctgcgctgcagctcctgtctccagcagttagttcatcatctgtacactaacagtaagctacgcgggcaggcactattttaaaaaacacacacaaagctgtctgtgaatggcaaaggaatcagagcaagtcattactctctagttcatttggctagaaaggtcaggtcgcctatattgacttttcatgaaaactaggcgaactagtagttttcatgcacaatatgtcaacaacctgttatatttgaaattctttttaaattaggtgggtgaatggtgtaaaacttcactatattttctccctgcctgttaattgacttgctaatctcctgccaatatatgtccattttaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgaggtatcatctcacaccagttagaatggcaatcattaaaaagtcaggaaacaacaggtgctggagaggatgtggagaaataggaacacttttacactgttggtgggactgtaaactagttcaaccattgtggaagtcagcgtggagattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcatatatacaccatggaatactatgcagccataaaaaatgatgagttcatgtcctttgtagggacatggatgaaattggaaatcatcattctcagtaaactatcgcaaggacaaaaaaccaaacaccgcatattctcactcataggtgggaattgaacaatgagatcacatggacacaggaaggggaatatcacactctggggactgtggtggggtggggggaggggggaaggatagcattgggagatatacctaatgctagatgacgagttagtgggtgcagcgcaccagcatggcacatgtatacatatgtaactaacctgcacaatgtgcacatgtaccctaaaagttaaagtataattaaaaaaaaaaaaaaaaaaaaaaaggattgtggcctggcgcagtggttcacacttgtaatctcaacagtttgggagaccgaggtgagaagatcactggaggccaggagtttgagaccaccctgggcaacagagcaagatcctttctctacaaaaaagtaaaacatatgaggcggcctgttggcacacatttgtagtcctagctactcgggaggctgaggtggaaggatggcttgagccctggagtttgaggctgctgtgagccatgaccgtgccactgtactccagcttgggcaacagagtgattccctgacttaaaaaacaaaaagattgctttaaacattcatcaaaaaacagagcaaattacactttggcagaaacatgaaggctaatacttgaatccaagcacccattccctctgggcttaccacactgaaggcaaaatgagtggggttggtttttctcctcaagaaatgttgttctgggacagtgagtcattggtttttgttcttgcaacccttcatcatctaacaggtttggttaactcaagaagttctaggaaatgttcaaacactgcagatatttatcaaggggcatttttaggagtagcagagtgtcaagaactcaaattgacatctagtggcaacacttctaaagattggggccccgtactatatacaatgctaaatttccaatgctgtgattggaaaagactatgagaaggcctctagtctcttcccactaccatcatctgcagcaggcccacaccacccaaatcaacacaggtatggaagaatcgccccctgccacaggagtgggcagtaagcgttagaacacagattgccgagttctggttctcagtccacccaagtctggtctgtttccctaactgtagaaggaaggtgttagaaatggaaaatccttaatatattctttgattttttcaaaacagaataattgatttttatcatctttcttagtatacctttcacgttctgcacaattattctagattcaaactgaagattgtggttcatgtcaagagtcagtttggtcactgaacactgtctcatccagctgtgggacactcatatgagcttggtcataggtggctcatcttcccccacttactgggtttccataatgccattctcttgggctgttagataaaatatttacaacccatccctccatcatcatcaaagcaatttatttgcacaaactccactgtcactaaatcacatgaatgcatccatctttcttattttcatctttttgaaaattagccagcatgaaaaataacagcaatcgattaagctattgcattgtgaagagtagcttagatttctttctttctttttttcaccctgttgcccaggctggagtgcagtggtgcgatttcagctcactgcaacctctgcctcccaggttcaagagattctcctgcctcagccgcctaagtaactgagattacgggcgcctgcctccacacccagctaatttttgttttattttttttagtagttatggggtttcaccatgttacccaggctggtctcgaactcctgacctcaagtaatccacctgccttggcctcccaaggtgatgggatcataggcatgagccactgcacccagccagatttctttcttttgatgatatttgggagtaactgtggaatgtgtccccccacctatatcatacagcaatatttttttgatctacaaagcacaccatatacttcactatttattctgctgaggggaaatgggtgagactgccagatttctatgagaattacagggttttcaagtcattatggagaaaatgattgaggttcagtgtcattggaaaaagcatattcttaatttgtctataatttttcctttaattggtagtttggctccattttcaaagtacttttgaagctttcttttccaatttggcatcaaagttatttttctaagtgccattcaatttgggacttattttctattttgattgacataaaatatgtcattctgaaaggaaaaatatcaacacagtttttgagtaagaaactcagtaacattgaacttagtaatcacctccctaggagtgaaatttcatggtcatatatattgaaaaaacctcacaatataaccaacatgctatctgaatcttgattgagattccacatcataagtgctaatttcagttctgactataaccaatttgttagtttatacttactctttactaaaggaaagaagagtaggaataggatggtgcggtggctcacacctgtaattctagcactttgggaggccgaggtgggtagatcacatgaacccaggagttcaagaccagcgtgggcaacgtggcaaaaccccatctctgcaaaaaattataataattagccaggcgtggtggcatgtacttgtagtcccaggtactggagaggctgaggtggaaggatcacctgagcctggggaggttgaggctgcagtgtgtcgagattgtgccactgcacttcagcctgggtgacagagtgagaccctgtcttaaaaaaaaaaaagagtgagaataatgaaactgtgcacacgcaggccttttaataaactttccccctgtacgcagcccattctagctatatatatttcttggtcccagcctcttcaaataaaaattgttttattcaaaagtatgacctagccttatacaagataagatagcccacttaaaagtggcataaaaggccacttttatgcatctccattttaggttggttacaagaggcacagagagaccaaagcccatgggatgctcgtgagagtaggaaattgggtgggaagggtggactcgggagacaacctgacatctctctacttgaagcctagcaataaggttcaaaggttcctcatgccttgttttcccttctctctacatgattaagatcccattcctgtaacagatagcaatgtgtttatgcagtaaaattagataagggagattactagggaagtcactactcagttagggatgtcagtggtgctcactgcaggtccaggttagtaataagaactctggactagtagctaggagtgcttgaatctagattagttctactttctaactcgatgtgtgacattttttccacttaatttttttggccttggttatcttattggaaaaaatattcaagttgcacaaataactaaatgatgcctgagttttcattcagttctaaaacttctcaactgagcaatctgttgttgaaaggagagtacgagttctaaaagctactctagggagctctgcattcaccaagccgctccatcattgttgggaagaaaatactaaggttgactcattgtcaaagccacattctactcaaactcaatgtacataactcgaattctagccacattccagccaaattgagatagctgttcaaatagtcatggatttatttaataactgacttcgaaattctttacttctttcaaggtggcattaacaagtatttcggaatttcaacagagatcggttttcacgtgctcttcaatgatccctgtgaaataaatcatattcaagggtttttttccccttatgagttattcgcctgaaggaagaattcttcatttctttttcttttaaatgcatgttggaataaagtcttctttgaaaagtcttaatgaaaagagcaaacgtggaatagcatccaccccagttctttctctggtccttgcactctgagaatgaagtcttagacagcagaatgtcaggggactctcattgcgtaaaagtctgtgcccttctgcgccttggacagttatggacagaagcctttaagaagaagaaaattaaaactagttaattttttagttaattttagcaacactacatatatgagagagagaaaagatggcattttctgaatgaatgagatgcctctgcattttgcccaactcattggagactcaggatagagaaaagggagaaattatgtttagaggctgataaatttccctatggttactatcaagagatcagactcttattaacatttgcaaagtgtgagcagagaagagcatttgaacaataagcatagattaagtactcctctttccttcattcccttttctctagtcatattctcagacagtccaggctaagtattaatgatcttctttgaagttaaacatacccttgctactttcattacattattatttttatgttcttccttttggagtactcaaggtaaatgacatggcagaatctgtcccagtccagtgagggtgtcacataagaggcccttggcttacctctatgcataactggcccacgtcacatctttaattagaagtccaagttattggctggacgccatggctcatgcctgtaatccaagcactttgggaggccaaggtgggtggatcacctgaggtcaggagttcgagaccagcctggccaacatagtgaaaccctgtctctactaaaaatgcaaatatcagccgggtgtggtggcacatgcctgtaatcacagctactcgggaggcttgaggctggagaatcgcctgagcacacgagatggaggttgcagtgagccgagatcgtgccactgtgttctagcctgggcgacagaacaagactctgtctcaaaaaaaaaaaaaaagtccaagttactgttgcagggattgggacatcttgcctttctcaagttgagcaatattcccaaatataaaaatgtaggatcttagtccaatcagagcagatatttggtgtagggcattttctaatgtagtaccaataaattagacgcatacctcaaccaaaaaacagcccatatccagtaagtaataaggcaatgatttacatttcacatattaccagagtaatgactaatagcatacatgtataaactgaaaagtgactgatgcttattttcagatgggtccaaatttattggataattatggagaataatgtatgttttctgagagttggtagtaagaaaatattgccattgctggccaggcacaatggctcacacctataatcccagcattttgggagacttgaggtcaggagttcatgaccagccacctcagcctcccaagtaactagaactactggtgcatgccaccaagtccagctaatttttttttttttttgagacggaatattgctctgtcacccagattggctgtgttctccattctaagtccagtggttagaaattgtcaagttctcacatctgcaaaaaaagtaaaaaagatgaacctgctacatctaaatatactttgttgtcttcctacaagtcctattttacatacttatggcatttttactgcagtttgaaaatacagtcaattcttgttattcacagtattgatgttctataaacttgccctaaatactgcattagtgagtcctgaatttattagttaatactgaatttcctaggggaaatacagggttaggttcctgtgagtctttggttacctttttatcaaccaatcaacaaaaatccttattttacctgtgtttttgtttgaagacaccttttaaaatatatattattgattcattagcattgaactaagcttatctaatgcacttattttttgtgtaaggtgtatcacagccttcttgagcctaggaatgccaaatagtacttccacaccatacttaagggccatttcattttatttcttatttttaaaatttattctcttttcttatttaaagaaaaaatttgtagatgccgggtctcgccctcttgaccaggctggagtgcagtgacacaatcacaactcactggagcctcaaactcctgggctcaagtgatcttcccacctcagcctcccaaatatctgggactacaggcacacgccaccatgcccagctaattttttaattttatttttttgtagaggcagggtctggctatgtttttgaggtcttaattccccaatgaacatgactagtatattccaggctggtcttgaactcctgtcacaaagcaattctcttgccttagcctcccaaagtgctgggatttcaggcatgagccactgcacctggcttggaccattttaaatagtgaagtcactcacacacacatacacgcatgcaggtgcacacacagacacaaaaagacacaaaaatgcgaaacttgtggcactaaaaagactgtggaaagggtgcttccttacagtatgaaaactgaaacaaaaaagcagagtgttgtttagttagacgccacctgggaacgtgcttgttgggaaactccagttgtccactgtcctgccatgtctatgatgactgcaaacatttgggagtattaatttgagggtcacaaacagattttaggtgatgggcatatttacaaatacagaatctgctagtaatgaggactgactgtataatgctttagtagtctcaagtatgttttttttctcattaagcctttgcttaagatgcaggcaagattgatgctgttggtttggtgcaaaagtaattgcagtgcttcccatttaaaagtaatggcacacactgcaattacttttgctccaacttaatacttggctttattgacttttagcatcagtgcagtttggttaatgataaaattttccaaagcagtgtctcatctgcaggagcaaactatagcaagggccctggccatcagttctcccttctggtcctgatattcctttttaaactgtctttccatacccctccctccagtgggcttggcgatgttgcattaaatagcaaagagaaggaaactcctccccagtcctcactgaccatttctttttccactcagtcctgctcagaatgtagaagagaagttgaatttaattcataaattcagcagcttgaggactgtcagttttgtcgttatttagtgaaatagtaattgaattgggctacaaggtcattggaatctgctgtttcatttcatatcattttacgtgttattattctaataagaatacaaatggagtttgatgccatttgctgatcatccatcttattgatgccattgaacagaacgcagaaacacaaagggatttataaggcatttcagttttgatgtcctttgaaaaatgaaagtcttttcagaaatgcaaaagacaaaatgacttagaattccatctcgttctgcccggtttgagggcatcccttcctattccttagatagctgttaataagagtcctgaggaaaactgggtttgaatttaaaaacaaaaaatttttaagagacagggtctcgctttgtcacccaggctggagtgcagtggcacaatcatagcccctgtaaccttgaagtcctggactcaagtgatgctcccacctcagcctccctagtagctggaactactggcacatgccatcaagtccagctttttttttttttttttctgagatggaatctcactttgtcaccgaggccgtagtgcagtggcgcgatctcggctcacagcaacctctgtctctcaagttcaagtgattgtcctgcctcagcctcctgagtagctgggactacaagcatgtgctactacgcccagctaatttttgtatttttagtagagacagggtttcaccatattggccaggctggtctggaactcctgaccttgtgatccgtccgcctcagcctctcaaagtgctgggattacaggcatgagccaccacacccagccaagtccagctaattaaaaaaaaaataaaaatcgtagagatggggtctccccgtgttgcccaagctggtgtcaaattcctgacctcaagcaatcctcccacctcggcctcccaaagctctatgattatagatgtgagctgccatgcctggccttaaatttttcaaaagcttttaaaccaatcttaaaatgttttatcctcttagaatcatgtccctagttttatagcttggaaattcttgctcttttcaaattgctctttaactctggcctgattggaaggtggcagcttttcaaatacaggtcatggcagcgctcaacctggattcctcagttgcagaagactgcttttgctagactgctgaatttacttccaacttttcagatgtttctgaggttgaccctggtgtggttcccactcaaagtggagcaagcaggtgggtggcaggtctcttcttagcggcttcctagagggaagcctcgtgagtgggatgggggacaggttgccctgggggagcccaggaatggggagacaaggccacctgctatgcagatgatatagtttggctgtgtacccacccacttctcatcttgaattgtagttcccataatccccacatgttgtgggaggaacctggtgggaggtaattgaatcatgggggcggttttccccatgctattttcataatagtgagtgagttctcatgaaagctgatggttttataaggggctttccctttcactgggcactcattcttctccttgctgctgccatgtgaagaaggacgtgtttgcttccccttcaaccatgattgtaagtttcctgaggcctccccagccctgcagaactgtgagtcaattaaacctctttcctttataaattacccaatctcaggtttgtcctaatcgcagcatgagaatggcctaatacagtaggttttcctgagtcctctctctgactcaccctctgacgggcaaaagacagtggcagcactgccagcaatcagctgggaacttctcccctgtgatagaaagcagtgcttgctggcttccctttgtgatgcttttggacagcagctctatggacctatgccttttgtcctttgaggacggacgcacagtctgtgcagctcgaggacgccgtcatgggtgagatgctgtggagtgtgatgacgccacctcttaggctgtgtgtgaaagtagcgaggagaggcagggtctgcatgagccactttggagcaggccaaaacactgtggagaagcacattacagccacagtggcggtgtaaagggtcagactgaccactggcttctggaaagtcttcatttctgaaagactgtcaggtagaagatggatgagagttactctgtgaggccggaaacctagaactcagaccattgtgtgcagaccagggagaggcagtgtttggagtgagataagcaggaattttgaaattacacagacccggttttgaatttactcatgagctgtgtggcttagagaaagctgtttaatcccactgaccttcatctgtgaagtgtccaaaaataatacagagcttgcagagttgtgtggataagggataatctatcgaaagcatgtggcaagtggcagacacaatgtgggcactaggcaagtggcaagtcccttgtattgagtcttatttgtctattcagtgaatatttggataccaactctgctgttctgggcatgatgttagccactggggagacagaaggaatgaaagagatgagtaacctaatgtgtgctgtctagtggggactgcaaataaagtgggtgttaccactagcgtgctctacagtgttatgctagagagaaatttacttcctttggccactcacttccttgtttttaaataagaactgagttaaagttgctaactgtgaagactgagtaatttgaatctgctgttggtgtactcagattacttttttttttttttttcttggagacagagtctcactctgttgctcaggctggagtgcagcggcccaatctcagctcactgcaacctctgcctcccaggctcaagcgattctcatgcctcagcctcctgagtagctgggattacagtcacgggccaccactaatttttgtatttatagtagagacagggtttgccaggctggtcttgaactcccaacctcaggtgatccgcacatcttggcctcccaaagtactgggattgcaggcataagccaccacacccagctcagattactgtttactcaaattaatggggatgattgaggatgaaacagtgcagggattccccattgttttgttttcttctttgcatttctagtgtctgtttttttttttgttggtggtggtggtgtttttgtttgtttgtttttttttttaaaaaaagatctgcagaggctattgtgtcctttgcataacccaagtccagtagcatccttgacttcaaagtctgttggcattgatggcatctgactcagtcataactatctttaatacatcattataaaatctacaatattgctcaagtgaagatattatcatgtaactgggagatattactaattaatgagtatgtggaaaattttccctagaaaatgaagtgtttgtgaaagggactgaaggatttttgcagaagagtctatgagaaagttattataaaccaaagggttatgaattctgcatatgaaacataaatagctattaaatattttatttcaatcaaaaagtgtaatgaaattagagcttctcattatgaatctgggatttatatggaaacttataaaactaaaaggtaatacattcaaaatagaagcacagatttaccaattaactggagttaaaactttttacttctctttacagtgacaggagaaaaatacatcctaaatatgttattatggtaaaaaaataatattgctagtggacagaaaaaatagtcgttaagagggtacaagttcatctgatagttgcaactaacattctaagggggttctctaagtttagtgtttgattttcttaaaaaccgatttgaaaattcatggtgcatggaactcagtgaaggctcctctgttgaagaaataactctctgaaataaaatgaacatataggccctttatcttttttaatgggatggcgtgcttaggcccatgaggatcggtttggtagaggttgatgttcttcctttatccttaatcattgatgcctctctagaaaagaaatgctcatgtcttttaggtggaaccataggatattggtgattacgtatgtcaaaaacagtcaaatatctgcagtttcatgtcattcatgctaatgaattctaaattggatgaagaccttgactcaccagatttggcaaggaataggggtccgtattttaaggacaaaaggctagaagcctgtttgcaaaactctaacaaacatttttgcttttctaagatttctgaaataatctggagtacacacaggtgaataatgtaagtgaaggaaagtgaaagggtgctataaagtaaaatgaaaagatgctgaatttcagcactaatttgaatatacctagattctagattgaaaatgaccttttccgcacaggtaaataaaatgtttccataaaggaataaacctggccgggcgtggtgactcatgcctgtaatcccagcactttgggaggcggaggcgggtggattgcgaggtcaggagatcgagaccatcctggctaacatggtgaaaccccatctctactaaaaaacaaaaaattagccaagcatggtcacaggcgcctgtagtcccagctactcaggaggctgaagcaggagaatgcagtgaacctgggaggcggagcttgcagtgagcagagattgcgccactgcactccagcctgggcaacagagcgagactccgtctcaaaaaaaaaaaaaaaaagaataaacctaattatacttcttcaacttaagatggacatttctctacctaagaatataaaattatcaaatactctagagaaagttgggtttatattcaaatagcacaatatcaacacatgtgaaggtcagtattccatagatggggatgttgatagctaatttcaaatcagtgtgttttgtttattaaagctagactgctgataggcaatatttgctagaaaataatgtaatttttaaaactttgatgtgtatttaaaataaagttttcattttagaacagtttgagatttacagaaaaattgtgaagatagcacagagctcccacatacaatgtatgcagtctactctagtattagcatcttacatcaatatggtacatttgttatgattaatgaaccaatattaacacagttattatctaaagttcatattcatttttttgccatcgtttttacctatgtgtgatgtaagtaatcattccatttcagtatacatgaattacaagatcagaattgttaacccatgccctgtgggaaagaactttatcaattagggtacagtgtgtttggacagtttcttttgtcttttgtcttacagaaatagtttgtttccaacattaattaggtcagcatcttctccccatcacctttccacatacacttaccctcagtgagactgtttcatatatttatgatacagttagattgcttggtaagatctgttccttaggctcttggctatgacagtttctcagactctccttgtttttaatgaccttgacaatttggaggagtactggtgagttattttgtagaatctccttcaattgagacttgtctgatgattttatcatgagtagactagggttaatatgtttttggaaggaagatcacagaaatgaaaagccattctcattatatcattatatcatatcaagagtaacaataatcggccgggctcggtggctcacgcctgtaatcccagcactttgggagaccaagacaggcagatcatgaggtcagatcgagaccagcatggctaacacggtgaaatcccatctctactaaaaatacaaaaaattagccaggtgtggtggcgggtgcctgtagtcccagctactcaggaggctgaggcaggagaatggtgtgaacccaggaggcggagcttgcagtgagcggagatcacaccactgcactccagcctgggtgacagagcgagactccatctcaacaacaacaaaaaaagtaccaataatctggccaggcatggtggcttatgcctataatcccagtactttgggaggctaaggcaggaggagctcttgaagccaagggttcaagaccagcctgggcaacatagagacctcacctctacaaaatttttttttcaaaaaagaatactaataatctatatgatttattgctataaatattagctttcatcacgaggctgaggagtctttttcaggtttctccactgtaaggtcacacacacccccacctcttttctatgttgtcttctttggaaagaagtcactacgtgttatccacacttgaggagtgtgctatgttccccctccttcagggtggagaatctgcataaattatttggaattctctgcataagaaatttgtgtttatttatccccctgtgtttatttattcaatcattcgtttataacagtatagactcatggatatttattttcactttgggtttgaatccagtattacttgattgttgctgacattcatccagctttggccactgggagccctttcagttgacccctgtgttcctttgatataccctcttcccctcttctttgtggtttgtgggttctttgttttttgttgttgttttgtggctcttctttatggcactgaaagatactccaggctcatcttctacatttcctgccacaatcctaaaatcaaccatctctctaaggagttctaaaccaagatgtgttctttgctactgaggtgttgcttctttttttttttttttttttttttttttcagacggagtttcattcttgttgcccaggctggagtgcaatggcgcaatctcggctcactgcaacctccgccttccaggttcaagcaattctcctgccttagcctcccgagtaactgggattacagacgtgttccatgatgcctggataattttgtatttttagtagagacggggtttctccatgttggtctggctggtcttgaactcccaacctcaggtgatccacccacctcgtcctcccaaagtgctgggattacaggcatgagccaccgcaaccagcctgaggtgttgctacttttagggcctttgactgatagagcaaagaaatatatgtgtggatactaaaccatgcatagacacatatctatatttccttctttcttttgcctttcccagaatgtcatataattagaattgtacaatatgtagccttttcagagtggcttcttccacttggcaatatgcatttaagattcgtccatgtctttttgttgcttaagaacttttcattgcttcataagaaactgacaaactggctgggatggtggcttacgcctgtaatcccagcactttgggaggccaaggtgagcagatcacttgaggtcaggagttcaggaacagcctggtcaacatggcaaaatcccatgtctactaaaaattcaaaaattagccagaagtggtggtgtatgcctgtagtcccagctactcaggaggccgagcatgagaatcacttgaacacaggaggtggaggttgcagtgagccaatgttgtgccaccgcacttcagcctgaggaacaaagcgacactccatctcaaaaaaataattaaaaaaagaaaagaaactgatgaactgtcctctaaatttgctgtaccatttttgcatttccattatcaatgaatgagagttcctgttgctctgcatcctggtcagcatttgatattatcattttctggattttagtcattatagtagtgtgtagtagtatcacattgttgttttaatttgcaattccttaataacaaatgatattgagcatctcttcttttcttttcctttattttttttttatgtttttgagacggagtctcactctgtcacccaggctggagtgcattggtgcgatctcagctcactgcagcctccacctcctgggttcaagcaattctcctgcctcagcctcccgagtagcaggaactataggcacaggtgaccacacctggctaatttttgtattttcaatagagacagggtttcagcatgttggccaggctggtctccatctcctgacttcgagatccacccactttggcctcctaaagtgctgggattataggtgtgagctaccgtacccagctgagcatcttttcttttttaaaagaaattttaattttagattcagggggtacatgtgcagatttgttacaagggtatactgtatgatgctgaggtttgggcttctataaaacctgtcacccagatagtgaacacagcactcaataggaagtttttcagtctttgttcctctccctcccactcttcccccttttggagtccccagtgtctgttgttcccatatttatgtccgtgtgtttattagctcctacttacaagtaagaacatatgatatctgattttatttctgtgctaattcacttaggataatggcctccagctgcatccatgttgctgcaaaggacacgattttggttttttaaaaatgactgcgtagtattccatggtgtaaatgtaccacattttctctatccattccaccactgatgggcccctaggttgattccatgtctttgctgagttctgtgtctttgtcaatagtgttgcaataaacatacaagtgcaggtgtctttttggtagaatgatttattttcttttgggtatatacccaataaggagattgctaggtcaaatggtaattctgtttttagttctttatgaaatctccaaactgctttccacagggactgaactaatttccaatccgaccaacagtatatgagtgttcccttttttccacagcttcgccaacttgttactttttggctttttagtaataaccattctgactggtgtgagatggtttctcattgtggttttgatttgcatttaatgatcaatgatgattagctttttttcatatgcttgttggccttacgtatgtattcttttgagaagtgtctgttgacgtcttttgcttactttttaatggggtggttttattcttgttgaattgtttaagtttcttatagatactggatattagttcttgttagaggcatagtttgcaaatattttctctcattctgtaggttgttcagcctgttgatagtatcttttgctgtgcagaagctcttcagtttaattaggttctacttgtcaatttttgcctttgttgcaattgcttttgaagacttaatcataaactctttgcctaggccaatgtctgaggggtattccctcggttttcttctaggatttttatagtgtgaggtcttacatttaagtctttaatccatcttggggtaatttttgtatatggtgataagtagagatccagtttcattcctccgcttatggctagccagtttccccagcagggagtcctttccccatggcttagtcttattgactttgttgaagatcagttggttgttgctgtgtggctttatttgtgggtttatttcttattctgttggtctatgtgtctatttttgtaccagcaccatgctattttggttactgtagccttgtagtatagtttgaagtcaggtaatatgtttgttctttttgtttaaggttactttagctattcatgctcttttgtggttccagaattttagaatactttttcttctaattctatgaaaaatgacattcacaatttgataggaatagtgttgaatctttagattgctttgggcagtatggacattttaataatattgattcttccaatccatgagcatggaatgtttttccatttgcttgtgttgtccatgatttctttcagcagtgttttatagttcccttacagagatctttcacctctttggttagatatattaatatttctgggtattttattatcgtgtgtgtgtgtggctattgttaatgaaatagcattcttcatttggctctcagcttgaatgttgttgctatatagaaatgctactgatttttgtatgttgatttcatatcctgaagccttagtgaagttgtttatcaggtctaggagccttttggcaaagtctaggtttttctaagtgtagaattgtgtatcttttcatatgtttatatgcatctgtttgtgttctttggtgaggtggttgttcagatcttttgcccatttttttaattggttttttaaaaattgaattttaagagttctttgtataactttacttatttttcacacccaaattttctaagtattttgagagaccttaaatgtgatcatcaacttcttaacttcatagattttaaaagttagttcagaataaagtttacccttcctcattaatacacttaataatgcttagttttaacaaattatatacatacacacacacacacgcatatatatatatacacacacacacacacatacacatacacacacacatacacacaatcactccttaaatgtgcaagaccgggacttgactttgagaaatttcaattcaggaaggaaaattcaatgggaggtattattatagatttaatttgatgggaaacgaggcagaaaatttcaaggacattatcccctttatattctcttcatcctttgctgattctggctttaaaagacttcagaagtcttccagagacatttatgcattttctgaaggaatggtaaaaatcctaattctgggtaactttgttttactccaaactcttggtgctaagattctgttccgtagtttctcaccaaagcattctgtccccttcagatagtcaaacatatgacaaacaaaaatacccacaccctctttcctttcctacctggtgctaattggaaagggtacctggtcagcgcatttatttcactttcagtcatgggggagtctaattatgtttgatttaaccaaataatacaaaattcctcagttcttgcttatggatttggacttcaaagcatcttgcctttacctctcagaagctgttctcacttgttttttgttttgttttgttttgtttttgagatggagtcttgctctgtcgcccaggctggagtgcagttggtgtgatctcggctcactgcaacctccacctcctgggttgaagcaattctcttgcctcagcctcccaagtaactgggattacaggcatgcgccacacgccgagctaattttttgtatttctagtagagacagggtttcaccatgttggtcaggctggtcttgaactcctgacctcaagtgatccacccgcctcggcctcccaaagtgctggggttacgggcgtgagccaccgtgcttggccatctcacttgttttgaatcaggatgcctaggtcagtgagagcctgtgtgagccaaaaacagccacgttcatctttgaaaaaacttaggccgacaaatcaagtttttaattacaggaaataatcaccaactactggagatgcaattaaaggcatttttctctgagagtagcttgtttgtcttttatatttttccccaaagctcattataaaaaatactatgttctttcatacttacagtctcaactctatcacttcctgctgtgagtatggaaatgaattttgttgaaatcaaagaaattagttaataagattttttttagcctgttagtagaagtggcttaacgtttataaagaatatttgctttgctcataatttaactgaatgagacatctgacctctgctgtctatcaaattcattaccgctttctgggacccatgaactgccttacattgtactagttgagaactgatgaaataaaaccataactcgattcatcaaactgtttagaattcaaatgttgagacatatctcacttaataacatgagggtattttgtttttctttttaaattgttcactctggcctttagtagccaccagggagacatgtgagtttggaagggcatctcaggtcaatcctaaaagcctgcagaagaactgagctggcagaatataatcctgcaggttgaaacttagccagcctttgaaattattttcatcgggaaagtactacaggattttttaaaatgacatagtagacaccctactcagaagcctactccctaatttttttttctagttactcatttgccaagatgacttgtttatttgaaagttgttgtgatggaagttggattatgtatattatgattgcttttcttcctgtgtattattttcatttgaaaatgtcaaagtatctcaccattttcctattttatagactagtaaactgagttatatgattttggtgaatttaagcttccagggctagatctccatttagctttctcttctactatttagcgcagtccatacaaagctagctgcaccagagagcattttatctgaatcctattcttgttcaccatgccttcagcaagcacattttacagagcgtccacacgccggccaatagaactgcaggtgtgagcagttccattaacctgtcctcaagccttagtgggagagatggcacagaattgctatataggatgtgaatgctcactcaagggacagagcatacaaggagaccagagaaacagaccatgggaacactagagggaacaaaaggataagaggcagtttgggtcagggaaggctgaggcttgaagagtgagttggagtttgccagacacagaagagacccttggaagcaaagagatcatggtatgtcctgtgcagagtttaatgagcacagcgtgtgtaggggacatgcttggacatgagacagctggggctgaatcaatgaagtacctggttaagatgtttggacttaatcctgtaggcactgggaagcaactaaaaggtaaatagggaagtgacatatcaaatttgcactttaggcaagtccaatgagaagggtttgagttccatcttatgaaaagctgcttctagatgccctgcaatttatacagctgccatatattaatctcctactgtgtgcctgggcatgcccatacatgtttttctttactttttacgcttttttctctactggctcttaacctgcctcatcctatgccaagtttataaacatatttcaatttaatattataaataaaataataatacaaagccattaagatgaagagattgccattgctgttgcattcagcaactgggagtccctgcaaatttgggaagagctggttcagtggagggcacgggcactggggtggtgactgattgagaggtaaggaaggggaagtgggaatatagatgctccttctggaaggtggactgtgaaaggaaggagttaaccagtgaaggctataagatgtgtgggccctacagaggcctgagaggagagaccctgaaggcatggaaacagttggtgggtggatttgcttttaataggggaaagaggaggagaaggtggaggaggagggatggaaatattttttccactgccaatgatggaagatcgcagttggggctgaattgtcctcatggaggaggaggaggaggaggaagttgtagaaggtttactgcttgccatcgaattttccaacaaagatcttccactgaaaatgagagaagaggttgatgaggaaggagactggaagagaagggacaagcttgagagagtttccgtgtgggaaggagaggggaatgttgagaaggattgtcactagggccctggcaagggtagggacctctagtaggtagtctcagtaatgaccagcaacacagtgtgggaacaggaaaggatgctgggaccccctgggattgagattgggctgtgtgggggtggtaggagggaaggtaagtggtcagaggagctgaaggctttgagaaaagtatgggcaagtgctagatcatggcacccagtctttttaatagtaggctgaaagaagatacagatggtcaaagatttggggattgtgggagccaacaggttgttatcaaaagcgaagagaatagagttgaagatttcagatgtagagcaacagttccgagtgatactaagctccaaggtatggcagttcgtgtgcagaggctaggcaagagtcctaggagataaggaggccgaaaaacctggagaccaaagaaccaggaggtcaaagaatctggaggtgccaagccttgtcctaagggccctgaaaccctcagggtgatggcaaaaattggagggaagagagagtggaagtagaactcccaaatcttcaatgaacagtgggctcattatctgcataagagtgaggattcatgggaaatgtgctccccagaagaaagcttcttacttgcattaaaaatattaagagtaactctgaaaacatgattttaatcacaatttctctcagtggattttagggttttggaaaaggccacaagtgccctaaagtagaagtctattgagataatgaaagtttactgaaaattgtatctgcaaacattacctgtcattcatctctcaggtgaggttgtatgagtgtaaaaaaaaaaaagttctttcttttttgctaactttcaccttatcacaataatgcaacaggaagagagtttcaacaaagcataatataaacagatgtctctcttttttttttttttcagacggagtcttgctctgtcacccaggctggagtgtagtggtgtgatctcggctcactgcgacctccacccccagattcaagcgattctcctgcctcagcctcccaagtagctggggttacaggtgcccaccaccatgcctggctaatttttgtaattttagtgagacagggtttcaccatgttggctaggctggtctcaaactcctgacctcaggtgctccacctgcctcggcctcccaaagtgctgggattacaggcatgatccaccgtgcctggccatgaagtctctcttaagaccttttattgtgtggggcagggggttgtttaaaatacatccagtgggaatggcaaattgtgccctcttttcaaagtttgtttttcctccatcatctatatttgagttgttctgtgtgaataagttttggaatgcttcctccttcttgttgaccacagtggttgttgacatagacagaggttgttgggataggaagagatccctgaggttgtcttgtggacaacaaagacccacgataacttttcttcccatataagcatgggctatcctagagcccagtcccctgtgggatatgaccaacaattatcttagaaaatttcactcaatcggctgggcatggtggctcacgcctgtagtcccagcactttgagaggctgaggcgggcggatcacctgaggtcaggaattccagaccagcctggccaacatggtaaaaccctgtctccactaaaaatacaaaaaagtagccaggcatggtggcaggtgcctgaaatcccagctattagggtggctgaagcaagagaatcacttgaacctgggaggcggaggttctagtgagtcaagatcgcaccattgcactccagcttgggcaacaagagtgacactccatctcagaaaaagaaaacttcactcaatcatttcacttctacctctcccagtcctctttggagcgtgaggacacttgtaaggcagtctgtggggacagtaacttataggttgtgtcctgtccggtagtgggctttcatcagaagtatgcttttggtcacactacaccatttttttataccaccatagagttgacaaacagcattcacccatttcattttgctttactactccgatgtggagaaaaaaaaaatctaaggattacatttctcttgcagattttttagatcaatagctattatttaaatacagggaatcctgaaagtctaagactaaaaaatttgggttccttttgtatatgttaaattctcccatatacacatgggtctgtaaataaaaataaataggtggcccctacccttgcagttgcatagagaaactagaccctgaaataaaatggaacaacattggaggatttttgtttagtggattaaaaattcaataatacttgaaaactttgtccagctcttcaacagagatatttggatgagttttctggcttttctaatcaggaaaggcttgttggagaattaaaggagatatgattgaggaaataaaacacaatacaagatttttctggatttattatgaataaaaagggaccccagaggattaagtggatgtagtttgcagttgaggttaagtggtcatggcagtttaccgtggacattgtttaactgatggaaaactccaaaagactgaccaaggaattgaagtagaccaatttggaccaataacttggagctcagaattaaccactgtatttctctattccaaatacccattcctcttccctggaacctcaggctggccacacaaactttcttgaaaattcttggggttctgcctttacaggaaggccatttgcctcactcatcagaagtattagaggtttattctgcacaaccatgaagaggttaaagagaagggtagggaggccatgagggttcttacattccatcttgagtcaaccatctcctgttaccctctgaaaagtggcagaatttgtcccagacttttttttgttgcacttcatatctactatggaattacatttatagctaatgcattaactctaaaaatggagaaacccattgctctgctgttttcatggtaaggaaaaactgctgagtcatgattgacatgggctgtttcaagagtttccacggaatgaaggtaaacgcttaggatatcgcagcctgagtgagaggcactgcaaagtgtggccgctacttgaagttcttcatggtgagtggagagggaatcctgagcgcatcctggattagaaaaaaaaaagaagaaaggtggcctgaaatatgatctgagtatatctggaaatacgcagacatctagtacttcacttgcagcactctgtgaaccagaaggccaatttctacatgctacaagctgcacttcaagatgcacccaaaatgcatgctcgggaagttgttttttgtttttgttttgttttgtttctgagacagactctccctctgtcgcccagccaggagtacagtggcgtaatcttggctggctgcaacctctgcctcctgggttcaagcagttattttgcctcagcctcccgagtagctgggattataggcatgtgccaccatgcccggctaattttgttgttgttgttgtttgttttgtttgtttttgtttttagtagagacaggatttcaccacattggccagcctggtcttgaactcctgacctcaagtgatctgccagcgtcggcctcccaaagtgctgggattacaggcgtgagccaccgcgcctggctgggaagtcttttttaatggcaataaccaaatgaactctcttgaccttgctgcctctgcaggcactgccccgccccggcccttccactctagaggaaagcacctggcatttagcatctttacacacaggaaacaacagatatgctcagggacttttcctctagcttgtaaccagggatggctgttgggcttggcagccgtcaggctgagagtgactcagcttaaaaggtttcattgttgatatctgccctgagcattcccctttggacttggagttccaggatgtcttgtgtctgtgcttcagcatctgaagccccttgttgcctgttcttaaggtagactgcattatcaacggtgtcttaaattaatagcttctctctactgactattcacttgtcacagctgacatgaaggttctcagtcctgagtgcctattaatgaagctcacagatagagtgcagaaaccctttgcaagatctgttttgccagcttgctggtgtcctggcatgaaggtctccgaccgacgtctttgaaatagttcctggccgggtgcggtggctcacgcctggaatcccagcactttgggaggccaaggcgggcggatcacgaggtcaggagatggagaccatcctggctaagacggggaaacaccgtctctaataaaaatagaaaaaatagccgggcgtggtggcaggcgcctgtagtcccagctactggggaggctgaggcgaatggcatgaacctgggaggcggagcttgcagtgagccgagatagcgccactgcactccagcctgggtgacagagcgagactccgtctcaaaaaaaaaaaaaaaaaaaaaaaaaagaaatagttcctttccacgtggagtggactggccaccttggggctctacatttgcctgcttggttcaggcagttctgtcccatttcatgtacatttcactcttttcccctactagcttctcacagtttaaattatcgatgtgattgcctacccagacatctaattctttcaacaggtagtggtttacagactccagtttctttatgatcatcaagacagggattgaacaactggcaccttccctgtctgtccattgaggggcatgtgtttgatgtgtgtggatgctactttcattaggcaagttaatggcagttagctacgttcacactgaggaggaaatagaccaccgtgtatgcatttagtaaacaccagcgtagtcagtggatctgtttccttaacagaacatggttctgctccactgtacacttcaaccaactgcttcagagcaagctttttccttagaaaagttttcatttaattaggatttagaaaggaacgtggaaactttaagatctccatttagtcttctgcatacttcagagacttctgatgtctcctacagggacaggaaaggagtcaggggtctgaaactctaggacctgaaaggcaagtgcaattcggtcactgtccacattgccagggtgtcaaatcacacataccctgcctgaaagtctgggaattggagaatttaaaatgacaatattttctactgtggaataccttgcattctcccactctgtaaactactattctggaggcggcccctctcactatatttcaaaaccagatgcttttctctggaaatactagaaatgtctctcttctgggctgacctaaaaccaacatagtattgggcattgaagtaaggagaaatatggtcagtgaggctaagacctcctcttctgagaatgaaaaatgactgagtattttgtgttaggtgggacactatttgttaatagagaacttatatcttaagtctcttaaaataattatagcatctcttagttatttccagcataatccaggagtgagcattccaagaacatcatcttacaacttttaattaatatatctttctctaacccttaaagaaatgctggtaactgcttgtcagatgaggaaaagatggatcattattcaagtaagatccaatatgggaaactcagatataaatagttcagcattttcgtttcttatcaaagatttatgactgtgtctactttaggatttatttcttctggactatttcaggagccccttcactggtctttcagcctcaatttcctttcctccgcccctttgtttgtttctcccactgctctgaggacagttgtcataaagctcagttctagacttcttgatttgtgtcccgggtgcttccccagttgttctcaggccaatttctcaggcccctgtttcaccattttatccacacctccaacaggcattccctcctggtggaacttctccctcttcatctgagggtgaagggtctctttgttgacactggtccctctgccgggcatcctctcccttctatacctccctattgctaccaatccttccttcactaagaaatcaacctaaatgccaccttcttcatcccagacatgctaccactcctgagccaggagtaattaattctttgacctgttgtatcgctcttatggcacatggctcttctgtttgatttggaaaaacgtatatctccttatgcaaattgtaagttctttgaaggcagggtccatgtttaattattttattctttaatgtgccttagtacttaaaatgtcctctgctggccagcagtaagggtgtcacctgtgagcttgctcaaaaagcagactgtcagcccccatctcagatatgtgggatcagaattcacattttttttcttttttctttttggagacaggggcccactctgttgcccaggctggagtgcagtggcacaatcattgctcactgcagccttgacctcctgggctcaagcgatcttctcccctcagcctcctgaatagttggccttacaggtgcacatcatcaaacccagttaatttttaagtttttttgtagagaggtgtctccatgttgccaaggctggttggtctcaaactcctggcctctcaagcagtcctcccgcctaggctttccaaagtgctggaattacaggagtgaatcactatgcccggccaggatccacattttaacaaggggtctccaggtgattccaatgcagctgagttgggagttctggctttgtacattgcacagaaccttgtataaagcagagactccctggatagctattgaacaactaatgaataaatcacattaaaagctgagtttcttctcattgacttagagggaggttacctcataattactcaaacatagaaaacgtaacccaacatgtaccattttcctatgaccattttgagtcttaaaaacgtggaaacccttttcttcttttaaaatcttggatttgttatttcagatcacctttgatagtttttctttctttcattttttgtgtaccctcactgggtagtgtttggccttcgcgaagaaggatagagagaaagcttgctaattggggctaaatacagattatgtgcaaaaaaagaaattgctagcatctaaaaataagcactctacacgtgtatagttttataatcttatcagctgtgatcttcaggaccaagtacgtggcaactacaggaggatggtctctgtcgctgtcaaaagctgagtattccaactctcacttacttgataccaaccacagaaggacatgagactgtaatacactgggattttcaaaatgcaaaagaatttgatattaaaggcttgttagctgtctaggaataaaacaagaatggggagaaacatataaagtaaggaagattatctctctacagctaaaaccaggcaaaaggaccacccactatggcatattgtgaaaattttgggggctacttttgtttgtcacaataattggagcagttggttgaagggtacaatgcagcagggccatgttctgttaaggaaacagatccactgactacatttgtgtttaataattgcatgcttagtggtctgtttctcctcagtgtgacgtaagtaactaccatgagtttgcctaatggaagtagcatccacacacatccagcacatgccccttgatggacagacagggaaggtgccagttgctcagtccccatctcaatgatcataaagaaactggagtctttagactgggtgcagtgtctcatgcctgtaatcccagcactttgggaggccaaggcaggcggatcacctgaggtcaggtcaggagttcaagatcatactggccaagatggtaaaaccccatctctactaaaaatataaaaattagctgggtgtagtggcccatgcctgtaatccaagctactcaggaggctgaggcaggagaatcacttgaagctgggaggtggaggttgcagtgagctgagatcatgccactgcattccagcctgggcaacagaacaagactctgtctcaaaaaataaaaaatttaaaaatttaaagaaagaaactggagtctttaaatgactgcctgttaaaagaagcagatgtctgagtagacaatcacatcaaggattttaactgagagaagctagtaggggaacaaagtgaaaggtacatgaaataggacaaaggccagggatactagataccttgcaaggcataggatagtctcatactgtgaagaattgtcacttgaggccgtgactttagaacatctggcctgacattttggtggtgaaaaagtgtttttattaatagactctaaaaatatttttatataaacaaaaattaaatatatgctaaatttttcaggaatgcaattaccatttcaattgagaggatactgtcctttgttttgtttagaactttactatacagtaatgtctctgctcatatcagtctgcatgtgtaactattgaattcacactgattctacttagaggtagctcctgatgtcattgtacctgagcatttgtatattgaaatgttccttatttgtttagaaattttttttttctcatttatataataggatattgtattgatttttttaaatctatgtgactaagcaagttttaaaataagtatatctcaggatataaaaagaggccttgggtctgatgggtttgagaattactggcatggacagcctcattagttcctgtcttaagacagaggataataaaagttaaaggctcagacttaatcaaagggttagaaataggagtagcgagccgggcgcagtggctcacgtctatcattccagcactttgggaggccgaagtgggcggatcacctgaggtcaggagtttgagaccagcctggtcaacatggcaaaacctcttctctactaaatatacaaaaattagccgggcatggtagtacctgcttatagtctcagctactcaggaggctgaggcaggagaatcacttgaacttggaaggcggaggccatggtgagccaagatcgcaccactgcactccagcctgggcgacagaggaagactccatctcaaaaagaaaaaataaataaataaaataaaataaatagtaagagcatatcccacaggaaaagaagctgagagacaatcttggagggaattcatgtatggggcaacttgtcagaatgaacagagcttgggctcaggaattaatgcactgagtttggtgctcttctcttcaactttcagaattcaactatcctgaattctggcttctgggggtcccggcagggtcagaatgaatattagagataatgaccttaaaacacctagcacagagttgcaaaaaatgttacaaattgtaaatactgtatataataacgctaatgtcatctggctcttcaaaatggaaaatgatgaagctatcttactggcttttagagaagttgaccgagttttctacaattgctcatggctagattttggggccaggctctaaaatccaggttctttagattattttgagcctaacaaccaacttaggtttgacctgacttgaatcactctcttcctctaaaattccctgtactcttggctttgtccatacagaacctgtacatcaaattacaccaaatatcacaatcctgtagctttctcatggcaacgtaagtgcctttgatatgtgagttttttcctttttttctggaaacagggtcttgctctgttgcccaggctctgatcgtagctcactgcagccttgacctccctggctcaaacagtcctcccacctcagcctcccaagtagctgagaccataggtgtgcaccaccacgcctggctaattttttaatttttttgtagagacagaatctccctatgttgctcaggctggtttgaaactcctgagttaatgtgatcttctcaccttggcctcccaaagtactgggattacaggcatgagccactgactcaatctagttttttccttttcagtagtcacttttacgcttatgagtaaactacaattttatgaagcctgtggatgctggagtgatacttacagccctggtgtgtcctctgtgggttcagcctgccctgtgaactaatgaaatttaaccagtgtggtgcctccctcccatttagacttctctctctgaccaaactgcctctgttttccttccctttagacccccagaagctgtgcatgctccatgtccagcaataacttttctcctagattctttactgcttgttcgattccagatgcaagagatatagcttcacccgtgcttcctatcttcctgtgatttctctgctaccgcagagggtagtcaccaacctttagctcaaacactgatgccgaggctacgtacagagagatgctttaccagttactcaccttcctcactgggcatctgcagagactcctagagaaatgtttgtaagacaacatgagttataaattttgcattcaaaatcttttaaattggtaacaaaatgaatccctgtcccacagtgtgaagagatcactgcttagtcagtttccttttgggagaattatttccaatttttttaagttaaatgctagttattagaaaagtgaccacatggccacctgagtctgttcagatcttttggaccattttccttctcctcttctgcacacctcgatttgcttgtcacaggtgttccagagattccttctgttcttgtctttggcaggatcatcttgaattgagtagtataaatatatcctgcctctgtttctactatgaaagcccctctctctgcatttcctgcatggtttccttacgctgttctgtgcattttgggtggcgtctgcattcttttattatttttttgagatggagtctcattgtatcacccaagctggagtgcagtggcacgatctcgactcactacagcctccacctcctgggttcaagcaattctcctgcctcagcctcctgagtagctgggactagaggcatgcaccaccacacctggctaattttgtatttttagtagagatggggtttcaccatgttggccaggctggtctcaaacccctcacctgaagtgaattcgcctgtttgtttgtttattgagacaagagtctcactctgttgcccaggctggagtgcagtggtgttatcttggctcactgcaacctctgccttccgggttcaagcaattctcatgcctctgccttccgaatagctgggattacaggcaccagccaccacgcccggctgatttttgtatttttagtaggcacagggtttcaccatgttggccaagcctgtcttgaactcctgacctcaagtgatccacccgcctcagcctcccaaagtgctgggattacaggtgtgagcccccgcaactggccaggtctgcattcctaatgctacttttgagcccggcaatctcagacaataaaattcagtgcagctggggcagataagtgcccccctgctctcacatttctctttagtcttggcatcttcaagttagaaccaggtcattatttttgtatcaatgacatttcattatgccataaatactgaggtgttaaaaacaccaaaaaagccctaaaaatgcctagaaaattatccgaagcatttactattaaggctgataaactttttcttctcttttcaaatataaattgattataaagcatattgagtgacttcaagctgaaggttttcagtatctggaaaactgaaatttaattgcagccttcatgtcaccacagtgccaggtgcagcatagtgctcagggccccacgcaccttctaacttccattcccaaacaggtcttccctcctctccattccccaaaccccaaccatctccacctgctgacactgtagcttcatccccagatcacttcagctgaaagtggttttcctttttctggattccaagaaggactttgcttgcaaaaaatgtttatttacttatttttttttaaaggcaacagaagttccacaattaatcttttcttgtaagtagactttattttttagaacgggttggccaggcgcagtggctcatgcctaaaatcccagcactttgggaggctgaggcaggcagatcacctgaggtcaggagttcgagaccagcctggtcaatgtggtgaaaccctgtatctacgaaaaatacaaaaattagctgagcgtggtggcgcccgcctataatcccagctacttgggaggctgaggcaggagaatcacttgaaccggggaggcggaggctgcagtgagccgagatcacgccactgcacttcagcctgggcgacagattaagactccatctcaaagaaaagaaaagactgagagacagcaaacgagacatagggtttatcaggggaacttacttacagggatggtccagtggtggcaggttggacaggagaaccactaccatttgtaaaaagcatacagtttatatagcattttcacttagcaccctccacctagcaacctccatttaacccaaaacaaagggacttgatcccctgtatgacctgcatttcaagagacaggccaggggtttggatgtccatcatgggtaaggagtgaatccctgggttggccactcctggattccttagctcagaactctgaatgcacattcttcttgatcatagtgtcattctcagggcatgcctaggttaagttattgctgtcaggtgcatctctatacacttcctaatgtgttgctcttttatgagtgaattacctttaatttggccttatgttttctatgtctatgttgtgcttctcttttattcttatttattcagtgtatatttcttaagggcatattaggcactgctgtgtaggtctggaaaaacagggaacacacaaagtacctgccttattagtgccaggatttcagagaaaacaggcaggtgacagacaaaccaatagatggcatgcagtataagtgctatgaaaaaaaaataagacagtgtaagggaaatcgacacaggagaccttaaagagaaggccttctggatgaaaggacactttgagcagacaccagggagcagtgagggaggaggtggccatgtggatatctgtctagtggaagagcccagaaggcagaggaaacaacacaagttagacagttaagaccaaggccttaggtggggtggcaggatggctacatgggactgagggaccatatgggggtgggacatagtcaaggtcaaggtcatgtagggtcttaacaggctgtagtaaaggcttgaatttttactctgagtaagagggaaaatcattggctttttatttttctagaaatagggtcttgctctgtcacccaggctggagtgcagtggctcaatcatagttcactgcagccgcaaactcctgggctccagcgatcctcccatctcagccttcctagtagctgggactgcaggtgcacaccaccaagcccagttaatttttaaattttttttttagagacaggatcttgctgtgatgcccaggctggtttcaaactcctggcctcaagcgatcctcctgcctcgatctccctaagtgctaggattacaggcatgagccaccacacctggcctccattggagggttttaaagacttatatacttagttaaagcagtctgtagggggataaggcaagcctggaagcagggagacccgtgaggaggctcctggacaacgtagggacaacaggccatgactagggtggtggccatgagaggtgagaattaatcagatcccagttcacagagttgatgggatttactactggtctgactgggaaggactgtaaagaaaagcagggagtcaagaatgattagaaacaaggtttgtgccctcggcaactggaggaggattcctgatgtcatttacagagaatggggaggggatctgaggtgggattaagcttgaggaacaaactcaagttgggttttggacagactacattcgaagttcctgttggacgttgaaggctgttggctgtgagtctgccttccaaatccctgagtccttgaattcaaggtcgtgtgttggccgtctttgtattaggacatctaactcttgtgtttgacttaatgggattcaaatttgcacgtgtgtggttttctgaatgtggcctacagtttcacttggatcttcatattctttttcatcataatctgtaaaagcagaaaaaaagaccattggaaagaaatgctgtatgaaactttctgaaaatggatagaaccagaaatgatgctgacaggagttttagaaatgaaaaatagagagtattcagaccaaatataagtaaattagcataaatcagcattctctgatttccacgcctacttacccaagttggttgactcaacagctgctaagactacagctgtgtgaatcctccacatttttttttttttttgcatggaaaagtgtttcagtttgtcattgcttcatcatttcgaattccatattaggttacctttttttttttttttttgcctgaccatagtacttaagaaaaatcttgcaactgtccttcattctgttgaaccaactatatcttatgttttcacttgacattttgttttagatctacttggggctttatttaaatttttttaacatttaaaaaaatttttttacttaaataatgaggcagtgtctcattattatccaggctggactgcatggggcattcatagttcctgggctcaagcaatcttcctgtctcagcctccaaagtaactaggactaacagcatgtaccaccacatccaactagtttttttcatttttttatagggacggggtctcgttatgttgcccaggctggtcttgaactcctggcctcaagtgctcctcctacctttaagtgctgagattacaggcatgagccaccagacctgaccttggggttttattatttgccttcgagccccttcagacagttcttcttggaggtttggggaaggcttctgtaaagaaaacttccttacacctgtttgatgatggtaaaaggtccaggtggagaaagacttcctaggcagaaggaaaaggaagtgcaaagctatgtagcctctacaagagcacatgtgtagtttagggtggctgcataggacctgggaagagagctgggtgatgcagggcagatgactggcaggtaatgaaggtacttatgggctatgctaaggagtatggaaaatggggagtattcaaaatttagagcccagggtacagtgatgggattgcattttttgacaaagctactttgactgccatgtaaagaacaaatgggaggtgagggagcctgattagaaggtccttgatgatgcaggcaaaagatgatgaaggtctcaaagttctttgagccttgactggaacacatttagtgtgacgtgtgtttataacataaaattaaatacgaaagcagaaacattggtgatggagaggagagcacaaaattggggagatattgtagccaggttgaaagcttgtactgctcactgcacaacagccagtaagtcaagagacaaggagttagagtaaggaagatgactttatttggagagccagcaaaccaagaagatggtggactggtgtcctaaagaaccatcttaaaagacatgaatctcaagcttctttttatatttgggaaaggggaacaaggagagggttgaggtgacaggtgaccacagacatctgagcattagcaggcgtccgagggtgttacattgaatattgcattgttacttgtgtctatgccctttttatttcctcagtggttagttttgggaagggactattatcatccttgctttaaactgtaaactaaatcccccccatggttatcttggcttatgtgtgggaatgagcaaagatagtcagcttgagcggttagaagcaagatggagttagttagctacgttatgtttctgtaactgttacgtcttacttgtaggattacaacatctacttggatgaatggtgatgtcattctagcatgaggagcaggtgggattaggttgaggttgaatgggaccatagttctgtcaggacgtgtcatctttgtggagcccaggggtcatccattaagcagctgggaatacagttctggggctcagcagagacctcagcctggaagaacatgtttagaagtcatcaacatctcattaggaaagagaaagagatcgcccaggagaggaaatagagcaaggagagaaaatggtcaacaagggaaaccatgctgggattgagtctctgtggtaccaatggtcttactattgacgtcagagttaaaaaagaagagagttatattcaaattctggttgagttagtctcttattaacatttcctgactcaccaactggtaaatgtccaagaaaaatatatctttttgttttatcagaaaatatacatgctatttgatcactcttcaggcattaacaaatggtgtctatgagaacattttaacaaaatgtcctttctactgttaatacccacagcaaccaacttggaaatcagtcatcatagaagatgactgcaggttctggctttcccaaatcaccaataattcacacctttgtacatggttctgtgcatgatctgttcctaatattatgcaacacttgtgaaatctttaggactttaagtaattcatcgttttgccccaaacctagacactactataagaaacccaacaggctactcttaccagcaataggggttcctgaacaatatcacggaacaatgagaaatcctgcactcatgaattctctttacaaccccaggtgctcaagcatggtttttaagggtgactccctggccacctggtaagtctgagtgacttgcgggcagctgtctttctggagcgggagttattctctgaagccatagaaagtgtcagggaaggctggatacacatcacgtatgtgcatgagaagtaatactttcaacagcagcagcatcttccaagtgataaaaataactcagctttagtcagtagcccagaagccaagtgtcccctttcactgcttgttctctgttggtattcttcaaagggacatcgtgtctttcacagtttggaatgtgatgtttctgttctcactgacataactgtcttagtatctgctcctcctcttgtcatatatttggaaggtcttcacctcttgatcacttgcattttacattctacttgtctattgttcattcacacggcaagaaatgacggctacctgccgggcattagttagcaaagctgcttatactctgatttctattgttctcccagtttttagactgtagccgtttaattacaatgcagcagctttcacgtcagtatttctcctgaaggtcttagtttattttattcctccatcacagaaggttccttgaggtcctgtattctgaaaatagatgcatttcttccaaaatactggatagcttttagatttttcaaagttcttggcaagtctacttttggaaaccttgactgacttgcgaatatgatttctccttttttcttagctccgggttgagctccttctcaagagctcttatgttataaagcttgtgttcatgagcagagaaggactgatagtgggtgttattaatcattgaaagatgtggctgtgactgctattatttcctgtgttaagcttcccaccagcaaacctggccaagtgctttggcgctgtggaaacagccttcgtgtacacacttcttgacccttcactcccttcatgcccttcttcccatcaagacttaatgattggctgggcatggtagctcatgcttataatcccagcgctttgggaggtcaaagtggaaggatcacttgaatccaggagtttgagaccagcctggaccacataatgagaccccatctctccaaaaaaaaaaaaaaaaatattagccaggcatagtggcaacatgcctgtagtcccagctacatgagaggctgaggctggaggattgcttgagcgtaagaggtcggggctacattgagccgtgattgtgctactgcacttagccttggtgacagagtgagaccttgtctcaaaaaaaagaaaagaactggaaaagaaaaaagaatggtgttcatctccacccagcatgctagagcaggcatgccattcattgtggaggcaaaactcccgcatagctgccaaaataactgctgagtgctttgcgatggagagaaacaaaggaatgttgggtcactgcccgagtcatggggtctctgcctgagccatagaaagcttttgatttctggagccacattgaatgaactgattatgtttaaaattataaaagaaaaatatagcctaagataattgagtgcaataaaccaatttaacttatttgttcttacgtgtaacaattgttgagtaggtaccatggtacccactctattgctaagctgtggaaggagccttgctttggaattctctcagctcctctttcccatcatttccttagctgtgtcccttttcagcctcctgtgctaactgatagcacatgtgtttcagaatggaacctggaaaaggaatgtgtgcagccctcgtaaggatataccgttccacattccatatgctgttagataatatgctggctagaccgtcaacagttaccccaggaagggggaatttggattggaaagaaatcaaaggaattggaggtaacataatggactgcagttaaacagtaatagggtggtctggacaactggacgaaggccagtttctaaattgcaggcaatcccctctgcccttttagaacaaggcaaggtccactgaatggagaagaaggcaggccatcagccttcttagggtttaattcagacacgggctctgagctttgtcttttgttctctttaaaggaacaaagccattgaatccagccagaaaaacctgtgcgtatccatcataaacatccacaaactcttctttaatctcccttgttattctccctaagaagtaaggctccaacataagttcttggttgcatctgacaagtgtcagctgatgtccatgaccccttcgtttcctgtgtcccttctacttgatgcaatgactggcataacgtatttgttggaatgaatgaatgaatggcattggtggctgggcacagtggctcatgcctctaatcccagcactttgggagtccgaggtggctagatcagttgaggtgaggagtttgagaccagcctggccaacatggtgaaatgctgtctctactaaaatttcaaaaattagctaggcatggtggctaatgcctgtaatcccagctacttgggaggctgaggtcggaggatcacttgaacccaggaggcggaggttgcagtgagctgagatcacaccactgcactgcagcctgggtgacagagcaagactctgtcaaaaaaaaaaaaaaaaaaaggaaggaaggaagggagggagggagggagggaaggagggagagagagaggaagggtgagtgagtggaagaaaacaatgaaatccagttctgagggtaaggagcatgccatcaatatgatgggggatgtgatatggtatgaggatggggtctttcaaactgtattgtgtagaccagtagaccatgacaaataggcgcgcgcacgcgcgcgcgcacacacacacacacacacacacacacacgggcttccatgttcttacaaatgttgcacactatatctgactgtgggatcacagtgtacgtttgtataccaaagtctctgtaaagacctgcaatgaagtgaacccctttaacctttcttttactcagtgttcccctattgtatttgactgtggaaccctctgcgtcatacccttttacatcccagaacccaccgaacacagtttcttcaacattggcagaaatttacaaaatcatcgtagtcttgagtccagctgacctgagtgtgaatcaaggtttaccacatagtgtgtgatcctgagccaaattaagtaacctctggttccctccttcctcatctatatgatgaggataatgtgcatctcctaaaaggagagaatgaaggcagttaatgcaggtaatccatcttgcgtgcacccagcacagggtggctcttccctggttaatttccaccctgatgtgtagaatttccctgcaacactctgctaccacaaagaggggcttcttaggatataacctattgtccttaaactttatgagcagtgcaataattgttatttgcacctgtaaaatgtgaataactggtctttctttttaaaatactttcccaaaggaaaattatggcaaagagatcatgtcctaactagtttctcacgtgttggtgctatcacctcctgagttttggcaacgttatttctctgctttttttcttgactcccctctagttcttctaaattagatattaagcaggagaagtatttttaatatcctggaaatgtgttttattaatctaccaaacaaatggctgtccaacaactccatgaaacaggaagaacggccactagcattcattttgcttttaccaggcaccaggtagcgctgtaaactctttatgtgtgtaattcatttcatcttcacaacaactcgatgaggtaagtgctattatctgcagtttgcagagaaggaaaccgaagctggtggagtaacatgcctaaggccaccctgccaggataagatgaatgaccacgactctgagtgactaaagccttaggaacaaagatgagttgaaaatgggagagccacctggggtagaaccccagagtttttattttcttgcaaagttttagtaaaactttctcagttttcaggaaacaaaagttatatattttagagtttgaaatcacaaattacacaccactcccccatctctagcctctacatttttaagcaagatcaacagaacccagtggagttccatggagttcagggaccttgctccaggtgtgcctctaacactcagtcccttttccaaggcagggcacatataattgaatataggctgggtgtggtgtctcatgcctgtaatcccagcactttaggtggccgaggcacgtggatcacttgagcccaggagttggagaccagcctgggcaacttggtgaaaacccatctctacaaaaaatgcaacaattagccaagtgtggtggtgcacacctgtagtcctagctatttgagaggctgaggttggaggatcacgtgagcctgaagaggttgaggttgcagtgagccaagattgtaccactgcactccaacctgggcaagagagtgagaccctgtctcaaacaaaacaaaacaaagcaaaaaaatgaagattgccaaatatttaaatgtcagttactattaatttaaatgtccatcagggttctccttgaagtcaaaactgctgttttccccaatgccagaactcctaacagtggaccccaggccgtaggaggtgatctagaattgcccctgaattaaaggctttgtgttctgcacacgtgatgcaacctcaggatcggacatgtgttagttcccagcctgtgtcctgtgacaccttggagaacaatcgagactggttgatatttggagggttaagcaaaggacctttcttttgccagctactctgccgtggttgaagtgtcttgagggtggtgaacgggtcctcgctgggcttgtctctgagctgcacacattgacttgacacaggagtcaagtagtaagtattggttgaaggaatcagcgatgtttggctacccattgtgtgctctctaatatttgctagggatatggtgataagggaggaaaaagacccaaggagtaatgaccgagcagctatgtaagtgaatcaatgatgtgaccacattgctttttcttagccgatagttacagctctatgcaactttttctacttattgctggaggtaatcacattccaaccctgaggactgctcccatgctgggcggtactgcagtgacctctgcatttgagctggggtttcttgtatctcacgagggtcaggggcctgtgggaactttttgtcatctggggggacaaaggctttcttgggaaaaaaaagtctcctttttatcctctgcgggtgaaaaagaagtgccgttagaataggaaggggcttcttgtaggcttgaaaagagaaggacttggcaggtggcacctgggctttgttcagcagaactgagagggcaagagtatagctggcttttttgtaagactcatgaactctgtggcccattgatgagatgctctctgctctacaaagtggactttcctcgaggtggaattttattttcctccctgtgctggtgttagattctctggatacataaggtgacccgaggagaagcaggcaatgtcatcacagtttatttgtaggatctgggcttcctccttcagaggaggtgccactcacacccgagatgcctgctctctccctgagcctttcagcacaagggcaggacggagaggagcccagctaacgaggggccagctcaaagtcattcaggaaaaacagatatacacagacatggccggaagcctcaatgtgtttttctactgcaggaaggttaaagtggaacttcatgtcatagatttaaaaaaaaaaaaaaaaaaggctggggccaggcacagtggctcacgcctataatcccagcactttgggaggccaaggcggccgaatcacctgaggtcaggagttcgagatcagcctgggcaagatggtaaaacctcgtctctacgaaaagaaatacaaaaattagctgggcgtggtggcgcatgcctgtaatcccagctgctcgggaggctgaggcaggagaattccttgaacctgggaagcggaggttgcagtgagccaggattgtgccactgcactccagcctggtgacagaatgagactccatttcaaaaccaaacaaaaaaaaggtgggcatggcggctcatgtctgtaatcccaacattttgggaggatgagagggaggattgcttgagtccaggagttcgagaccagcctgggcaatatagtgggaccccatctctacaaaaaaataaaaattagctgggtgtgatggtgcagacctgtggtcccagctactcaggaggctgaggtgggaggatcacttgagactgaggaggtctgggctgcagggagccttgattgtgccactgcaatccagcctaggtgacagcgcacatccttgtctcaaacaaacaaaaccctacatatcttaagaggtattggaaggccttaatacatgccaagcacataggactcaatgagcaattctgtctcaaaaataaataaataatagatatttaagaatacactactattaagaacctcagatatggaagttcatgaaagatacttttatttaataagacatgaagggaaatttagcgtcactgatggtatccttctctctcctcaccgcgatctcttccagttaactgctgaatgcaaatcaacagtagagcgggacgtattttgcagttcagttattgatttttagggagcctgggtgggtacccttatctgtgtctctttgaggacaatgacaggagccctcattgccaacagagataacagtgagattgtatttttatttgttccacaaacactgacgtgacaaagtgctcttactggtaggcttgaggagagtagcctggcgattaaatgttcttatttcgagtgagcagccgggctgtgttcagaagagcccattagcagagcacgggacccatcaacagtccaattaagagcaaagggatgtgactgcggaaatattaatgggctgtgttggtaaagctgcccggggttagcgccagatggagtttttctgtatacagtttgtaggaaactcttgtgtattttcacgcgggatgtccttctgcagagggggatggttttagataatgactgttgtgctttttggggataccacctgcagagatgtgtttattttgagtgtttatagattgcagaaagctggtgaaaccaccttgagagaggtgatcctttgattgaatgtttttttcatccaacaccaaaaaattacaggccatgattggattttggagctgattcttgctttgtaagactgcatggttttggtgaacatccatctggttgttttttttttttttttttttgagtctcactctgtcacccaggctggagtgcagtggtgcaatctcggctcactgcaacttccacctcccgggctcaagtgattctcctgcctcagcctcccgagtagctgggattaccagtgcccaccaccgcgcccagctaatttttgtatttttagtagagatggggtttctctatgttggtcaggttggtcttgaactcctgactgaacatccttcttgaatgatgaagtcaaccttatttacccttgaaagatgacttaatccttaccaagagagcttcaaaaatacctgttattctgtaccttcgtttaaaaaataagtcctattgccttaactcctgtccaatgcctactgtagctctgtttacatattacaaaataaatagaaccaaccacatgtctttgaagtaccagccctgttagtccatggtaagatttctgcctaaaatttaagcatcttgacaacatgcgggagacttaggggcagagaaggaccatttctcagaagaataacccctcagctcagcacagttgtgtcatctgtccaaggtagcactttagcagtttcctaaatgagggagggtattcatgtgtgtatgcatgtatggtgtctgtgtgtgcacacgtgtacatgtgctcacgcatgttataactgtagaaaacaggcaggggagcctgtgatttgccttgtgtttctataaacccccctacagctttaactaatttccatggttgttgatggaggttcagatgtgaaatctaatggtatctgtgatctgcaaaatatacatattggccgggtgcagtggctcacgcctgtaatcccagcactttgggaggccgaggcaggaggatcatgattgtcaggagattgagaccatcctggctaacacagtgaaaccccatctctactaaaaatacaaaaaaaatcagccgggcgtggtggcaggcccctgtagtcccagctactcaggaggctgaggcaggagaatggcgtgaacccaggaggcagagcttgcagtgaactgagatagcgccgctgcactccagcctgggcgacagagcgagactgtctcgaaaaaaaaataataataataaaataataaaataaacccattgttcatctaagaacctacccatgtctttcgggaggctttccatcttatcttgtcttggttcagacagtcttccatgggacccactgataccctggagcatctctggaaggttgaagcggaggacagaggaggcatggaaaaggtgtgcagtaatacataggaagcttccaaagagaagtgggtgcaagacagcacagaaacatgttcagttgcctcagctgctgatgttcaaaatacctgcagaaaatcaacgctgctacacccaaaagaaaaggaagatggaactgggggcctagagtgaattttttcaaaggtaaaaaggagcccaaatttcacagaatgatctcccgcttcagaaagggaaaccctctaagtacactatacacttccctgcctgttttctggagagtgataccgagtgttggcactgtctgcaaggaaggaagtaggactttgactaattgcacaaacagcaattttgtgtttttgaagtgcgaggactcagtcctgtgtccacgaagcctccttcaggaggttacttcttgacatagcccatcaaccggacctcccgttgctaggttctgagccttagggtgctttcaaatgcaatatctaggccaggagtggtggcccacacctgtaatcccagcactttgggaggctgaggcaagaggatggcttgaggcaggaggatcgaagtcaaggctgccgcgagctgtgatcgtgccactgcatgctagcctaggcaacagagcaagaccttgtttcaaaacaaaacaagaaaaaaaaaatatgtgcagaatccactaatggaagtcatcataaatttgttgccagaatgggaatgtatcagtttatacttcctacattttgttttttgtgatgactttaactttggatcattttatcagtgactggatgaaagtttatctttattttatctaatggggggggggaatccaaggagctttttaaagacagccagtataattgattataaagggtagttccctgctaagctgaaaatgctgtcttcgaacactttaggcatctgtttctacctaagagatgcattgtggagcccagtctatagcacctgccactggtcttcaatgtgttcagtatgtatcctgataatatatgaaacatcagggtccgctcacctgcttcaggtgctgtgtgtactccaacaggtattctacaatccgagctgttcatcagttgttaaattactgtgatttgagtcccttcaaagtgagatccattggcagcaggaactgttatatagtattatgtgtgtgtttaagggcagagggatggtgttatctaactgtcctgtcccagtttgcaggcatggaaggagttcctaggatgtgtgactttcaattttaaaactgagaaaggcctggacaaaccaggatgagttgtcaacctgcatgggggcaatggatttggccatgaacttcatcatttcaaagtattaagttgttggcattctgaatgcccctgaacctattttgcatcgtagagtggacttgttccccagtgacccatgtccacccctagtggactcgatcaactcctgacacacccctactaggaacacgaaaatggttgtagaatgtgtttcattgtcctcatccacagatacagacactttggtgactctgtgttctatctgaatgggggctgagactacaggataccccatcccatttctgtcctctgtccttcatccaaggtgtcaccatttgtatctatcaggaaggaggctttgcagctaaaatttaaaataataagaagaatatatttccgagccagagattagatgcctacatatctcttttggcctcagcattctgtggtcttctatggagaaaggctaattttctgaaggctttgaatggaatgaaaactgcctgttcaaatggttctgaggatactgagagacgctcagtgtgtggtctttttatttttagtaatagtgttggaaaaaatcaggttatgtttacgctgagtgtgtggggggcgctggtgagattgtgtagtctagaaaaggctagaattataaattattataaacgttggccatgtggggaaattcttataccaaaaatactgcaatgtatgtcagcctatagattttcatgtagtttcttgtccaaaactgtatatgagagcagaaatgattgattatgttatgttcaatgtatacctaatatctagtgctgatacataaataaacccatcatttgtgacaagggtcttttgtccgcatttaattttattttgttactttttatttatttatttatttttcagccagggtcctgctatgtcgcccaggctggtctcaaatttccggactcaagcgattcccccacctcagcctcctgagtagctgggactggaggtgtgcaccaccacacccagcttaattttatttttatggccaaatatgacacaggtgaaagccattacccagaccttcaaaggagtgtcacgatggggttggcaatgaggacaaggggtgatgaggaaaatacattgctggaaatcaagttgataataggtttggtggaagatctaagaaatgtagtgtggaacctctgaggtagggaaactgggaattcttttctttagaatatacatgtatattggcatgtatgtagaatatgcatgtctggaactccagaatacaatctgggctgcagccatcagtgtacaggttaaaggttcttaggctttctctgttcacggcattcctgtagactaaaagaaacagctaacagctccgtttattaagtagtaaagcccaaacaacttagtaattatttatgacctaacaatttagtggccaattgaaaatacaatcacatcaattcaaaagaaaagatgtattttttcatttttaggtgatggctggttttatgcatcaacgtgcgtagggcatggggcctagatatttggtcaaacccctgactgggtattgctgtgaaggtttgttttttagatgagattaacatttaaataggtaagttttctgggtgcagtggctcatgcctgcaatcccagcactttgggaagcggaggcaggaagatcacttgaggctaggagtttgagaccaccctgggcaatatagcagaacctgtctctaaataattagatagataattagatagagatagattagattagagaggtaggtaggtaggtagatgatagatagatggatagatagatagatggatagatggatgtatagatagatgaataggtaggtagatagatagatagacagatagacagacagacagactgattgagtaaagcagattatcttctatactgtggaaggcctcattcaataagttgaaggccacaagagaaaacagactgaaacaggctgaggtttccttgaggaggagggaattctgcctctagactgtccttgaacttgagctgcagcatcaactctaccttaggtctccatcctgctgaccttcccagcagattgtggatttgccatcccccacaatcatgttagtcagttccttaaaatcatcactctctctctttctggttttctcttgaatacacacgtatacgcacacctccccctctcttatctggagaactccgccttctacaattaccagtgggatgtgtgcacctgttgggcaccgcacaactcccctgaccttggaatcagattggacaacatttcctattccgctttgatttttctgcagtactggcattttaatcccagcaacctctgaaaacctcatgttgcaaaaatgacatcaacaagaagaatgcttatgatctaatgttgaaactgtgaactacctgaagtgaatcattagcccagtgtgtaacaagtattgctgtgtttccctcaaaaagttaaaatatccctcagtgcctctgtgagttcgctgtggcatcccatccaggacacctgggtgcacggtttgggagctgcaggtagagtggcagcagtagtcatgggagtggatgagttcaggtggagggcacaggaggtggagacagcagagaagagcttcacagagaacatctaggagggacagctgaagaagcgctttggggccgggcgtggtggctcacgcctgtaatcccaacactttgggaggccgaggcgggcagatcacctgaggtcaggagttcgagaccagtgtggccaacatggcgaaacaccgtctctactaaaaatacaaaaattagctaggtgtggtggtgcatgtctaatcccagctactcaggaggctgaggcatgagaatcccttgaacccaggaggcagaggttgcagtgagctgaaatcatgccactacactccagcctgggtgacagagcgagacgttgtctcaaaaaaaaaaaaaaaaaaaaaaaaaaaaaaggcaggggatggctttggaaaggagattctaaagggagactagagacacagggaaaaattgatgtactgtctgtgaacagcaaggaaaatatgattacacctaagagatgaaattggcataggcgagaagtcagaaaaataatctatacagcttgcatggttggggagttaggagaggccaaggccacgtgcacgtagagcaagaggtagaagaggcccgggggctagagcgcaccctggtggatagtgtgagaatttcacactggctcaagccttgaagaccaccccaggggtgcgccttagcaacgcacttatgcaagaccccaacaactggcccttgaaaggagcttttcactggtggggtgtggccctgcttgtattcagaaccatagttttaacaagccagcattaaatccacaagtctttgccaaagcactttaagcctcttgacatttattggaattaatttacctgcaaggaagttcatatatctagctttgttaaccctacattcgggaaaatgtttccatgagataactaaaacccgcatgaatgatacaatactgtgacaaaacccaaaggtggcataattagcatataaaactcccaaattttttttgcaattaccatcgtctagtaactggttgtttcattaggtaaaagtggatggaatcagtggaattatatgtatgatatgaaatgctctttggcatctattaaatttttattttgaagaaaaaataaaggacaaggaaagcatcctattccaagactccaaggagattatatttttaattccacaccacagaaaatgcaaacaaatttctaattacacttcatgcatggagatctgtagaggaaaaataaattggtacccatccacccaaaagccacaaatcagacatagaatggctaatcacaaatataacttgtgtgcctgatgctgattactttctccgcagtctgttgtgaacaattaagaatttagatcttgggctgggagtgctgtttttaaagtgtgactcaaaagcataaagttcatttaaatttctcctaatcctggtttgcaatttctattcctttttggttagagtattatttatcttcaggaggcccctattatactataaatattgccttggggcagtgttcatagcaccacagcacctatctatccatttatcagaataatcagcacttcctgttggctgagaaaacactgtcatttttactgtttaaaaacagaacagctttcagtagcaattgccattaattgatttcatggcaggaagacggaaaattctccattttttcattctcataagtcacctaagaacatcttaaaagctacagagaggccgggctcagtggctcatacttgtaatcccagcactttgggaggctgaggcgggcggatcacgaggtcgggagatcgagaccatcctggctaacacagtgaaaccctgtctctactaaaaatacaaaaccaaaattagccgggtgtggtggcaggtgcctgtagtcccagctacttgggaagctgaggcaggagaatggcgtgaacccaggaggtggagcttgcagtgagctgagatcacaccactgcactccagcctgggcaacagagcgagactccatctcaaaaaaaaaacaaaaaaaatgctacagagaaaggggacagctgccatggaaaacagtggggcggttcctcagaaaaaaataaaaatagaattatcatataaccctgcaatttcacttctctgtacccaaaataattgaaagcaggaacttgagatatttgtacatccacgttcatagcagcattattcacaattgccaagggataggctcggcacagtggcttatgcctgtaatcccagcactatgagaggctaaggtgggcataatggatcacgtgaggtcaagagttcgagaccagcctgaccaacataccaaaaccccatctctactaaaaatacaaaacttaactgggcgtagtggtgcatgcctgtaatcccagctactcaggaggcgggagaattgcttgaacccaggaggcagaggttgcagtgagccaagatcgcgccactgcactccagcctgggtaacagagagcaaggcttcatctcaaaggaaaaaaaaggagccaaaggatggacacaacccaggaagaatggataaaatgtgaaggaaattctgacacatgctacaaaatggatgaaccttgaggacattatgctcagtgaactaagccagtcaccaaaaagacaaatagtataggattccacttgtatgaagtacttagggtagtcgaattcagagacagaaagtagaatggtgattgccaggggctgggagaggggagatggggatttactgttcaatgggtgtgcagtttcagttttgcaaggtgaaaagtgttctggagatgggtggtggtgatgatcacataacaacatgaaaatacttagtgccactgaaccggacgctcaaaaatggctaggttggtacattttgtggtgtattttactgacattttattttattttattttattttttgagacagggtctcgctctgtcacccaggctggagtgcggtggcccgatctcggctcactgcaatctccacctcccaggttcacgcgattctcccacctcagcctcctgagtagctgggatcacaggtgcatgctatcacacctgactaattattattattatcatttggcagagatggtgttttaccatgttggccaggctggtcttgaattcctgacctctagtgatccacccgcctcagcctcccaaagtgctgggattacaggtgtgagccaccatgtctggcctgaaatttatttttaaaaaagcaaatctacagaggagtgggctccaccatagaaattcagttccagttagtcagcagtagcggcctgggcagcagcaattctggtctaaggtgcggggtaatctctgaagtagttaaacacaagtggtgtaaccaatgtgtcaggatgggagaactgggcactgggaaagagaaagactagtgttgggaggagcagggaagcaccagcaaggaaaaagaccctgtacatgaacttggctaaggaattgtttcagtgatagaaataccagacactgtaaatggttgtgcacatgggccagagaggtctttaaattacatttgaaacatatacacctactgtgtacccataaaaattaaaaactattttaaaaaataaattccatttgagccactccttcaaaccacccagagtgggtagacgtctttcgtgcctctaagaagccccatctctattctgcgtctcaccttgcagggctgctcatctgaatcctgaagatggtggacacccatctgctaggactgaaatgaataggacagagggaggtgcagagtgaatggaccatactacctgtcatcttggcaacgtgtgattgaataaaacaacttctttagaagtttgatagagtgatttgataatgtaatttacaagtgatcatttctttttattttcattttcagttgttttttatagacaaagtctcactctactggctaccggctaggctagagtgcagtgccacactcgtagctcactacagcctcaagttcctgggctcagcaatcttcccacttcagcctcctgagtagctgggactataggcatgaaccaccatgcccagctaattaaaaaaaaaaaatgtttttgtagagatgagtcttgctatgttgcccagaatggtcttgaactcccgacctcaagtgattctgtcacctcaacctctcagtcttctttttatttgtgtacctggcttcagcccttttgtttcttcaagggcctggacttgttactcctggcccaggagtatgttgttaaacactggattaatggtgtgacctatgcatctatttaatttatacgtatgtacagagagatttttgcgtgccgtcagtggctaaccaaatcaggcaaaccacagttcatttgagtaagtcctcccatgccatgaggcatccctgaaagggatccattctccttttccagagaattttctaggatcagtagcaaggcctggtgtccctactcatgctctttattgaatacaattcattttgagtgacctttacttctcagtaatagttctttatttgtgaagcgcagtttgcaaacagcctaatcggcttctggcttctggttactagtattccacctgctttgtaatgccattgtaaaaaccagctgggtaggaaggaagaagatattgattgaatgtttttcactggaagaaaaatttgtgtagcaatgagactgccctagattcaaatggaatttgaagacaatgcccatgttttctcttcgtgtgtgtgtgtgtgtgtgtgtgtgtgtgtgtgtgtgtgtgtgtttgactaacttagggtggttttttttcgtatttcttcttagtacctgagagttaatgtatcctagttaattaatgatagtatgtttctaaaaatcaaaggaagaataataagtataataaaatgttataaagttaagcataagatcttaggctaaggaaccactgtaaatacacctgtaatcccagcaatttgggaggccaaggtgggaggattgcttgaggtcatgagtttgagaccagcctgggcagtatagcgagacctcatctctacaaaaaaaaatttaaattagctaaacatggtaacatgtgcctgtagtcccagctaccacggaggctgagacaggaggattgcttgagcccaggaggtaaaggctgcattaagccgtgatcacaccactgcactccagcctggacaacagagtgagaccctgtctcaaaaaacaacagcaacaggccgggcactgtggctcacgcctgtaatcccagcacttcgggaggccaaggtgggtggatcgcttgaggtcaggagtttaagaccagcctgtccaacatggtgaaaccctgactccactaaaaatacaaaaattagccaggcatggtggcatgctcctgtaatcctagctactgaggaggctaaggcaggagaattgcttgaacccaggaggcagaggttgcagtgagccaagatcctgtcactgcgctccatcctgggcaacagagcaagacttcatatcaaaacaaacaaacaaacaaacatacaaaacaaaacccacagcaacaaagaaactatggataaattgacccagggtgagagtattagtaaggactcttggatttttccccctagactatggctcattagttattttatagtcctgctttttcagggatctttgtattatatcttagaccctgttttgttttgtttaaaaatgtgatgttaatacttgtctgtgggctggtcttgtcaagtcttgcaaacttgtactgctgttgtgctgatttcttggataggagcccgaggttatcatgtttccctaacaatgctcaatcttgcccctattcagcgactgactgtttagaaaagcctggccttcttgggttgcccatgaacttgaccccttagatactggcagtgaagagcttgagttaaaaaaggagttgaaaaaaagtgtaagcaggtgactctcaaagtgccggtcagttgccaccttctctacttgaaataatcctagaaactctcacttctacttctcaaagaacaatccatagtcacccagaaacaagcactatatatacacaaaaactcgggtttctgacttgtcttcattccttcaacatgtccttgttacaaaagtgtgggacagtgatttgcaagttctttgacagtagtggttatactggggattttcttctatctttcaggtatggaactcagctctttgatttcaaggagggaaactcaagcaggctgcagcagttcaatgctctgcaggcgtcagttcctggcattatggagaaactcagaattattagggggaattatggaagcaggatgaaatgagaaagaagggtgtgtatggcccctgagcgggcacctaagagtaagagtgagaaggtcatcttggttccagcctgtcaacccacagatgaggtccagagagagtatagagctagcaagcaaggtctcagatagttaaggcagctctgccaccagcaccttttcaaatgccttttgcaccaccttctgaatagattgtcttaaacttctcagacatgactaattacaagtggccggttgatcctataataaccgatttgtctggtctggctataagattagagaaaattatgctcttaatgcagagtgtggaaaaacagaatggtatgtaatggggtggaagtttggctttgcatgtggatctgtctggacatgtatgaaatgtacatacatttcagaggggcaataaggggaagaaaataaagaaataatttgccattttctctcctaagttcaatttcagaattcagcaggaagctcctctctctaaatgaatacttcaatgactttgtaagaaaaattagataatttagagagttacattattttcatatttataatgctgtgagtaacactgaaatgagccccagcaaaggccttaagttttaggtataccagttaacaggacctgccccgctaaggcctggttggagtgatgtttccatcactccaggaccgtctaaaagaaagcaacactataaaggccttgcatatttgggaaagtaaaagaactttacttcatttccagtttttacttcgttgtgtttttcatcaagctcgttcattattactacggtatctctattgatactgttagataagttgtaaaagttcccataggctaccattttaatcattgtctctcctagaattgtttatttcatgcaagatgttgatattaacaccttatagaaaaaaaagacttaaatcataaaacttccatttgcttccttgtccccctcaccctggaagaatgaaaaaaaaacttgctattttttttaaagtcgatggcaaaatactttggtttagctcatgaaacataaatatttgtggtagcctagttggagaataaatgacaaaagcgcttttataaaatagctgttgtagttatataattcatttttttccagtatgctttaacatttcttgaatctaaaggtgtgaaaggcatggttatcaaaagcaaatagatgtgaatactgctgttattaaatgtcatgcttttcaatttgtcagtcatatattatctgaaaaataaaatggatttttctgttattatttttttcttttattttctcaactgggctgtccacaaaaggtttgtggcattcttgtttttccagtgaaaaatggaactttaattgcctttggatactttcataattatataaattaatactgacccccaaaacccttacatataggaaaggtacaactggaaataggatggcattttaatgataattagggaaacgaatgatatgaaattacttatgatttgtaaatgatgcttaataatttaagcagagagaggtggtaaattgttgtctacattgagagtgttttatgcataccttttggttatgcataacttttggttttccttttgtttaattattgcttcttagtgttttcaaaacacagcacaaaatatttgagtatgatttgttttctgaaagataagatgtaaagtgcaaactcattagatttatattagaatggatgcaagcttgctgcagtcttctaaattggtattgcttatcctttgttgagaactagtttgggtatggtcagtgttttggaaagccatttcatgagcactgccttcacaaggtaagatgccaaatacagacgtttcagaaatataagttcattgggttaccatcactatgatacccagcccaattatgttatctaagtgaaatgtttaagaatgtctcctaaaacatggctacctatttgactttaatgtgtttttgctgttttattaattgatgtaaagtcccctataagtataaatttaagggaatttctcattgagtgctatgtgcctgacatgtattaatgtctcttcaatactctttgacatatgtagttttttgtttgtttgtttttgagacagggtcttgttctgttgcccaggctagagtgcagtggaacaatcatagctcactgcagcctcaaactcctgggttgaagcgatcctcccacctcagcctcccaagtaggtgcacgccaccatgcctggctaatttttgtatttttgtagagatggagtctccctatgttgctccagctggtctcaaacttctggactcaagggatcctctcaccttggcctcccaaagtgctgggattagaggtgtgagccactagttttatttttatttccattttactgacaagaaaatggagacacagaggatttaagtagcctgactgtgatcacagctaacaaatggcagagccaagattcaaactctagttctagagagcattatcattaacccattttctccaggcccgggattctgggtctgatgttctgggtcacctcctatatgcagtcatgcttcaccctatcccagaggctaaatattcatgtcatctctgtgtctgaccttgtaactccctgattgggacccaggctgaactactcagcagtgaaactcttatgaaacaccaggggtttggtctaggtcctgctgcttacctaacaggaagccaatcactgagacaacaagtattgccggggaagaaagctttattcaggtgctgcagccaaggagatgggagatcagtctcaaattcatctccctgtctgactaaaattagggggttatgtagcagggaagaaatgtaactatgtgtgagaaaacaggaattagggagaggtaagggaggggagttggtcaacaggaagcagggggtcaatgaggcatcatcatgggtgaggggtctgacaatttattgtttagatgcagtgatctggtgagtgtcagcttcttgatgctaactgggaggcctgatggtttcctgagaaaagaactcagataagtcaaatgtaaccatctcaagttttaagactggggcgatcagtttttatgtttttttttttcaaaagaaaccataaacattggctctatggaacaagtgagtcagtttaaaaacaactttattaacagagttgatgatgtattttttatttactaggaataaatgatcaattgatatattgttttcaaattttcaggactgggttctttcctcctctcctttttataaccgcaaaatatcctcacaaacaatgtaattaatataaattttatctcatactttttgagatacatttacttttctgtttatagcttgtcttagtttgattctatgcactgagctgaacaccatacctactaccattctgctggaatcccagttttattaagtgaatttgcaacacatgatatggaatcactgtccttcagcatgtgtcttcccaattttcataactgatgacataactttatagggttcgccagtagcattgttatgatttataccatatcacatttgtagtatattgcatagtataaacatatgctgtttatatacatagtatataagtagcacatagcatatactatatacatagtatataaatagtataaatatatagtatataaatagtataaatatatactatgtaattagtatataattatactggagtgtatatatatactataaatatatacatagtttatatttatacatagtacataaatggtgtatatacatagtatataaatagtgtacctagtatataaatagtataaatatatgctatttatatacatagtatataaatagtacaaatataaataagtttataaatatattttttaaacagaagtataaatatgtatactatattatacatagtgtaaatatatacaatatacttgctgctcagtggaaaataagaattatttgcttatacttaattaatacaaaatcttttctagagtaaaatcattataaattcccctttcttcagagccaaaggagaaaaataaattgtcttcaaatataagtgcatcactcattgcatgatccaccctttacagacctaaaggggcaatgtacgctctcctggagtatgtcaatgggaagttgagcatgaatagccctgcatttagtaaatcagaagttatttaactactcggaacctagatgttcctatgtgttagataggaatgaaaatacccatctttccaggtttactcacatttaaatatgatcgtgtaatgtacttagtacagtgcctggctgccttctagtgtcggcactcaataaggagtagttatcattggttcttcgtagactgccattgggaacttgagcaggtttggagaagtggccattagcaaagaaatcataatggaaagaggctaggaatatacacaaagccagcactgtcttatggggttgcctaaaatataggaaattatggaaaatggaggcaagaaaatctctattcttgacttagaacttgcttaacttgtctaatgcataatttacctaaggattcaaaagtgtgggttgcttaagaataagcagaaacggctgggcgtggtggctcacacctgtaatcccagcactttgggaggccgaggcaggttgatcacctgaggtcaggagttggagaccagcctggccaacatggtgaaatcctgtttctactaaaaatacaaaaattagccaggcgtggtggcgtgcacctgtaatcccagctactcagaaggctgaggcaggagaatcacttgaacccaggaggcagaggttgcagtaagccaagcccacaccactgcactccagcctaggtaactagagtgaaactccatctcaaaaaaaaaaaaaaaaagaataggtagaaacttgaaaagcaaggctatgttaccctttggacattttttgtttgtttgtttgccatttaagaggacgtaaaaggagatcattagacagaaagtttgtaagttttggaagtaaaattttagagcaaaaggaacctttgcaagcacttttgatatagatctgtcattccagagaatccatacataggcttccagaacatctaactaagccatagaccttggaggtatcaggggtcttgctgccctcttctgccttatagaatcaaataaattcatagagaaacagtaggggcattttttatttttgagacagggtctagctctgtcacccaggctacagcacagtggtgtgatcatggctcactgtaacctcctcctaccaagctcaagcaatcctcccacctcagcccccaagtagctgggactacaggtgcatgccaccacaccaggctaattttttaattttttgtagagatgggtttttccatgttgctcaggctgttcttgaactcttgggctcaagcaatctgcccaccttggcctcctaaagtactgggattatatgtgtgagccactgtgcccagccaggacattttatttttatcttatatatatttttttatttttattttttgagacagggtctcactgtgttgcccaggctggagtgcattggcatgatcacagctcactgcagccttgaacttctgaacccaagtaatcctcccacctcggtctcccaggtagctgggaccacaggcaagcaccatcactcctggctaattttttattttttgtagagacagggtctccctgtgttgcctaggctggacttgaactcctggcctccagcagtgctcccacctcagcctccctaagtactaagattacaggcatgagccaccatgcccggccagtgaggacattttaaagaaggaagcagaagaatcaactagactgattgccctctccaaaattaaatattgcaaaggcaggagttggataagcatttggtcatgaaagatgttaggatgccttagaatcttcgaaggctaaaaagcagcagcattaatgaagttgaatgtatgaaagcagatttcaggtgttgaagaggaagcagctatcaatgcagagattaaatagacgaagtcacaagaatctagcagtagtaattatgacttaatgaaattccagttaacgaagcaatgaggtagagaaggtaggagaaaacccatcaggatgaacaaagcgtggcttgaatagctgggtggccaataagaatgctgcaatgaagcgaagagcatggcagagggccaaggaggagaaaggacaaacagcagcttcaagccaggaaagctcaggcaggaaatgagaagcaaatttcaaaacacctcaagggaaacattctttaaatacatctgaaagaacaggacagggaaatgtcgtttctattaggtagaggagggagttggttttatttatttatttggagagggagttttgctcttgttgcccaggctggagtgcaatggcgcgatctcagctcactgtaacctctgcctcccgggttcaagcaattctcctgcctcagcctcctgagtagctgggattacaggcgcgtgccaccatgcccagctgatgttttgcatttttagtagagacggggtttcaccatgttggccaggctggtcttgcactcctaacctcaggtgatccacattccttggcctcccaaagtgctaggattacaggtgtgagtcacggcacgtgatatcagtagtcaggttgtctgttttcttttccatgcaaagcaaaacttctttgtttcaagagtctggtaatatttactggaagttgggagagtaagagaaatgaggagaagagctgacaaaaggccgttatagcagactttggattaaaatctgtagacacccatgtcctgcctatcaggggtactgaaatatttctttagaatgattgcctcatggaacacccagcgtagagagaatatagaactagaaaaggtgcgagatgtcatttgtatgtaacaggaggtgaagaatggccttgaaatgacaaatctgaaggcttttatgacctggaagaaaatttgggatgggttggggtagcaggtgtcatcacaacatcaatttggaaatggcttgtaagctgtaaggtagcaggtattagcaatgtggttttaaaaagagcaactcctgtcagactaatgcatcctctctcggtgacagagtagatggaggaaaagtgaaagatgtaacctagattgattttaggagagttgctaatgcgtatccataagtcacacctgtgggaccagaaagaaatgattactttttgctgtacagctcttggaggggctgcctcattggagcacatgtaaagtgtgtttaattaggaattaaatggtcatagtggactgggtaaagagggtcatattaagaaatgttctaaagtgatcattaatagatccagtgctcattcaaaatgttccataacctgcaagatggcaggaaacacagaaaatggccaggtcggtggcaggggtaggagggaaggaggaatttaggatcagaggttaaaatgattatgattatttagaggcacagtcagaaataatgtagtagaaggtcacgtgaaaggtagaagggcagggcagagtatgtactgttttgtgtgtgtgtgttattttttgagactaagtcttgctctgtcacccaggctggagcggggtggtgtgatctcggctcactgcaacctctgcctcccaggttcaagcaattctcctgcctcagtctcctccctagtagctgggattacaaacgcccaccaccacagccagctaatttttgtatttttagtaaaaacggggtctcgccatattggacaggctggtcttgaactcctgacctcaagtgatctgcccacctcagcctcccaaagtgctgggattacaggcatgagccaccacagggtacttactgttttatgggtaaggattatgatgatgaatggttgcctagaaggcctacatgctgagtttatctgggagtgacatttattcctcaaagcgtatctttttcataatttcaatttttatttgggattcagggggtatgtgtgcaggtttgttgcctgggcatatttcatgatgccaagatttgggtatgagatcccatcactcaggtagtgagctaaaagcagtataaaatgggtttctttcttagccctgtaagttggttctttcttgaccaactaccctctaaggagagttaagagaagatcttgtaggtataaagctaaaaatcaataggctggcctacaaggtcaagtaacaaagcacgttgttttaagctcagggtcttaggcttagtggagcagggatctggtctgatccctacaagtaaaagaatgattagagacattgaaaaagccataaagatggttaaaaggttggggaaaataaggcttccaggccaaacaaaacttgaattcagtgtggaaaaatgttgagagataagttattaatgttaagtatgcaaagaactcctaaaagcacatggatgtcagctgttctatatttcttttgctgaccaactaagagggcaaattcttaactgaatgaagcatttgccctacatcaacttggaatagatttaaaagaagagagtatgactattactaaacatggagataagttagtgggggagggtatgtgtctccttctaagagatctttaaaattatgagcaattgtggctggaggatacatacatgttatacatttataaaatatttgagtttggactcaaagtagaaaatgaagatgagcccttttgtctctttcaactatgcatcaagattagtattagttttggatgacttagtctattgcaagaaagttttcactaggggttgggcatggcggagcatgcctatagttccagctacttgggaggccaaggcaggaggattgcttaagcccaggatttcagatctaacctgggcaatatagtgagaccctgtgtcttagaaaagaaaaaaagatgaaggaaggaaggaaagatggaggggtggaggagggagggaaggatggaaggaaggaaggaaggaaggaaggaaggaaggaaggaaggaaggaacttacttgaattggcattttccttttcctatcacaactatgccttcagctttcttctaattaccatctaagtccttataataaggacttataaatccttacatctaagtgccttacagtagtgtatataaattcttactgtatttgctcacctaacagtcttcttggtgcctctcagctctgtgaatgaaccatgtctaccctgctcactcaccattgtaactctacttccaacagtgtttggcacatagtcataatatctgcaaaatgaatgatggatgttggaagaagtacagcacagaaggttgcaggcttagaaggttgtcatttatagaatgatttgtggaggctggaatatcactaagaagtatttcccgatctttttcatattgttgaagttgtactcctggaaatatgtgtcatttgaattaaagaacttcctctgtaagcatcttctttttaaatgcaaatggaatccacacaaaaactcatacatgaatgtttacagcatcactattaatagttgccaaaaagtagaaacaacccaaatgtccatcaactgatgagctaatacacacaatgagatctatctaaacaatgatactaatacatgctacaacatggagtaatcctaaaaacattacgctatgggaaaaaagccagccagaggaccacctgttacatgattccatgtatatgaaatgtcccaaataggcaaacccataaagatagagaaactacactagtggtttcttagagctggggaggttaggaggagatggggaataactgctaatgggcaaggagggtttttttttttttttgagacggagtcttgctctgtcacccaggctgggagtgcagtggcacaatctcagctcactgcaacctccgtctccctggttcaagcagttctcctgccttagcctccctagtagccgagattacaggcaggtaccaccacacccggctaatgggtatggagttttattatgggatgaaaaagatgatctaaaattatctgccatgatggcacgagcctgtgaatatgctaaaaaccactagattgtgtactttattttatttaattttatcttattttatttatttatttatttatttatttatttatttatttattggagatggagtctcgttctgtcgcccaggctggagtgcagtggcaagatcatagctcactgcaacctctgactcctgggctcaagcaatcctcctgcttcagcctctcaggtacctgggactacaggcatgtgccaccacacccagccactgtaaaaaaattttgtagacataagaggtctcctaatgttgcccaggctagtctcaaactcctgggctcaagcagtcctcccacctggaacttccaaggtactgggattataggcgtcagccactgcactcagttgaattgtgcacttgaaatgggtacatttggctgagcgcagtggctcaggccaggcacagtggctcacgcctgtaatcccagcactttgggaggccaaggcaggcaaatcacctgaggtcaggtgttcgagaccagcctggccaacatggtgaaaccctgtctctactaaaaatacaaacaattagctgggtgtagtggcaggtgcctgtaatcccagctactcaggagggtgaggcaggagaatctcgtgaacatggggaggtggaagttgcatgacccgagaccgggccattgcactccagcctgggcaacaagagcaaaaccccatctctaattaattaattacttacctaattaatttatggggcacttggcatcaaggagatttctctagcaagaaaaagagcacaaagaacacgtatggtagacaacacaaaattcaaaatttttcctactttttagttttgccttttgctaagtgtgcttaacaattacacttgagaaataccttttctacaacataagcactgtagagtgttgctgttttcccttagaatgtgtgcaaactcctcatcttgcactcagtatgttaggtctgaagtgtggatgtctgtgtgtgtcctgcccttcacgatgtgaacctgagcactatgatgccattctgttcagcattgtgtctgtgtttattatcccagaacccatggtaggaggaccacagatatttgctgagctatctatactttgatataaaggatataaagacctggggagattttctttcaagaaagagggcagactctattatgagcttaacagagttgcctgcttagaatatggttttttaaaaagttaatactcaaattattttcaacaacagtgccaagatcattccattgggaaaggaaaatcttttcaacaattgctgttgggaaaaccagatatccacatgcaaaaaaataaatctgaacgcttaccttatgccgtatacaaaaattaattcaaaatggatcaaacatctaaatataagagctaaaactataaaatgcttggaagaaaatgcagggcaaaagtttcatgacattgaatttggcaatgattttatagatatgacaacaaaacacaggcgacaaaagaaaaaatagataaattggacctcatcaaaatttaaaacttttatgcgtcaaaggacactaacaacagtgtgaaaaggcaactcacactgtgagattaaatatttgcaaatcgtacacctgataagggatttacattcagaaggtatttttaaactcctttaattcaactgtaacaagtttttaaaacccaatttaaaaattaggtctaagacttgaatagatatttctccaaagatgtacaaatgtccattaagcacatgaaaagatggttaatatcactagccattagagaaatgcaaatgcaaactacagttagatacatatcacaccccatcctaatgagtatgaaggagtatctcattgtagccctgaaagggttctgggaagttgatgctgtgcccacattatgtcttctgtgagctatggcttatattgggttggtctgcccatgcgcatcacacttcatgagaatatgacagatcgcattttcttaatctgcagacttaaatgtttttttgtttgctttgtttttgttttgtgtggtttttttcttttcttttcttttcttttcttttcttttcttttcttttcttttcttttcttttcttttttttttttgagacgagtctcatactgtcgcccaggctggagtacagtggcgcaatctccactcactgcaaactctgcctcctgggttcaagtgattttcctgcctcagcctcctgagtagctgggattacaggtgcctgccaccatgcccggctaattttttgtatttttagtagagacaaggtttcactatgttggccaggcaggtcttgaactcctgactgcgtgatctacccgccttggcctcccaaaatgctgggattccaggcatgagccaccgcgcccggcccgtaaacatttttatgtttgcctttctcctagtcattttgccagtttcagcagtacatgggacattgtaatctctcaaagtgttttctaaatttaacttgaatctgtaatctagaaagcaaccaacaaatggccaatgcagcatgagtctcaatgtcccaccagcctcactcaattccccttgaatctttttgtcaccagaagttctgagtagtttatgtcccaatgtggatgattttctaggttctgccaatgcagaggattattctaggttatacaggttattctaaagaggcccgagacagctatccttttctgagtcctaaggttgaacccatacatatatctatgcaggtgcatcctctggtgtctgaagtgcagcttcttaacatcccattatgggggatcagaatcttaagcaatcttcttagccctagacccccagtcctgaaggttgatatgcaagtggcctgaaaaaaaatgacattggctgccccttgcttctgaaggacttacagatactctctaagtcctatagcatgtgcacaagtcagaaagcacctcatgaaattattcatgcattcaagctggactgaatttaatccttcaaagagagacagctgtcaacttcttaagaagctgagcatgttttacagttttgaccttgatactcaagaaatgtctgtgtctgacctaaaacttgtttgaaataggttttcttttcacataatgtaaacgtatttgctttttcctcattctagaagcaaaacatgttccttttcaaatattgtcaatttgaggcattttaagattatttcctttatttgttttttttgtgggctaggaaatctagacagaattgattattattatatggataacttttaagaaagaataatttcatcttaacagaatcatgttgaaactatcttatagaaggatatatagaaaaatataaaccaagattcatttcagaaataaattccatttacatggagaaggaaaatttcgagtcaaagtgacttacattgaaatcctggtttatgcatgaactagcaagtttttgaagcttgatttcctgatctgtaaaactgaagattccatatttttctcagtgttactatgtggattgaataaaatattacatgtgaaagaacctgataggtttctggtatacatagtagctcccccaaaaatgatctcccccgttctcacactattttccttatctctaattaacctcgttttgttttttaaatatccctttttggatgtctctttagtagcacagaaaatatgtttctattgggttgtaatcattacaattcagtcattgagtatatacatatatttcccttttgggcattgtcacccaatttttggctattcaaatagatcttcattaatagttcattagttattacttaatttcaatataaagaaaattatacttctgagtggaaggaaatcccatgtcacctcttgtaaagaatttactttcttagtatcaaagtaacatgtttgaagctcagaatcaatattacatggacctattgaattactaggttcagaagccagtaagttcaagggtgaggtgataatcaggaattttggtgtttgtcaaatatccactgtgagccaggaactagagcaggtgttgtacgtgtgtttccacacttaatttcacaactctctattaggtatcattatcactgttttacaagagaggaaataagggctgcagaggttggttaactcaatgaggatagcacattaagaaagttctgggccaatgttgcacccaggtctctctgagacttttattattatccaccatttaattgcatttagggaccatgattatgaggagacatcttttacaatgaagaactttagtgtccccccaaagccaatgttagtctgtctcccaaaacagattctccccttttctttgactctgtcttctctcctactcttccttgcttgtcagaataacaggttcattgttgagagtgggttagtaaatacagcgaattccaaggatttagagtgttgcgaagtcaggaaagaagacctgctgcaggctgtgtggttctgtggggaaggaaaaggatgtctaaccatccaactgggacctgatctcttggccatttgggactgggtaggagaatggctagactgacagccctgtgatttggcccttttcctttggaggggtgtgaatctgatgctgtaacaatttctgccttctgttggtggtatggcttggccgtgtccccacccaaatctcattttgaattgtagctcccacagttcccatgtgtcgtgggaagaacccggtgtgagataattgaatcatgggggcagcttctcccatacagttctcctagtagtgaataggtctcacgagatctgatggtctgataaagggttaaccctttcacttgcctctccttctctcttgcctgctgccacgtaagccatgcctttcaccttccaccatgattgtgaggcctccccaaccacttggaagtatgagtccattaaacctttttttctttagaaattacccagtcttggtatgtctttatcagcagcgtgaaaacaaactaatacagccggttaatatccctgcagttccctccacccgcatctcttccctccacccacatctcttccctccctcctctgtagcatccatcacaggactaaagccagacaaggctccgctggcacaagcagagcaattcattgtgaagtttactcctgagagttttcttctgctttaaactgccacagaaagaaccgtctagacagctacctcatgtaattgactgccccacgtttaatagaatgatcttttcttctgagatgtcaacctcataaggaatcataaagttcacttggaaattattttcaagtgagcagaaatgcctcagcatttgatccagttttctagtggatgggaatattctttgaatgtgtgtgagcacgtgcacgcttgtaaatgtgtctgacacatgttatgcgccgatagttctccgtcatgtaatcctgagaaatgcgaattttttctctctgattgctttgctttccttccctatagatactgtgttgtactcaataggctgccaagtccatatggattagatctgcttgttatccttttacttctcctgtcaaaataaccatcacagtgcaaaaggaaaaccaagaaatgcattctccccgggctgaagttggactcagtgcccagcttgcaaatgaactcttcttattttctttctttctagaggcattccacagtggtatatgataggattcccttttccatgtcttctatgtacaggcaaagtcgtgattaaatccttcattgggatggaaatcagtaggtcagttggaagattgtcaagccaagatgattctttctcttccggtcctaaaaaaaaaaagacctcatgaattgtttttatttaaattggatgttttgttaatctctatctggagttgaattctccttttgcctttcttttcattggagacttgatgttcatttcattatttctacttgtagatacgtatagtatctcctctatttgagcccaacattccttggaaaattttatgaagttgaatcagggaaacgaagtgtatttccttttatactctgcgtcatagccaaagactcctttaatacttactttaatgaactgaggttgtaatttagatttcttcagtgtagcttttagagcaaagagcatgaaactggttttcaggagatctagaatttcccactggctttccaactgctaactaatagccttagacaagccattgaacttttattagttccaatctcttaaatgtaggagttgaagtgggtggtttcaaagattcctttcagcttccaaattctggaactctggaaaaaaaaaaaagatagccacatagacttggaatatcgtcatgtgttcctaaagtatcatcttttataataattgatgttgtttgaaaagagtgttgatatacagatcttggacaaataattaaaatttaaggaagtctaccagactgtccttgctagcatgaaattatgcctgaaggcatagcactgtggcctttgcagccagagggcttgttttagaagtacagtacactgtacacgtcctagtcactggggagctctgtgtacaaatacacacaaggccatggtcacagagagcaacagtcacaaacataaattcagatgtgtgaacaagacaattgagaaacaaatcattgtcatttaagcttaaacttttaaatcagagagacctacctcacatacttgtccaatttagtagaagactgtgacaacagagaaaatggcagctgacagcagaaacaggactgatttttttaattaaaaatttcaaattaaatgtaatatatgtacatggaaaaacttcatacgttaagctgtgcacacaatcacaaagttaaaagcttctaccttcaattctcaatcctcctttctaaaattaaccattgttattcattttttgttagatcctttcctcaaatggcatatgcatatcccagtagatagatgcatggcttatgtgaacatttataaaaattataataatctacagttactctgtatgtcgcttctccacttagtgatgcatcttcaaggtacttcacattagctcatgcagatacaactcaattttttttttttttttttttttttgaaacagagtctcactctgtcgcccaggctggagtacagtggcgcaatctcggctcactgcaacctccgcctcccaggttcaagcgatcctcctgcctcagcttccagagtagctgggactacagatgcatgccaccacatccggctgattttttatttttagtagagacagggtttcaccatcttggccaggctggtctcgaactcctaacctcggggatccgccgacctctgcctccaaaagtgctgggattacaggcgtgagccactgcacccggccgactcagtttttaatgattacattgtttaccatcatatgaattatcatttactaaatcagttccctatgctaatttaaatgattatttttctagtttctgtctttctctaactgcaactcctgcatttccatctttatccaatttcttacgaaggcaaagctgcactggatggtctgttcatatatctgggtatttttttccacaggataactttctaaaggtagaattgattgttcaaaatgtttacaaatcttaccagaaatgttagacctatttggatatatataatattctgcaacatataagaatgctagttgatagttgctatcctgtatattaactttttaaaagttttgctaacccaatgagtaaaaaaagctcattgttttgatttacatttttataatcattgacgttagagtatattttcctatattagttagtcaattttgtgtttgtgcgaagctccagtttgtgtttttacccatttttaattggatgatgaggtttttggggggtatttttagaccacttcataaattaaggaattaactttcacactttatgcaaatatttctccagttgttaaagtttgcatgtatttttcccatagaaatttaaaattttcatgcaatcaacctcagaaatctttcctctcatatttctgcctctggaattgtatttttagaaagaacttccctgtcctaatattacatattaagcattgtttgtgttctatactagtgctcttagagtttagcttccttacgttgtaatatttgatccttctacagtttattttgaggcaaggagtttgatagagatctagctttctttcttttgccaagtggctagtcaacagtaccactaccacgaactgaataattaatcttttcccttgttgatttgaaatgccactttgtgagatccaaatttctgcctgtgtttgggtctgtttctgaactctatgtttcattccattgagctgtttttccgtctccaattctacgatgtttgagtgactatatttttagttatgggccatgcagggggaagatttgcaaaattggttgctcagttcactgttttgaaactgcttaatgaagaggcctctttgtttccattttctctattaacaccagaattagtgttcacgatgacattgtatcatccaaaaagaattaattttgcccttataataagcttaacaagattgaatataaacaaaattttaaataaataagataatgttaaaaatagcatctagaaggatatttttaaatgtcttatctggaaatctcacttctgggacagcgttcaataaatctactgtacctactcacacacacatttgtagacaatcagacagaaaactgttcgtatttcttgcgctttgtcttttagaatgtggcacatcgaatagagttaccagttgccctgatctgactgatttcgtataaatgtctttgctttggcaacagttgagacctattccttctctgaggtaaatcttcttgcagagcaggaagttgaggttttggggtagagtccaagagtcagttctgaccttattattggggaatgtggaaacctaaagccttccatgagttaataatgtgcacagtgaaggatttttttccctcctgaactgattgggtattttctaaaagaggatgagcttttaataacaggaatgtaacttttaattttaaacagatctgtgcttaaacatggtcagggaatagcccctgctcaaaaatctccttatttgtacatgttattgttcaagggagagaccttcctatttatatggcgagaaaataaatgagatttctttctatctgtcttccatatgtttaatggtaggaatgtgtcttggatcttgaattaaaacagactgtggattcagttagttgatacaattaagaactgttcttatctcagaatcaactctgcagactatctcagagaatccaatatcaaccatccaggtggctaatccatcatcaactgaatgggcaatttggttgcttctgttcaattgaacaaagaggcataggcactcgttagttccacaccccagtcagagaagcaacatgggtgtgtgacaaaaggggtatatagtctgttctttggcttcagatatgaaaaagcttttttcaatccaactaattcaagacaccaagcatagtgatttcttcactgacagttagcattgaaaatgaacttcattttcctcctaacacacacaaaaaagggggtggtagaagccacggcagatcatggcagatggcacttagggacagctgtagtgcttggcttgagttcccctccgcatggagcacagagctgcccacttcgtaggaatacggcaatatttatctacgcataggagtcattccaaataaaaagggtaacagaaagaaattgcagcctactgctgtgagcctatccaaagggtatccatacatagcccaacatttgaggtaagggcatggtttaagatctcaaggaatcaaaacattatggaaacactaacgggaccattagaataaatgaatgaacctaagatcttcagtccgacttgattgagtgcagatccagtcccctttggagagagttgttaagataagacttaactgtgactaaatatacaggcaaggaattgcctctgcaacacaaataagaagcttagaataatttgccatttgaactttccttatatagttagatactttgtagagaaacctaggctaggagttggtgattttttttgggtgggggggtcgcttttttccccctttctcattttattcatttgactatcggcaactttacgattttttaaattgtagtaaaatacacataacgtaaaattaccatcttaaccattttaaagcgtacagttccgtggtgttaagtatattcacattgttatgcaaccaatcttcagaactttttcatcttgtaaaactgaaactctatccattcaacaacagctctccatccccgccatcctcccagcccctggcaaccaccattctactttctgtctctgtgagcttgactattctagacaactcgtttaggtaaaatcataaacctactgaaagtgtttgggtttttctatgtgactggtttatttcacttagcacaatgtcctcaaggttcacgtatgtggcagcatgtgtcagaatttcctttttaaggcttaataatattctggccgggcaccgtggctcacacctgtaatcccagcactttgggaggccgaggtgtgggcggatcaccaggtccggagatcgagaccatcctggctaacacagtgaaacactgtctctactaaaaaacaaaatacaaaaatatttgctgggcatggtggcgggcacctgcagtcccagctacttgggaggctgaggcaggagaatggcatgaacccaggaggcggagcttgcagtgagccgagatcgtgccactgcactccagcctgggggacagagcgagactccgtctcaaaaaataataataataatatttctttgtatgtctatacattttgtttattcattcatctgtcaaaggacatttggtattttgggttttgttggcccttttttttttttttttttttggaggcagagtcttgctctgtcaccaggctgaagtgcagtggtgtgatctcagctcactgcaacctccgcctcctgcattcaagcgattcttgtgcctcagcctcccaagtagctgggaccaccaggtgtgcaccaccacacccggctaatttttgtattttagtggagttggggttttgccatgttggccaggctggtctcgaactcctgacctcaagtgatcctcccaccttggcctcccaaagtgctgggacaacaggcatgagccactgcaaccagccaggttttgttggcttttaatcaagataatatgcaaacactacttttgtccatctgatgatgtctcaacaaagccattttagaatctgaagatacttcctcattaaattgttactattgttaataaccgagtgttggcttagtgagtgttaaggtatataagagtagtccaaataaatggcatagaaataaatgacagtgattaatcactcactagtctgatacctcatagcttccttacttcaagtttaggcaggtgcaggagtcatgaaaaaaagccaaaagataaaggtcgcaaccacttggtgaggaatgtttgctttcttgaaatgatagccctctacccagcaccatgaaaagtgtgtttttcgtggtcattttcaggcctctaagcttgaggtgtgggtttatattctgaaggatgcagtgcgtgatctttctcaccaaactctctcaaatactgcactggataaacactcagaggactggaaagtgggactggaaggagccattgagattttttttacatcctcttgtcctggagtactttccttcctctacactttccttacatttctcagagaaaaaaagaaaaactttgtcatttttgtattacaaacgtgccagctttgactacccttgacactaggtaagtgggagattaattgttgggattatacccatggaaaaagccataaggcttacatcacaagttttattttttttaatattttgttttcatagctggggattactctattggcattcagggagagagaatgaaaaaatatactaggataaaaaagggagtactaattaaaactacaaaagcaatgcaaacatacattaaaagatacaacaaattccatgccagtttcgtgaagaaatgctttgaggtttttttccccccagctttattgagtataattgacaaataaaaaatgcatatatttaaggtgtatgacctgacaatttcatatacaaatacattgtgaaatggttaccacaatcaaattcatgaatatatccatcaccacacatggttaccatcctttgagttttaaggtgaattaatggaatgcgtgtcattcatatgcatattcatatgcatgtcatttgcataccattccttgactcaagaaagttgctatatgagtgaaagataattattgatcatatgaacttaagatacaattattctcatctggccaggtgcagtggctcacgcctgtaatcccagcactttgggaggcagaggcaggtagatcacttgaggtcagaagtttgagaccagcctggccaacttggtgaaaccccattactgaaaatacaaaattagctgggcatggtggcacatgcttacttgggaggctgaggcagaatcgcttgaacctgggaggcagaagttgcagtgagccaagatcacaccactgcactctagcctgggtgacagagtgagaccctgtcacaaaaataaaataaaatgaaataattatcctacaagaattaccagtaagtatacttctaaaatagatcttactctagttcattccaatactcacataatacaactatatattaaatggtgaaaatatcattgcagataaattctaaatgaaaataaatcctaatatgtaatccattaggaaataaaattctaaatttaattctacaaattactttgtgattttgataaaatttacctaaagatacagggaagattttaaatttgtttaaaaatgggaagttagtaaaatcttgaggataaagaagaaatgtatacatatcaggcaagcccaccactgcatgttccatagaatcttacagataatggatctcaagaataagcaggctaaattttcacacccatcccccaagtagctgaatcattggggattttcttttggagaaatttagggccctagcaaagagtagatagcgttctgagcaagttactactcccaagggttggcccaagcattcaaaaacagctgggggctgggcacagtggctcctgactataatcccagagttttgggaagccaaggtaggaagatcatttgagaccaggagttcaagattagcctgggcaatatagtgagaatcccatttttctacaaagaaatttaaaattttgcctatagtttcagctagttgggaggctgaagtgggatcacttgagcccaggaggtaaggctgcaatgagccatgatcatgtcatgcctctgcaccccagccagggcaacagaataagaccctgtctcaaaaaaaaaaaaaaaaaaaaagagagattgagatctgagatctcatatttttgtagcaggttacactgagtgttaatggatgcatgatgttaacttactgattttgtttgtgaagaacatataacctggttatttgaaagaaaaaaccatgactaccagaatgaaccaatgtgtaatatagaaacaatccctctggctttgatcccctaacatctgtgtgtcctctggcaagatttttgagtacaggttggagaatgagcaaagcaaaggtatttgttggacaccaactaggcatcagacactgaagttattttagttactcctgaccacaactctgcataagctacagggtggttttcccattttacagacaagaagactgagcctcaatcaggccattgtttggcagacagtacatctaggacagcctgtttccaagcctgtgccctttgcaaaacaccttcttttgcctggccagcttgatggaggctcttataacctgaggctatggtgtgctggtgggattgtaaacattagaaagtacatgccaagaaccgaaagccattaaggaaaatgagtcactttctggatgcattgaacatctttagattatgagagcttcgtgaagaaataaagtacagaaatgatttttcttcttaaaaagaaaggaatatctctctggagtagagattgttggcaagttcatgtataatcatggtcagcagaaaagaaatctaagcagtaatgaaaagcttgtgtactcagaatgcctttaacccagtgagctgaagagcaggcctttgggggaatgacgttggatggaggtggagttgggacaggaatagaatcctggtcctggagggaaagacaggtaaaagaaagtgagaccattaaaagcaggcatgatgcatggttactcttcatccctgggtaaggtggtataaattgcttttgttttgcccccgtcccccaaatcatttttttaaagaaagagaagaaaatatttttgagggaactcattaccttttggcttgaggcatagaagcctcagaagctgaaagcaatgttatatttttatatgctgcagatgcttcctggttttaaaacagtgacctggctccccaacaattacagcatcaacattgagggagaacattcttgtgtatcgtgtaattccaggagcagatgtggggtagcctttacgaaattaggaggaggggaggcagtctggtttagatcgtgaactacccaaaggaaagttacttggcatgacttcgattgtgtgttaagataatttttattgtgttctagttctcagacaatatcatagataacctcttttgcctgggtgcattttgaaaggtctttgtgttgattatctgcttttgatgtgttttcatgatccgttcagactacccaagccataaaacatcagtaattaagaaaaactctccctgtggagaagaatcaagaagattctacttcttttatttaatttttaacatatctaaaggaatgcagtaaactctttttacccattagtaattgactttgaaacaggatatgcctttcctctggagtctacaagtaagtctcgagagaaacttcataaaacagattgatcctaaacttccctcctgcattcatgggagttagctgacaggaaatacacagtgcgaggaagtggtgagtgagagaaaaaaaaaaaacagctaactgataagatcttaattgcaagggtcgttttcatggtggatcatacctaataggtcatgtatttcaacagtttttttggaaaagtgattatgcatcttttttttttattattttctgaggcagagtctcattccgtcaccaaggttggagtgcaagtagtgtgatctcggcttactgcaacctccgcctcctgggttcaagcaattctcatgcctcagcctcccaagtagctggaattacaggcatgcgaccatacgcagagctaatttttgtatttttagtagagttggggtttccccatgttggacaggctggtctaaaactcctgacctcaagtgatccgcccacctcggcctcccaaagtgctgggattacaggtgcaagccaccatgcctggccagtgattatgcgtcttgtaaacgaatttttggggtctaacttttccaaaatttctatctggttttctttcttcccttctaagagtctgtatcttcttccctgccctgggctttattcttttctagagatcctggcagtcattatgaccatgccctttatggcacatccaaggtcagtgttcatgcgtgtcctccctcgttcattccctagtatgggtggatatagctgtgttacatgctgaatcctgctacccactgtgcaatggaggggtcagagtcttgtggaaggagagctggagagccagggagaatacaggacttttcttcaccttgggttgaggcagaactcatgaaaaacaatgaagcaaggaataatttcgttttgcacccgtttttttcgtttatggaccccatttcctgcatcttagcaaaatctctcctcaaaaaaatgttctagattagtagtagtaaattgatctatctgatggggctgctgttggatctctccgagccatgtttgaacttttaataatgaagtccacagtccctgcatagcttaccaagcaactgtggatttgcagggtgcggccagcaggttgctggagcgagatgggctcccagttcccctaacatcactctccaccctccacagtctatccacaagccaccaccctgctgctcacaggtctgaccctcccctgtggttgatgggcaggacaggactctacatatgccggtgtctgttaacacaatggggaacccaccagagatccctcacacaggatcacttttctggctgggctgtttttcctcatctttcatcagtgagtgttggccgtcagcgtggcactcttcacacccaagtgaagcctgcctttcccctctgccacattgcagtctctgctggggtggaaaagaggtcagcaaatgaactcacaatagtgctaagcattggattaagctttcaccattagtcttttcagctgacccaagaattgcattgtgaatggggaggtggggtgactcactgagtaatcctttaaagagtccattggaagccagtcttctttcaaatgtttcacatggaataatcgtgaatatttttgcatggatgtgcaattaattgcaaagtatgtatgtatactttaggtggaaacttaaaaaccttcctttgccattctcataaatgggcttgctgatctgcctattatagattatggtggccaaagcaccacccttctattaaaaagtataatctttttttttgttgttgttaaccaatcaaatgttccatctgtttagactccgctgtctgctctggattttagaacaatgcagtcaaggttattcttgctcagtaatcttgccttgaaaaagtgagttactgttcccagaggcaaaggcactgcttcttgatgacaggcaagtgggatttattagctttgtgaaggaggtgggagggcatcgtgatacttggtaaattatgagaggggctggggagaccatgtcaaaaagaaagggattccttgccagatgttcctaagagttgaattaccatggagaaaataatctgaaaatatgagtgacctcgactttgtcctaaacccccatggcttaaagtgcaagcgaaaggagggaatgtggctttataggggcttgcaggtagatggagggtgggtgggggtggtgtcaggtcagttccttatgggcttccctaagtcagtgctggagagcaaaaagagtgttgaggcctcccgagaacgctagaatgaccccacatccctctacatcagctttagacccacagcagcctcctaggtcttctaggtggaggctgagatagagatgttctatcctgaatatgttcagacaagccaggggcactcatataggtggtgcggtttcctgttttgcaaaggacaggagatagagccacccaagcagatgtcccagatgaaaatggctgtgaaacgacagtgtcaccttaatatccatttggacctcatttatgggaaaagccacctttcccacaccactatattttgtttgttacaatctctgtttgtccttctctttcaaacatatttctcattagatttattccatcgcatattttcagcttgtttctgtgaagttccgacaggaggggtgttccaggaagctccgcggtaccttttattttattttactttatttttgcccttctcctggaagagcacttggtaatcttcttaaatgctttttgaaagccttttaatgacatcactcagtgccccgctgatcactcatgaactgcagttgtacaccagctccaaaagttccatatttatgatgataaacaagagctgtaagatttctaattttgctgaggggctattttccctctctctcttgatgtgactcagtttttcagtgtagggccagaggctgtttgtgtactcagagacgatgttttcaactttttgctcttgatttttccaggcaattagcaaagtctttttagagtggaattgttatgagcatacattctattttaattcattgtaattagagggatgagcattacacttcttcaagaactcctagaagtcaatgttctgatttccaaagatcaaaatcttattttatgagcaaaaaatgtgactagatatgaaaaatgacaatcagtaatattcctccagctggcagagtgtatgaactccacttgtgatttcaaaatcatgctgcagagctgtagctgggttttctgatggtttctccacggattatcttcctcaaatacaatgttaaaaataataacttgtcactgtggccctcagtttggttgtgtttattataaagaagattgaacatatgaactgccaattgatgatggcccatgttcctggtctgtttaagtaacatcaagtcatctttgaatttaagaaatggtagcattctcttatttgattgctattagccctgaaatggaactgtccagaatagtatttgtgaaatggcagagttcccggacccccctcacaggacgtgagacaggggtgtggctagtctatctggccacctagtgagcactcaaaccccttacaggagggggagcatgcagatgggcaggtgcaggagccggggcaagtgcttttggactctggccccacagtagcatctaggggtgggtgcctgcaactctcaaagctgcagtgggcatgttaccatgctcttttagctctgccatctgcacacagcttaagtgttaaccagctcagtgccctcttggtatccaagtccttgtcctgcatccaggaagaatcaggtcacacagacaaactgaaggatggtaaatgcgggggattttattgcctcatcaaggtggctctcagcaggatggagtgggaagatgatcttcccctggagttcagccatcctgaagccaatctcctctctcaccattcctagccaaactcctctcagcattcagatgttccttctcttctctcctctgctcctctgctcttctgctcctctgctcttctgctcatggagcctggggcttggggtttatatgggtacaggatagggaggcatggcagaccaaaaggcaacatttgggcacaaaaacaggaatgcccgttcccatttagggccatgggtttccagacttgagggtggggcttttgccaaggaaccaccctcttctacccagtatttccctgcctcctgtccatgtcatttgtacaagaaaacatttttctcccagtaaagcttatcagttttcacagaataattgtcagcccctaaagtatttttggctgtctccagaggttagtaggtaagaagcttgaagatgaggccagagttcagcattgagctgtcccaggtgacacagactggtgagggcaggcaggttggctgaactcagtccctggagcttggggccagaggaggttgcagctgtgtaagcaggtgggcttcagcccctcaggatagcaagtctcacagccagggatgcagatgctaacatctgtcacattgtcttcagtggtttattatcttagtttcagctgctgcaaccaataccatcgacttgggggcttaaatgacagggatttatttctcatagttctggaggctagaagtccaagagcagggtgccagcatggtcaggttctggtgacaaccctctttctagttggtagacctctgtcttcttgctgtgtcctcatatggcagaaagaaagcatctgtctcatgtctctttttagaaggacactaatcccatcacaagggctctactcttgtgaccaaatcacaccccaaaggcctcacttccaaatactatcacattggagattagggcttcaacatgtaaatttggggttggggggcactcacattcagttcatggcacttgtgaactgaagccaagtgttgtaggtcttctgtcgccacagctgagcaggctgagatgagcatagcaagtcctcactcttttttttttttttttttttttttttttttttttttttgagacagagtctcactctgtctcccaggctggagtacagtggcccgatctcggctcactgcaacctccacctcccgggttcaagccattctcctgcttcagcctccccactagctgggactacaggtgtctgccaccacgcccggctaatttttgtatttttagtagagacgggatttcactatattggtcaggctggtctcaaactcctgactttgtgatccacccgcctcggcctcccaaagtgctgggattacaggcttaagccaccacacctggacagcaagtcctcattctttagcagcagaacattttagggtctcttctctttcttttgtgcataacttaagtttcttctccttaatgataacatcattgctttattatttttagagctttatagttaacagtgctttcaaccagtttgcttcatttgtgcttcctggagaccactgtgaagtaggtgggatgattattgccattctgcagatgcagaaattgagggtcatggtttagttgccccagtacaaagcctgatgctgggttaagtaatttattcaaagtaaaacagcatcgaatgctgaatctacatcttgaacccaggtccttctgaccgcaggtccttcccatgggtatttagagatttgcaaaaagcacttagagctcctgcccattagtctaggccttccttgataataaccttgtgggggagacctctagtgtggccaaggatgttaggaggttgccgtggtttcagtgtgtcccccaaagttcatgtgttagaaacttaatcccgaatgcaacagtgttgagagttgggacctataagaggtgactaggtcatgaggcacaacccacaggaatgaattaattctgttatcttggaagcacgttcctaagaaaagaataagtttgggccccctcctctgtcactcacacacatgctcccttgcccttccacaattccaccatgggatgacacagcaagaaggccctcgccagatgctggcatcttgatattggacttccagcatccagaaccatgaggaatgaatttattttctttataaattacccagactgtggtattctgttatagcaacatgatacggactaaaacagaggccatctgtgtctaaagcaacttaaagctaaaatttgccaaaaaggtttaatccaagtcttcattttaatgcataaggaaattaagggccagataaatgcctaagttacaatgagtttgaggcagggcctgggctaagaattggtctcagactctcagcccagtgctctccagatcattgagccttacctctccctcatagagtggcaagataagatgccccactcgtaccacggccagccattatggaaactttcagggtagaccttgtatgaaggccagcccctgcccactgtaggtagaggaagacaagacactcagaagcatccctcagctggctgcctgggcctggagtagtacgaatcaccttgctttggatgcaagctggtcagaatctgtgagtttctacactctgggcctgtttcctatggaagaaaagggagaatcagaagtgcattctggactagcttcaataaatcatcttatgtcttatcccacctcttttccctattaaaattcttacctttggccgggcccaagcttgagaaggccactcctaaagcaaggcccctttggactagggcctgggcaagagttaactggcacctgctatgccagcacaaagcttaattcccctgcagcagcacacccgcaggcagctattgaagcaaggatggaatgtcttacaatacaaagcctttgtaataatgagagggaaatagaaaccagaggtttgcaagctctttttttcttggggggttctgagtatttttgtttaacttaagtttcgtgttccaaggaaggggcgttttagtgaaaattgtgaagggaaaccctgccaaacagaaattccttataggatgagtattttcctcctttcaaggtgtgagagcgaccaagaagcaataacgcataggggagtcggggtgatagattggaatgctcttggctggagtgtgattggtgtctggaagtgagtcccagcaggttggctggtgaggccatgtgagcattgggcctgttccagggctgtgaagtgtgcaggcttgcttgaggctgtaggcaccactgcctgagccatgcacgtaaactccccagaccctaagagtagtttactgtcagggggtaagcccccaaatcaagcaagctgcacagagccaagactcccaagaaccaatgccttcttccagcctttcattcattcattctgtaagtgaaaactcagcgtggatgtggatgaagatattcatgcctttgtgatcattacatttcagtgtgtgggtgcaaggggaaggagacagataagaagtgagcaaataagtaaagtatctagtgtgtctaggggttttaaatgttatggaggcaaaaataagcagagttctcaaggaactggtcatcccgatgtccatgggctgcacttggttggggcagttctaagagtatctgtcacacttgcagagacgacctgggtcaactcttcccaggcactttgtagaacaccgggcagggatacttcaatttcactctttgttaactgggaatgtggaggcttaggaaagaactctgagatttgtgaatgtgataccagtcctcctatagttaaccaatgtgtttgttcattctcatacactcttgcatttgtatgagaatattaactatttcaaagctctcataaatctattgcatcattttagtcttatatcaaagtaggaagggtggatattgagacacaaaattgaagatcaatgactgtgctgtggcatgggttgtccagtcaggacagtggccatacacagtggttggccatagtgaaaactggctgaatagtcaccctgtatatgacaggtttgctttgcaatttgttttttgtttgtttattttttgcattgcaatggcaaggtcatagaaataatcttgtcacccttcaaactcactactttgaaagccagcactccattgtatgcatatatatacacatacacacacaaagtgtacttgttttgtttttttaaaaatcagtctccttactttgacccatgagaacaggagcacacaggagttcagacatatccattggccacatagtacctgagatctgtgaatgagatcacagtcgtcctatagttagccaatgtgtttgttcattctaatactttctttctttcttttttcttttcttttctttctttctttctttttttttttttttttgtttttttgagatagagtctcactctgtcacccaggctggagtgcagtggtgctatcttggctcactgcaacctccacctcctaagctcaagtgattctcgtgcctcagcctcccaagtagctgggactacaggcgtgtgccacaaaacccaattaattttttgtgtgttttttgtaaatacggagtctcagcatgttggccaggctggtctccaactcctggcctcaagtgatctgcccgcctcggcctcccaaagtgtcgggattacaggcatgagccaccatgcctgacttagctttcatttgatgagaatattaattatttcaaattgctcataaatctgcattactgtatgtcagatattggctttagcatttttctcaagttatttcatacaacaaagtataatataaacatcattattactatgtcatgaatgaagaaagtgtacatgaaacatgcctaaggtaatatgcccaaagtctcacagatagtaagtgttgaaaatgaagcttacgcccagttctttctctttccagaaattatactttcaaccactatcctatattcactataggattactttagattctaagattccttaggaaattagaaattcttagaattagaagctgttgggatatcaccctgaactcttttttgttaaatgttgctgctttttagtttatttacccttgaaggtctttgaggctttatattttattattgttatatcaactataattcttagtgtgacttataaagtctcacaaggctacgtaattttattccatctttaagtattttaaacagttagaaaaggaattatattacaattagatttctcaatttagtagctctttttttttaacccaaataatcagaaattactttgctcccccagttactgacagactgtgtatctttaggatataattacttttttttttttttttttttttttgagacagactcttactctgtcgcccaggccggagtacagtggcacaatctgggatcactgcaacctctacctcccgggttcaagcgattcttgtgcctcagcttcccgagtagctgggattacaggcacacgccaccatacccggctaattctttgtacttttagtagagatggggtttcaccatgttggccaggctggtcttgaactcctgacctcaagtgatccacccacctttgcctcccaaagtgctgggatcctgtcacgcccggccaagatagaattactttcaagactatttcccaacgtttggtcttgttatattctttagttttgtgtcatgaggctactaattttttattcctcagtggtaactttatgaaatctcttagacttgcagcaatcaagcctctcccttctatcgtgggctttaactatgcaagcagtcagcccattacagttttttcacagactggttacattcagcccgagtttgaaccagggccatttgggggcatttggagaggatgaagatggaccaaaagcaatcagttgacctgtgtcttgtttcctcttgaatttgggatttcagctgcctcctttgattatgctggagactgtatcatactcgctaggttcagggcacccccttgtggtgcaactcgaaacgtaatcaacgtgaggaaacagaatgatggccaaatgacgaggaatgaagaggccacgcatgtagatatgattttattgttcttcccatttttaaaactctcaaatcaaatctcctgtttttctcctgttgtttcaaatttatcagtagttatttcaatgctaagtggttttttttttttggaggtagaaacaaatcagaaaagcaagcacaaataatttaatgctacatctcgggagtttttaaaaaaattttattacaaaagtaaccatggatattctaggaatgttagaaataatagactaagagtaggagaattatttacaatcccatgacccacatagaatacttgtgttaatattttggtgtatatccttctcctatttttttctaggcacatagactcaaaggaaagaaaccacatgccacaagcacatgccatttttttttcttatttatgttattttattttttgagacagggtctaacactgtcaccccgggctggagtgtagtggcgcaatcacaggtcactgaagcctcaacctactcaggctcaggtaatcctcccacctcagcctcccaagtagttggtactgcaggcagacgccaccatgcctggcgaatttttgtattatttgtagagatgaggttgcaacatgttgcgcaggctggccttgagctcctaggctcaagcgatcttcccaccttggcctcccaaagtgctgaatttacaggtgtgagccacagtgcccagcccattgttttctaatatgattttatccacttaattatatgtgtgaacttctttccctcctgttacatgatagctacttcatcattgcatgtggttgcctggttttgttggttccactgtgtgtgggcaaataccatatcatgcagggcctccttgtagataactgtagattattttcttgggttctttattagaaatagaatggctgggccaggggcgatggctcacgcctgtaatcccagccctttgggaggccgaggcgggaagatcacgaggtcaggagatcgagaccatccgggctaacatggtgaaaccccgtctctactaaaaatacaaaaaattagccaggcgtggtggcgggcgcctgtagtcccagctactcggaaggctgaggcaggagaatggcgtgaaccagggaggcggagcttgcaggttcgggccactgcaagatcgggccactgcactccagcctgggcgacacagcgagactctgtctcaaaaaaaaaaaaaaaaaaaaaagaaagaaagaaaaagaaatagaatggctgtatcaaaaagatatgcaaaattgtcttcttgttcatttgttaaaatagagcatctttttgagaatgcaattttttttaaatctgcaagttcctaacatttgcatccttagtctgtgttaggaattgtgtacagtgtttcacatgcctggatctcacttcatcctcccagcaacctattatgatccattgccacaccaacttgctgatgaggaaagtggggcttaaggaaattaaagagctgttgtgggacttccaaagcagaagacagtaggctttcagaaatttgataaaaatagcactttgcatttcttgaatcttgagctaaatggaaattaatactaaacattctccactggtaaaatagagaataaggatattaacagtaaaagaaaagaagaagaaaaggaaatgtgcttccacagatttagaaacataagtaacaatctaagttaaggctttggcgattagatcttcatgttggaagatatgctggatggctcagtgatttgctgtgcaattacaaacccgagacaatttgtaatacaaagagcttttcatgagatcttacatttttttatgaatatattttcgtttaccatggttagtctcctaactggttaaattgcttccagagagtcaaaatttgactctatgtaaagtgacatcagaaagtctctaatttctgggccgggcgcggtggctcacgcctataatcccagcactttgagaggccagggtaggcagatcacttgaggcccggagttcgataccagcctggccagcatggcaaaaccctatctctactaaaaatacaaaaattagccaggcagaggttacagtgagctgagatcatgccactgcactccagcctgggtgacagagtgaaactgtctcaaatttaattaaaaaaaaagaagaagaagaaaagaaaatctttaatttgtgaacaaaagtggaactttgggtgagtgcttaaattttagcagcctccagagtttcctgatgttactccctagagatcaacaattcactttttccctcctttactgatacttttctttgtgccttgttatagaattatatttattatagaaaaccctgaaatagacatagcaaaagaaataaaataaatatcgcttgtcattcagaccgtttgaagtactgtacgtgtgtcattcatttctggttctctccactacatttgctcattgtgtggttacccaatatttattattcttgagcaattcttctcagactcatcagcattaggaaagaaactctgaacccctttcccttcctgccacatttagcctttcaaagagatctcaagtgccatttagtacaacaacaatgtctgaagtttctttttgccattttcttatgatagctgatgaatttattaggagtctctgaaataataaatgctcttctgtttaatttttacagtattattatttttgccattccttgaggtagttgagtcttcctgttttctcagtaacattcctttagttttttgtgggttttgtttttgtttttttttttttttgaaacagggtcttactctgttgaccgagctggagtgcagcgtgcagtggcacaatctcagttcactgcaccctccacctcctgggctcaagcagtcctcccaccttagcctcccaagtagctgagacttcaggcgtgtgccactatgcccagctaatttttgtattttttgtagagatggagtctcattgtgttgcccaagctggttttgcacacctgacctcaagcactcagcccaccttagcctcccaaaatgctaggattacaggcatgggccaccgcaccaggcccattcttttaatcttgatctaacctctttatatgtgataaactactgattatcattagcatagataatccagaagttcactgaaaacactcaactctggtctcatccactttttttttttttttgagacagtgttttgctcttgtcgcccaggctagggtgcaatggcgcagtcttggctcgccgcaacctccgcctcccaggttcaagtcattcttctgcctcagcctcctgagtagctgagattacaggcgcccaccaccacgcccagctaatttttgtatttttagtaaagatggggttttgccatgttggccaggctggtctcgaactcctgagctcaggtgatccacccgcctcagcctcccaaagtgctgggattacaggcgtgagccaccgcacccagccacccgctcttattttttaagaacaattttctatcgtatagtcaaagccgtaaatcaagcttgtaaatgctccacgttgatttagcaggtatatgtgagaggcctaataaaatccagttttcttttttattgctcttattgttgggctcaaaactttccacacagatggaacctactgagaagcgaaaaaaggttctcagtgaggttcattttgtaatcctgagaaaacttatgtgtgattataggatcctgaggcctaaagttcgtgagcttattccattgcatcttctgagaagggcttcctacgtctccagcatcccggggccttccctgctctgatggtgggagattcttccagcttctaggtttccgtgaccttagttagcaaaggcaggaaaagatgtaacaggtagactaggggtttgctccacagttcggaggctttgagcaattgtgtgtttctcttgcctgcctgccttccttcctttctttctttcttttttcttcctttcttttttttttgttttgttttgacagtgtttctctctgttgcccaagctggagtacgttggtgtgatcatagctcactgtactcactgcaccctcgacctcctgaggtcaagcagtcctcccccctcagccccctcggtagctaggactacaggcacttgtcaccacaccaagctaaattttttctttcatcttttgtggtaatgggagtctccctatgttggccaggctggtcttgaactcctggcctcaagcgatcctcctgtctcagcctcccaaagtgctggggttacaggagtgagccacctcacccatcctcccctactttcttgactttcagatgatatttgtctaaagcaatggctgtagcgactttccttgcccccgtttctccatatttcattttctttgttgtaagttcctctgatgagggtcacctagcagagagtggttgaggtctctttgtccctcctggcagactcactgggactccggtctcttccattaccactttccattcctggtcctctctgaagggctgtggttgtcctggttctcctcccgcagccggtgttacttatcatcgctctgtgattttctgtgctttttttttgtcccccttttccctgtccatagcagctcttcaaatctatcatcctgtttttatcttacacttttatttaccatgcatctgcagggctttattatttgtggtctacttcagggtatttctttcacagttgatgaagcctgtaaacttcagagcagagaatcagagggccctaagcaaccctcacctttctggtgagaatatattcacctagaaaagggcttttatgaggtcactttagctaattgtttttctaatagtgtcactccctttttctcttcaaggtctcttcaagttcttttatttatttatttatttttttaacccctatgtgcatcttgggtagaatattttagtacagtttttgtctggagacctgttgtttggctttttggctttcgagtgtagccatctgtgttcaagtgttctttttcttctagtggaaatttgtgtctgatgtgtgggactaagttctaagtaatatacacacatatatataatctatacacaatggtgatatggatcatggatattgtataattcaatcatgacggtacttagaggctcctatatgttactagtccttatggatatgtgtatatgcgtgtgcagtaagatatgcagctatggcaccccactggcagatattgggcacaagaggaagtcactcttcttgcatgaggattatagaaattttcattttttaagtcacaaaaaaatatttcactgccatgtttttttaaaaagttaagttgctcaaaaatgagtcggatgcagtggctcacaaatgtaattccagcactttgggaggccgaagcaggcagatcacttgaggttaggagtttgagaccagcctggccaacatggttaaaccccatctctactaaatatacaaaaattagccagctttggtggtgggcgcctgtaatcccagctactccggaggctgaggcaggagaatcgctttaactcgggaagcagagggtgcggtgagctgagatcacgccactgcactccagcctgggcgacaaagtgagattctgtgtcaaaaactaaaaataaaaataaaaataaagtcagtggcatcaatgagaattaaaatatttaaatgcttgcacagtaagcattgtaaaccaaaggcacactccagggtccaccaggttcaaatattagaatttgtgccctgaattacagtgtggatcttctgttcctgcatgtattcaccttgggtgtgccctcctgcatggcaaagcatgggcagagagcactgcactcacaggcctgctttcgtggagcaatctagtggccagtgagcccggggccagtgacaatcaagatggcagcctcagactgcattctggctaagaaagctatttcatttgggttgggcaggctctagtaagttccctgcagctctgggacaacctcagggatggtggattaatatgacacattctccaatgatacaaggtgaattcagaagcgcctatggcagggtattttggggcaaacccattgctagttaaggcttcaacatgtctttctaaaatataaggatggaactgtcatcatttttctttcttttcggggaagaggagttaaccgtgctacattttcatcatgaataaataggtggtccatttggtcaacctattctttttctcttcatgttttcaccccttttctttcctatttttttcttgttttctcctggtccacaggctttgaagggcatgctgatctctcttcaggcagaacttgacattcaaaggtacttgatgaaaattgaatcgtctcagcgagttagtactctacctgttctttttctgcatcgagttgcaccctcatcctgcacctttccctcacctgcaagtgccattctaatcagtgtcagccactaacgcctgcacttttcgctgtttaccccaatccctgattcaaaactatcagagccaagtgcttgtagcattctgaaatatgtgcatttctaaaaattatgagagtcagtattaaaatgaacactaattgcatgcttgcttcgaaatatttaatttgctttccacagattggattgtggaatcagcagtaatgcaaccacaagctggagatctttgaataattgtttgaaaagtgggcatctctaagcagagatcctatccttgccagcttgctccagcagaatactcatggcagtaaaacagaagcctgaatcattctgacaatcccaaagctatgtcattctgctttgctcagttccaatgtgtccaatgttgggtccagatcattttacttatatacattttaataatgatcataatggaaataaacacatttctttagaacttatatacaccaggcactgttctaagtgccttacaagtattaacttctcacagcaaccctgtgggggaggtatactatgatccccattttacaaatgaggtgattgaggcacagagaagttaagtaacttgcccaaggtcacacagctaggtaatggttgtgcttaggaaatgttcggccatctggctttgtacaaaagtgacctccttcccattggtcagtcttcagtgaccatgcttatctctttaccttccccttcttaataatcagtctcattgatctctttttagggtaacaagctcaatttagaaagttcctgcccagacaaataaacattaaagttcaagtttagacactaaagagaattttcatgtcacacatcatcccaattctgatgagtgtttatccttaattttattcttaatcattttcacattcctaaaattcatgcaaaatagaggcatctttattatttccgtgcgcatgtattgtgcactaagttaaaatgcagaaagggaaaagaagggcatagtgagctcttccctacaacttcacaccctgccattaacctttattcctactttcagaatagagatttgacattgcccagtgggattttcccatcataagtagtactgagtttgggattccctcccgctattctttttttcttctgcttgaaacaaataaatcttcagtactgactttccttttctttctttttttttccatatcagcaaataattggatatctgaaatttttcttgaagtgcttttttggcatttacaagcattttaaattataatgctgtttttcagagatggaataggatgaaggttaaggttggaaatcgaaggtgatcttccccctttagtgaatgagtaactctcagatcctctccagatgtcaaattctgttttgaaattggatgtaactatttacctatctcacaagaccaagatgaaggcatggtggatccattaaaggtttgtttgtacccttctcctctcacataggatcccagaagctacgggacttcccaagaacagtaggaagctgagccatctagaatcaccctactgagagtaacaccagcttactacctaaggaaagctaaatggttggcatcttttataatttaccaattgctgtcccatgcaacatttttccaattacttctcactttatcaagtagatattctgattattttataaaagtgagaaccgaggttcagaaaggtttcatatggagttgcaccgtgagttcatggcaggattggagtctgcttttcataaaataacctgataaaaacagtaagttctctcattataaattttgtcttctgtccatctcttcaaacactggtatactttcctagagcaggactagaggaaaatcagaatctttggtgcagaaagctagttagaactttcactatgtgtgtgtgtgtgtgtgtgtgtgtgtgtgtgtgtgtgttttcatttgaaaatcattccagtgaaattgggcaggtggtagtggtggttgttttggactggcgggagggggaatgtgtttgaaattaacagtgaacgctattcccaggatgtatggggagggtctggccataagctctgagccttggtgaccccaggaacccacaagagtccctcttgcccagttccctgtggccttctccactgtggggtgatgaggacatcataagctctcccatggcacagcccataccctcactgagggtgagggcctttgctagcaaggaaagcctctttggtttggcaacaatgcaattaagttttaggggtacgattccgtggcttgggatcccacatcctctccataaagcactgaagcctaggttgcagagatgagcttaaaaatggcttttgttaagaaggccttctaagatgtgtacttagcaccatgttttgctggttgtattttacttgagacttcaaaggctacaagcaggtttctttccttttatcagtataataacagcaatcctcacacagacaccttttatcctatagccttttaaagtgcattcctgactttctgaattacaaaagcatctgcagtcttgctcagacctcaaccaatgaggattttggcagccaaagcctgttcaacattttacttgttgataaggcattacttttcttgtttcagaaagaaaggagagaaagaataaattaattgttgtattcaaggcaacttgcaataaaaagacatctacctggccgggcgcggcggctcacgcctgtaatcccagcactttgggaggccgaggcaggtagatcacgaggtcaggagatcgagaccatcctggctaacacggtgaaaccccatctctactacaaatataaaaacttagccaggcgtgatggcgggcgcctgtagtcccagctactcgggaggctgaggcaggagaatggtgtgaacccgggaggcggagcctgcagtgagccaagatcacgccactgcactccagcctgggcaacagagcgagactctgtctcaaaaaaaaaaaaaaaaaaaaagacatctaccctaaggtagatacactgaaaatcaaaaagcaaaatctcgtaagaagaggaagcaaattttaaaatataggtactatgattagcttggacattaaatttactttcaagcttcctgacatacatgatattttacatatgacaaggtaatacttattaatccttcaggaagcaaaatcatattctttgtttcaaattgtgaaagaaacattgttcgtgcctttataaaaggtacactgatcagcatagtaggcaggaccaacaagtaaacagcagtattcttcatgtggcttttgtttttttagagacaggatcttgctgtgtgacccaggctggagtacagtggcatgatcactgcatagctcactgcagccttgaactgccaggttcaagggatcctcccacctcagcctcacgagtagctgggactacaggtgtgcaccacgactcctggctaattttcatgttggttttttgtagagatgggacgttgccgaggttggtctcaaactcctggcttcatttatcctcctgcctcagcctctcaaagtgctgcaattataggtgtaagccaccacacctagtccaggcttttaattttgtatcggcaaaacgaaaagaagaaaacacatcactgaataaaaattgcatgaacgtatttctgaaaggggtgaaagtctgagttaatgagatccagacttggaacttaccgatgatctaattttctaacttggtagaaggatgctaaatggagatcatagttgagctaggctttattttctttaaatagcttttgtctcattctggctttggggaggagtcagagagcagtcaatctgaggtggtatttcagtagagtttatgtcatgttacaggtaggccacaaggcagacaggtggcaggttgatgtctaatcctggagttgaaaaggccaccctgccttctgatctgataagaacccctgtctcctctgcaaggcaacagatttagcagctcctctaggtggaaccaaacctcttcaagggaaaaaaaagaatactgtatcatctacaaactatgaagggttgaaaggtggaaaatatctctgggatcatagaaaattgctaaaattccaaatttacctagaatcaaattttaagagcctttaaattaaattactataatggtatcagaactacagatgtggaagtctgtctctttaaaaggtggaatgcaatctgcatgtctgaaattgatttgatggccttggcgcttttcttaactgtatcgttttgtagaattggaagttttgtaagaactggattcttgccaaatattgcatggcatgaaaatgaaaacgtgtttcccttcccatgttttccccatgcatttgtgttgtcatttcaggggccatctctaatgacaagttcttaaacctagaatccaatcatacagaatacacaagagaagacaggaattgggcatgaatacattcaggtcaccatagacaggaatccttctggattctaaatgttttatgggaaagttcccttcctctgatctattctttaaaaatatcatgcctatttagtaattctctgatttgtaaaaacaacatattcttattttggagaaataaagaaagtgtgtcactcttatcctaagcaatctaatgcagaacagaaaacccaatgcagcatgttcttacttaataagtgagagctaaacattgggtacacatgggtataaagatggcaataatagacactggggactcctggagtggggaggcaggaggagagcaagggttgaaaacccattgaatactacgcttgttacaaaaacaccgggggtttggtcgaggttctgctgctcaccaaacagaaaaccaatcactgagacaagtattgccaaggaagaaggctttgatcgggtgctgcagccaaggagacagaagctcagtctcaactccatctccttgactgactagaactaggggtttatatagcaggaaagaaacgttaagaacacataagaaaacaacaactgagaaggcgcaaggaaacaatcatgatgaatgaggggtgtggcatctggtgtggtgatctggtgcgtttcagttctttgatacttttttgagagtcctaaaggtgtttcctgaggaaggaactcagataaaacaaatactggtttccagctttgagaccagaacaatttcttgttcagtttatcaaaaaaaataatctatgggactgttgggtcagtttcatgctcactgcctgggtgacgggatcaattgtaccccagacctcagcattttgcaatatacccatgtaacaaacctgcacgccaaaataaatctaaatctaaaataaaaggtgaaattatttaaaaagaatgttacccgtaatcccaccatcaaaagaaaactaatgctcgcatttggctctattgtgtccaattactaaattataccccaaaattccattaaaacacctttattatgattgtgtagtactctagagtacacagacattgtaatttgttaaccagccctccaaattgtttcaagatttacttattctattaaagatgtaatatgtacagatttgcttcctgacactccagtacaagaactaccacttttcttaattttcccaaatcaaaccaatctatcctggcttcagcaattattgagaaattcatcctcatcatattaaggggaagcattttcccctcacttggagtcataaggaaatcttgaggagcttgtccaatccaataaaaccaggccagggcctctgagtctcctgggacttatagtgaattgctttctgtgcagcctgtttgcatccaggtttatggggacctttgccaagtatcctaagtgtgagcacctggttccacccactctaagcatgtcacacatccatcttcccagttgtgggtcacttcttgcaaatggaatacaggtcttcccaatttgaagagcaccatcgccaccactgacaccaaaactgccaccctcttcttggctctgggaagtcatccactcccctcttcctgcgcaattaggaacttcctcctttccccttctggaggtaagtccagacgtcttttccagatacctttaccttctaaccccaatttagggagagagtcttcagagtggcctctgtagcatggggataccattaacaacccttccctgtgggaagaccttggaacttaaaggcttggaagtttcccaggaggtgatggctagcaatagaagttccataaattttttgttgtttctgacaaccacaaggacaaggtaaattaacaatacctcagaagatgaatctgacacacagataatactctatggagagtatttgcatagtgtggtgcttctttaaacaatgaggaagagcccttttctgcacagaggtgtccttgtcatttgtttgtttgcagctgtaggaaggcagggggctttgcatggtgacaatgggttggcagaggggtcctgcctggctcacttcgctccacacagaggatgcctcagtgcagggatgactgtggctggctccatatgagctgcccgtgggcagcgggtaatgggtatcactgccctttcatctttccaatctgataatgaaataatacacacagagaaggaaaatgtggaaacaaaagatgcagttgtactttgcccaactgctgaatcgtctgatttccatccagaacaaatgccattctgttttcacaggtgaaaatcatgaataacgtctgggtactctttggatggaaaagggagaaaagtgttgaaatattagcgttgaagaaacaggatataaactgagtgtatcaaggatatttcatcaaaataaatcctagagaaaatgcttcccctttatctaagtcagggaagagaaatactaattatcagacctcaacttaagctaggagaaacgtgagaatctcagatatgcaccgttggaagttggcattaaaatgtggttagtgaatatagatctatcttattgtaaggcccagaagttcctggttactagtcatcctggcaagtatccacaaactgctcacatccagcatccagatgtccactaaacactcgattttgtgtgtgtgtatattgtactgtagattaacagcaggaccctctagcgcctgcacccaaggtttctattaaaaacaaaagctgctgatttattctcctctaccaccatttctctgagtctttaatgccagacccaccccaaaattgcaagatcataataaaactaactacagttctcttctccatttgtgttgcagttctcacatccacccgttgtattttagaatcatgggtgtctcagtctattacccagagtgatcatagttgcaagaatggcactggggagatatcattcagattttgcttttctgtccataagccacagaagccgtgggaagttgccaagaagacatgcatagctaagccttgctgttctttttttaaattttgtattcttctgttattttttagagatgggagtcttgttctttctcccaggctgatgtgcagtggtgtcaccctagctcactgcagcttcaacctcgggctcaagccatcctcctgcctcagcctccccagtggctggaactacacgtgtgcagcaccacacctggctaattttttaattttttgtagagacagagtctcaactaggttgcccatgctggtcttgaactcctgggctcaagcaatccacctgcctaggcctcccaaagttctgggattacaggtgtgagccactgtacctgaccccagggctcgctgttcgaaatatacacctggctgttggtcacaggactcaccagagaatggcaggtggtggccaactggaggaagaaggcctcagctgatgctgtcaccagggatgggtttatgtaaggatgggagataagatagaagccaggtgtgcccgatggagctccctgtcttccttcccacccttagtcctcaacccagcatggacattaaagacaggaaactagaaggagagcagaaaatgggaaaaaggcaactgcactgtggcttgtaaaaaggactctgtaagcaaatttagaagcgtagagcttccaaagtgagagtttattaattttcctttggagtaccgtgaagcaggaatggtagagaaaacctaaattctgtggatgatttatttgttaatttaatattttgttcctggaatttttaataaaagtacctagcaactagaatgttctcttcaactgaaatcagaattttgactgggtttgagttgaaagtttcacaagtgaaagaaatggggctaaagtgtctgaatgtcatgattaaattaaccatgtcctttaatgagtgctaggaatgagtcattccaaatacatttgcatgtggaaaacttcattgtattttcaaatgccctgtggcaaattgggcattaattaggatgaagtaaaacttcatcacggcaatgttgatttttcttttcacaatagaacgtaatctgaagcaaagtgaataccttggctagccagacaccccactgttcctggcaattaacatattacgtaaagctacatttgcaggttcattttctggacctcggcatttcaatttagggtttaagggtctgaaaacgggaatgaaaaatacatcatcaatacctctagctctaactttcttttatctttgttgttatctccaaatccaatagcattgcaaagaatatgaataaatctgatctccctcgcagaacagtgcacttggtgaacatttcagcaaatatttgttcatgatgttaaaatgaaatcatgaccgtcttttaaaaattaatgctgttcaactatgttgcatacacttgaggacataaatgcggaaagccagatcttagcactacctagctacatatatctatggagcaggtgctataggataaataattcgaaggaaatctcagtaaactgtttttctggatgacatgatcttttcttcttatatgatgtgtacttagagttagaaagttttggtcctgcaagggatctgagacaccaactagctcaacctctggccttacagatgagatacctgtgactcaacgaggttatatgtggaccagtttttggcagaagctgaactagaactagcattcccagactcctggttaaataaaaattttaggcagggtgcagtggctcacacctgtaatcctagcactttgggagactgagatgaaaggatcgcttaagcttaggagtttgagaccagcctgggcaacaaagtgagacctcgtctactacaaattaaaacaattagctgggcatgatggtacacacctgtagtcccagctactcaggaggctgaggtgggaggatcgcttgagcctgggagatcgaggctgcagtgagccataatcttaccactgcactccagcctgggcaatagagaccctgtctgactgaatgaatgaatgaatgaatgaccaaccaaccaatcttaccactggtgtcaactctggagtgcgccacacgtgatctttgctcctttcatttggtagagtttcagggcaagctgctttttctattttctcagtggtaatcagtagtgtgaggttacagggaaggttaaattaggttaccacatgacagttacttgatacagagcagcaggcacctgttatgttgggtcctttatttcttccctcatcctttcattaggaagagaatatttctatagggtcaatcacagatgcagaagaggagagagctgcattgagccaatgacaccagaatgtcttcgtgacagagagaccccttcgaagaagagaagaatagaaaggacaagtggggttcaggtggcctgattatacagaccacccccttcatgcatgaccccaaagggcttaccatttgggtttgcgggtttggggttgcctaatgatttggggaagtctttacaaggttgtgatggaaacagagggagattggtgtcatggatctccatggagcaaggaggaaaatccagtcttacagacccttgagtcctgctcacgtggctcagagaatattcccaccatcccctgcttcctcctcagttaggcatagctctccactcagcagcttagggtagcagcttcaaacaccaagctgtaggccatgcatgactgagaaaagttttcaccggaggcaaaatgagaacactaactccaacataaagaatttttcactagatcaaacctgaaattgtgtttgcttcccccttttttggtattaaagtatctttcctttcttatggtaaaaaaatgataccacagagagtaagatttctttaatgcctcttactttgcaaaataaaatcaacatccttgtattgtaacccctcataaatttgggggaaatatttctttagaaattttcatctatgaaatataaaataatgggaactatgattatggaaataagctccagagagtttagctttctccatggttcttactaatatgaatatgtgagcatcctagcagcttagccaggaggaaccattagaattggtgttggtcagcggtggtttgcttgtaaggcaccgttatcccaaactagtgcaagaacaaaaactgaattaattgaaggaattcattggaaggaccccacagtgtactggaaacagaaagtgggaagcccaggagaccccagatggctgctgtcttatcttttgtgctctctgaagatcgtgggggtctcacatctctgttttttaatacagattcgctttattttttttctctgcacttttttctgtttcacttttcctgcccacgttaaccacagcttcaagttgaaaactaagttgtttcaagttctctgtagacattgactaatagatcctctgtcccagatctaaatttacaattgagagtttaattggaccagctaagttcaggtaactacttcttgacccaatcaggaaagacatttccaggggcgagaatttgattgatccagctaagatcaggtgactactgttcagtccaatcaggaaagaccaggctgggagtgggtagccctgtactttattgcccagttcagagcaaccctcgcacctccctcacctacactcttcctcctcccctgatgcccctttaaactcagcagttactgccccagactccttctgcacccagggtgatgtgcctcttcattcttcctgtccatctattgcatatatattatcttttgcccccatatagaccttacatgcttgacgagctcaagaacttttatctctggtccacttttacccatggtgcctagcactgttccaaaatgctattttgactttttttttttccagcatatcagatcacagggtatctggcacaagtgtcagcaatttccattgtcttttctctgaactaaatgatgtctcagcagcaagctggcatcagaggggagggtactgcgtgtgaggagactgctaatatgtagtgatcgttttcagtgagaacgtgaataacaacaaaaagaggagtttacatttggagctaaatagctatgtttaggaagtgaggggagaaaaaatatatagccctgcatctctgatttttctacttacctaccactacgatgaccctgaacaagaaacagagatttgattttgattttcttcaaggattattaccttctgcaatggaaaatgacaactcatcaaatgtatggtttctgccgtgagctataaagatgaccaaaaggcagaggttataaatgtagccatgttgcttaaagtaatattatttcttggctatcttgctaaactgaatctaccttctttaaaaaaaaatgtcaggaatgaggacatcataccttgatattctgctgagcacagtaaggaggaagctacttcactgaggaccacgtgaatttgtctaaatcttggtgaactgggcagtgatttagggataattttcctggtcaaatacttgtaatgtgtgtcaaagccagatccccataacagaagcagactttgtaaaaaataaatctaggaatgcaccactttggggacttgtacagaaaaattaaccaaaggagacaatttcactgttaatgcatgtcctttctggtcatgatattggcatatctttgctgagtttcctgtagaacacccagtcatctccttgaagccacatcccttaagaaacacagggcggaaggtactgaccttatccctgctttcctctatgggaaggtcctgagaggcatgtaggaaggtgtgattgtctggataatgcaattggttctgttgagaggggtcgtcttgtacttttagcaagaagctgctcatcccattctcaaagggtactgctagagtatcaggcacaccttgggcatccctgaaacaaatctgtagcccaaaactcaaggcaggactggctaaagaattgtcagggtaccttgttcaaaaatcattaataaggccgggcatggtagctcgcaccttggaatcccagcactttgggaggctgaggcaggtgcatcacctgaagtcaggagtttgagaccaccctagccaacgtggcaaaaccccatctctactaaaaatacaaaaattagctgggcatgatggtacatgcctgtaatcccagctacttgggaggttgaggcaggagaattgcttgaacccaggaggcagaggttgaagtgagccaagatggcaccactgcactccagtctgagcaacaagaatgaaacgccatctcagaaaaaataaaataaaataaaaatctcccttgcaatgtgagtttactgattgtggaaacagtcttggtatgagactctgaaggaccagttgtgttcaatttactctggtattagtagctcatccatctagggtgcgtagaagagtatacagtcccatctgttgtgaaagcactgttagaatttgtcgggcaaaaggaattgttttgctgtcactttcttataatgtggcttgtcctcaactccctgttcaaaatgcaccacataagtcaaacaataaaaatcttaatggagaccaggtgcagcgggtcacgcctataatcctagcactttgggaggccgaggcaggcggatcacctgaggtcaggagttcaagagtactcaaagtactcaaagcctggccatcatggtgaaaccccatctctgctaaaaaacacaaaaactagccaggcatgttggggcacacctgtagtcccagttattcaggaggctgaggcacaagaattgcttgaaaaccggaggtggaggttgtagtgagccgatctcacaccactgcactctggcaataaataaataaataaataaataaataaataaataaatacaatggaacacttaagggcaatgttattttccggtaattttcacaactgatactttgacccactgggtctttagttttccctatctaacccttgtgatggactgttaccccttgccatattatttttccagattaatagaaatggcattggacatattttccacacgattaataatagtctattttcccactttctttaaaatgccttttgcagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggtaagctttagaaggcagtttctgatgcccctttcttactgaatgcgtttgttgttatactactgaacctatactctttcattcaacattaatttgatcttgatttgcaaatactctagtactgggaaacttcattggtttaatatcaagcattgaggatttgcctgctgggtaatcaggtcaagtgcaagctgattttgaggctgggcactttcagaagtggttgggattagcaattcaagccaagaggctagtagtattttacctatgttcctgctactatacagcaggagtccccagtccccaggccatggaccagtaccagtctgtggcctgttaggaaacagaccacacagcaagaggtgagcagaggatgagcaagcattaccgcctgagctccgcctcctgtcagatcagctgtggcatccgcttctcataggagctgaaccctattatgaactgcatgagtgagggatctaggttgcatgctccttatgagaatctaactaatgcctgatgatccgagatggagcagtttcattccgaaaccatctgccatccatggaaaaactgtctttcatgaaaccagtccctggtgccaaaaaaaattagggaccagtgctctataggaaattgtgaggaactgaccgtagaatgatcctcttctcaccttgcaaccctcctctccagtcccagaggccaggacagttggcatttgtacccagtggtgtgggtttccaccagccctgctgcacctgtctggtagtccagtggaggagatgacaaaaagggacaatgtggctaacatctgcatgactgttcataagaaccataaacacgaggctgttcccactaccacgtgaaaggatagaggggcttggtgtgtgtagggcacagcttttctgaaaggcagaaggattctttttatgattttaccacgtatcatttccttttttttttttttgtattggaagtttactttctatcttgctttgcttttttaattgctttttttggcgctttaacaaaatggacaagtcgtgaggatttagacctctctgtcaagggggcagatgtttcttatgcttcattgccatgttaaggttctgatttgggtacttgtgtttgcaaacagatgggcttggggataagaggggacaggaaaagagtcaacatgcaaaagccttcagagtctagcacgtgcaaaagacagctgaactctgccatgtaaaactgagcaaatgccttgctgggagaagaaagaaaaagattgatgtgagagaaggtaccctgattttagttcctttgctgcagataatgacccaagcagactgaattcagacattgtcctagctgtcctaaaaaaaaaccctacaactttgttattatttgtattatcaatattaatatttaacattaaattttgtgtcaaattaaattttgatcaaattaagatcaaattaaaatttgatcttaggttagtaatctaggatcctcattgtataaatgagagaagaccacagaaaatgtgctttttgtttatgtgtgtgtttgcttgtttgagctcacacacttaattaagtggcagcagtgggaagtccagggctccagttcccattaacatgatcttacaaatgaagggacaaggacacacaggggagggacacacccaaggagcatcatgggccaagacagtgtcaagatgacacaggcttccacaccgtcaccaggctggggctttctgtgtggattcaagaaatttgtggtttttcttttcttttttttttttttttttcttgagacagagttttgctctgtcacccaggctggagtgcaatggcatgatcatgattcactacagcctcgacttcccacgttcaagggatcctcccatctcagccttcagagtagatgggactacaggcacgcacccaggcgcctggctaattttttattttttgtagagatggggtctcactatgttgcccaggctggtctggaattcctggactcaagtaatcctcccaccttaacctcacaaaatgctgggattataggcatgagccagcatgtctggcctgaaacttgtgctttcttaactccactcacacttaggagccaggcaaggaatgggatttctcctttgtgcttggaggaaatgagctcaggtctctgtaaagataacctcagctctgcaaaccaaaacgaagataagaataaatgcctgtccgccttcccccatacctgggggaactttgactctgtcggataatggatcttttgtcttaaaggaaggaatttcctctgcagccaagaacggttggcagtgcaggttgagacttgctgggttcaggaaccaagccttggggcagagaggctgcaggagctggggccggcttgcccaaggaatggctgagggtggcgggtgttttcgcacggggtggccacgcttctgcaaattgctccattttactcagcatcctttgctgtagagtgccggtgtgctgtcacagcaggctgaaaaatgcatctgacctgtttattctgccctccctgtgaggggctttttggcctgccatttttcactactcctggatagaaacaaaggaacacagtaagaggagaggagagaaatgagaagtttcttgccaaagccaagggaagctctggttccagaaaatgaggctggcactgggccagctgggttgatgttgcccttgaccgcctctttgtggccgattggggaatgtccccccagccgcacctggcccttatggcgtaatccagttgagcctggacgggaaataaaaaggaaaatgtgactcacagcaagtgcaaatgcagtctccctcccaggggccttgctcagcttagtctttgggaaactccccgcctgcctggccttatttaacacacagacgcacgggttcctgggataaacagtgctccccagagagccccggccatgagcagggtgtctaccagcacctgggtggcccagaagcacagctgcaactccatggggcctcagatatgccgactggatactttgagctgtaacccccctggaaacccgctgttgatgccatctggaagccctgggtgtcttttggcatctgtatgttgtcactttatctcaatccatagagttttaagttctctcatgaagccctgttgatcttgcctttatttaaaattttgatggtttatcatgaattttttttatcattttattttttaggagcaattttttaggtttgtaacaagatcgagcagaaagtacagacagttcccatacacccttggcctccacgcatgaacagcctcccccatgatcagcataccctactagagtggtacgtttgttacgatcaatgaaatgagaccgacacattgatatcacccagagtccatagtttacactggggttcactcttgctgttgtacattccatggatttggacaaagaggctgtcaagggcaacatcaacccagctggctcagtgtcgcccaggctggagtgcagtggaacgatctcggctcaccgcaatctctgtctcccgggttcacgccattctcctgcctcagcctcctgagtagctgggacgcaggtgcctgccaccatgcctggctaattttttagtatttttagtagagaccaggtttcaccatgttagccaggatggtctcgatctcctgacctcgtgatccgcctgccttggcctcctaaagtgctgggattactggcgtgagccaccacacccacctgctttttaaaagtattgcacaaagacattatttatcatgatcactgagcttttgggagacccttaaattttgcactggaggtatgcgtcttgttgacctcaccccagtgctggcccctcatgtaaccccaggagcatcagacactgttactgccagcccccagccacggggcctggagtaaggagagtgaggaaagcccagttcccggcctgtacactggcacgtggtgccacagtttgtcactggagtccttccccagctcaggcagcacagaaaggggagggctaggcaacttgagggtggagccaggacaagatggaatcctcacaccactccggctcctgagaggagaggaagccttccctcacttcagtctgcctgtgcctggagataaacctgcctgcctcttagtttctccacttgaataagtcctcatttctattgcttcagtgtatttgggggctgggagaaatgcaggaaggctgagcatggtgcatttcgcaaatggtgttaaaagacatgcaagagaaagtgtggggaacagtagctgtgttttggacccgtcttagacatcactggtgtctgtgtaatggtctccctcgggtgctgtcctgggatgcaaggtgtctacttctcatttgggagaagcattttgacattcagacagagccaagtgacagcaacacacaagtcctttctgaggcttagagcctagaaatttacaaagaagaaaggtaaagaaagaaattgatgggttcagcagcactgacttatcccaacgccaggttccaacaacctatcgtgtctaaatctgtacttccacagagtgatgggttccctgccctttcctctcatccagagcccagctgaaattcttttcagtggaatttatgccacttctcctttactctctcttcagtgaaaatagagaagaccaggagaaaggaagactaaaaagtaaagtgaaaaccgccttccaatagaatttggttgcagaaataatttccatgaaaaatggtcgggctgatattaggtctggagtcttaatgatggagtagtttccttttaatcatggtgctgtcttagaaatgcctgtctggaatgtgaccatgggcgggggttggtgtctggccactgcgtagtcggccttcggggaaagggtagccacaagatgttcccactcttctgtgagccctcaggaatttgaaaataagactcatgtgaaaacaggaacaacagcagcaacttcttgatgcagacagattcctttgttgaccatattctgaatgcatagctttagaaaagagacctcactgaccagcccggcagccagaggagttcccatttctgcaacaaactgcctctgaaacactcagactgaaaaagcaaaaatgatcttaagtggcataggaggattttagactggttagagggagaagttcctcagggggacgaattattgaatatctgtgtggctgttcttttattccaacatgattaactttgatgcttatcattccctatgggaatttaaggaaaagaaggctcataattgccagaatcttccatcctgtgtacatgcaaggctgagtaggaaatcagggcaaaggaattgatgaattgtctgtctctaaagatgaaaacaaagagggggcaacaactgtaagactaatgtgagactgtctgaatgtgaacagttatttcttgaatattcaaaaataaatctattttatttatttatttatttatttatttagagacagggtctttctctgttgcccaggctggagtacagtggcacaaacatagctcactgcagccttgaagtccctgactcaagcaatcctcccacctcatcctcctgagtagctgggactacaagtgcacaccaccatgcccagctaatttttctgtttttatttttttttagaaatggggtcttgctgtgttttctgctggtctcaaacacctggcctcaagtgatcctcccacattggcctcttaaaatgctgggattacaggcatgggccactgcacctggcccaaaagataaaagaattttaaacaaatgaaaagaagtattgctctgtagagtaagtgaaacatttatgaaatttgttttttctaagaccttgtagttattgaaaagtaatactgtaaaaacaaaaattcgcagaagggagtttcatagcaggtcaataagttcatggtcaggctcttaggctgctagcatagaaaatgtcagagcaggcagacacacaacaaaaaaagagaattttagaccaatatccctgatgaacattgatgcaaaaattctcagtaaaattctggcaaactgaatccagcagcacatcaaaaggcttatccaccaaaatcaagttggcttcatccctgggatgcaaggctggttcaacttacgcaaatcaataaacataatccatcatataaacagaaccaaagacaaaaaccacatgattatctcaatagatgcagaaaaggccttcgacaagattaaacagccttcatgctaaaaactttcaataaactaggtattgatgggacatatctcaaaataataagagctacttatgacaaacccacagccaatatcatactgaatgggcaaaaactggaagcattccctttgaaaactggtagaagacagggatgccctttctcactactcctattcaacatagtgttggaagttctggccagggcaatcaggcaagagaaagaaataaagggtattcaattaggaaaagaggaagtcaaattctccctgtttgcaggtgacatgactgtatatttaaaaacccccgttgtctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaattgcttcaaagagaataaaatacctaggaatccaacttacaagggatgtgaaggacctcttcaaggagaactacaaaccacttctcaacgaaataaaagaggacacaaacaaatggaagaacattccatgctcatggataggaagagtcaatattgtgaaaatggccatactgcccaaggtaatttatagattcaatgccatccccatcaagctaccaatgactttcttcacagaattggaaaagactactttaaagttcatatggaaccaaaaaagaggctgtatagccaagacaatcctaagccaaaagaacaaagctggaggcatcacactacctgacttcaaactatactacaaggctacagtaaccaaaacagcatggtactggtaccaaaacagagatacagaccaatggaacagaacagagccctcagaaataataccacacatctacaactgtctgatctttgacaaacctgacaaaaacaagcaatggggaaaggattccctatttatttaataaatggtgccgggaaaactggctagccatatgtggaaagctgaaactggatcccttccttacagcttatacaaaaattaattcaagatgaattaaaggcttaaatgttagacctaaaaccgcaaaaaccctagaagaaaacctaggcaataccattcaggacagaggcatgggcaaagacttcatgactaaaacaccaaaagcaatggcaacaaaagccaaaattgacaaatgggatctaattaaactaaagagcttctgtacagcaaaagaaactaccatcagagtgaacaggcaacctacagaatgggagaaaatttttacaatctacccacctgacaaagggctaatatccagaatctacaaagaacttaaacaaatttacaagaaaaaatcaaactcttcaacaagcgggcgaaggatatgaacagacacttctcaaaagaagacatttatgcatccaacagacacatgaaaaaatgctcatcatcactggtcatcagagaaatgcaaatcaatccacaatgagataccatctcacaccagttagaatggcgatcattaaaaagtcaggaaacgacatgtgctggagaggatgtggagaaataggaacacttttacactgttggtgggactgtaaactagttcaaccattgtggaagacagtgtggtgattcctcaaggatctagaactagaaatagcatttgacccaaccatcccattactgggcatatatccaaaggattataaatcatgctgctataaacacacacacgtacgtttattgcagcactattcacaatagcaaagacttggaaccagcccaaacgtccatcaatgatagactggattaagaaaatgtggcacatatacaccatgtaatactatgtagccataaaaaaggatgagttcatgtcctttgtagggacatggatgaagctggaaaccatcattctcagcaaactatcgcaaggacagaaaaccaaacaccacatgttctcactcataggtgggaattgaacaatgagaacacttggacacagggtggggaatatcacacactggggcctgtggtggggtgggggaatgggggagggatagcattaggagatatacctaatgtaaatgatgagttaatgggtgtagcacaccaacatggcacatgtatacatatgtaacaaacctgcacgttgtgtacatgtaccctagaacttaaagtataataaaaaaaaaaaagaaagaaagaaaatacaacaacaaccacaacaacaaaatgtcagagcattctctctagcatcagaaccagcgccctggcctaagtagctgggagtgggtggttagggtgtctggctggaatcacccataccagtctcttcctagtgcacctgctgctaccactgaggctggaaagcagattctttctggaatatccaatgtgctgggttctggaaggtgagaagcaaggcagttgtggagacttgggttttttgttttgttttgttttgttttttttcagcattatttgccaagctcccagggcacggccaccagcttgatcgggttgagactgctggggcaggcatccatctctagtactgaagtgaaggtgaggcccaactctgcatctgtgctggcagcttccaatcaaggcagcatggctttggaatcacacctgaccagagtttaaggaagcttcctctttaccaaaccaggtctatagtcacccagttttactgtgaagattcagcccagtgattctgcaagccatttaataaatccattttttttaactggctgaaccagttcagttctctacaactgatctctgactgcacaggggcctaacttattatatttgtagatattgtagtgctgcctgttctgtgtgtttcaggaaataggacaagtgctggagggtataggttgatgacttctggaggcttggcagggagctgtaagtgtggttttcaaactatgttctagagaacatggaagttctatattataaatactgcaatttcatgtaagatctcatttgaaaaatgagctgatgctaaactggtaaaaaatacaataaaataaaaccgatacacacaataaaaattaaataggccagtagtatgggggaaaaaaggagggagggagggagggaaggaaggaaggaaggaaggaaggaaggaaggaaggaaggaaggaaggaaggaaaattatgaggaaatttcaaaagaaagggagaaagagagagggagggagggaaggaaggaaatgaataaatgtcctttatactcagcaggagtctttaaatactttaatttgccaaaacattctcttagttttctcgcacttgatgtaatgaatgtcctgagaggtagttttttaaaaaccgagtcaatctttaagtaaaacatttcaggctaagaattaaccattgtaaggaatatgtcaaaaatttcttcagtatagtgaagcatgttttgtgatacaagcatccccccagtttgtcctttatcaactaggattttcatatatgaggcttgctgaaaaaaggcagcgttgtccaggtttcctcacttggctcccaattcacccataagaaagaatgttcttgtaaaagatcatgtggattcatgatgcatttgtgcttactttaaaaaacaaagttggtcagatatccttaggaatctcttgtgattaaaattcctgggttgaaactctagaagagatttctcaaactttgaagcaattgtttagttaatatggacctgagagattctatgccttttaccaaaaaaaatatatcttctaggattactttgcagatgggacataggtaaaaaagcatggcctgaagtgaggagaagatgtgatgaatgacaaaggtgtcaaccctcaggcaccattattttagagggactttcagtgatcagggactatgaggaggaaacagtcttagcagtgagagaggtcttagagaagatttaggttctcctgtttctttctttctttctttttttttttttttttttttttttttgtgagacggagttttgctcttgtcacccaggctggagtgcagtggtgtgatctcaactcactgcaacctccacctctggggttcagcaattcttgtgcttcagcctcctaagtagctgggattacaggcaacggccaacacacctggttaatttttgtatttttaataaagacaaggtttcactatgttggccaagctggtctcgaactcctgacctcaggtgatccacccacctcagcctcccaaagtgatgggattacaggtgtgagccaccacacttggcctaggttctcctgtttctctttcttcctttgcagccaggctgttgttaaacctggagtataagtcacctttttataaagttaacctaagacttttcagtgctgaagatggagctatagggttaagtaactggaaaggtaacatatttccaaagccatttcagaaaatcagtcttggcgttaagttagagtgaactattccattctctctctgctatacccattgataccccatcctaacccagacacctagctgattttgttttcctgatgcgaaaaatactctaattcaaaaatgaaccctccatcaagtttcaaagacaacacagaagaaagtaggcaagttttatctatgatttatacctttctaaatccaaattagatttgatctggcttcatcaaaaccaataaaaatatcaaagaaccattaaaataagaattaatacaagtagctgttgggtaaaatatgtgttccagaaaaattaagataaagatgatggctgtaattgcagttaatattagaatataagacaaaagaagaaatgtaaggcattattacatggattgcattgtttaagatgaggtttataccagctcattagaaaaaaaaaaagttttaaggcattatcttccaacaactcttatatcttaatgtttttgacatctgattatctactaagcagttatatatcacagttgttttatgaaatgttttccatgtggctatatctttaccataaaacttcaaaatccaacaacacagtattaagtcatgcagtgagaaggccataacttagaatctatagatttccagggatctaatttaatacatggaaaaagttgatgtagtcttgataattgctttagccctcagatggttggtccttggctattagttgtcttagcaggttgggtaacttcagctgaagaggaatatttgagaggcagatcattgttgaagacttgaatggcaaaagagagttagaaaagtcatttctcccacagtgacaaaattccaaaatttttaatatgttccaataataccagctactactctacactttccccgggaatgacattggaaatttatggattcagatgctgtacttttagatgttctgcaatggtttggttggaacaagagatgagacattaggaaatgttacctgaactgtgtatgaggaaaaagattttgtttatcagcctcttttgtttccctttgccatgaaaactctatctaaaatctgttcaccatgccttactgttttcataaatgcaaaatatattacacacattatttttttttaattaaaagtttctggctgagtcaattttttttgaaagctaattttcagatatgatcctttaggtttatttaactcgatacaagttccccacatttttagcaccggcttttaaagaacagtctaaaaaatgttagaaataaaattaagacgcaagccagttttatggcatacacccaagtagaacttcatccttggtgttctcatcctagcagtggcctccagaaggctgcccgctgatgtccagaaactgagatttagggcagtttctcatatttctggctcagtcgaggaacatgggaaggtacacgttctgcattgctggagggtagattatgtcttcttaggcagaggagttagtgaaaggtcctggtctactggcatccagatttcacaagttagctctgtggtatggatttgaaactaagcaggcccctgtctggagatgaggttctgtctggagcagggaggagccagactttccatccaggaaagctgctttcatgcaggacagcaggcgagagcccccaggcaccaccatgacgctcttcggtttcttgtgattctgagtcactctcttgggggctgttaagggaggaattgtgcctaccctctcccaaattcatatgttgaagtcctaactcctaatacttcagcatgtggctgtatttggaggtaggaacttcggagaggtgattatgttaaaatgaggtcataagtgtaggtcttaatccgatatgactggtgtccttacaagaagaacagatttggatatagacgtgtacagagagaagaccatgtgaagacataagaaaaagacagctatctacaagccagggagagaggcttcagaaggaacccacacagctgacaccttgatcaaaataactctgttgtttaagccccttagcacagccccacgtacttaattgtggcagcctgaacaaatgagtacggggactcctgtcttcttctttcgtcctgtctcctttgaggggaatgtcaggcttatgacagttgtcacaaacatattgtgtgtctttcttcaagacattaaaattgtgtttgtcaagctttccattcactttaatttgttttcatttcagcacatcagcttggtttcttagcattccaaggggaaagtttaaaacctttttgcatatagactccatttgcacggctacttttcttttcggcgattctcaagccccatcctcaaattcagcccgtggaagttgtttgacatctaactgagttaactgcatcctatcaagcgaagctcctattttcagcctgctgagtttggctactcaaaagttggttaatgtcattaaaaatgatattcccaccaacttttcatttgcagaatttgctaaggtgttaattggctttcagacatccctggctaaacatctccctataatataaagctaaacatgataaaaataaattacttgttttcccctctctttctgccccaagttttgcccactctcgggttttgttttgtttttttttaatctccattcatgtgtttattaagaatcgatttggtttctggcactgctaaaggtgccatgatgagttattttaaaaacatatacaatctggttcttgtatttaaggaattttcagtataactaaagacacatggtaactatgtaaggactgactttaaaatatccataaatcaaagacttcccggatgaagctctgattacacccagccaccccggactcctggctgttccagcagtctcgcccagcacctacatccctgccgctctctgctttgattcaccccacaaacgccagtttcccatacccacatctagacctctgcccatcagagagccctccactgggtaaaatattaatagcacccctgctgccggtctctgtctccttacctgctgcattctagtttcatgatgcttctttaacagaacagtgattctcagactttagcaggagacgtgttaaagcgcaggtttctagccctacctcctgagtttctgattcagtaggtctagggtgggacctcataatttgcatttctcacaatttcccaggtgacatggatgctgcaggtcaggggaccactgattgagggtgagacatgccctcagaaagaatgaaatggttatttcagtgaccaccatcaccacataagggcatgtgaatcagtccccagtggagaatagaaagttgtcattttacattggcaggaaaacatagaggcccttgcagggaggacctctcccccattctttgctgttcttatttttgatccctacttgatctctgaatcacctcatctgccacctctttcccctgctggacacccttagactcaacatctgacctccgccctgttgctccggtcttggagggtaatcttttcttatgcctttgtgccactctgcacatacatcccaagttacttcattcaaggatttcccacaccagtgtcctgcccttctcctgccccagggacactctggctccaaccatggtcagtttagcaaccagatgttgatatcattcatggtgtggacgaggcaaaggaccagtgcttaaggccagtgcacctgagaatgtccctggaaaagaaagttcccttggaacaagatgctctatgctttgattcagtaattggcctttcttgattctagggctaggcacgttcttgtgcttccatttggttcataaaaggaaccacataatgtaggagcctttttttaagagacagagtcctgctctgtcacccaggctggagttcggtggtgcagtcatagttctacagcctcaatctcctgggctcaagcaagcctcccacctcagcctctcaagtagctgggactataggtgtgtactatcaattacacttggctattttgttgttgttgttaattttgtagggacgggggtctcacgattagcccaggctggtctcaagcttcaggtggtcatctacctcagcctccaaaactgctggaattacaggcatgaaccaccaagcccagcctataggagccttcttaagagtaaaaactcaattaaaactacataccaatgccagcaatgattcttttaagaaatgcttaccggccaggcgtggtggctcacccctgtaatcacagcactttgggagactgaggtgggtggatcacctgaggtcaggagttcgagaccagcctggccaacatggtgaaaccctctctctactaaaaatacaaaaattagacaggtgtggtggcaggcacctgtaatcccaactagtcgggaggctgtggcaggagaatcacttgagcccgggaagcggaggttgcagagagcagagattgcgccattgcactccagcctgggcgacagagtgagactctgtctcaaaaaaaagagaaaaaagaaaaaaaatgctcaccaagtatctaccaggcaatcttaataaaacagccacaaacctctggcttctggagcttctgttctgttggaggaggcagctgataaagaaataaaatatataatagatggtataagtgctatggagaaaaataaagcaggagaagggatacagagagcgctgaagacatgaagatgggagagttgtaattttatgaaagatggacagggggagcctcactgagaaggcagccttcgagccatgacctggagcatgtgaagatgtaagccatgcagatatctgggggaagagagttccaggcagaggaacagtcaatgcaaaagcccgagaaagagcatgcctggagcattcaaggaacagcaaaaaggccactatgatcggaatgatgtcagaaaggtaacaggccaaatattggatggcttttgcaaaacaaacactctggctccactggcaacattggaaagagaatgtctgcttcattgcagaggtaggatcagtggcgccacttcagatttaaagactattctggctactgggtttggaacagactaaaggcagtgtggacaggagctgggagaccagttaggagtcttgcaataatccaggaagatgggagtgttagcagagtgagcagggaaaagaatctgggttctgtagatgctttgaaatgagattaaggttggtttctgccatccaggagtttgtgttctgatggagaaggcatagatgtaagaaactctttttttttttttttttttttgagacggagtctcactctgtcacccaggctggagtgcaatggtgccatcttggctcactgcaacctcatacctcctgggttcaagcaattctcctgtctacaggcatgcagcaccacacccggctaatttttgtatttttaatagagacaggatttcactatgttggccaggctggtctcgaactcctgacctcgcgatccacccggcttggcctcccaaagtgctgggattacaggcgtgaaccactgtgcctggctgatgtaagaaactcttaaccgaggatatgatgcaaacatcaccatagtagctaacatttgctaagcactcattctatgctaggcggtatctaacacaccaaccagcaaagccaagattggaacccaagcagccttgtctgtagaacctacatacttaaccactacaatgtacgaaaaagtaaaaacgacaaagatcttatctggataactgggagagtttttaatgaaaagtagcatttgatttgggttttgaaggatgactagaaattgacagtttgaaaagggggaaggtctcttatgagagcagtgactataataataagattccactaataaccatgtagtgatcacttgaacattccagcaatgaagctggagccacagaggtgtatttctctctacagcagttattccatcctatccagtgccattcacacctgtagctacagctgttcccacaaccccacccccaataaagagggcactgagtgtacccggaagcagccagtagagtaatcaggatcatctcatctgggttcctttacttaccttgtctgtgacattgggcaagttaatcaatctctgagccatttctgtaaatacctacctcacagagtacagttgacccttgaacaacacagggattaggggcgctgactccccatgcagttggaaattcacatatagcttttgactcccccaaaacttaactactaatagcctaccattgagcagaaggcttgccaataacataagtagtcaattaacacatattcgtatgttctatgtattctatactgtatttttaccataaagtaagctatagaaaagaaaatcttattaagataatcattaagagaaactactatttatttagtggaagtgggtcatcattaagctcttcatccccatcatcttcacattgaataaagctgaagaagaggaggaggggttggtcttgctgtctgaggggtagcagaagcaaaaggaaatccacatactgttaagaatggcaaatatccgacttattggtggcaaatatgtacaggtctgcagcaatctcaattcttgcctcctcagaagaaacaatttgactgaggggcctaaggcagaaaaagaaaccaaggcaagtttcagggcaggagtggaagtttgttagaaagctttagaacaggaaagaaaggaaagtacacttggaagagacccaagcaggcaccttggagctcaagtgtggcatttttatatatcgacatatttcaggggtcttgtgtcctttttcccatgattctttcctctggatgggccgcccgcatgcacagtgacctgctaacacttaagagttgagcgtgcacagtgtgtttactgcagttgtacacatgcccacctgaggcattcttcccttttccagtggcatgcccccagaagatcatgctttgccattttgtctctaaatgtgcaaaccaaagtctagtggcccaatttctgagctgccagttaccaatttcaagtgtttttatttatagggaaactgcctttccctggtactggctgcgaccaattattattttagagagaccattaacaactacctgaccatcacctgatggttgcctgactttcctggtagggttggagggagccctctcctgccccgctcatgcctgactagctgcctaccataataatagaagtggacccacacagctcaaactgtattgttcacaggtcaactgtagttgtacatagccagtgagatcatataggtcatgttcttaatacactgcctgatatatagtaagtactctgtaaattagctgatggtcatagcgatgaactgaggtttttttcttaatgtctattgcattctaaggtaggacattacaaatttcatttagaaatatttacatcataatggttaaaattaagacatttctcatttgtgacgtactcacttttaacttattctttttaccgatgatgttaactcaaacctcatctctttcccaattcaaaaaaatgctctatcattgtcctttcacatcgtgtttcatttgctaagttcatgagttattttataataattaacattttagattggtcagctgaattctgatagtctttattctcattggtaacatgtcactgagttatattttaggttatcttagatcccatctctaaattctaatggccactctgtgttgcactgttcttttcaattctgtctttcagttcctgggtccatcagatctaagaatgtgactgaggtattccagcatggagagagttaatgtgaggttgaatgtggataatgcttcagaaagagtccaaaaaatacagaaattatgctaataggaaagaatgagtatcagaagatttctagcaatatagcagcatgagggatcttagatgctaactgtaccccttgtcaccacaaacacgtagcgacccaggatgaaatataataataacaaaaaaataataataatacatggcaagtttgaaagcgatgaaaggaaatctccagattccaaaagtgaagaagaatatcaaagtggaaatcaccatggacatggatatttcagagatgggtaccatgtctttgaactaggactttgctacttaacatagcaacaggaaaatgaacagatagatggactaatcgcccctgcgtaaatagcctagaggttcaaataactgatcatttattttttaaaaatgggtagatagaactctaatcacatcccaggaaagcagcaaagaggtttgcctctgacctgagaattggggcagaaaaaaaaattatctgggagaaacaaaagccctagacaggaaccgtgcacagggatgaagcctggacttatactacctgacctgcattttggggacttcccacagtatatcagtcaggataggctagttaatgctgcagtaacaattcccaaatctcaacagcacttatcacaaccactgtttatttcttgcttaagttgcttgcccagtgcagcttggcaagaggtcctgcctgtcatagccacccagggtccccatgctgatggaagccccatctcaacatgtcacagaagcaggataaagggagcataacaaatcttggctcttaaagcttctgcaagaagtgatgctttggttaaaagaagccacagatccatgcttacctccaaaggggacaaggaagtgcaatccaacaatggacctggaatatttgtgaacaatactagagacaatcacaccaagcctatacattaacctaaaagtaatcaggatcattgaaatccctagtccagagtattcagctgaagagagaaatagtcaaccagaatataaatatgaggaaatctcacaatctgaggagagaaaacatgaaagaccaacttagagacaggatcaagcaaccagggccacctatgtctgagaggaattctggaagataaggctagaaaaaaattggggaaagacaatagtggatgagagaatagatgagaatttttctagaattgaagacaaacctgagacttaagattgaaaaataacacaaaattccaagcaagaaacatacacacacacacacacacacacacacacacacacacaggcccactttggagaaactgcaaaacatcaaagatcaaaagaaaattttaaaagcagctggagagaaatgacaggttacttacaaagaaaagaaaacttaataccagcatgcttttataagccaagaagtcagaaagcaagagtaatagcttcaaaatccaagggaaagaagttaccatcaaccaatatatatatatatatatatttttatccagcaaaattctttatttgagagtgagggcaaaaagagcctactttaagataaacaagattaggagtatttaccattcacagactcactgaaagtactattaccatatgtatttcacacaaaaatccttaatacattataagcaaatcagattcatcaaggtgtaaaagcaataatacatcacaaccaagcgaggtttattccaggtatgcacggctggttcaatatttgaaaatttataaagtaatccaccatatgaacaggctgaagaaggagaatcatatgatcatgttaattgacagttaaaaatatttgataaaatctaacaacaattcatgattaaaaaaacacaaaactcccagcaaactaggaatagaggtgaactttctcacttcataaagagcatctaccagaaacctacagccaacatcatactttccctctaagatagggaacagccaggagtgtctgatcttaccactcttaacataattctggacatggtagccactgcaataggcaggaaaaagaaataaaaggcatgtagtttgggaagtaagaaataaaactgtctctgtttgcagatgacattatctacataggaaatccaatgaatgcaccaaaacaactctcctagaagtaatgagtgagttcaagatcaacatacaaaatctattgcatttctatatactaagaatgagcaaatggaagccaaaataaaaaacacagtaccatttacagttgctccagagaacatgaaatacttaggtatacataaaacaaaacatgtatatgatctgtatgttgaaaattacaatatgctgttgaaagaagtcaaagacctaataactgaagagactattttcatagataggaagattcagccaaatgaagatgtcactgctctcccaaaagatctataggtttaaaaatattcctataaaaaccacagcaagttttttttgtaaacataaacaagcttgttctaaaatttatataaaaaggcaaacgagtggtcaggcgcagtgactcacgcctgtaatcccagcactttgggaggccaaggcgggcggatcacgaggtcaggaggtcgagaccatcctggctaacacggtgaaaccctgtctctactaaaaaatacacaaaaaattagccgggcgtattggtgggcgcctgtagtcccaactactcaggaggctgaggcagtagaatggcgtgaacccgggaggcggagcttgcagtgagccgagatcgcgccactgcactccagcctgggtgacaaggcaagactccctctcaaaaaaacaaaaaacaaaacaaaaaaaaaaaaaaggcaaaggagtttgaatagctaaaactattttgacaaagaaaaatgaagtgggaggaattattccaccagatttttaggctgcttatagagctacaacaatcaggactttgtagtattggcagacacataggtcaatgaaacagaataaagaacccaaaatagaaccacccaaatacgcccacttggtcttttacaaaatttaagagttctttatatattctagatactggtccttcatcaaatgtggtttacaaatatttcctttcagtctgtagcttgtcttttcatcctctgaaggagatccagtctgggcacgatggctcatgcctgtaatcccagcactttgggaggctgatgtgggaggatcacttgaggtcaggagttggagaccagcctggccaagtgaaaaagcaattcaatggaggaacaatagcttttttagcatatggtactgaagaaatgggatctcccctcaaaaacttcaacctgagtctcacacttaatacaaaaaaaactcaaaatagatcataaacttgaatgtaaaatggaaaaccatacaacttttagataaaaagcagaaggtattattcaggaactgtagcattgtgaagatttcttagacgtgacagcagaaacatgttccataaaaggaaaagttgataattggatcttattttattctatttatttattattattattattttgttttgacacaaagttttgctcttgttgcccaggctggagtgcaatggtgcaatctcagctcactgcaacctctgccacccgggttcgagcaattcttctgcctcagcctcctgaatagctgggattacagacatgtgccaccacaccttgctaatttttgtatttttagtagagacggggtttcaccatcttggccaggctgttctcgaactcctgacctcaagtgatcctcccgcctcagcctcccaaagtgctgggattacaggcatgagccatcttgcccagcctggatctccttaacaggatggaaagacaagctacagactgagaggaaatatttgtaaaccacatctgatgaaggaccagtatctagaatatataaagaactcttaaaactcaatagtgaaaaatcaagcaatccaattagaaattggatgaactacagaaagagacatttcactaaagaggaggtacagatggtaaataagcacatgaaaagatgttcaacatcattagcctttagaaaaatgcaaattaaaaccacagtgaggtagcactacccatgcatcagtatagttcaaataaaaaaaatagagataacacccaatgcgggcagagattcagagaaactggatcacttatacattgctggtggaaatgtaaaatggaatagccacgctagaaagtagttttgcagttccttttattcattttttattttttgagacagggtctccctctgttgcccaggttggagtacagcggcgtaatcacagttccaccatagcccccatctcccaggctcaggtgatcctcccacctcaacttcctgactagctgggactaaaggagcacgccaccatgcccagctaattttttgtatttattttagacacagggtttcaccatgctacgcaggctggtctcgaactctggggtcaagcgaggagcctcccgctttggcctcccaaagtgctgagattaaggcatgagccactgagcccacccctacagttccttttaaaactaaaagtgggccgggtgcggtggcttatgcctgtaatctcagcactctgggaggccaaggtgggcacatcacaaggtcgggagatggagaccctcctggccaacatggtgaaaccctgtctctactaaaaatacaaaaatcagccaggcatggtggtgtgtgcctataatcccagctactcgggaggctgagacaggagaatctcttgaacccgggaggcagaggttgcagtgagctgagatcacaccactgcactccagggtgggcaacagaatgagactctgtctcaaaaaaaaaaaaaaaaaaaaaaaaaaactgaaaatggacttgccatgggacccagcaactgcagtcttttgcatttatctcagacaaatgaaaactgttttcacccagaaacttgtacatgaatattactagcagctttgtttgtaagagccaaaagctagaaactacccacatgtctgtccttcagtgggtgaatagttcaactacgatacatgcataccatggaatactactctgcaacaagggacaaactgtcgatacacaatgacttggatttatgctcagtgaggaaaaaagaaaaaagccagtctctaaagtttacatactgtaccattccactgatacaaaacattgttgagataaaattatagagatgcagaacggattagtagatgccagggactggggatgtaggtgggagagaggagtttgaatacagaggggtagcacttgggggcctagttatgatggtacaattatcttaattgtgttagtagttacacacagctatacatgtgataaaatcgtatagagcaacataaaattaataacaaatacatacacacatacaaatacatgtgtatgtgtatcaacctgaataagctctgtgggttgcagcaatgccagtgacccagttttgttattgccctatagttatataattgggggagggagggcaaagagtgcctgcgacctccctgtacatttctttgcaactttcttattataatttttttcaaaataaaaatacatatacttctctaagaaggataataaacctagaaggaaaaactgaaatgtgagaagtaatggtgagaaaataaattagtaaacatgtttttggaaaacctaaatgagcataaatcctaataaatcatgtaagggggttaaaagtaaggcaaaataaaaatacctggcagaaacaataaaagaccagagagagtgatcagaatgaaagcatcctaaaagtcctcctattttctagaaggagactgatagccatatacttgaaatatttttatgattaaaaggcagaatggtatctaaacctacgatgctattttgatatgaggtgtcatttactgagcatctgccctgtgtctggaaacctgctaacatcacagtctctattataattctgaaaggaagtagctttttcctctttttattgaagagaaacaaatgccaaacagggggtgaataaagtacaagttagagcggtaagtggtaaagtcaatatttgaacccagggctctctatctcctaagcatatgtgcttttaacctccctgtcccctcttgagcataatgaatatggaaataatgcattttctaaaaggaatgctgcagtgttttgaaggtgaagtagtcttacattttatagaatgaaatatgaaatcatctccaaactatgggcacaacagaaagctttcctatcttccctttttatttgatttcattgaccaaagtgtggacaaaactgattacaaaatagaaggctttcacatcttccctttcctttcatatcagctccaaacagtcattgtgaagccatgtgtcccaggaacccatcattcaatgagttgtgctacttggaagaatgacgagcaacaattcacattcagatttggtgttttcttcatcaagctataagcatagaaatgaaatttttgacattgtcccatatggatgagaaaagaaaaagtggtattttgaagatcaaagaaaaccacaaatctatggatgtcctatatgtaaatcttgtttctgtttctcctgatgctaaaatgttgaattctaaatatgcaaaggtacattcacacacaaacacacacacacacacacacacacacaccatacaggatgaacacacacattgctaatgggtcctagaaaaaggtgctagggcttagttgcacatgtttgttgacaggttaaaataaaagaaacctgaacacgcccctctgggtctatcagtctttttctccttttagctaaagctctccagtttatacaattgaaaagagggagtacttttatcttacctgaaacattatgcagccaaagcttctatttactgactcataaaggattttatgcctcatctgttgtacttaagatgactatagagaatataccagaaaaaagatttgaaatgtgttgccttctgaagttagaattataatcaggtgtattattgaacaatcctactttccttaatgtgtacagatttcagcattggcaggaagtattgaagtaaacccaaacacagcattaagcaaaatgtagcctcaaactctaaaaacatgtacaattgccactcctctgtgtgaagacttcagaatgattttgcccaactctttcataatagtttcatctgatgaaacaacaaaagcacctgtcactgggtgagcgcagagccttctataaaaacatcaggaacattctgatcccagaactaccatcgcagctctgtcatggaataagccagagagaccctgggcagatctcttctcctttctagaccttaattttctccatctataaaatcctgacacatttcccaagaagtctgagaggaagattggctttatagaaatggttctgaacagcaggatgtctcgtagcaatgtttaatcgttggtgatgataacatgggagactatttactttgtgtccttgatgaagatacgtgtgtgtgtgtgtgtgtgtgtgtgtgtgcgtgcgtgtgcgtgcgcgtgcgcatgtgatgaagtctcactctgttgccccggctggagtataatagtaccatcatagctcactgaagcttcaaaatcctgggttcaagcaatcctcctgcctcagcctcccaagtagctgggaccagagattcacaccatcaagctcaactgattttttcatttctatttttattttttgtagagatgggttctgattttgttgcccaggctggtttcaaactcctggcctcaagtgatccccccacctcagcctcctaaaatcttagaatgatagggtgtgagcccccacgcccagccaatagctattctttcaccaagataaaaccaaaggcaaagtatcagaaagaagaaactcatcaaaacgaaggcagacatggccataatattctaaaatgttcatgtcccattccattttagagttagtgttttcgaaagcgtgaccttgatggcagtccttaactgccattcctatggccatggtcatgaagagtggcctggtagccccaccttatccaggcggacccgtgaaaagcgtccacttgtatattggtttgtcgtgttcttaacaaaaaaataaagaggtttctgaattttttggtttaagaccctaagttttacatgaatggccaatataacatatttctcaattttgttattggtctaggttcatcttgagcaaaatattatttatatattaattttgagaggtcatatagcatgtggttaacagcatagactctaaagccagacagcctgggatcatgtcccagctccatcatctgccattgtgtgatgctggtcaaatcatccaactactctttgctccagtttcctcatcagtaaatggatataaaaataggacctacttcatagtattgctgtgaggattacattagttaattgtgcagtatagtgcctgaaccataacaaacacttcataagttgggggtatttttgtttttaagcatttcataaaaccaatgtgggaaaataaatcatgagctatcaacccaccctccgaatgtatatagatcctgaccacttcttacatcccctactcctaatccaccaccacctcttgctgggacttgtgcagtagccacctaactggttcccctcttatcacgagcagtctccacagggcaacccaagtagttgttccaactcctgagtcacatcacacctttcctctattcaatatactgcgtggcccatcatttcattcagaataaaagagtacaagccttggctcatcccctgccaccctcctctcacctctctgctccaattcctggcatcttggcagcttctttaataacctagtttattggcaacaacctcaaggcctttgtactttctgttcttttttgcctgatatgttcttctcctagatgtctgtgggagagtggcttctccctcatcaatctttattcaaacaccatcttatctgaagaagggctctctggccacaatctctgaaatatcctttccttccctgttaaatttatctctaacctgccttatttccctatagaggactaatagccacctgatatagtatacgctcattcttaaactgacatatgacctgtctcttgctaaccagcatcggtggtccatgacagcaactatcttgttttgttcactgctgttttacaagctcctagtatggtgcctgcacatagtagatgctcaataaatatgtgttgcattagttaatgaactggcgtggatgatacagtagtttatattggactttcgaagcacttttacatacacagtcttatttgatccttggaaataagaatcacagggggacagattttttttcttgcccctacacctacaaagattggctcagatcccaaaggggcttccattttttccaaaaccaagtaccctgacaccactttacttttgtacttatgtcaaatattactattttatttgactgagtttaagttgcatcatttaatgtactcttgagataagcaacagcatggatgtatctcaagataatgatgcagaatgaaagaagccagaccaaaagagtatatactgtctgatttcatttcttcaaaattctagggaatgcaaattaatttatagtgacagaaagcagatcagtaattgctcaggggctggaggaagggattacaaatggcccaaaggaacattttagggtgatgcagatagtcattatcttcattttggtgatcgtttcataagtatatccatatatcaaaacttaccaaattgtacactttagatgtgtgcagttttttaaaattttttatttccataggtttctggggaacaggtagtatttggttacatgagtaagttctttaatggtgacttgtgagattttcgtgcacccatcacctgagccatttcactgaacccaatttgcagtcttttattccctcacccctctcccaccctttcccctgagtccccagagtccactctatcattcttatgcctttaagtcctcatagctcagctcccatttatgagtgagagcatacgatgtttggttttccattcctgagttacttcacttagaataatagtatccagtgccatccaggttgctgcaaatgccattaatttcttcctttttatgtgatattccatcatatatatatcacaatttcttttcttttcttttctttttcttttttctttttttttttttttttgagacagggtctcattctgtcgcccaggctgaagtacagtggtgtgatcttgactcactgtaacctccgcctcccgggttcaagcgattctcctgcctcagcctcctgagtagctgcaattacaggcacccgccaccacgcccagctaattttgtatttttagtagagacagggtttcaccatgttggccaggctggtctcgaactcccaacctcaggcaatccgcccgccttggcctcccaaagtgctgggattacaggtgtgagtcaccatgcctggcctataccacagtttctttatccattcattgattgatgggcatttatgtaatttattgtacattattttgcctaataaaactgttttgaaaacagagagataccttgcccaaggtcacacacatttttctgcaaatcttgactgcagtccatgtctgtggattcctggtatgtccttctgcttcctgtgttgcttaccaggtgggtaatgaggctcagggttttaacagtaatgatacccatttacaataacatttatttatgtattgctctgtgctgaaaggagaactttgattttacactttgaaggtgttctctatcacttttctaaggctctatctcttaaatttagtgaaaatcaagtagccaacattgattggatagtatttgaggaactgcaggttaatagcacttttatatgaacaaattgagagaatttaaatgatttgaccgaggtcatcaagaacagcagctttggcacaggaattagaaactggattgcccttgcattttgtttttcagcataaaagctacatttctgttctctccattctttatgggcaaattgtaactctttttccccccaaagtacctaaaataatctgtttctcacagtccttcgtgcgtgtcttctttttctcgcttgtgaataaggtgtactaaatgcctcccagcacacacaggactcagtgttatgttctttttttcctctcaattcaccgtgtaagagaggcaccacctattaaaaacaatatccacagacctgaagtcagcaaagatatcagaatgtactgtgcatgtcagattagggctgaaattccaactatagtgtttaaatggggactcattttaattaataaatttggtcctgacatgcaattgctcttcacttgatcaatattttgctattcagttggacaggtttttttttaatttactgctgtgtgtgactgagttcctacttaatattcattgacacaaaaggattcaaagagaagtcagcctaactctcaagtaaacagaatagaacagatatacatgtgttttgcaattgcaaggaaggtatactaattttgagatacttgagatttggggctttaaaaataattaatggatctttatagttcagctttacatttattggtttatcccttttattgtacttacattcccaagacccttggttgattattttacaattgtgattttaaatgcattttgatactaactgctacttacaggatatacttggtgaattctttcacatattaacattactctctggtttatctattatgagaaagtgtgtgtttgtgtatgcatgtgtgtgtgtacatatacacacagatatataaattttcttaaattgagacatccttttctattatatttgcaagtatcactaaagaatctgagtcacacctattctggcagagagaaagaaaacaacggaaaattaaagctccaacatgacttttttttttcattcgtgtcatggctctcatctaattgaacactagtatgtttccttgggtcttgctgtaaacattgaaaacttttagttttctttggattttggagactagatacgatcagtaggaaatcgctaatgggaattgatgcttttgattccagccaagcataccaccgaggtcacagaggtaacatccaactcgtacacaaaacatgccttataaaactagagcatcgccgagggtgggttagtaacatctgcagaggaacagccctacctgtgctgccagaatcatcagtgtaaccaaaagttgttgtgtttgcagaattctaaaagaaagatcccgtgtgatttttatgtttgttataattttccattaagattgtgagaatatcacaaaaatgtttggtccaaaaaaaaaaaagagaagaaatctgaatcttctaaaaatatttctattattactggtggcattcgagccatgtctcatctgacttgcttgtcagtcttcagcaatcatttgggactatttcgagattggatgacctcatgtttcagctttaatgccacattccccctcaagctactggcctatgttgacaaaatgactagatgactagaaagggattatctaaaagcactgtttccagttcttctcctgtcatttctcttggacccatccattgatgccttcaatccctccactccacagaactcgggtccaggtcacagatgattccatgggttaaccagtgcttgcttctcttgactgccaacacatcacatggtagaccatgtcccatccttaagacacacccgtctcttggcttcctggacatctcttccatctcacaagcttccttatgacctcactggctggtcctcctgggtctcctttgttggttgcatctcattttctcatccatagacactggcttctgccctagacctcattgcttctctatattcatgccatcggtgtgaatggatcctgccgcatggtgccaaatatcagctataggatgatgaccgctgtagcctggatgtgtcctctgaaatacagattaatagttcagatcatctacttgacatctcaacctcaacaagtccaaaaaatgaacttcttatttcctccaataaaactatctcctcccacagttttccccatctcaataaattgtaaccctgttatgctagttgctctcaacaaaaccctttgcatctttactcatctttcgatctcatttcatatctaatctgatgagaaatctcattcactcttcttccaaaatatatgcacaaatccagccacttctcaccatctctatctaaccctgcactcaggtccaacccaccataatcactttcctggattattgccttaactcctggtggtctcttgagtttagtccttgtcccttgtagttaattctttttgagatggactctcgctctgtcacccaggctggagtgcagtggcatgatctcagctcactgcaacctccacctcctgggtttaagtgattctcctgtctcagcctcccgagtagctgggactacaggcccagctaatttttgtatttttagtagagacagggtttcaccatattggtcaggctggtctcctactcctgacctcaggtgatccacctgccttggcttcccaaagtgctaggattacaggcatgagccaccacgcccagccccgtagttaatttttaacagagcagccctagccattgacctcatcttgtcacacctctgctcataatcctctgttgccttgcagctcaatcaagagcacaagggcctccaccatgtgatcacctaccacctttctaacctcttctcattccatttctcatctcactcatttccctccaaacacagtagctctctgctgtttctggagcacatccagcatacttttgtctcaagaaaacttgcttttccctttgcctccttcccccagatatctacaagtctcgcttccacacttcttccaaatatcttcacatcagcaggatgtgcaactactatgaataaaatagcaatccgcccacttccaccccactgctctctagtccccacaccctgttttgtctttttccctgtgtcttggcacactctacacttacttgtttatgagtttagtgtctatctacatcaatagaagctatgatctctgagcttaccatcgtatcccctccttttagaagactgaggtacatggtggtattcaaaaaatatttctagagtaaatgaaatccatcttttaccatacccattttgtttaagtgtgaagtttaatgcaatactgtttctctgtaaatctaaaacagtcctaagtttcatcaacagttctctattcctaaagaatttatttaaggatcaagataatagtccagtctgctttgctttagttgttcctccttgcataagtatgccacataggttgaattatcttgtcctgtggaaaggggacacagactattatcctcccttttgttatgcttgttatataagcataatgtttacatatgagctgaattgctactatagaaggtaaagctgacagaatgcacagatgctggtaagggaagcagattccttccacctggggtaggtgctcaacttgtttaatgcatgttatgattggggtagctcagtatgatgactttgcttgataagttcctcaggtaacaaagcagatgggagggggtacttatagggttgattgcttttttcccagtgccttgagttggaaagccaacaattgtcgttttgatcatgaggcatttagggggacttctacctctgtatgtaatggggagagaaaggtgatttatggtgaatctggaagcaggagttgtattttacaggtggtgatgggaagatctggggacatggacccatcggaggatgggcaccttgtccttgcggactcgccccacccaccactctcagagctgttcaaatggggccctgcatggtttcgccaccctcagacatttgttctttattgtgtgatcttgtggttgagaacagaagtgactcttaaaaggcagcgccagaacttcaaaaggaaatgtctaggaggaagtagccatgtgtgatgcctcttaaatgcctctttagaaggtatcagaggagaacaaaagataaaggtacaaccaaaaagtcttctggagttttttaagggcggattggaaagctaggtttgtgaagcccagccttggagatttaagtcatgggaatgactgtccccaagatggctgctcttaaagtccctgcatggttggaggcccggcagtctggagcagcatggtagcctgatctctctctttttttttttttttttttttgagatagagtctttctgttgtcacccaggttggagcacagtggagtgatctcggctcactacaacctccacctcccaggttcaagcgattctcctgcctcagcctcctgaatagctgggattataggcacctgccaccatgcccggttaatttttgtagttttagtagagacaggatttcaccttgttggccaggctggtctcgaactcctgacctcaggtaatccacccaccttggtctcccaaagtgctgggattacagtcatgagccaccacacccagccacttgatatcttgttaccctccttgcacctgtacttccactagcagtgactcttctttcccacttgctcttggggaaaaaaaaaagcatataaagatacactttacagactttacaaacattagataagccttacaaacacattgtaaaaacccccttccctaccagaacacaagccaccaaatgacctagatctgaacatgaggccaacagatcggtctcaacccccttccgcctttgcttgagactcacacactcttgcacactcacacacaagactgtgatctgagcactcatccccagccttagagaattgggcccttttcagtgccatctctctggaccctcaaaagcagtagctccctcaggaacccctttattgctctggccagggctgagagaaggacattccagttctcccacaggggcagggtgtgtaaaggcagaagacacagacaaggctgccagcagatccacaccctgtggcgtgggcctgaggacgtgggaggagctgtgctgggaacagcagggagacccagggaggggagtgggcagagagccagggactagcctaggaagggatgatccggctggctgctggcttcaggctgcagtcaggctggatttgcctgagagtgtccccagggcagctgtaccctgttacaagggaggaaacttttctaacagccctaggaaagcctattgaaagctttcagtagtgaaccagagactgaacaaataacgacgtaattattacataacagtaacaggaaaactttagagcgtaaatggtaacaaaagttgttccccaatatataaactttggataccctaaaagcagctcagcgtgactcagtttttgctactagcataaaaccaaaaataatcagatccctgcagaagtagagggtactcaggtatccacctccatagcactacttaagaaataaaaataaaataacctgttcatagagtggacagcacaacttgaatgccaaaaggcagagaaggttctgttcctggctttgatgctgacgcttgggaaacaccccttgtctttctgcatcacacacaagcctgcctggggcaagaatccagaggcttgtatatgcccatgtctaaatatttttaaaggtataaatcaagctaacaaactattagataaaatgtgttctatcctcatactttgacaaatttaccttcacgatgaccgaggatgccagatttgattttagacttctctgagccctcacagttgtgggctggatcatgtgatcaggaagggtcccccccacatcccagcctgcagcaagccatcttccctcctcttcatcctccctccagctcccttccgctttgcaaggaggctcaggcacacgtgagtgattttcctcaactacacgggcaggttccctccatgtgccctgcaaacagcattctttggtcacccctcagtgtgaggggtgcatacaccaatgtcaggcaaggattacgggacaaggactcccttcccagactcctcctccattccacagtttgacccttattccttcaggacttatacccctaatccctgtacttccatcaagtcagtcacaaggatttagggaagctgatcatttctatgagagctggcaatggatggattaggttcctttatgttttcaggtcacgtaagagatacagcgagtcttttgttttttttaagagctccaagatgaaggccagcgtgatatgaatttcctcaaactgcccacacagtctttctccccaccctctggggaaaaaaatctgagcctccccctcagatacctaagaagaagctgagaaaaatctgcccagaagaggaacagctgctgagagcctgcctcaccctccctggctggccgtatttccaactttgttgccttcttcagtagatctggggaacaaaaaagcaaggcgtgaaatttgagtgttcccaagtctctctccatagctgcccgtgagcagtgttaccttttgattgaggcactcacgcttgagggccacatgaataaatgcacgcctaagtgtgagggtggcaaagaccaatcattcacagactgatgggaattgtttccctaaaatattcccctgagctgctagaaagggggtgatttccacgagagcatagactgatgcggactagaattgctaggacagggaacccccgtggacggctggccattgagacacagtggagaggaaggagaccatggtgtgaagtctacgaatgagagtgaggaaaaggaagaggtgggaagaagtggtacccaaggataaggctttatggaatctaagcatcccacatttactgtttttaaaaatgagcttgaaaaattagggtgtccgtcctgtgaaatggaatcccacagccacagatctgctaacatttgtttatatttgttgtcaaagaatagcttgatttttttttttttggttattaacataacttaagtggaataaaagtataaaggagcaagcaccatggttttctgtcatctcctctcctcttttcttttttcttttctgagacagagtgttgctctgtcacccaggctggagtgcagtggtacaatcatagctcactgcagccttgatctcctgggctcccgggtcctcctgcctcagcctccgtagtagctgggactacaggcatctgccaccaccaataaaaaaaaaatgctgctttttttttattttttgtagagatcatctcatcatattattcaggccggtcttaaactcctagcttcaaacgatcctcctcccttcttgtcctcccaaagtgctgggaatactggtgtgagccattgcgcccagccaacactgtttcctttccacttggaaagtagtttatcctggaaattcctgggatcccgacttttgtttaccagagtggaaaagctaatcaagttgatacttccccagtatctttctcccccaacttgaggaccaaacaggttgtgccttttcaaaaagaataattttttcccaatagtagaaaataaatcttgaacaataaaatttatacacttcacattgatgctttttaaatctacacgcaaattacataaaaaatagcacttcatgctgaaaactttctaaagatatattcactcctctgtaataactactggttatcactacgtaaaataccaatactttagcacacaagaaaaattttagattaactcaggcagtttctcactaaagtccataatctctgcgcctaaatctgctaatcactgtaattgaagaaaatgcaggaagtataaatctcctagggggcagtgtttgtaaccctttttaaaaagaaattacacccagagtctttttgatagtttgaaaacatgcactggaaactgttgcatatccctaaaaggccaacttttttttttttcctggggccatgattatttaacttttacatttttgttcttatctttaagaaaatctctgctgggtgcggtggctcacgcctgtaatcccagcaatttgggaggccgaggcaggcggattacctaaggtcaggagtttgagaccatcctggccaacatggtgaaaccctgtctctactaaaaatacaaaaattagctgagtgtggtggcaagtgcctgtaatcccagttactcgggtagctgaggtaagagaatcgcttgaacccaggaggcagaggttgcagtgatcacaccactgctctccaggctgggtggcaacagagcaagactcgtctccaaaaaaaaaaaaaaaaaagaaagaaaatctcattctttctgacctttgctctttgctttctataaccactcatcagaagctaagggccataactacatccagatttggcctcctgagtcagatctgagtgctctgtgggaggggaactattaagacagctctcttttgtcacttttaaaatgatttttctttaattttttgaatggaaaaaatacagaaaacataatatagtaataccataaacagatgttagtgtctgtttaatgtctgagaggcagaatggtacagtggtgaagacaattagctaggtaagtcacacaacttacttctctctgcctcagtggtcctcatctgtgagatggggataatagtagtgacctcatacagaagattaaatgaattaatatgtggaagagtttggatcagtgcctggcacatagcaaatgctatataggtttttgtcagattttaaagagaaaaacatgtttccataattgcttgagccctcttacacttttaaagtaaaatattgtaaaacccctgcactttctttccccatcctttgccagagctaaccacatgctggagttggagagtgtaactaccatgcacattttgggcttccactatgctcacaatgtatattattgttttgtgtgttataaagctttacttaaataggatcatactgcacgtatccttttataagtttcggtgttcactcagcattatgtttttgagattcatccatattgacagagatggttctagttcataatttgttaccgctgttaactgttccaatgtatcaataacccactgagaacaagcagatgacaaacggtgctacaatgagctccatggaacaagtgtccacatgtgagattttctctgcgatggtcagcttaaaagacgtagctaggtatgggaggcacctcttcaacttcatggatagggttcaatagtgattatgcaaatttacactctcaccagcagtaaataacaggctgtattttcccacatcctcaccagtacttgaggctgttatattttctgacttttctctatgtgacgagaataaaataggatgtgacatttttcatttttatgtccataattactaatttattggccactggagtttccctctcattgaattgcctatttatatccatttttggatatccattattgtctattttcttattgctttataaatgttctttaattattctgaatgcaaatccttggtagagcatgtgagttgtaaatatcttctctctgtggtttgtcttcattactttgtttgtaatgtcttttgtagttcaaaatcctcatttcaatgcagtttaattaggtaatattttccagcatagtttatgatctttgtttctttttaaagtccttccctgtaccaatacactgggagacaacaccatgtggtgtttttagttttttgtttatgcgaagttttagagttgagcttctcacatgtatgtctttggtccatcaggaattgcttttacttatggtgtaagaaagggatgtattttttactttttccatatggaaaaccaattttcccgacactatttattgaatagtcatttctctatgggtttgtatgacctcttctgtcatatatcaagctctcacaaagtctgtgtctttgtctaggctctctgtttcattgcgtagtcttgtttgtcctatccgtgtgccaagccacactggcttaatagtgctgatacctggtggagcaagtaccccctcttattattattcctcaaaattgccagattgatgttataagtggttttgtttgtttgtttgtttgtttgttttgttttgaggtggagtcttgctctgtcacccaggctggagtgcaatggtgtgatcttggctcgttgccacctcatgcctcctgggtttaagcaattctcctgcctcagcctcccaaggagctgagactacaggcctatgccaccacacccagctaatttttgtgttttcagtagagacagggttttaccatgttggtcaggctggtctcaagctacggacctcaggtgatccacccacctcagccttccagagtgctgggattacagacgtgaaccatcatgcctggctgtaagtggtatatttttattaaactgtattctctattttttctagtatttcaggttgctgtcaatcctatatattgatcctgtatcattcagttatattgaatagttataatagtgtatctgcagatttccttacattattatattgtctatgaacaagtaccattttggctatctctttttaatccatattgcctttatttctttttcttatattcaccatgctagtgagttcttaggatgcagtgacagcaaaaattccaaattttaaaacaatccttctaacatttcatcactgagcctgatacttgtttgaggtttttgctaaacataagaacattctttttaatttttaaattactggtttttaaaaaagttatgaatgtgtgttggatttttcttaacatttagctgactctgttaagataagtgtatagtttttttatttatattgcagaaaattttagggctggactgtctaatgtgaaaccagccttacattcctgagataaattattttggatcatgatgtgtttgttcatatattgctgtatttgctttactaatattttatttagggctttggatttgaatgtaaaatcccttcttattctatgtcttcgtctgttctcatgctgctaataaagacatacctgagactgggtaattgatcaagaaaagaagtttaatggactcacagttccacatggctggggaggcctcataatcatggcagaaggcaaatgaggagtaaagtcacatcttacatggtggcaggcaaagagagagcttgtgtaggggaactcccttttataaaaccatcacctcatgagacttattcactatcacaagaacagcatgggaaagacccacccccatgattcagttacctcccaccaggtccctcctatgatatgtgggaattatgggagctacaattcaagataagatttggctggggacatagccaaaccatatcattctctctttctaatatcaaggtttatactagccttataacattaattgatattataatatttgatttaaaccacagctcatcttaagtgttagaattcagatacagttatagcatattcgtaattagaatagtgttcctcacagcattttcttataatattttctcccttaattgttgagtaacctttgagatgaaaatgaggactcaactgatgttgctacaagttctgttgtgactttacattatagcttcttcatggacaagtttctaaatatccatgcaaagggacaagaagacctatttggaaggaccaggaggatcacagcactggaaatcagcatctttcactcagtctgaattccagaaatcatcaattgattctttcagccattgtttagagaaatgccttgggatgctcatttcaatgatattaacattttacttgaatcccaattgcaccaatttgtctgaaacaaaacaaagttaaaggggtaagccccagggctttctgtggagaatgagtgcctccaagcagaactctgcccagtgactgccctctgtcaggtggttatggggggcaagacactctctcatattacttcctatagatttaactttttttttttttttttttttgagacagagtctcgctctattgcccaggctggagtgcagtggcaccatcttggctcactgcaagttctgcctcctgggctcacaccattctcccacctaagcctccagagtagttgggactacaggcacccaccaccacacccagctaattttgtttttgtatttttagtagagatgggagagatggggtttcactgtgttagtcaggatggtctcgatctcctgacctcgtgatccacctgccgtggcctcccaaggtgctgggattacaggtgtgagccactgcccctggcctagatttaacttttaacatgttctttcagggtgctaacataggtttcctcacacttatgagtctttaaagcactttttttttttttgagtcagagactcagtttgtcgcccaggctggagtgcagtggcacaatctcggctcattgcagccactgccttctgagttcaagtgattctcctgcctcaaattcccaggtagctggaattacaggcgcacaccaccacgcccagataatttttgtttttttgttttgtttttttgagagggagtcttgctctgtcgcccaggctgaagtgcagtggcaccatctcggctcactgcaacctctgcctcccaggttcacgtgattctcctgccttagcctcccaagtagctgggactacaggcatgcaccaccacacccagctaatttttgtatttttagtagagtcgaggtttcaccatgttggccaggatggtctcaatctcttgacctagtgatctgcccacctcagttttagtagaaatagggtttcaccgtgttgcccaggttggtctcaaattcctaacctcaagtgatccacccaccttggcctccgaaagttctgggattacaggcatgagccacagcacccggccaagggcacattcaaaattggaatttagcttaaaattattattgcctggaatttctcagtccttcataaagattcgtctagagactctcaaagtcttacattgtcctcaagtatcaggtcactaagtgaaataaaaaaataattgacagatagatccttcttgaatacagcaaaaatttggtatttacccaattcaagataaaaacagtgaaatccaagagtaaagttattccaaattttttttttttttaaatccagactttctgcggagaatgaattttctattatctttttcttctttgcaaggcaattgtcatcattctgctttgtcacctactttaaaagctatcctataggaagggacttaacagcgggagagttctctctgggatttgagaagttactgacatcagaaggtatcctagagccatttgaggaacacacacacccttgttcaaatcgctgctgtgtttgaaacaaaatgtcagctggtgttaggtaagaattgctaacttctaaagaatagtgtcatttatagaaccactgcaggggttagaacacagaggatgaccagaaaacacctccaagaagaaagagattgagtgagacttttttgattgcttttgtactcccgagttcctggcacaggcctggcacaagatgggaacttgtctagtgaattaatgaagccatttctaccgttgcctctagggtacctctaagtacgttatattctttgtgggtgttgtttttctgttctgttttttgtttttgtttttgctttttttgagacggagtctcactctgtcgccaggctggagtgcagtggcatgatcttggctcactgcaactccgcctcccaggttcaagcaattctcatgcctcagcctcccgagtagctgggattagaggcacatgccaccatgcccagctaatttttgtatttttagtagagacggggtttcaccatgttgcccaggatgatctcgatctcctgaccttgtgatctgcccacctcggcctcccacagtgctgggattataggtgtgagccaccgcgcccggcctctttttagttttaaatcataagactcttgaatacagtctcttaaagatatgctactgtgttaactgtactggaatcttttgcttaccttaaatgtcaatgtctttcccatttcagatgccagtgtacattctaccaactctactgaaagcttttatttgagcagcccttggcttatttcctctggcttcaaaaattacccagttaactgagtaggattcctaactggccagtccgtttagcgattttttagatgaaagttttagattttagtgcagaagttgtctttgaagattatcaaatcaaaacatccttattttagaaagatgatacagaaaatcataaggaaatctgagtgaacttaccacccttcacattttagggtatagtcatcaggtatttcaggagacttaacttgaacctaacgaaaccaagtttcaggcccctctaaatataaatgttcacttttatacctaagtttctgtttcaaatgttgttattcttgttcttaaagaggccactcaaaattgtgtaagcttcagggctcacaaaatgtggggtccatcactgtcatcaaggtgattaattgatttgtataaatctagttcctttctgttttatgatatgctttgtcatttaataaaatacagttttttcacattgccatattctcttacaattgcttttcataactgtttagtgttccagtgaacagatttattaaatgaactacttattaaatcaatcccctattgttggagattctccctcaccttatattattcctacagttgatacttcattgagtgtctaggtaaggatgtcattgtgcctaaatgtgtaaaagttgaattagtgcttcaaaccacatgtgtactttgggggcttttgatacattgacaaataacccttcagagaaatggtatcaacttactttcccaacagtgatatgtgggagtatccattttcccatcccttgtcagcactatttattgtatcaacctttgccaatgttgtaggtgtaaaaacttaccttgctattttaattttaatatttttcataagttgaaaacttatttcccatcagaaaacgcaataagaatcctttatatatttaaggcattagccatttgccactggtattgcagatggtgatctgcatagtcctaaaatggatttggagaaactgaggcatttagtttatttggaattgtcaccgtcagctgcctgcagaagacgcccttcagggaaaatggtattgctattccaaaaggcaagcatacatcatattcacttggccacattacaggaataatttaatgtgtttcaactaaaggtatctgagcgtctactaggtacctaactctgtactctatcttaccatctggtgagggaaactgtatacaacaaaccataatgcaggattaaaagccacgcttgcagccaggtgtggtggctccacctgtaatcctagcactgtgggaggtcaaggtgggtgaatcacctgaggtcaggagttcgagaacagcctggccaacataccaaaaccccgtctctactaaaaaaatacaaaaattagccggacatgggggcatatacctgtagtcccagctactcaggaggctgaagcaagagaatcacttgaacccaggaggtgtgacgttgcagtgagccgagatcgcaccattgcactccagcttgggcaacagagcgagactctgtctgaaaaaaaaaagtcatgcttgcagtctcaacaaaatacaatatgagcacatcggtgaggtaaattaattccttcattcctgatgaggaaatgatggagtagtaatgggggaagattgttcagaggacttgatgtatatgtgaagcaaagaggtggtgagaagtgcgtggcgcagcgtgtgggatgaatgtgcaccgtaagaggtccagtcccactgcggtgccctagcaaagtgggacgcttcgggaaaataaggcaggaagaggagttgaggtcacatggtgaatatccttggataccatgttgagataaagatattttagaagatgtcccacattctggaactgattctgagacgcaaaagataatgaagatgtgtgggcacaagtgtgacctgccaactgcaccctgctttttgtaaaatgtgagtaagagatcttggttaaaatccacattcctttgcaaagccatggaggtgaaagaacccttcagtgttcaggcttctcagggggacactgagcattgcaaggttcatatcgacactcactctggcacaggtttcagagctcggcacctccccctcccaccccacacccccatccagcatgtggatccattctaaccctgtgatggcattcccttcggttgaggtaaagacgggaatcttttttctgagctgcacccagcacgcttcaacatcttcaagcagatggtcagcctaaaagtgtgaggatagctcaggttgccctgagaggatgcttgcaggagatggacagagctaaatgcaggatttcaggagaagtatgcttcaagaaagagagcatggcatctatgaatttggcagaagtggacatatagcttctgccaaatgatgagttgtaacttttaggcaaattgcttggactttctgagcttttatttccttatctgtgaaatggggtcatagtatccatctgacaagagatactgtgctgatgagatgaaatacatacacatggtttctgacatatggcaggcatcctataaatgcatttctctcatcctcatcccttcttcataaaaagggagtttgggaggcagagtcccctggacaacctctgggaatctggagcagccagcactaacttggagcgaggaagcctgtgccaaagcatgcggaatctctagaaaccatgtgggcttttgttcatcatcatgccaataaaacgccatcggatattaagagaattccttctgagtctaagcatttctaaatacctttcctgaattgagaaagcaaactgtgtaaaagccaagcgtgaaaagactattctgtttgcaaaggcatttttcccatcctgcctggcttgtcacgttctgtgactggactcatgcacccagctggcagctgcaccagccagaccctgaggtaactatagtttaggcccattttttttcctgctccagagactacaaattctatttcaagcacacgcatgtacagaatgcagatgtggggatgaaaatcagaccatcttctgggagcgaggctgtgatacttaactgtagggacgccattggtggcctttctgcagtggcctcgcccaggcatggctggggcatggacctcaagagcggttttggccttttgatgtaccatagcaatcacatgggacaatcaccacacatcccacgtggggccaagacattgcgtgatctgtgatcagacaggcttaaaaggtattctccgcattctgaggaatttgtaacagcatggagattctggaaaactagttccctgaaaaagctgagggtcaacacagggatgagtggagaggggacatggagcccttatgcctgacatgaagggactgctctagtcaaggaaacagccacttcagaatgtgtctctactgtggatacaaaccaagggcgaggttactaggctggttacatcatctagcaaaagctcttatagctcagatagacccacaaatgagacattccttttcaatgactaataaatcattcgtttattcattcaacaaatatttattgagaaactactatgtaacaggtagtctcataggtactaaggatacagtagaaaacaacaacaaacttaaaaaaaaaaaatcccttagccccagttacttgagaagattgcttgaagccagtagtttgaggctgcagtgagctatgatcataccactgcactccagcctgggtgacagagcaagaccccatctctttaaagataaaaaaaaaaaaaaaatctctgagctcatgaaacttacatgttagcaagagaaactgatcataagcaatatcactaattaaaatatgaattataacatagagtagaaaatgctaagaaaacagacataaagcaagtataagagtaagaaatagtatggagaatggctactaaaattctagctgaggaggctagggagggcttcactgagaaaccaactttatagagacctgatggtttggataggtatagacctagattgaaaatatttccctccaggttttcaaaggcattgctccattatcttttggtttctgaagttcctgttgagaaagctattgcctttctgatacctgatccttcctatgtgactttttacctgttctgggggcttttaggattttctgttttccccatcttctggaatgtctcagtgacaaacctgtgtgttgagtatttcataaacttttacaatctgcgatctcatgtccttcagtttacaaggaaaaaagaacattcttataatattgttttggaaaactctgttttttctgatctcttttacccaaatctccattactggggatctgggtactctgacatgattctatgtttcatattgctcttctctcttttcccatctctcagtctctttttttcggaggggaggtggcctccactttctgagattgcgtcaactttttcttcttcactgaattttaaaattctgctctcatggttcctagagactgatcttatcctccaaatgctccccctttttctggactgtttgttctcttccgagtttctttttcctgtttctttgggtgttttcatttgtgttagaagcttctataaaaatgtttgtgacatcttgggagtcagttaatgtaagagggaggcacggttgtaattttgggaagttttatatgtgggtctggctgcttcgctatggggtgaccagacagaatctgaatatgaccctcaaaaatctgtttgtcaggccagacatggtagctcatggctgtcatcccagaactttgggagtccgaggtggtcagatcacttgagctcaggagtttaaaaccagcctaggcaacatggcaaaaccccatcactaaaaaaaatatacaaaaaattagctgggtgtagtggttctctcctatggtcccaggtactcagggggctgaggtgggaggatagcttgaattcatgaggttggggctgcagtgagccctgatcatgtcactgcactccagcctaggcaacagagcaaggcaagactcagtctctcacatacacacaaaagtttgtctcttctcatgggtcattcagcattcctagagaggaccctccagtgtcctgactaaggagctggcccctttgccagcattcggtcgagggcatatcagccccttcccctatgcttggtcagccagaatccagtgtgtttgatgtggactcttccatcttctgtggatgtgatgggtggctacctggctgggtggggtgggaagagagatggacatttgctacatcagtggtccctagcctttttggcaccaaggaccggttttgtggaagacaatttttccatggacagggttagggggagatggttttgggatgattcaaacgcattacatttagcatgcactttatttctattattattgcattgcaatatataatgaaataattatacaacgcaccataatgtagaatcagtggaagccctgagcttgttttcctgtaactagtcagtcccatctggaggtgatgagtgacagtgacagatcatcaggcatgggattctcttaaggcgcatgcaacctagatccctcaccatgcgcagttcacagtagggttcacgctcctatgagaatcttatgctgctgctgatctgacaggaggtggagctcagacagtgattcgagcaatggggagcagctgtaaatacagatgaagattccctcgctcagccatggctcacttcctgctatgtggcccagttcctaacaagccaaggactggtactggtttgtggcctgaaggctggggacctttgtgctacaccattttaaaatcaagttcagtcaggcatcatgcattcaactcactatgcatttctaccttcagaagggttgggagcctcatttcctgagtttccctggctctgcctgttttatgttgagttattcccttgaaggtttaggtatcagcttgctcttgtctactgttagttcctctctcattcccttacttctttgatgtatgcttttgtatcccttattgtcactttaatggaatttctggaggaagcagagacaaatgtattacatgggctgccatattgaaccggaattcattcttttctcttttgagtctccctttccaaagtttactccagtggtagtagttcacccccagtagattctcacaaaaagcaagactcaaattcagtgtcaggattgtggatatcctgtttcagttatctgtttctgaataacaaatcaccctaagcatagtgacttcacatgacagtcatttatttgcttatcattctgcaatttggacagtgcttggaggggccatctcatttctgctggcatcagctggggtagctcacctggggctggggagaccactcccaagacggctcatccacataacctcagtggttccagctgtaaaatgggcgcttagatggggtggttcttcagcatgtgacctcccgtgtggctgggttggactcctcagaagctgagttctgaaaggaaacatccccaaaccaagctcaccaagaggacaaactccagggtgcaaacacatatcaagctttccttttgcatcacacttgctaatatcccattggccaaagcaagtcacacagccaagcccagaatcaacgtggaacagagctgctctccacagatgggtgagtgctaggaggcagggtgcactggggcccacataccccctgggaactctgggatcctgtgctttttccattttatttctgaaacattgaggtgccagattctagcacgatatgaacattcaataaatatgtattagaaccacagaaatcttgttgcatttccactgaaaatgtttctgaatggactagacagatttaagctatgtagcttacccatggctataatgattgtgttcctagttaatgaaagacatgaaaaaaaatcactctatgaggtcagatttctaaatatacctttccaaggaattaagtatcgtcctttttttttttttttttttttttaagatggagtcttactctatcgcccaggctggagtgcagtggcgtgatctcagctcactgcaacctcccaggttcaagcaactctcttgcctcagcctcccgagtagctgggattacaggcatgtgccaccacacccagctaatttttgtatttttagtagagatggggtttcaccatgttggccagactggtctgaaactcttgaccttaagtgattcgcctgcctcagcctcccaaagtgctgggattacaggcgtgagttaccgagcctggccaagtattgtcttttgctttaggctaccagaggtttgcttcttgcatgtttgtttttgagtcagggtctcactctattacttaggctggagtgcagtggcgcaatcatagctcactgcagcctgcaactctgaggctcaagtgatcttcccaccacagcctcctgagtagctgagactacagtcatgtgccaccacacccagctaatttttttttttccaaagagatgggatcttgctacattgcccaggtgggtctcgaactcctggcctcaagcaatcctcttgccatggcctcccaaagcactgggattacaggcataagccattgcacccagcccttgaatttttgaaaattaggctctttaacacctgcttggacttcaaagaacgaaggtgagtacttacacaataaccaaacagtgcattccttggaaattccaaacctagatctcttgttacatgcttgccaagcttgtcctgaacgttcctaagtgcagcaggaaagaagtggctcagcttgtgctgtgtgtcccctgagtcttgacctgtgactaataactgtttcctttgtgtgcaggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggtaagttgtgacatcattttttgcctgccattttgccttagagttttttttgttttttgtttttttgtttttgaggggtttttttttacccactatattgcatttagagtgtttttttgttttttgttttttgttttttgttttttgtttggtccatcatatccctttcatagagtttataccaaattctaatttctttatatcctagtgaagaaagcagattcattatcctgattggttgggcttatttcacccagtcagatgatttcactatctggttttctacaattcatttacagggtatagcttataaaaacgaggacaaatttctccgccacagatttttgaatgctacatctgaaaagaacattagaaatgattcagtccaccattttatctaagggttagggaaactaaggcccaaaaaggtagcggagagacctgatcgaggtcttaagagttgtaggcagtacttcattcatattggaactttcccaattccccctcaagtgttctttcctccatagaaagaccctgtggacattttaggtaatgatcccactgggtcgttatttacacataacaagttagaataaaagcagtgggctctgtattattttccataagaaaagagactgagaagcatcttcactttccattcatttcttaaagagttgtcctttacccaaagatcttactttccaggtggcctttccccagggcccccagttgaatatcctccaaaattaagctaaatggactcctgctattgatgggattgagagtcagttagaaacaaaagcatctctctctccctctctctctctctctctttttttttttttttttttttttttttttatgagacagtcttgctctttcgcccaggctggagtacaatggtgcgatctccgtttactgtaacctccgcctcctgggttcaagcgattctcctgcctcagcctcccaagtagctgggattacaggcgcccaccaccaggcccagctaatttttttctatttttagtaggtacggggttttaccacgtgggtcaggctggtctcaaactcctgacctcaggtcatctacctgcctcggcctcccaaagtgctaggattacaggtgtgagccaccatgcctggcctcatctctctttttttgaagacagggtcttgctctgtcacccaggctggacctcagtggcatgatcatgtctcagtgcagcctcgaccttctgggctcaaatgatcctcccacctctgccttccgagtagctggcactaccggcacatgccaccatatctggctaatttttaatcttttgtagagacagaatctccctatgttacccaggctggtctgaaactcctgaggcaagcaatcctctagtctcggactcccaaatggttgggattataggcgtgggccaccacacctggctcaaaagcatctttattgtcattttggtgtcatgtatacagtagaaagaactcatttgatctgttccaaccaaacaacctggaaaacaggacttagatcaacacaagcaatcagttgctagtatggtctctaaacattttagaactccacagattatttagtgactaatccagccatttcattttatggaaccagaaactcagacgcataaaatttgagggacttattcaaaagcacacagccagctaagtaccaagctctgccccaaatatggctgttcacacttcttggtcaagaactttttgatttcttcgaatgttccctcaccaaatcactggaggcagaacttggggtttctgagtccacaccctggggggaatagcaagttgccctgtttcttcatcatggaattaatgggtaccacttttaaaaaatatgcctctagtgcataataaatgtaaactgatctgtatctaccaatgatcacaaatgacatatttaggcatgtgcccaggtgtatgagtaatttagaactttcaaagtttgacacatgcctcaaggtatagatactacatctgtttcacaaccttacagctttttaaaaatgtgtttaaatattcatgggtacccaaaaattcatgtttgtttttaaactaaattattaatcaagctgtcaccaaaagaaattttttgcattcacaaagcgtaaacttgaaacatgaaataatcacattatatttaaagacaatgtttgtagtaatataatcccacatactgtttttacatggagctgccagttacaacaatcatcttacatttctgcctttgcaattagaggaattgaaggacacagtaatagcaagtaaacatgcaacttagggaagccacacttgattatggagctcaaggctgatgaggttattatgagtaattgggcctcactgtcttgcagcctgtgcaaggatttttatattacaatgagtcaccattttctagagcttttctcaagcttcaaagtatggctactttgccttcttttttacattgtttgggaaagtcgagaagtagtcacaaaataaaagaaatgagagggaggaaaaagaagaaaaggtcatgattctccttaatggaaatctagttgataacataaatgaaaccatcagtcaatatgttgatatttgtgaaaatgatgatcttgttgatccgtaagttgtagtatggatagcctaactttttttttttttgagacagaatttcactcggtcgcccaggttggagtgcagtggcatgatctcagttcactgcagccaccacctcctgggttcaagtaattctcatgcctcagcctcccgagtagctgggactacaggtgtgcgccaccacgccaggctaatttttgtatttttagtagagatggggtttcaccatgttggccaggtttgtctcgaactcctgacctcaagtgatctgcccacctcggcctcccaaagtgctgggattataagcgtgacccactgctcccagcttgatagcctaaagttatttttaaaaaactctcatttaaaatatttaagtggaaagatcaccgatttataaatttgtctgtaattttacttttcagttactttgatttaaataaaaaaaagaacctaaaaatgttcaaatgtagacaatgttttatttggtgatgacagtaatgtttatgctatgtgagcacatgcatgtcgcttccaaagaattattctatttcttgattttatgcattaaatgccttgattatattttatttgaatggtagaagaaattttcaccaccagcattatataagacaaaaaaaaaaaaggctgggcgctgtggctcacgcctgtaatcccagcactttgggaggccaaggtgggcggatcacgaggtcaggagatcgagaccatcctggttaacacagtgaaaacccgtctctacggaaaatacaaaaaattagccgggcgtggtggcgggcacctgtagtcccagctgctggggaggctaaggcaggagaatgctgtgaacccgggaagcggaactcacagtgagccgagacggtgccactgcactccagcctgggcgacagagtgagactccgtctcaaaaaaaaaaaaaaaaaaaaaaaaaaagacaaaagaaaagtatcatgtagatttcaactggagacagtgactttaatcttctaagttcagagacaaatttcactgcacttccttcagtgtttctgaagcgtgagcatatttgctaaacagttgcctatctcatcattgtgttaggctcctcatattttccttagggaaatgctatggagagttcaggtcagaatattgtgttgtaaatgttgccacagtaaatgcaaccccggcctttactgttggttcatctcagatgaatatgtttctaaagtcatgataaaccaacctcatgcattttaaatacctccagaatcacagttagtctttttcatggctcccgtgaggttttctagtttttcacgtcctcgcctgtgactccttcctctggccaaatggggagctcctttagtgaaaccccacatccttacctctgtgagtctccccttcatattcacccagccccctttaataacagggctgctggttccccctcaagccgacttctaacaagctactggagcaaccgtgcaagcttgggctagtcattgcttcaaagcaattactggcggatatttaaaggagaaagagaagactagtccaagaatcctccacttcagttaaaacagaaacacaagccagtaatcccagtgattgggtcagcccactaaatgaggctgcacctggaagagaggaattcttcctcctgcccacatttctctgagctagcccagccggcattggaagggatcacagtgtagacagagccaaaagggccttgggtggcccttctgctgatgaaagctgaacatggagggagagagacttcatagatattcatgtgctcttcgataattttaaggtaggctctgatcctgtcttttgctacgttatgacaccttggctctaagagccgggttcagagaaaaaagaagaatttatctgctgctatttcttcacatccagcaattcgatttgtatatagaaaaactaattttctaacccactatggaaggaaaaaaggcatggtaaagatattagatctttttggtactgtttttttttttttttctggactccagataccttttctttcagttgccgaaagtgtttgaaggcaaaaaaaaaaaaaaaaaaagaaaaagaaaaaaatcttctttcatgtacattcattagataagcagcaaaccaggtgtttgggaaaagtaaacaattaaatatttaaatatcaaccaaatctctttgaatgtattgtaaatattggaactttatttttttttttaaagccttagtttccatactcggaatcttgaaagaaagttcgtgccacccaacatttatgggtggggaactatactggaggaataatactttcttggggaacaagaaaaggagagaaaagctgaagtcatttttcttcttcttttccgtatttataattgcctattttatggtcacatagcttttgactggcgtactgtagatagcctttggattgtctgttcatgttttttacctgatctttaagggcaggctaaggaaatggccaaagtcaggcttctttcatctgccatagttatcgatgtttttgattccaggaacattcaagacagatcactcctcaaagtgtacaacaaggatcctgcacatgcgtttaatcacacaccaaaaactatgaatggagacatgagggtaagtgtttctgtcatatttttacttatcttcagtgggtcaaagcgtccctcctcttgcttgtactcctgatgtaatcagaactctacaactgagttttggagggttctccgcactcatctcacctagtggatcattatttgttcttggtagagaagtaagatttcctggttatttagggcaaagggattaaaataaggctggacacatcctaatttatctttaagcaaggagttatgtccttactttaaatgaattctgaaaatcttcctataaaagggtccctggtccacagtatattaactgactcagaagatctcttgcatttctttctccaattaaagcaaacctaacatacaaaaaggcaaacagcaaggtgcacaattgcatggaaaatctattcatactcttacattagctcttccaagttctaacattctaattcaatttctcaccttctaattcaggagctaccctggaagaattttgttgttgtactgtcttaaatattaccatatcctctctgagccatgctgaggtcataatacaaaaatccgcatgatttgggaactaaaattctctagctttagattgtctcaggagattatccaaacattcaaagcacacagggatgttttgaagaaaaaagaaggagaaactgaaaaagcagattttaagatcatattaatgcaggtccactagaaagggattgagtttctaaaaataaggctacattcctctgtagcaaaactgggaggtaaaaagaagattagcttctcagctgtacaccccctacacacacacacacacatttggaagacactgtgccattttttctcatcttttctacagattagcacttggctggatgctcaagtttagctagaaaaataaataaataaatgattaccttttattgccaaagaaacccaggcactgttctgtcttggagctgcagttttgttcctgagcgaggctgtctctgcttcctgatagtacatattagtttcctgttgctgctgtaataaattaggacaaattcagtgacttaaaacaacacagatttactctcttaaattttagagtctgtagactgaaagtctctggtctgacataaggggtcaccagcaggtatgcattcttttctggaggccctagggagaatcttttcttttttttttttttcccccaacttctagaggtcatcaacatttcttggtttgctgtcctcttcctccatcttcaaacccagcaagatagcttccctttgaccctgcttccatgctcacatccctaaccctcccatgtccacttttaaggacactttaaggacattgagcctccctgatcctccagaaaaatctccctatttcaaggtcagctgactggcaatcttgactcccccttttccatgtaacctgatgtagtcacaggttgaggggactaggatgcagacatctttcagggaccagcattctgctttccatattgggtaagtttagaaccataaaagaagccagcagatctagctgaaagtgctgggagaaggtctgtccttctggactggaatatgaatgacgacattgtgggatcagagcctacacttctggagggaaaggcctctcacgtactcaactgctgttatttttgtgtcagaaatgatgtgtgacttgaattgaaagctgtgtcgctacttcagaaattctaggattttcagccttattttgccagttatactttatgtgtaaaccagagccacatggagacagattgagtcatgccaatcgtgaagcatggactaaatattacagcaccatttgccttttattactctgttattctctttcttggagacattcatcaatgtcttcgctccttgaatatctttattttttgctatgtctagccttcaccctggagttccatggtgctgagagttctgttcctatcacatagagccatttccacaccggtgccccagaatcgcctctgagaatcttgtttgtggctggaaagacacctgttttaaccctccagcagctctggtacctacgtaaggaccagcagtgaggactgagagtatcgaatattgaccgtatgaacaaagctgatcaggatatgcagaacatgtgctgtgggtttctgcagagtggttctgttcttacttcaagatgaaaccctgctgatcactttttctgggttacccagagcctactttaagccctcattttgtgtgtgtgagaaactcaatcattgtccccaaatgaagggacagtaaatgttcaccatctaaccagcagaaaagcttttgtgtttcaatgcagattacttagaaatgagaaatagaaagcggtttcaaagccagctaggtgtgatcatgcctgcagtttgcaacttggttcctgttcacagattgcagacgctaaaaggcatggaattcagctgccctcaccttttggctctgcaggttggaattctttttcctttcttgatgaatgtggctgcattgccattaaagggcaggaagctttgttgagccctgcctctggagcccagctgcacaacccactgcccatggtggagaacagaaacagagaacagagcaagcatcaattgttgtagactaaaccacgctgcagcgtggggttagggaactccgtcctcccttatgtttgcaatgtgagcgtggccatgaaggaattcgatgctaactactcacatgagtcagtcactgcagtcctgcccctgatgtcattagacctcactccccagcctccagagacagcctggcacagacctcccagctgcctgcttatgaccaataaacatgcatgtcatgaaaaacatcagttggaataagcagaggggcaacaaaagtcacaccagaactcctcaggggctcctgagactttccttaaccaatgaatgtaatatcttgcctttgaaagaaaagaaaatgtaaaactctccatctaaaacagtcttcccagagcggttttatgattggaaatgtgttactcaggaagcgtgctagactaggcctcagagtgtgcgtggaatgcatgcttggtggggaaaacgtgtactaaattttcatctagcatctagctgagcatttttgaggctagtctgtctaaggagacttgtggttctcggctggaactcagcatacctggctcctgtttctctacccaccaccctgatctaatttaattgcgtggcttttgtttccttacatcagataggagctttgataattcagttcccaagggactgagctcaccatatggaacaggcccttttgcaaaatttatatatgtactcacagggttttaaattcacaaatgtacaacttgaagatggaaccattccatttcatgactctcaaaaagtacacgtttttccataccagcagtttgttgaaggaactggacaattctgctttgagggtgacttgctagtcaccaaacctggtggctttttcatagtgtgggggcttctccaccttcttgtgtgctttaagacaactttccaagactctctgctctcatcatttaatactctccctcttctctgcttcctttaatttctcttgcatgtctttgatttttacttgtatatagacaattaccagattggccctacctcttaaattattccccaatacccaaggtaactgctgcctcccacccctcttctactgatctttgtatttgacaccagtgaatggtccccttataaatcattggtctccatggcacttttgtgtctaaataccttgtctgcattcacagacacctcagcttccttcattccctaactcttcttcctcttgcctgtgtttaagcaggcttctctagtttggagtttatttgttttgtttttttaaatttactcttttttatctgaacctttgcacttgtgatttttatcttaccacttgtttgactattacatcagtgtggttgacccttgaagccatatccctaactctgccatctctagaattcaagacccaaatgttcagcttctaagtgtcttcatatggagatcatttccgtggtttccaatgcattctgttgaagaaaaaattcctaatcttttttccactcaagtctttatccttcttgattaccttttgaagaatggaggggctatgatagggtgtgtgtgtatgtgtgtgcacatgcatgtgtgcctgtgtgtgtatgcatgcatattttggggaatgtgggaggagggatgtaaaacattgagttaccaatgattcttctcttgcctgacctttattcttccatgcatccagctggtcaccagagttcatccactccactttgcaaggcctctaacagatgacccttctgccactgcctgtaccagtattcttacaatagctaacttatttgagcatttattaagcacttttgtgggatttttttttttttttttgagagggagtctcactgtgccatccaggctggagtgcagtgttgcaatctcggctcattgcaacctctgcctcccaggttcaagcgattctcccacctcagcctactgagtagctgggattacaggcatgcaccactatacctggctaatttttgtatttttagaagaaatgggattttgccatgttggccaggctggtctcaaactcctgacctcaggtgatccacctgcctcagcctctcaaattacaggcgtgggctactgcgcctggacagtaatgttaattatttaatcctcaagataaacttttgagccaggtcttggtataagcccccctgtttacagatgatgagacagctccttatgttaagagatttccccaaggccacacagccagagagtagcagaacagagatttaaacccaggcaccgtggctgctgaaattatagccttcattatctctctactgaatcacctaacagttcttacttcccacatctcattctcctgttctctttttccaagtgtctcaaattcactctccctctctacatatctgcctttcaaaattctactcatctaacatattccagaacaattgtctaattccttcagcaaattgcagtcatgaaaaaaaagtgggggagggagcacagttaagtttctcgggggtcttctgtaccataataacaaaatgtggcctgtgcaccatcttcagattttgagaagaacaaagcaactgtaaaagacatctttaaaactatttgggaaatttgaacatgtgttaggaatcaggagatattaagggatagctggtaattctgttaggcataataataggttagtggttatgttttaaaagatggaacatactaaagtgtttacaggttaaatgacatgaaaaatgggacttgctttaaaatactgcagcaaaccaagaaaacaaaaaggtggaagtagatgaaacaaaatggtaaaatgttgaaaaatgtcaaagctggatgatgggggtaccttttattgttttctctacttttttgtgtttgaaaattttcataataaaatctgtttgttttcttttcttttcttttcttttttctgagacagagtctcactctgtcaccgggctggagtgcagtggtgcgatctcagctcactgcaacctctgcctcccgtgttcaagcaattctcctcccttagcctcttgagtagccgggactacaggtgcacaccaccactcttggcacatttttgtattttttactagagacggggtttcaccacgttgaccaggctggtctcgaactcctgacctcaggtgatccacccgcctcggcctcctaaagtgctggatttacaggcgtgagccaccatgcccagcccataataaaatcttttacaaaataataaaaacttgtttttagagcccaaataaaagacttcctaccccaggaagctttcgctaatgctctgtcagaattcatctttcccttttgggggcctgttgcacattcgcattgtgttataatcatttagctgtgtgttcatctcatgcaaaagactgtacactcttcaaagccacaagccatattatgtgatgattcatcttcacgtccctccaaaaaccagtcatggcatcttaacccctggtgagtgcagagtaaacacacttgttaaacaggatgcgctgagtgtcctactgatggtcctacaaatgccatattattcattttctatcattaatgaggacccactgtaaaaatatctctctgttctcatcaccagaaatagttgtgcttctcctggtttatttttatcatatggacactttgagtcttgtaagtgatcattttccctctttgtgttgctactctaaagcttagaattaaatttgtggcccacccacagcaagggtacaggcatttgtggcgtgtgttttgtgtgttggcttcattcctggactctctttttaattttcctactttcatcttcctttggttgcacattctactttgacttcttttttctgtaaaactgtaaaaatgtataggaactctattaatttcttggtgcaatctatcaggatataaatagtattcattctctaccatcgttgttctagatagaagatagcaaacctttttgtgtctgcagagtaggcagtgtgttaagtactttacatattatttaaattagtcagtaactctggcaaagtgggtatactgacttcgttttcacaggtgataaaactgaagccaaagaggtctttcccaagctcacacatctgatcaatgttggacactggatttgaacttgtttctgcttgtttatacacagcccacagcctcccttccttgatatttccatttaagttttgcaattttgaagtgatgttcctactaagactttagaacaaacaaaatatgctttattaaacatttgtttcatttctgtttttaattattattatactttaagttttagggtacatgtgcacaacgtgcaggtttgttacatatgtatacatgtgccatgttggtgtgctgcacccattaactcatcatttagcattaggtatatcctaatgctatccctcccccctccccccaccccacaacagtccctggtgtgtgatgttccccttcctgtgtccatgtgttctcattcttcaattcccacctataagtgagaacatgcggtctttggttttttgtccttgcgatagtttgctgagaatgatggtttccagcttcatccatgtccctacaaaggacatgaactcatcattttttatggctgcatagtattccatggtgtatatgtgccacattttcttaatccagtctatccttgttggacatttgggttggttccaagtctttgctattgtgaatagtgccgcaataaacatacctgtgcatgtgtctttatagcagcgtgatttataatcctttgggtatatacccagtaatgggatggctgggtcaaatggtatttctagttctagatccctgaggaatcgccacaccaacttccacaatggttgaactagtttacagtcccaccaatagtgtaaaagtgttcctatttctccacatcctctccagcacctgttgtttcctgactttttaatgatcgccattctaactggcgtgagatggtatctgattgtggttttgatttgcatttctctgatggccagtgatgatgagcattttttcatgtgttttttggctgcataaatgtcttcttttgagaagtgtctgttcatatccttcacccacttgttgatggggttgtttgtttttttcttgtaaatttgtttgagttcattgtagattctggatattagcactttgtcagatgagtaggttgcttaatttcattatacatctctttcatggtatctttttatatttaattttgcttcattctcttcttttctgagcacactaaaaatatatccattaaaaaaagaaaagaaaagaaaagaaaaagagtgagttgcccatttagtatgtgtgtctgcagtggccactgaactcagagcactttttctcacagggcagtgttcttgttgagaagaggggtttgggattcagggagtatcaagtcatcccgtagtaacaaaagaatcccacagaaatggaagtttcagaaaacactcctagctgataatctatttagagatcgtttttgacccacctgtaatatccccttcactcatgcaatgacaacggtatcaataactaacattcctgacgtgcttactctgtgccagtcaccatactgagcaatttgcttgtatttactgccatttgattttcacacctatacaatgtgagagaagttcttattattctcctgtttcagaagtggaagctgaggcttaagagaggtcagtgtgcttgctcaaagctacccagctaaagagaagtggagctgaatttagagccaggcaggccaactctagaactggcctttgtaatcatgcctgtggtcactaccgtccgtcctttcccaccactgtcttcatcagtgtgtcgatgagtcatcgccacatgtccatgggcctctcatttctgaagacctaacccagaagccactctcttcatcaagcctctctcacttctttccaaacctcaccactcactgtcccttctcgaaacttccatagaacttcacctccctgccccgctctctttgtgcactccccttttcctgactgcactgagttattgatgcacgcttctttttcttttcctttcaccattttattctttttttaatgaatgatttatatatttatttatttatttatctatttattttatactttaagttctggggtacatgtgcacaatgtgttatatatgtatacatgtgccatgttggtgtgctgcacccattaactcgtcattacattaggtatatctcctaatgctatgcctccccactcctcccaccccacaacaggccccggtgtgtgatgttccccaccctgtgtccaagtgttctcattgttcaattcccacctatgagtgagaacatgtggtgtttggttttctgtccacacgtcttaagtgtctttcagctctaagcttctcagggacagggtctccatttcattcatcttcacgctccctgtggctctctcggacaatgccctgccctgagtagattctcattaaatacctggatagaaaaagatacttacttcagcccttttctatcaccaactttcagttaattagtgccttatctactaagagcgatacagtgatttgtaaaggtacgtgtttgaggcttatagcacattacctaatgtatcccgctattggccactgacccaaatgagaaataagaatgtctgcctttcctcagtctatcagtataatttgatagaagttaattaccctgggctgagcgcggtggctcacacctgtaatcccagcactttgggaggctgaggcgggcagatcacgaggtcaagagatcaagaccatcctggccaagatggtgaaaccctatctctactaaaaatacaaaaattagctgggtgtggtggcgcgtgcctatagtcccagctactcaggaggctgaggcaggagaatcacttgaaccccggaggcagagattgcagtgagccaagatcacaccactgtactccagcctggtgacagagtgagtctccacctcaaaaaaaaagaagttaataaccctgaagtttaagaataacaataaagaaaaaatctgctttgtcagattaaaataagtgttcatcagaaatacacagttatctaacctttttttgcgtggggggggctggagttttcaggagttgaattcacctgtggtagaacgtaaactaaatccctagacaacaaatctaaataagatagatctgattttgctgtgtttataattcactaggagaaatcttgcttttattttgctttatttttattttattttgaaggcagggtcttgctctgtcacccagtttggaatgcagtggcacaatcatggctcactgcagcctcagcctccctggctcaagtgatcctctgccccagcctcctgattagctggaactactggcacacaccacaatacttggctaattttctgaattctttgtagagacacagtctccctatgttgcccaggctggctttgaactcctaggctccagggatcctccctccatgccttccaaagtgctgggattacaggcatgagccactgtgcctggccccttgcttttagattgagtcgatagtcagtatttcaaatatctctaaacttacaccgtaagggtgatgatttttgaacagttaacctaacttcattactgtaagcgtttactgattcactcaatcagccatagtgagtcagatccttcctctggtctcagctctcatgcaagatcctgaagatatattggcaaaaagcaataatgatacagacaataatcaattaactcaataatcaataatgatacagacatctataatttttcacataagttcaggctcatgaaatccttgcctgtgttctataatttgctggagttaacactatggaactcatttatgagtgatatacataatgatatcttttttatattgtgcttttctgggaggcaaaaagatgtttctgttatgattgataaggaaggactcttacagaaatgattagctaggcaaacacatttgaatacagtggctgtccagaacatgggagatattttcttgttccttctctgcttccagttataaagtcttattttttagaagcaagaaaaggtaatatatgcacatctgatatgcaacttccaagtgatacaaatctcatctttcctgctgcgtggctgcttgcttttccttgtactatttttttttttattttttgtcattgagaggttatgacaacatgagccatattgtatttataaacatcacgtgtttccttgatatggcttgcagtttctgccagacagaacacatggaagaaacatttctcgttagttcagcattggttttagttatgctgatttccgggacaggaaaaatgccttcctactcagaattaactttcatagagtagaaacaaaacctctgaatgtccgtgaaatagttttaacaagagtggatactgctcctttaaaccacatattttgactaaaagcttccttctgtaaaaaacccaaggcttgcatttagtcaccatgaagacaggcaaagctgaaagcattggagagaggggtggtttcgaggtctctgcaagtctagaaagtttcttctagaaaagaaaggctcacggaaaatgtaaggtaagaactgtgcctttatgataggatattatctttagaatcttttttcatgctctggcacgtttatctttcattaacttgtcttctgtattcaagttcaatgcaataggcgattgcaattttaggttttattttaacttcttgcacactgcctagaagaaaacctctctttgttattgacattattctgtttttttgaaatccacttaaattaaactgggctggtcttcaatctataaatcttgtggtctagtttctggctaaccttataatttggaatgggatttaaagtgccaacacagtttgcttttacaggtcttgttgatttatgtgctctgtgacaattttcagtgttttcatgaagttgttgacatacattcagtgtctgaggcaaagtcgataatttgaaggcatggtacaagcaaggagggaaattcatatgtgtcctttaacattccagggaaaaattatttggtgttttgttcttgtgaaaatcactttaaatttaaaaataaaaataacctttatcctggtcttgaaaaaattttaaagaaatagcagtttaatctgtatgaaatcacattaaaaacttctacagttttaaatgacaagcttgatataacaaatctcttatagcaggtttagtgattgcctgaaaaagtctttgacagaaatcttgtttacttgagataactattctgtcaactcttgcagtaattcactcacaatatttttgcattgatttcctttaaaggaatttaataagagcaatgtccttttaaatcagtctgtttcctttcaaaagtacatgtgttcatgaatttgcttgttcatatttctgtggatatctttatcccagtttatagatgagttaatatacctgagaagttgttatccaatgtggtttacgtaatatctattattctatttagtcatcatgataaccctatggaataggtactattacacccattttaagtttggaaaaccaaggctcagagaggaacaagatcaagatcacacacttgtaagtaacagagctgggatttaaatccaggctgactgtcttccttgtttttaagtcctggacagcacagcctcaatagtagctgagagcttcaggtctgtaatcaaatatagatgacttatcttgaaaataataataatatataatgtttacgtggcttcaggataaactattttttacttttctggaattttattttattttagatctgtagcatccaaaacctagtatcacactggttgtttatccagggacctggttacaacttactcagagcataatgaaaacagtgaacatcagagagtgtagagatagagaaaagcactttggataaacgactcttccttctttactacacagacctttcctgctctcttctttgcttcatgtgccgtgttgctcataaaaaaatgtttccataggacagagcaggaagcttgtttgtgagcttgatttgggagcaagaaagtatctttgaatggagactggctaactgtgcctgcccactgcccttcaggctgctggcagagctctcaggagggggacaggaagaatgttaaggctgaaggtggagggttctgaagttagggcagctggctcagctgcctgagagcccgaacttcaccttcaacagtgctcttcccacctcctcctgaagattgagacatcaacacagcagcaaaaatatcctggtgatttgtaatgcaaagtaattactgctaacagcatcaacaggggatgcagctgctcacaacacaggcttcaggatcaaggcttccagccccagttcagcataaaatccaggattggctacacaaccaacacaactcaaagttgattggagcagaaccttccttctccccaacaggtcctagggttagctcccgaagagttctgagccgtggctggctggagtgcacatgagaggtttttgccacatccctctgccctttgatatccaaaccacatcccttttctttgctcttataagtataggtgttggcggagattgcttttgactggggacatatgtcctttcattttcaagttgcatcccttgtacctgcatgttgttcacttgctgaggtcttgcttttctgtgttctttgtgggtgcccagcaaggcatcccagaccatactaggctgttgtctaccacatcagcctaggcgccccgagtcccagaccctactctatagagggcttccaggggaccatttttctcttgatgctgtttctaacatttctcaaatgagcatgtgttacttttatataaatttgggggtagggagagaacacgttaatcttttaaaaagaaaaaagtgtttttaagatacattttgcctactggtaacacattttcttctgtcctagtttttcttgtggagcaggtgatctctgcttgcatgtggtttgcagaagtcatagatactctgtccgcttttgaggaactagagctggctactgcagacttgtaattgagaagacaaacctgacctgcaccaccggtgctccctcaagaaacagcactgaaactaataataattttttaaaagacggttaatggtacagaaaaatcatttagcaggaatgaatgagacggccgggcacggtggttcacgcctgtatttccagcactttgggaggccgaggcgggcggatcatgaggtcaggagatcaagaccatcctggctaacacagtgaaaccccgtctctacttaaaatacaaaaaaaaaaaaaaattagctgggcgtggtggcgggcgcctgtagtcccagctactcgggaggctgaggcaggagaatggggtgaacccgggagtttgagcttgcagtgagccgagatcgcaccactgcactccagcctgagtgacaaagcaagactgtctcaaaaaaaaaaaaaaaaaaaatagaatgaatgagacctagtatttgctagcacaacagaatgcctatagtcaaaaataatttaattgtacttttaaaaataactaaaagagtatagctgaaatgttgtaacacaaaggataaatgcttgaggtgacagacaccccatttaccctgatgcgattattacacattgcatgctgtatcaaaatatctcatgtaacccataaatatatacacctactctgttggcacaaaaattaaaaatgaaaaaaagaaagaaagaggcctgacttatttggagtcgtaggatttttgaaatagaaagaaggtcttagacatcatcttttgtaacccattgccctgtaacctgagacccaggagttccagagtggttggagtgagatggtcaagatcacaaaataaagaagtgacaaaaatagggctggatctcaagtcaccgttcccaagaccagacccttgtctctatgcagtgccatttcagcctgttctctgcttttgttctcacccctctggatcttatgaggtttgtcttcttgattgatttagaaaaacactatctatttgactatctatttgacttctcttagccatcttttgtggtacctgagtccagccagctttcgctaatcctctagaaagcaggacaactctcttttctggattatcttactaaaagagaaccagaaatcctgtagttaggccagagctgattaattggaaatgcatgagcctggactaaaaataaatggattttaaactaaccagatttagattatccagtattttttatggaaggagaataggccatcatgtcaactgaaaaatagcagctgtttcaaattatgagatactttgaatagagcaatattggctcagcaagattgtacagtgttatggcattattttaaaaaacagcctctttgctgtggcaaatagctcctgcagttatgctgtttgaaatgttaatgtatgactcctcacattactttcagagttgttcattgcttggaaccagtgattttaggtggcaactagaaaagcagtttgtaaatggtaataattatatgatgttgttttgaatgaatgttggaaagactggtagcacaaagaacttgagagttacttttcattaactccttaagtcacaactataattcttagtcacgactaaggagagaaaaagtcaatttaaaactgacttaaagaaaattattaaatgagtactaggacagctgatacaaagatatagccaaagtggtgatagtatcttgttaatgtatgaagtataaaaaccaaggctttaagatgaagcccaaattgagggttcaaggaaggaacagggtaaaacttgatttaaaagcatacaattggcaaaaaaaaagaaaaacgaaaaaaaaccattttgatgtccaaatgaattctaattcctctctaagagttctcaagacgatcagcatcgtactatttggcagaaaagacaaactactcattaaatagttttttgagcagatttatttatttaaggtctctccagataaaaggtgtgactacctagcttttcatttaagctagaggacctctttccattgtgcaggcagcactaactcactccatattcctgaaacagaaaatatgtttgactcagttgatcgacacatgtatttgatttctttccttttcttcttttcttgtgacatcaaaggtcgtgctttgccttgttctgatttcactctttgaaactgttccttttcacgcacccttgatagagtaggaagagttaccaaagaaaaacacaaacaacaataaggaatcataccaatgccaatgatggggcaattcagaaatagcaggggcctgatctgtagggtgcttaaacttccatgcatgattttcatgaaatgcagcacctctaaagcataggactggtggtcagggtctgatagcttcgtctagaatgagcatctagtgccagtccttgcagtcacttacaaggaaggagggcacggaatagaacatgttgtagatggttgaccccttgcagtagggactgagggatcatgacggatacatcatggatggaaatccacaaagtggaaaccgtttttgcttgcctttaaaagcaaatctaaaaatatgttttctagcagctgtgtaactgcaaggaaaaaaaaaaaaatctgctccactgcaacacaactcgctcaccagatatctgcagggttcagatcttaatgcttcagaaatttgttgcagattttactgtatatatttagaccaaggagcctattagcttgcaatctgagagaacctctgcattttcatgaaaatgagaaatgtggcactgttggcaacctcgggctataattatgttaatctgaccattttaagactgaaatatgttgttttaaaatgtttctgtatttttattattcgtaacaatgatctgaagaaatttactgaaatgctaataagtttctattcagtatcactttgagactagagcacaaaaaatgagtcagatgtggaattttgatatttttaattttggcacagaatttttatcgacagatatgtactcatatacatagagtatcttaatataaaaactacccaaatataattttatattttaaatatagatacagtgagtatatgtgcaaagctgtcttggcagatatgtgcaataacaaaacatctctacatttgcattaaattcccaatctttgctctgccaaaaattaattttgcgcattattacaagataaatgtttttctatcaagaaccatgctaaagcacccagttccctgtttttgatataaatgtaggacaggactagaatggataatgtagttgaaattctgagagcctctaaacacatatcttgagctaattagttcggcttcctcttcagcagccaaagcttgcattctggccacagacaagtaatgacacgggtgctcttttcattcacaaaagagatgttctcccaggtggtaagatgggaaggaaaagagaatgatccaatgccaagatgtgggtaatcacccatctcacagtgattatagataattgcaatttgagtctatttgttgttgtaacactacgaaatgaattgggagtcttttacatatagcctgatctgggttcagaatgatcaattaatttgggaataggaatgaggaaaagtactttttgtttttttctgagacacgagtctccctctgttgcccaggctggagtgcagtggtgcagtggttcactgcaacctccgcctcccgggctcaagagatcctcccaccttagtcccccaagttgctgggactaaaggcgtatgccaccccaccaggctaatttttctattttttgtagaggtagggtttcaccatgttgcccaggcttgttgcaaactcccgagctcaagtgatccaccagcctcggcctcccaaagtgctgggactacaggcgtgagccaccatgtccagcctggaccattttctcaaatatgatatctttgaaatataatacagtatgatgttcttacattggctgcatccagagtcctcattttttgccagttcttgtatctccaaaacgaatgtgtcattcgtttcatccttctgtgaatacattcaagtgagtattttccgttttattcattttcttctgcctcacagctcactgagtgggcccgtgaatgtttgctgatgatattaataatcatgcgtgctcagtgacacaacaatgatggaactcattaggtattcacagcaccagaagagaaagtgcaagaaggttttactgaagcaagtaagcagctgaatcaggggctcagagttcagtgtcaggactacagtcacagttatgagaccacagccaagaagagattcccagcagggaaaaaccaagccctttgagtcataatccagtgctcgatccaccacaccccactgccttccttgagatgatggtgtggaggagtactgattgatgaggaggattaaacctttttttttttttttgagacagagtctcgctctgtcccccaggctggagtgcaatggtgtgatctcagctcactgcaacctccgcctcccaggttcaagtgattctcctgcctcagcctcccgagtagctgggattacaggcacctgccaccaaacccggctaatttttgtgtttttagtagagtcaggtttcaccacgttggccaggctgctctcgaattcctaacctcaaatgatccacctgcctgggcctcccgaagtgctgggattacaggtgtgagccactgtgcccggccaattaaaccctttttaattaaaaaaaaaaattggaaactaatttgtgtacttcagtgtgttggaggaaacgtcatcgaaatggcaccagtgtcttgctgccttaattttaagaaatcccctttatttattgtcacttatcttctgtcctctctgggagaagtgttgctctaacgttgcttttctgaaaagtaaagataatgcaaagataaaaagagttggggaggttgggttgggcattgagggaagataagctacctttggttcagcctgcagcttgattctttttgaagtgacttgaaagctcttggtgctaatcaagaactttttgtttgttttttgttttgtgtgtgtgtgtgtgtgtatgtgtgtgtgggtggcggggtttggggggaacaggatcgtattctgtcacccaggctggagtgcagtggtataatcatagctggagtgcagtggtataatcatagctcactgcagccttgaactcctgggctcaagccatccttcacctcggccttcaagtagccagggtacaggcatgcaccaccatgcctggctaattttttaaattttaattttgcagagacagggccttgctatgttgcccaggctggtctcaaactcctggcttctagccatcctcccgccttggcctcccaaagtgctaggtttataggtgtgagagccactgtgctcagccctaatcatgaactttgaaaagtgctccatagattacaaagcattttcttcacttgccttacatcctgtgtgggaaggaagtctttccttcctggaggcaacgggtaagaagagcaactagacagtgtgtagctccttactctcggtaggcatttcgtcatatggagcatgacttattgacttgcttctgttctttctcatgagctactcagtgtcaggagtacagggcttgacttaaacatagggatactcaaaggcccacctggcagtttgttgttgggacacagggaagcagattgtgtctctgaagaggaggcttctgtcggtgtcagagcctggtggggaagaagggattggtcaatatttggctaaactccttcagctgttggtgcagcaaaaggcatggcagggcgtgggcagagatgcctgccaagcccggcctcagggcatgtacagctcccaaactggttgtctttgaggctgttatttatccaaataaggagaagcagtagttttgctgaccatctcagatttccaagccatgctccctggctggctgactgacttgctatttgaactgaaaacacgaaggtattcctttgaaatggagcagtcttgtggggctcgtgagtaccctagagtcattacttggaagaagattttttttgctccccacatttgtagataacatgaacatggcttggtctatttgacccttctcttgtgactctggcaacactcaatacagatggacctgatctgggacagaaatagtactcattttcagaggttcttgaaccactgccctcctttgaagaggattcaaaggtcagacctccacactgatttcttaacactagaatgcaagattattctagcacttcatagatcctggccctgttatctgacttcaggtaagatatttgaagtctctgagccccagtttgttcatctgtgaaatgggaattataatgtatctaatgggaatgagatgagaattaaatgaggtaattttggaaagcattggtaaataggaagtcacccaaaatattcattttcttccctatttccatcttctcttggcagatttaattgacaatatttataatagagaaattctagataattatgattgctgtccaaaggatttaaccaagctcacagtagaatggagattgtgatgtgaacgttcagtgaccctgcattactatgtccctctactcactaaagcagtggttctcaaagagtattccctgaaccagcaggtcagtatcacctggggacttgttagaaatacagattcctcggcaccacccgagacctactgaatcagacacagtggatgttagacccagtaatctgatttactaaactctccaggtgattctgaagcccaccatctgagagttggagaaccactgtccgagagtaactcactggttgggtcggtagtctagccattcccccagggcacctggactttcctatcccttgtccttgaccatgccttagttcctgcctggaatacctaagaaagggacctctttcttacctgctgaaattctattcatcattcatgaacccactctcacctcttcagaaaagtgttcctcagtcatccccaccataagaacctcattattctatgaactaccagagtatttgtctgttgcactcatttgacacttagcaaagttattcttgctttctcatattttaatgttcacgtacatgccttatttttcctactagaatgtaagttcttcagaggtagaaatcatgtcttacagatcccttttccctcatcagccttaaccctgggctttgtatataggtagctactctgtaaatatatggacccacagaatctcatcattggaatgggccttagagaaagtctacatgagatttcttatttacagataaagaaagggatgttgaccaggcgtgatggttgacgcttgtaatcctagcactctgggaggcctaggcaggaagatttcttgaggcaaggagtttgaggccagcctgggcaatgtagtgagctcttagctctacaaaaaaaaaaaatgttttttaattagctggggatggtagtgtgcacctataatcctacctattcaggaggctgaggtgggaggatcacttgaaccaaggaattcaaggcttcagtgagctatgatcacaccactgcactacaacctgagcaacagaatgagaccctgtctctttaaaactaaaaaaagtgaaaagaaagaaaacaatgttaacacctggaccaaaatgctagttccgggactccccatttggtgttcttcccccatcaccctgctgtgccgactgcggagaaacatacctgggggctttcagagccactggcctggccccaaaactagcaggtgttctcatgttctctgccacagacttcaactaaacccaaggaaagcagatgggttttcaaagctatactcatttaatttataaacctggaacctcttacattttttcataactaatgaaaactgggaaagtacaaaattttcattcataagcctataaaattgtataacaaatggcatcaattcctagccttacacgtgagaatttccccagctcacacactccgtatacttaggatacccatggaacttcttttatttttgaataaaagttcacagtgaagatcattcacagtggagcaggcggctcttctgaacccaggaagaatgggcatgagggcttttttaatctaggtccccatcattgtttttttcatgtttattttgaggaaaaattgaacctggcagatctgtgaattactgtctttcggtgttaccctctgggactattccctcagacaatcctttcttctcttgacacatgggctgatgttgtttggctgaggatcaaaataatggcacaactaaaacacctttcatcagaagtcatccataacataccctttaaaatttgctccacagacacagctcactttatgctgtatgttttttcttttgcttggtaatagaacctacacatatcctactgagatcaatatgaacacagcagaatgcaggcaatggaatgtgtttcctgtagacgggctaagacggtaacccaggtccacagagttggtttcagaaaagctataatcaaagaaggaggaacagtgaaggtagacatgagacaggcctgaaggggttaaacctactagggagcaattggtagtaagaagctgagaccacatgaggctgtgagaaaggagttattacagaaacagacatcctgggatttgagtagctccattgtgagaagacattgacagaccacgaataaatggccatatggtttccaagttgacatctgccattccccaatgtgtttaccaccattttctctcacgggctctgaaaaccatctatcctttacactgcaattgtatagtgtgaaattctacatagatcaacatcaattcattgtttcagtttaggtatatcatatcatcaaactaaaatatatatacattttaattttcatgctgtaatcatcctaaagttatataacactccatctagctgttttcatatctgtcctttaaactgcaattgtagagcataacattctttttttgtttttgtttttgttttgttttgttttgttttggtggtggggagacagagtcttgctctgttgcccaggctggagtacagctgcataatcttggctcactgcagcctccatctcccaggttccagcaattctcctgcctcagcctcccaagtagctgggattacaggtgtgtgctaccatgactggctagttttttgtacttttagtagagatggggtttcaccatgttgtccaggctggtctcaaactcctggcctcaggtgatccgcccaccttggcctcccacagtgctgggattacaggtgtgagctactgcacccggctgtatagcataaaattctacacagatcaacatcacctcattgtgtaaatttaggtatgttatatcatcaaactaaaatacatatatacattttaattctcacgttgttgtaatcatcctaaagttatataatgctctacctagctatttttgttcacgatataatcaatttggtcagtttctccagtgaaaagaaagaagagcatagagtgcagcgatggagaccctgtgcctctgtgggtggtgcatgcatctctgaggggcatggtcctgagaatgtcaccccataatggaattagggttgtaatggtaagggattttaatcagctaaggctcagatattttatttcataagtaatccggtgcctgtgactgatgatgactttgtgcatgcttctgtgtgtacatatatgtatatgtatacatatgtataacttgtgatatggtgatatccatatagtactgagtgatgtataatatcgataggtatatataagtataatatatataagcatatatactgatatatctattaaatataactaatatataactaattatataacttactcattttgaggcaagtagataaaacctaattgtaagtcaagagaggctctaaatcattcgagccgaagcccagtgagatgccccagtgattcttttcctttgctgtgaaaatctggacctgtgaatggagtgaggtacttctcaacagacttgttcatgtttcacaccatggccagaaatcgaataaggaatccatcagtgatcacgcgtgggcaggcatgaggaacatcgttctttgcagaatagcttgcagtgtcctgaagtgcacagcaggtcacacgcaaacaaccgaggaagctggggttcttgctgcctcactgcttagcagctatgggaagctgggtgaggttcttaactccctgcacttctgtttcccaactattcaaaaagacataagacacctgttctatgtctttcactgagttctggagcccatgaaatgtcacaattgagagccctttgtaaactgcaaactgctatgtgattattggagtgtttgtgggtggggtatggtgagcacggggatttaaaatctcttgttagaatatgaagtgtcacaagcaaataaagcagtatatcctatatggcaacatgtggttgacaagttacatagtagtttcaagaactgtcataaagagaaaaataaagtctaaggcgctaaaaagttgtagttgggtgccgcagataacttactagcatccaatctagaaaacattaaaagggagctgtgcataaaagaacaaggttcgtccaggaaatgggtggatgtgcagagatggagataagagaaggaattatttgtaccatctgttgcaagtggcataaaaaagatatcattttacaaactgtaactatttttggtacaaaaggaggttgtccttggcctggggaacatgggagtagcccagcagaagattgagtgtcagtgagaaggacatttttcttttatccatcctacagcactgcacaattattgattgtggcttggaagcgaaatgatttatttaacattacttctctattctgctccagattgagatctttaatcactgttggacccaggactggtcagccaggtctggccactggagggctcagtagagttcctctgtcaaaagatttatagaaataacgctcatcttaaatatagccataagctaaccgctgactggaccatctctttcctgggaattaaataattttggcagcagtctgtctgtctgtctgtctcatgtctgggagacattccgtttacaatcaaatgaaacaataggctaactaaaaccttacaaatggcaatcttcccaattttaccaatgcaaacaagatgaatttgaaattttttcaacgtaataatcccttcccttcctaatatcatcttcatatctataggcacagttcagattttctttgagcaaatgtaatttttttaaagccaatgaagaaatgaatatgaaagggaaaataggaatgaatatgtgtcacaatactattggccttgccagagcataaaaattacttcctgttgaggtaatcctgaatatttcctagcacgtccattcttaacactgactcagaaagaatacattgcttccactttgcttttaggcctagtcaatgaaaggaagagggaaaatgaagagtgggacactttatacactgctgggaagaggaacgtagtaatggctgtaatgtcccaaggtagagaaggcagagaaggatctggtgatgtaatcaaaccaaagcgtgggggtgttagtggttgcacacactcatactgaaccaaactttatggtgagttagcctgaaagagcccttctctggagaatgtgccttccactgagataaagccactgggtcctagatggcaccaggatattgtttaggaaattggcttgtctggttcattagcaggtactctggggcctttggagattgaactccacctctcttgggtgagcttggcgcttgctaaagagcatttaactcatcctgattcaccgcaggattgggctggctttcaaactcctgacagtgaattactgctcttgtaatgacgaatccatgcatgcatgctacagacagtgccctggagcattttgaaagtgaaaggaaattgctgtgaacctggcaggaaggaagagaagggagaggtaaactagacttcttctcgcattgaaccgaccgactctcattgtaacagggtcaacagaagccacctctctctagcgtaatggacatggtttcttgtggttttaccctttgttgcttttttttggagccagggtctcactctgtcacccaggctggagcgcaatggtgtgatcttggctcactgtagcctctcaacctctcaggctcaagtgatcctcccacctcagcctcccaagtagctgggaacacaggcatgcaccagcatgcccagctaagtttttactttttgtataggctgggcctccctatgttgcccaagctggtctcaaactcctgggctcaggggatcctcctgcttccacatcccaaagtgctaggattacaggcgtgagccacatagcacctagcccatagcagatatgggataacatgtcgaacatggcatgacttgcttagccaagcagcagagagacagagagttcactgtttgtttcctgggggacagcctggccccagacccttcacatacagtcactgggacaagcaaccctgcccataataagcaggtaaagaagaattataagagccatgtctgttagcacacctcacgccataagacagggtctttggaggatgtgataggggcggcatcgtggcctaatcagacaagggggaccactcctccatcccccttcctggaaagtacgtgcttgactgaagacacaaaacaaaacctgcctaatgtataccagattcatcagaagctgatagtgtgtgcctcccatactctggtgagaaataacaaacccttgctgattagattaaaagtcaagagcttccacattccttctactgttttccgacctcttaggtggcatctgttacaaccacttcatccaaatatttttcctagtgagacatcttaggagggtggcaatgtcacgtgctccatttgcccccttctttaataaccacaaagtgatttgatggcagtaaacagtttttttagaaagcctgcaaaggactggatttgaacttgaaagacgtcatggaattcttttggtcagcaagaacaacctctaaaagccttaaaatgttttaaaaatgcacaggctgcccagagcgtggtagttgggtgtggcgtgaagccagtggggcttccagcccagtgagtggagttccttgtcaccgtattcccacttggatagctttcggttccacccagtccccaagggctcagaaaacatgatggtaatcagagcctgcctgggagcgcaggagatgcttcctttctcccccaccttttgctagcaatgcattaatgccagtcctccgctgagagctgcacaagtcacttcgtgttgtggacacgcaccttcttgtacctgttcccctggaagataccagctgtgctgacagcggttgtagccagaggtctctggggatcgcctaccttctcgtccttcatcttgtttagggtggggcagaagggctctggtttcctttccagaatcccctctgcacagccctggtttgccctctctatctttccttctcgtttcagatgtattttccagggtgattgcagttccttgcccggcgctatgtaggactgattaatggctgctacccaaagttcagcgtggtaaaacagggctggttaattaatagacagcctccttatctccctcatgttttccctctggtgttaaaccaggagaagaggcttacgtttccttcagctgccaattcccagacttcaaaagtctggcagcaaagtgggtattgggtgctggtctaggtttttgcagtagcacctttaagtcaacagaaaactgatctgaaagttggctcctctggattgagtatgttgggttttttgacagtttcatttctcggtggctggttgtttgccctttctaatgatcctgtttgccttcagcgaaatatattttgtaatatttcctttgctgttaacccatttacctaggccgtttaaagttccttcattggtgttttccctgtaagcagttgttgaaggactgagtcacccgtgaggtagcctgtggttggatgtgggctgaggttattcagtgactaatttccaaggggaggagaaattgacttatcacggggaaggttactttttatccatgccagtgtcagcttctctccgaaaactgggtaatacgaaatggtctttattggttgtgaacactcgagctgagaaacattttaggatctttgtgtcttttgtgatgattttgtttctgaagaggaagctgtctaaaatattcaagtgtgcaaccaaggatttagatgaagccagcaaacaaaggaatcatgtaatcaggacctgagcgaatgtgcttactcacggcgttagttacacaggtgatttccttaagaaaaagtaagtggctttaattctttgagggtgaaagagtgtcttaagattccatttcagttttctctgcttacttcattgtgtggtctgattgagtggtatgtttacaaattctagacttggaagggtggggtttgaaatacaacaaactgtacataatattccttttccacaagcaatatatatatatataaatgctccacagacatgattacatgaggcagtttcccaagatgattttaaacaaatattttttatactaggttttttttttctggaaacaattttaatatgttgtttcttatcttacgttcaagaaacttctgaatgagtgatattcgatttgacttatggttcttttgggaaataatatatagctacatgtaagaatttctaactcagacttcagatcttaatttgaaatggccccagatattttctggtgtttcagaagtatggtgtaaacagcattttgatccgtgtgcagtctgtgggcagggacacctgcctgtcagcctgctattatgatgaggctcttgaagaaactaccctctttctaagaactggaagaactcaaataatgaagagacaatagaggtttgggcagtaatggaaagaagaaaagacagtgcctagccaagcagatgaatgaggtagaacagtcttgttcatacattgccattatatctagtgcagttgaatgaacattttctgtgtctgggcttaggtgcaggcaaatagttatctgtgttgtattcagataaggggttagaagaatctttatttttctgtgtcggtcatctctttcttgctgtaaaatgaaattgtttaaagcttacattatgacattagtgttgaaattctgtggggaaaaagtgtcaatggtacaacatagctagttacttaaactcactaagggaaaagagatgataagattagtagcatcagagagatcagtggcagaataagggactgggatatattaatgtgaatggcaactcgtatgtgtgtatgtgtatgtgtgtgtgtatgtgtgtgtgtgtgtgtgtgtgtgttgcttatttattttctttgtaagtttagtataattttctcccacaaggtctgactttgagtaccagcgcaggaaaaacccagtatgtatttaatgccatgtctttactcattagccaaataacagttaaaaaccaaaacaaaataaatctgtgttggtgacagattctaggaagatctctccttagtaagaatacccgcagcaaaggctgggtttgttttaaactgtgaattatacaatcttaaccatcatgctgcttccatctatcagattctggagtctctaaattctactttttattgcaagtgtgaccttggaaatcacattgaagacttgaaaacatccctccagtgatgtccccttaccttcccccacatcctaagagcgagttgccttaggttggtccctgtcttttatggtaggattcccaagttgtctgatcgtaagggttcattctagttgtggttttaaaacaaatgtttcccactctatattgggatcattgtgtcatttttcttcttgggctctgtttagagccaaggatgaaatacatgatcctggttctttttaaaactccgtcttagaaagtcagtcacagcttggcaaaccaacataagaattctgccaagacttccaacatctaagtcacctgtgttgatagagacattcaacctcagattaccaattctgtcacaaccgaatgtttgtattcagcgccactgtggataactcagattgatggtgactctttcggtgacccttttggatgatggcaagattattttgaagtggacagggcagggaagacacacaggattagctccagatccgggctgctgactgttcatggcaagcagccgtcctcattggctgaggtcccattctggttggttggtgtccatgccatactggatattagctgtaaaatatttcgactatcactggtgtttcccacatgaatgcccaatacaatgtatcagaattacttttagttaattgttatatttctttctaatctcatctatacataccactagtaaatctattgagatattctagttagatctttaaatgtttcattttaaaggttatttatatatctcctaaccattttttgcatgtcaccaagcatgtttttaaaatacctatgtaaatacctttgctgttttcaaagaaatgtactcaactttttatgaatttaaataaattttacattttctttttactaatattatttatccttctggacagttctatactctctagaatattttattttattttattttactttattttattggagacagagagtcttgctgtgtcgcccaggttggagtactgtggtgtattcttggctcactgcaacctccgcctcccaggctcaagcaattcgtgtgcctcagcctcctgagtagctggattacaggcgcatgcactgcgcctggctaatttttgtatttttttatagagacagggttttgccatgttgcccaagctggtctcaaactcctggcctcaagtgatccgcccacctcagcctcccaaaatgttgggattataggcgtgaaccactgcaccgagaccctagaatcttaatgtccctttttacactcctgccaaaaagaggaaagcttctgctggttaattgggatcgtagtcccccagataaagatgtactctgaaggtggctaaggaaggaaaagagaacagggaatagtgactgacctagttaggactgttgttcataccaagagggttctagatattatattgattgattgattgattgagacagagtctcactttgtcacccaggctggagtgcagtggtattatctcggctcactgcaacctccacctcccgggttcaagcaattctcctgcctcagcctcccgagtagctaggactacaggtgcatgccaccatgcccagctaatttttgtattattagtagagagggggttttgccacgttggccaggctggtctcgaactcctgacctcaagtgatccgcctgcctcggcctcccaaagtgctgggattacaggcctgagccactgtgcccaggcagttctacatattttaaatatttttctggaattaataacaataatgacaacagtacctaccatttgttgtatgtgatttgccttggacactgtgtaatgctttataaacagtggcatatttgagtcgatgtgatgaatttatctcgatgtttgttttggttggttattgcattgtgtaatctgattatgtggagaatttgcccacatatccgctgctcgctgagccagtccctcctgtattttatgacctgtgaagccctgtgctgcttcctgctgagccatactttgctttttattgagccctgaattgtgaaggcagagtgagagaggtatttatagaggatccgtgtcgctctcctgcaaaacctgtgtcacgcggttgcccagcctccctggaatgagcatcagtcaggtgtattatcatgcaatgaccttgggactgttccttctggtctaaagcactgagcacctgagtcatgagggtgtccaatgagcagggaggtcctcatgggctggagcatcagggcaggggccatgcagagcagacgcacctggagcctgacctcgaaccttcatatggatccccaagaactagcacatggggagagagaccctggagtgaggacagcatcaggatatcacaagttaggtttagagaagggagaacagattagcctatcataatgggagctctgtgtgtgttttgggaggggagtagagaggaagtggagataaaattgtaattgtgagggaggagcctgcatactccagggggcccagaaatagcccctataggagccaagaggccaattccgtggtgcccaggtcatgtattcaaaaagggctcccttttgttgctacatattagcaccttatttgcacttctcattggtcactttcattatgaaatccacttgtctatgtaaaacttgcagggcagggattctacaccgctggatccttccaggagcaagataaggaagccatgggagtcccactggttgttcctgcattcttatctacgaagtttaagaaagaaggtgccctctccatggcgcttgggagtttccatggaacttgggggcttctttagaactgtatcctagaataaccccaggcacttaccaagtgcttggtaaatactctttactacatgcagtgaatttttgtgataaagaagcagttagtttgtatcctgtgcattaggctctgtttcattttcaaccttctcctggtgcctctactatccctactgtcttccacatcatccacatcatggggtctcttggctgctcatcttggttcttgccattcaagcccccacctctttcctcgggtccctccctcatccaccctccaaccatttatacccttcttctctgtcacatctcctggaagtcaggatagggactgtgggctcctgtgacctcaccaatagaacttgaagaatggatggagcctgtctctccttccctcagttatttggagaatctcagtggtcatttccccactgcaccttgaccaaagcaaaaatatatgaaatcatcatatcctgagttatttttttttttattctactcccttgctaaacacagtaacatagttgcaaattacagttgaccattgaacaaggtgggagttagggatgctaagtcccccacacacagtaaaaaaaaaaatcagtgtagaggccaggtgcagtggctcatgcctataatcccagcactgtgggaggccgaggcaggcagatcacctgaggtcaggagttcaagactagccgggccaacatggagaaaccccgtctctactaaaaatgcaaaaattagctgggtgtggtggcacatgcctgtaatcccagctatttgggaggctgaggtaggagaatcacttgaacccaggaggtggagattgcagtgactgagctgagattgcgccactgcactccagcctgggagacagagcaagactccatctcaaaaaaaaaaaaaaaaaaaaaaaatctgtgtagaacttttacctccccgcaaacttaactactcacagcctactgttgaccagaacacttacagatgacttgaatggtcgattaacgcatagcttgaatgttatatatattatatactgtattcacataatcaagtaagctagagaaaagcaaatgttcttaagtaaaccataaggaagaaaaaaatgtgtttcctttctattaagtggaagtggatcatcataaaggtcttcatcctcgtcaacttcatgttgaataggtgagaaggaggaagagaagggcttggccttgctctctcaggagtggcaggggagggaggatatctgtgtatcagtcaacctgcacagttcaaagctgtgttcttcaagggtccactgccattgtactcttattgcttaattatttccttccagcctctccatgctgatttctcataggctcaaatgaagagttggtgaatgaatgaaacttcccttccaggttttcccccatgcatctcctttccccctgctcatctccctagattgtatccactttgaaagatgggaaacatggttactatttcccagggctaacagtagaaaaacgtgctcaggacaagttttagaagactcagcgtgagcactattgatacactagacctgcatttattaagcagcatctctaagaagctgtgacattaaaatttaagccaccacactattttttcctgaaatcccacaaaattgcactctccatcaggtgtattcatttcttgtggttgctgtaacaaattaccataaatttagtggcttaaaacgtcatgatttttttaaacaccataggtgtatcattttacttttatggagatcagaagtccttaatggattttgcacatcaatatcaatgtgtcggcagggtcatcctccctctggaggctccagagtgggatccatttcctcaccttttccagcttctagcagctgcccacattccttggctcatggccccttctcatagcaccttccaaactcttctaaccctacttccatcagcatagatctcccctggagctgatttccctgcctccttcctccgcatataaagacccttgtgattgccttgagttcaccaggataaagatctcccatctcaccatcctcaacttcaccccatctgcaaagtctcttttgccatgtaaggaaacatattcacagattccaggatgagggtgtatacatcttgcaggggaagtcacacggttacacactgagacttctcttgaaacacgaatatcaaagtcaactttctgatcccttgttttcttttcagatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccaggtaaggtgcagtgagggtgaccgagggtggtacctgggcccatgtgtcactgtgggcagctctacaggggtcaaaccgacagaataaatgtctgagcacccatctctgcagcatgtcctgtggatgctgcaggagtcacagagtggtgtcaaagccaccattgtctgcaaatagtttctaaattggcaggggttacagtcattaagccatgttcaagaagacaggtgcagcaacaatagtaatcagtcccttgtgcctctggagcatggatctaagagcattatcatttgtataaatctgaataatttggaagaaaattgtcattagcagaagacagatgaaaagatcaaaaggtcataataattgatctgctactgctgaaaataaggagtgagtgttttcagttttaactgttggaaatggcagtttgtgtttttccttgtggaatacaattttgttttctcatctggttgtgggaagtggaaataatgtgtctgttttctaggaggataaacatctgaatttgcatgaaaatagaatggcttagatttaatatttatctaggagtggtgctgaaatcagcaaaatttttccagggaaagactctctggggacttgaatttctttttaaatagacatattttataatttaccaattcagaagcttcctactctatcttgaaaaccttccaaagttcatatagtaatagaaaagctaattttgataaagggaatttctctagcctgaattggttgaaacaagtcaacataataatcataaaaatctagccaaagaaattgagtccaaagaaggtttaagcatgctgctacctattgttatatatgaatcaaggggtatgaaaaataagatgtccaggccaagtgcagtggcttacgcctgtaatcccagcactttgggaggctgaggcaggtggatcacctgagctcaggagttctagacaagcctggccaacatggtgaaaatccatctctattaaaaatacaaaaattagtcgggtgtggtggcaggtgcctgtaatctcagctactcgggaggctgaggcaggagaatcacttgaacctgggaggtggaggttgcagtgagccaagatcgcaccatcacactccagcctgggggacaagagcaagacttcatctcaaaagaaaaaagaaaaataaggtgtctagatattcagttattcaataccttattagaaccactgcttctcactaaaaaatgttaatatcacttactattatataccatgtaaaaagaaggccaaaattgtgaatggaatgtgacctgtctaccttactgttttcacacacaagtcagaaagccctgaagtcctctttagcacagttttattatgaaagggcaatcccttcttacttgttcagttacagggaatatcatagcagaaagattccaggagacagaaagagaaagaacatgaaagttctgggatcattaatgaaacaaaagttctaactctctcatgtagctagaataacaacaacagtgaatggcttgatgatgcaggactaagaaaaaataaggattggaaaatagtattcattctctcctttccaaagtcctcatgaagtgaaattctaagcatcaaagaaagggactcttcccgtcactgcagacagctaaggggtataggataaacactcatagtggttcatgggaacagaccaatgtgacatctggagaggaatctaccaagatgtgcgataagtcttggaagcctgtgttgcatacttcacagaaaggataacacacctgtcccctttggcaggctttgaggtgctggttgggaaatggtatgttgctgaggggatggaacttacgggagcaagaatttagaccagaaaacaataaagataatttgtctcctgcatataatgttgagagccagaatcctacctcccacactgacctatcctagataaaagagcatcaggagcttgattttgccatgaccatattgaactgtttccaccccggttcttggatgataaaaacctgaatttgcatgaaaacagattagtttagatgtaatattcttttgggaatagtgctgaaattatcaaaatttttggccaaccaaagatggtgtctgccttctttccagaacctagctcagtgtcatctgtgtgattaccacgcacacacaacttaatgtacatccttgagcctcacttttcaagacgtttagttatggagagaataaaacaaaccctctgctgacctgtggagtcatctctgtatgggatcaaaatcttgaaagattttagcttttggtactatgggtattctttgagagcctccactcccttttttaaaaaagatctgccaaccctagagacttccattttgtaaaatttcagaaaattctatggacttcagttttacatgttagaaaacctttttagaaaatccaaattattctatttccagattaacaatataagaaaaactgacaaaacagatgaatattcacctaaaatacagtcattatcaccagtgtattctgacatatgattgtaattatgaatgtaattttacatgttcacatttttcattccccataatgtaaaatagcacaggaaaaattttatctcatacatcttgccaaggtgactccccacctgtaatcagcttatctccagagggtggaattggaatgcttgggtatatgtgggccggttagattctcttttcctagagacctgcacatagacacacagacacacagagacacacacataccacatggacacacaaagacacagacacacacagacacacgacacacacacaagacagacacacctacacattctctctacatttagactcactattgctgaaagacctaaacactccccgctaactcccctcagtcacatgtcaaaggtgaagaataattctctggtcaaaagaacttgagtctggaacttttgccctcagcactcctacatgcttcccccattgtttcttacatgggacaaagtgacaagggtgaagctcatgccatacttcctcctccaaggacagctcagaatctggccctgaactcttttagatatcttggtaactaggctgacatgtagcattcctggggaatgtataggaaggaggtgaatggcacctatcatttattgagagccttttatgagccaagcactatgtgaagtggtttctatacattatatgatgtaatcatcatgacaacccagtgagatatgtactatcatcatctcctttttacagatggagaaactgaggctcagagaggttaagtaacttgcccgaggccacaaagccagtaggtggcataaaatgtccaggactattaaagaattctacatattccatgctgtttaccactgtgcagtattctgccttgcaaatgagaactataagccccacctccacacaacagagaagttaattcaggagtgaattctaaacatttcaaccagaattcttcaaaaattgtttcaggactagatgctaagtaactgctcctaaaggatatttacaatcataaacacagtagaatttgcataattatgctgctaaatatacacatgccattttaaatataactgccctagctagtatattagcacaattatgcagaaataggggaagaaagaggacagcattcttggtagacttcatttttttaaatgcatctgagtactatgtcaaagaaaaatgttaaaaacaggaacatcagaaacaattaccgaagcacaaaattataatccattgtctcatctataccatgatgttatttagaaatgcttaatctgtgtaagtattgttaaagaattttcaaccccttaaagcttaacttcatgagcacagggtcgtataaagaaccaatccaatttctgttgcaatttcataatattaaaaagcaaataaatatgagagtgtttttcatatgagagtctcaagtgacattttacatcgaagatgtgaagctgcaaaaacaccagtgggaggctgagaaatcggtggctgtgctttctgttggcactgctgggttcttatgctgttctgaagagcacttcaatatagtagcccaaataactgtgggatgttagaaatcagagggaaaaattcttccttccacatgcatactttgaagacatccagtggtagcttttttgaaggaacatgatttggtaacagctctgttgacttgaaaatagctcactcaagactaagtaattgagtcttcagtcttatatttagtcacataccttgtgctaatgaatttggcatttctttctttctaaagatgcttcaatgagcatctagtaataataaattgcatctagaatatctgaagaacacagtgtctatggtataacattcttgtgatggtaggggtctcctaccagggactttggggtacagtgacagatcatagctgctttgactttcagaacagccattctagtgtctgagcttctagaaaagaaagcaatcttgagtgatgaagtggttttatccaagtgacttccattcagctaggactccaagtagagaatagtcctagtgaccaggagagactgcccaaggagaccatgtgtgacaaatggcttagtgcctgaggctctgtcttctctaggttgtaaaattacttcattaaacagcatcattatttctattcatggcacataaaacagcccttaagaattgtaaaattctgggacatttatgttttgctattttctatttgtagtttggatcatatactgtaatgtaaaatacctttagtgaaataacactcaaaattcaagagtgcttatcgcaaagtgactaccttgccttcgaaatatgtaacagattcctccaaattgatttttcaggacccagtaaacttgaactgagattgtatttttacactattctatacctagagcagctacattcgacaaattagcatagagttacactaggaagaaaaattttgcccattccgagcacctataactacagaaaagcaaacaacttgagtttctattatgatttttgaggcatggtagacttagcagaaccttctgtgtacaggaggaagcccacatggcaactggcagcttgtgtctgctgttaatcatttcacatcactttctcattttatgaggattcaatgttactatgttggtaacttttaggggtgagatggatccttggttaaacagttgatcaaatgaaagtctaaattcagatttatgtcattgaaaaatgttcactgcgactggaagacctttgaagatttcctaaaccatgatttatcctcctagaggacagtcagtttgaatgatgggaaaagaaggattacttgctttcctttcttgctggtatagtaaaaagtgagccacatcagcgatatcctaagtagttacagttagcatctcggtaaagcagagtttcttaacctctgtactgttgtcagtttgggcctgataatttgctgtagggggctgtcctgtgcattgtaggatgttgtcttagtccattctgtgttgctataaaaaatacctgagactgggtactttgtaaagagaagaggtttatttagctcatggttctagaggctgagaagttctagggcatggccctagcttctggcaaggccttttgtgctgcatcatagcatggcagagaaggtcaagggagaagtgaacccaggcaaagagggagaaatctgaggggggtctggtttcctaacaactcactctcatgggaacaaattcattactgatagaatgaatccaatctcttaaaagcgagagcaagaaatcactcactacattgagaacagcatgaggcccttcatgagggatctgcccccataacccaaacaccttccactaggccccacctcccagcactgccacgtgggggatcacatttcaacatgagttttagtggggacaaaccatatccaaaccgtagcagatgtttagcagcatctctggcctctacccactggaagccagtagcaaataccaactaccaatcctgacctagccaggataatcaaagacatctctagatattgtaatgccctgcccaggggggcaaaatgccccagcttagaaacgttgctctaaaggaaatttgaactttttctacttttaataaaatagagaaatgaaagaataccccatgttcaagcaatgtaaattgtgacattcgtaaggcaaggaccaggacagttattacctccattctgccctcctcctcgtgataaagcaactcattattgatagagcttgctatgactaccttcaggtcagtcaatctgctcatcaaccagttgttcagaggcagtaacttgtaatggacttccaagccagagtgcctgggttcaaatcccagttctaacacttgccagcagatgggacctttgacaaagtaccgaatcttgctctgcctccatttgctcaactgtgacatagagataataatagtatctaccccacaggatgcaacaactcattacagttcagtgtgttatggcagcctgggatatactaagtggctgagagtttctagtttgagcaaagcactctactaagtgctactaaagaggaatgtaaatacacagagttggcaaggatgaggaactccccgaagaagcagggagagacatttctgaatataatatcagaaaacacgtaaggtgagcaagggtgagagaattaaactaaatgtgaacacagaatagaatgagctgggcttacagatccaaattagaatgtttagagtatcaaaactgcttcgaagttcatttcaggaaagtagccagggttgcacatctgcttgggtccaggggcaaaaagacaagctaggttcagggcatccttttaaaactgcatctgagctataagactgaagataagacagctaagccaggtatgcgtgaaatcattaggttatctgttttgatgcctaatagtgcttgactgattcagctcttgtctgaattgctttttcatgtagctgtaattatggatcaataaatgtttattgagctgctcttatgtgcttagctgtggactggaggatttgctgcatacaaagaaactgagatatggttcccatacaccaggaacataaaccatgaagacagtcataaaatattaaaagcttaatataaacatataagctttgtcacggtttaagtacaggaagcttcggagttacaaatgcctactgaatacctgtttttgagaaacaaccacaatcattgaatttcacacgtgatatttcttttggctttggtgatgcccagggatgctcttcttgtcattcctgagagtgacaatgtctccttgtgagtcagagaggagagaaggggacatgccaagtcacatggcacccccagaggcttgagctccagagaaagatctcttcccagcttcccaaagtccagcttggaagtcaggacacgttttccttgaaaacaatgaggaacgacgacaggactaataatacattgtaggttaaagaggcttccatgggccagctggaaatccaaccaccatttattccaagttctaaacaatgaaagtacaagtaaacttttcaatgacaagcctgccataatttggggtctgcttgtacataattaattccaaagaagtgatacagacggtaattgctatgaattcagaaaagggaacattttcccaaagttatgtgggtctcagagccttcttgagaacattgagatggtctagaattgagggcatgtacgtaatgaaaagatgtcatttgggaaagaccaactagtctctatccaaaatttgctatacttttaccatcatggtacctataaaaatgacatctcgatatgatgttttgccagtctcagaaatcaagtgctgaccaactgaattgttatttcgttcacaggagtggaatttcatggttaagtcatatttgctagttattccttagactcctgagttcaggcatcagatacttgataaacatactagaccaactaacagatttatgcagctagctctattcttacaccagggatactctgtcagaaatgccaatggaatagcagccacaaggtctgtgtgctactttaaacaaatcaatatctcaaaaggaaaaggcgtcgtctgtcactaattagatcaaattaaaatgtgctgctgtatctcctttgaatattcatgaggtgctctcaatcagaagccctaagtctgagaccagaaacttaagccagaaaaaactaaatactgtgagattcagataactcggtcctttgccaactagaacttcaaagagaagaggaatagcttaggtgcagagtaagcctcctgaaaagatgacaaaatcagcttaatgcagaatcgtggggttcccacccaacctaaagatggatcgtcaaaatagcccaggagctgataatcctagactctgttgacacacaggacacatagtttagcctctcttgtgatttacttgtccttctgtctggcggaaaccatggagattacacttgtccttatttgaattctggacttcatttttcatgaatgaagtgattcaaaaaatacagctgggtctaagcatgaattctaactttcaaaaatcacagatcttaaaaagtctgtattgaactgggtgcagtaactcatgcctgtaattccagcatgttaggaggctgaggcaggagggccacttgagccctggagttcaagaccagcctgggcaacagagtgagatcccatctctacaaaagactttttgaaaaattaggtgtggtggcacatgcttgtagccctaggtgctcaggaggctaaggtggaaggatcacttgagcccaggagttggaggctgcagtgagctatgattgcactactgcactccagcctgggcaacagagcaagatcctgtctcaaaaaaaaaaaaaaaaaaagtctgtatatactcatgcagggccaacttgtatcaccagtaaatacttcctctgtctccttgtccatcctcaaagctaaagagaccttggagaatactgggtcctaatagctgactttacagcaggagaaacagcaaggagacttcctaaaggtccaaggatgggagctactctagttaaatgacatttcgctatcctgctgccttaagggtggctccagccattgctcttgacctcacagccacccactgggccactccacctccatctctcacctgacttgctacagtggtctcccaaaaggtctccccactcagtccctgcccaccttccgcctgttctcattggggaggccagagtgaccccgttaaaacgtgagacctttcatgtcgagcctcagctcaggactcgccgtggcccccctcacattttgtctttgcaagcacaagtaactaagacaaaacaaaaaggaaatgcactagagagaccaaatatagcaaatgtttttttcttttccctaagagtcattattttatttcttttgagtccgccctaagatttacagctctaaagcaggcgagagtggggagttcatttccacagtcaccatgaggtccactcaagagaccatctctcctgacaccgtctctcatttgaaggtaaattagctggccgtgttcagctggcccataacatgaagcaactgctattcctacctgtttgtacctgtgcaaaaaatgagatgtcaattccagaacacaaatgttccagattagcctcagggaagagaaagaaaatgcaaaacaggtgatttcataaagcagggtgtaggcttgccctggggagtggcggctctaggcacccagcagagagccaacaggaagtgaagtgcctcaccctagatgtgagtcactaagggaggcagctcagtgccacagagagccctggatccgagaaagcctgcaagctaattgatctgtttccctaagaaaagccctgcctggctaagcctcagtgtcttttgtcctaataaggggatgataatctactcaagagttctgtgcaatttttatttttatttttattatatttatgtgtatatatatgtatatatgtatatgtgtgtgtatatatatatagatatacatatatattgatatacatatatatagatagatagatatacatatatatatatatatatttttttttttttttttttttttgaaacagtctcgctctgttgcccaggctggagtgcagtggcatgatctcggctcactgcaacctccgcctcccgggttcaaacaattctcctgcctcagcctcccaagtagctggtattacagaagcccaccacagtagcccagctaattttttgtatttttagtagagacaaggtttcaccatgttggccaggctggttttgaactcctgacttcaagggatccgcccacctcggcctcccaaagtgctgggattacaggtgtgagccaccgtgtatggcctatttttatttttcaatgtattattattttagagatgtggtcttgctctgtcacccaggctggaacgcagtggtgcaatcatagctcactgcagcctcgaactcctgggcttaagcaagcctcccccacctcagcctcccaaaatttggggattacaagtgtgagccactgtgcctggcagagggacaagttctgtgcaatttaaatgaaaatagctattagatcactttgtgtactggacagttttctatgaataaatttttcattgacataaaaccatgaagccatagagttgtgccagcccttcggatctgaggggggttgtgtccttattcctgacttggggctgtttcctggtcccatccagaacagcctacacagaaagtgaattgtgaaatagattaaaggctgcctggagccttccctaagtgcatttgctgtgctgggcagagcactgctagaacctgggaagccaattgtgcatgcggggaacaccaggcctgggtgggactgagcttggacctcctggttggacctgcccgctttttttttttttttttaatagcttcattcaagatcacagacccagaatgggaagagctatgggatttatgtaaatcccttccaaccagaaacttatgtaattccaggattctaagtgaggctggatttctgtgggtagtgggtgtgagagaatgggtacccctgtttaacaaggggtaggggccttctgagactgtttcctctacagagtaagggttcgttcagccttttccgtggcctgccaagaactcaactccatgttccctcacttcctgtaattgaccttgtccaggactttctgaccttggagaattcacctttgctctttctgctgcttcgtgcattcttccaccaaatgtctaactgactggctcctctccaaactcaaggctttgccaaatgccaccagctcagggaggcctttcctggccatgacacttgaagttgcaacactcccccgcagtctcccgtgccccagatgtaagttccatgagggcaagccctgtgcttttaccaccatatccccagcatcttgagctgtgcctggcccaagaaatatttgttgaatgaatgaatttaaagggatatcatgaaggcttacacatcctcaatggtttacaggttataatgtgcttcgctacacatttttctcatttgccctcattttgatgtctctgtagggtgacagcctttgggacaggtaaggcagttgttttcccaattcgatggttaaggagcggagacccagagacgttaagtgacttctgagtggagatttgtatctccccgtggatgtctgttaatgaacttgaatgcagcatgcccaaaaataaagtcctatcttccccacatcaggtaacaacagcttcattcatctagtcactcaggccaaaagtcttggtgtcatcttgattgctgtctccccaaccctgcgtttggacacccagacccagagaacagtaagatctgtactcagaggtttcctggctccagccattgctctcgacctcacagctacccattgggccaagccacctccagctctcacctgacttgctgcagtggtctcccaagaggtctctccactcagtccctgccaccttcagcctgttctcagtggagggggccagagtgaccctgttaaaacatgagacctttcacgtccaacctcagctcagacttccccatggttcctatcacactcagggtcaaagtgagagtccctaagatgacacacaagtagggagaatgcccttctcggctggactgggacagctccagggtatccctattgtccttgtacaatacttgcaatgaccaatggctcccctgtccactttctgaagtatcctggtgtggagaataaatgatttgattcccctcgccacaagccctggacaggtcaaccgtctgcccctctgacatcatttcaatcaccctccccttccttccttcactgcaggcacactggcctccccagctctcctcagtactgccaggcatgctcctgccttgggcagagtgtatatgtgtgagtgcacctgcccttcccacagcctagaacgttcctcctccagacagcacacatggcctgctctctcacttccttaaggtctttattcaaaagtgactttctcagtgaagccctgtctgctcaccctgcgtaaaatttcagctcttctttctatctctcttcccagatttttttttctccttcatgttcgttggtgtctaaggtttatcatctatttcgctaatggtcagtagaatgtaacctccacgtaagcaaggagttttgtctgttttgttcatgtctatgtccttagtgcctggagcattccctagtatgcagtaggtgctcaataaatgtcagttggattaatggctgaaagaaaggtcaccgctgtaaggatggagtcagagaacaaacacagttaattcctggtccactgtttttgcttccactaaattgtatttggtctacggcttctccgcttgccctggaaccctgctcagaacactgctcccttctccttcttcttctccctccggataaattctgccattcttttcagcatcattcacatctcacctattataagaacttgttcttccgcagcctattgctccgtctccaccatccaggagtaccttattgatagcactgagcacagaggaaccccacagaattctggctgggctgtagccaccatgcccacccaagccaagtcatccgaagcctaggatcaggaagaaaggcatcagcatcactgactctcagcgcccgtcatggtgctcacgcacaaagtgatggtggaagtgaactgaaattgacatgataatcaatcgtctcccgaggccatgaagaaaataaacagcatccctaggagtatgtgaagaactatttattagagagaataccatcatcgccacagcattccctttccacatctcattgccagttttcattctgtcaacacctcagtgaatttatgaagaaagattagaaatagctttttcctctagatccttgtaaatggagcttcatttttgcctgttttttttacaggtatccttaaatgtgtctgtcttcctgcactgtaagtgaaatgcagaacattttagatgagcccctttgttaggttacagactctttcctgacttgggaaaagtgcctaatgagaaggtttcccccaactctgtctccttgaagattaccagaaggagaggacataggaagaaatagaaggggcacaaggggccttttcttctcatttattaccctcctctgtcattcagaaagcaacgtcagtatagcatgggaacagcaaggctgaaaaatagcccagatgcaatggggttcagttgggataatgttgaaagtattcagggtccaacctgggtaagaggcaggagaaatgaccagagactgttcagacagtatcgaaggtggagaaagcaaggccaggctacagataaagaaatagtttgtatgaataagagaaatgaagacaacaaaaaatcgccatacttagagggggtcttggagtttcagatctagacagtaacaccattctgagttagaactcaaggtcagaggatggctgtaaagattttgaggctgtatagtgccaaatttctgtaggggttgtaagtatggatgttgaagctacaaaggatggcagctggggtatggtggatgggagcaccagggatgggaggggatttcctgggtagtggtagggaacttagggatgagatagtcaagaattccaaagcaggggagatactgagacattagacgaaacaaaatattgaagtgctttttaggggagacagaacgtagccagtcttcttgctcatgccataagcacagggcccggggagaagaaatggcagccctgactgcccactacaccagtgtctcccaaatagatctaaatgtgtcaatgagaagttaaatgtattgggagtttggggaacaatgtctttagttacacagcttttccaccaataggttaacttctggcagaaatagaaaggtcattgcttagagtcacatttgaagctttaccacaaattcagacaatttaaattcctttgttttgttgaactcgtctgaaaacagtctttaattactttgggtttttttttcctcataccagagtcagggcatgaacaaacaagggcatagcctcgctttaaacctgttcactattgcatcctggaaaaatgccttcggcactgccaagatcaaagagttttagttcaggtagattgctcctagaaaaaaggaaattgacattgtcaaagaaaggcatgcctgggaaaggggatgcagtgcctctgctgtgtccacggcagctagcatgttacctagcacgtattaagggctcaaaaatatttgttgattgactctttggccatgtaacactttctggggtggggagagagatgacagggaatgagcaggaatacaaagaaaaaaattgcaaaatttagaactagaagcaaatggcggaaccacctagtagggactctcagaaggccagaatactgcagttgttactgactacagtgggttgaggctgcagtgagctatgatcattcgtgctgtactccagcctgggaacagagtgagaccttgtctcaaaaaaaaaaaaagttctataaatggagtcactggctaaaaatcatcccctaactggttaggaaggttaatgcttcagattagggactaatcacatcagctcggctagctggtttcagccatcttctgtaatatgtcttctggaaacttaagaacaaatcctttgggattcttaataggggaatcgccagcttcatatgctactgacttgtttcttaatagccattcatttacttagatatataataaggacttaattcaggcttagtgacactttggtcagtacaaagtctctagtcaaaaaaaaaaaaatcaaggtgaaacttgaatcaaaaagttatataagtgggccaggcatggtggcttatgcctgtaattccaacactttgggaggccgatctcgcttgagtccaggagatcaagaccagcctgggcaacatggtgaaaccccatctctactaaaaatacaaaagaattagccaggcgtggtggtgcatgcctgtggtgccagctacttggggggctgaggtgaaaggatctcttgagctcggtgagttgaggctgcagtgagctatgatcatgccactgtattccagcctgggaacagagtgagaacctgtcaaaaaaaaaaaaaaaaaaaaaaaaaggttctataaatggagtcattggctaaaaatcatcccctaaacacagattcttttttttccttttctgtgttccaaaggcagaacagaccaccagcggtatgaattttgcttcgtcttcacagacagacatggagcttgcaggaaagttgtttagagtaatcggacttttaacactggaaacagcacttccctgaatttgacttgagtttttttattaatattatgtttggatcatgagaagactcattcagacaggctgacttaagacattaaatgactagttaaccatatacactaatcacataaatatggtttgtggaatgatataaaatggtttacgaaatcatttttaagccatcttttcaacagtaattgtatcagtcctgtcatattttaaaccaagcgatattggcaagaatgagcctaaatgtctttaatattctgatgatgagcatgaaaaattgccactgcaataaaatgacagggttgtgttcatttctcttcttccatggcactttgctttcttccctttcaactttaaaacacacttcctaacatttcatcatgggagaaggctgcataagtttccagttgctgtaatttacttaaaccataaaattgtttccagattaccaaccataaaatggaaagacaatcttatttattaatgtataaatcagataatgtccccaatatgaatcctgaaaccagacacactttgacgattaaataggagggaaaatgttttctcattaccatatgtcaaaagaatggtatttttgtgaagtggctttggtcaagagagtagagcatacacttgtattcggtgctctgtgtgctcccacccaggagagaatggcttcccctctactgtcaagcatctgaactctccaggggggatgtcagatgagaagccacctgactcagtatctctgatgcagcgtgtctctttcctggtggccttgcaggtgacatgccctgaacgaggccatccagggagccttcactcccttcctcacagatacaaaaaggcaagccaagcatgtgggtacctggagtgcatatagcccttttgttctaaaagcacccagactcttatcccagaccgttctgcaactctgtcaatgtcagccttaaagaagaataggatgttgtttgggagttgtctctctctgcaccctaaaactattacctggtgggagctcagggtagaagctgagtactcactgagccaaggaacatgccgaaggtgtgtctgcagctccccagacttccatgtgtagatgacgtggtctgtgttgtgacattctatagttctaacctcgaggatgaatcagtagaggagcagcaatgttgtttatccagaatgattcaggtgctttgtttctttttttttttcctttttttttttttttttttttgagacagagtctcgctctgtctcccaggctggagtgcagtggtgcaatctctgctcactgcaacttctgcctcctgggttcaagtgattctcctgcctcagcctcccgagtagctgggattacagtcatgtgccaccacacccagctaatttttgtatttttagtagagacgggatttcaccatgttggccaggctggtctcgaactcttgacctcaagtgatccacctgccttggcctcccaaagcactgggattacagatgtgagccactgcgcccagcctgttttgaattttaatgctgatgctctcctttgttggacgatgtaatgaaacctgttgaccagactggaagcagaaagaaggctggtctagccctaaccagcattgttcttgtggccagcgatggaatcccaggactcccctctgccatttccctcttagcagagtctcatttagtctctacataaatgagacctacctatttcttgcatttcttaatattactgtcttctgcatgtactaaggttgtcatcatgccttcctatcccacactccagctgtacagaaccctttaagcaacttccttaccaaagctgtctagactctaaaaatgccacgttacctttttttttttcttaaaggaatatcctttgcatttgcctaggattgaagaaaagcagtaaagtggtacatctcaaggtagccctgaatgcacctctgctcttactgtcattcattttactccagcaccactgcggatagagtccctgtgggacgaatgaggacactgggcaactttcacctggggctgagcattcttccgaggaagtcattcatttcccaagagtgtgtgcaagtctgtgccccccatgtggcaggaagagtgaccaaccaccactcccattttttctgagatgctactgtgacttgggtcaataagcttgacattgctgatggatgttcactaacctgctttccttatttgaatttcttaccattgtttctctttgatatgtggactattttatggcaaagagggttgccaaggtatgactgaaatgctatatggctgagaggtttagcatcggctggtgtacctggaaacatttgcaaatcactccgtggagatatatttccacactcaccgtttgagatttcttatttccattctattacagcagagagaccatactattaatacttaaaattgcttggtgttttttttcctccttggtggatttgcaacctttaactatccagactgcatgacttatatgcaagaaactcagtattgtgacagaccttcaattttaaactaaagaaaatgcatggagttctgatatcagaagcttccaattacaaaattaagatcagtgttacatatggcactgagagttacattccaaaggcaaaactcaaggccgcaatgcttgagttggacaaaattacccttgaatatcatcttgattgtcacaaaattcaggatgcagatgcaccagcttaatcagttggctttttctagtggaagaacaggccatcattactttttttttttttgagacagtcttgcactgtcacccaggatggagtgcagtggcgcgatctcagctcactgtagcctccacctcccaggttcccgtgattctcctgcctcagcctcccgagtagctgggattacaggcatgcacaaccacacccaactaatttttgtatttatagtagagacggggtttcaccatgttggccaggctggtctcgaagttctgacctcaggtgatccgcccacctgggcctcccaaagtgctggaattacaggcaggagccaccgtgcccggccagaccatcattactttttccactgacaatcagataaattagccagcatgtatttaatagtgtaagaatatactgtttgcagcatgggaatccccaccactcacaaacccagaggcctgtgggactgagatccgcagtgaggagtgaggtcccctctcttatctcaggctcatgcaaggacactcactcatgggagataacagcacaggcaatgcccatgccatatacattgttctcctctctctccttttcctgttttgaactaacaaatatgcataactgaattcacatgaggtgacatgtgaagcctctattcacttactcgtattgttgtttttaacaatgtgttgaaaacatggcaatagttctgcgaaacgtccattgtctgaggtctagaaatgtgagtctatttcaaatgccagctaaactgtaatgaaacatcaaagagccctggagagagaggaacagtatctgtatatggaaatcattgggaaatttttcattaacatcttgagatggccaagctgttagggatattcgtgttcctgcgtgattctataaaaacctccaggctaaagttcctatgacattagatctaacatcatctaccttcaaataaatgggttgttttgttttgttttgagacagagtctcactcttttgcccagtctgtagttcactggtgcaatcttggtagcagagacagggtttcaccatgttggccaagctggtctcaaactcctgacctcaggtgatctgcccacctcggcttcccaaagtgctgggattacaggtgtgagccaccgcgcccggccgggtttcagtcatatttctccatggtctaaagaagagacatgtttgtgttgcccctaagctgtgacacaagtgttactacccacacagcaaacagctccatcatttacaccaaaaccactccgcagcctcccagctgaggtgtacggcatagaaatgtgtgcagctaggtgagatctggcctgggacactgcgaatgctagggaacagcccttttgtgcaaggtgaaagaaagaaagcagggcagaaagactcaaaaacataggatgtgcaaacaggagtgtttccgagggagatgtctttgagttggtccgtgctgtgtctttttttagccagtcaggtcactggcttgatactgaacactgatcacgaatcttgacctgagctaaggatgtgcggctcttcatgttcctgagccaggttgggtgaacttccacggccttctaggtggtaccttttataaccctcaggtggtgcattcacccggacaaactggtttgaaagtccataaagctttaacaaacaattctcttgttttacagagagaggatgcaagccatggagaaacagattgccagtttaactggccttgttcagtctgcgctttttaaagggcccattacaagttatagcaaagatgcgtctaggtaaaaaagaagaaagccaatgaaaaaaataattcaatctgtttctcttttaatcattaagataattcattcattcaaatctgttttcttgtaatcatttcaaggctgaaaatattcacatctctatggatcatgggcgttatttttttgttttggggggtttggttgctttttttctttcctccttctggtaattcttggtcgaaagtaacactttggcccaagaaggtaaatgggcttcccagtgcatgtggcttcatggaccactcaccgtgcagtgcctgcaaccaccacccttgcgtgtccacgtcgccatcatctgaaagtcacaagtgagcctggctgcattccacccccagtgtcaggtgcacacctgggaagccttttccatcctggccaattgtgatgctgatgctaaaataccttcattgcttaatcccatcactgccaattgcttcaaatagtggatggaatgggctttaaaaaaaaaaaaaaaggcattttggaaactgcatagctgactctctttttcttttattcagcgagaaaatgatgaaaaccacagccaacaggaaccacacagatagtgcaggtaagtaagtgtttttggagctgtaggaggcctgtgggctgcctgggatgagccctggctggtctcagaaatgtttaacatttccctaagtcacgtatttggtatgatgtcaggggattcctagatattcctgccaatactgaaattccagatttattcattaattcgggggcaaagcactgtattctcccttcggttttcattcattcgctcattcatttgttcattgatatggccacacggtggtcatcttgcagacacggggctgcctgcctagaacttagaattcagtggggaagatggaaatgggacaagtaattttatgtgtgtcaagtgtttaaaagtgcaggataaatgtttcaccaataggactagcctataccaagggcagtccccagacaaagtgacataaactaagcccagaaagatgaagaggacttagggggaagaagggttgtccagtcaagggaatttaaaattgttctaagtgcaaagtgaagccatcggaaggttgtacactggggaaggacatcagcccagctgcaatatggggatggatgagaagggacagtagccaataaggaatgaccagtgtccagatgggagaaaaaggagtacttggactagggcctactttttattttatctttttaatctcatgacagatgacaaggcctgctttttaaatgccagcattccccagaaagacagcccagttctgttagtagtggcgttcactagtatccaggtctttgcaatgaatgtctcatccagcagtctcaagccaggcctctgcaagaagatgaggtcttccctctcatcgggttagaaatagaaatccttagcaggaacacattcagatactaaattacacagaaagcatatggcaagttgggtgaaaccccaaatttagggaagccacgtgtactagttttgtgcagcacggtagagtagacagaattggggacttcagtttagggctctgttggtcgtggttcttctctggctgagcacaatttagctacaaagccaacagggccactctgccatcattcctgatcctgacgggatttgttgttttgcttagaaatcaatcagtggccttggccgaagccagagaattatttcacggaaattgctaaacttgtcttcagagcaattgccagtttgtttcggagatacttaattcattcattttttaaaatggattgtaaacttagggagaagaaaggaaactactaaatactaaaagctcccatccttctataatccattctagaaatgattcatatctgaaagcactgctctaagcaatatgtacgtgctgttttgtattctccttttatttctttttgctttatagagaagaagaagaagaataaatatgtagtgagtgcttcctatgcacttttcatgcattcactcatgaactccttaccgcagcatctagggagaggtacagtttttattctcatgttccagagaagaaaactgaatgcacatccacacacgtgacacacatcatcatagtccaaatgcctcccatttgaactccttttatgttaagatgcctcagtccctttaaagatatataggttgtttcatttctttgttctaaaaactcttgtcaatttcttttcaaatgtggggaaaggagccagtgtcatttcctcagatatatttcccaaagtggaatcggtgggtccaaagggacagttcagtgccactggtgacatgctgttagttttctcttctgaatggctgagctgatttgcaacgccactggcaatgagcacgtggactcactccccacgtctctgctaggtttggactttctcactctaacgtatcagggcgagatatcgtccacaggggcttcgttgccatagcagccttgtatagtgcacaaaatataataattcttccagaatgctaggaagtcagctacaagacaagtattatccctgttctgtagacaagtaaacggaattatatagaagtcaaggaactcatctggccaagagtaaaggaaaacccagacttcctggctacttatggaatgtgtagtttactgtggaaagagaacagatggaacctcccatctcaaaggtttttatactgagcattagatcatttaacacacaaaaccctataaggaagatgtcattacccatattttacatgaaaagaaacagaagctcagggaggttaggttagttttccaaagcgacacagctattaagagtgacagccaggctgggcatggtggctcatgcctgtaatctcaggaccttggaaggctgaagtgggaggactgcttgaggctaggagtttgagaccagcctgggcaatattgcaagaccctgtctccacaaaaaatgagcgtggtggtacatgtttgtagtcccacatacttgggaggctgaggtgggaagactgcttgagcccgagaggtcaaggctgcagtaagccgagatcaagccactgcacttcagcctgagtgacagagcaagaccttgtctcaaaaaaaaaaaaaaaaagtgacagcctgactggctgataattgagtagatagtggtgccactggctacaattaggcccgtattataatggacattggagactcagaagtgggcagggtgggaggggatgagggataaaaaaaactacgaattgggtacaaagtacactactcaggtgatgggtgtactaaaatctccgacttctccactatacaattcatccatgtatccaaaaactacttgttcctcaaaagttattgaaattatatatataatacaattaggcccacagagacagaaagagctttgtggaagacgagtggaaataatgaatttgacttgtttatggaaaagttcagtagtggcgtgaaggcgttagtatgtggatctgaagatgattgtgtgctgctgacgagggtgcgggagaccttggtgggtggtggtagcagaagtggcctccctagaaagtatgtccagcaagaagagaagtggacccagggacacaacatatcaggatttaaaaggttggcagaggaaggagttagaaaagagattgaccaagacggagcagcagaaagggaagaagatcatggaaagtttcaaagtgactaaaaggaaaagaagtggctgacaaagcttagtgtcacattgaagcaaaggagagagtccacaggggtgacaactagaagatcgctgaaatgaacataaagagccatttcagagaatgaaggagctatgacatgtaccaaatataggagattaagaggttatagatgaagatttttttaagtgagtatagattccattaagaaatttggttgtggcttggcatggtgacccacgcctataatcccagcactttggccgaggcaggaggatcgcttgaggccaggagttcaagaccaccctgggcaacatggcaaaaccccgtctctacaaaaaatacaaaaatattagccagatgtggtggcacatacccatagtcccagctttggaaggctgatgtgggaggatcacctgagaccaggaaggttgaggctcggggaattgcaccgctgcactcaagcctgagtgacagagcgaaaccatgttaaaacaaaaaaattgcgctgtgaaagttatcttcttaaaccagttatcagcattcaactgtaacaactagtacctagtcttcagccttttcctccatggaataaaagatcgaggggagggaggtaccttggtggcctcagaatgtgtaaggagaaagaggtatagaaagaatgtgtgatttcctttggctgaggaattagcagaatggttcttagtagcaaacagaaggtagcacagtgtcatctttgttggagaaataccttgttatcagaaatgatatggcatgttgtgagtgtgtgtgcgcctatccctcaaagagtgcctatccctctctgtctggggaatgatgataaagtaatttgactgattctgtaaggaaaacttccaatggattgtggtcagaatcactgacattggaaggcactgttaactctaacatgcagctgtcattggaaatgttatcagatatgttttacttggtactttcatagttggagaatatccttttgaacaacagcagagatgacaaatcttgctctttcgaggatgattttgatttgaggggtggaggaaccaccagaaattggtcagagccatgactggtgatgtgagtgaccatttaggcttagaaacataacgtggctgggcgcggtggcccacgcctgtaatcccagcactttgggaggccgaggcaggtggatcacctgaggtcaggagtccgagactagcctggataacatggtgaaacctcgtctctactaaaaatacaaaattaactgggtgttgtggtgtgcacctgtagtcccagctactcgggaggctgagacaggaaaatcgcttgcacccaggaggcagaggctgcagtgagccaagatcatgccactgcactccagcctggacaagacagagcgagactctgtctcaaaaaaaagaaagaaagaaacataacaaaaagctcgctatcgggtctcctggagctccattgtcagttctttaaaatgccttctggcctgctcccctgctgcctccccaagagggccattagaggggctgggagactggccctatttggatggtcactcatggatgaagaccatggggcgccagcagcatcagcatcgccaaggccaagcaagaaagaggatagtttcagggagctccctggctcatgagccactttgagctccactggggcctggctgagttgtgtgtgctggagcgggaaaggttcccgaaatgactgagccaggatggaaagacagggtaccaccacactatagccactccagggtctgcaagtggccagcagtgctctgtcctgcaaggccagcctggcctgtgacaaagctttacaggaaagagaactgaacagaagtgtgtgtgtgtgtgtgtgtgtgtgtgtgtgtgtctttattagtaacatggatccagcctctactccagaagagtgtgtgtgcgtgtgtgtgtgtgtctttattagtaacatggatccagcctttactccagaacagtgtgtgcatgcgtgtgtgtgtgtgcgtgtctttattagtaatatggatccagcctctactccagaagagtgtgtgcgtgtgtgtgtgtgtgtgtgtgtgtctttattagtaacatggatccagcctctactccaggtacctgtatcaatagaattgcattgtcctttttagagtcccctcctgaagaatttttgcatcttgccttattttcttactaaaggagttgtgtgcagatgccctctttcttttcattttggaaatctgaagggattcaggacagtacccagttcttactaatctccccttggcgattggctgaatctctgcccagaaataagttgcatgtccttaggttacatttgctgtgcagaaaataggcacataagcactctatattaggtctcagaattttaaaattagttttctctattataaaattgcagatattcagtatgcagattttagaaatacaaaaaattggccaagtgcggtggttcacgcctgtaatcctagctcttagggaggcagaggcaggaggatagcttgagcccaggtgttcgagacctgcctgggcaatacggtgagaccctgttctcaaaaataaaaaatagtaaacaaacaaacaaaaaaccttatattggaaaagcacagctggagataccgttaacactttgttttatacacttctaagcttttctctatgcaaacctgtgtgtttaaaaaagctctacttccaggggttaagaaaagaaaaaaaaattaaaataaaaaaaaaataaacaaaattgatcaattgatagaacaatcagtggatagatagataggagcataggcagctctgtggcctgtcttcctatggcactttcttactaaacttctagaatgtgatcattgcacactgcataccataacactgtgtgattcatatatatgcatattttttgtaatgagagaattaggcctttttagaattaccagtcatctgcattgggatgggatgcatagcttagactttcctttgtggccttctgagttctctgatgcacttttctcataggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccaggtattcctcatgcacggcggcctctgtctcggttgccctgagctcttcctaccttccttttcctaggggctccgtgaagacctagagaatgtagaaccatagaaacagcatggcttcctctctcacacacacaatccaagtctagagccttccactgcaactatagtcaatctataaccacttctttttttttttttttttttttttttttttttttttttgagacgtagtctcgctttgtcccccaggctggagtgcagtggcgcgatctcggctcactgcaagctccgtctcccgggttcacgccattctcctgcctcagcctcccgagtagctggaactacaggcgcccgccaccacgcccggctaattttttctatgttttagtagagacggggtttcaccgtgttagccaggatggtctcgatctcctgacctcgtgatccacctgcctcggcctcccaaagtgctgggattacagtcttgagccaccgcgtctggcctacaaccacttctttaagctgtgcgtacttttacgcaggaagagactctagggcatttgtttttggagaagagccgaaaggagaggggccacggggagcatgccgacagccagtgaaggctgacttctgacagcttggaggctccatcctcctccacactgaacggggacaaaggtggatagtcagccaagctttttttttttttttttttttcattttttttgcaaggatctgtgatgtatttagaactatgagtttagaatagaagatgaattcataaggaaaaaaagccatcatggtgatttgttacgaaaaacatctgcatttcattcagatactgtgatccatccgttccttgctcttttccattgttaaggaatatataaactctacgggaatcaggataagtgacccttcaggtcacgaatcttggtcaacaaatcccgtaaatctgccaaagcagaataagctgtctcctgggtaataaggaggtagagatgtgcatctctgcatgagaccacatatttgctctgtgcaccttctcccacctccctgccctggctggtaggttggtcgttgaggatacagtgctggcctaggctctatacagatatcctccctgacttccagaagctcataatccaaatagtgctagaagatagggccaggtgtcatggctcatgcctgtaatcccagcactttgggaggacgaggcaggtggatgacgaggtcaggacttcaagaccagcctggccaatgtggtgaaaccccatttatactgaaaaaaaattagccaggcatggtggggtgtgcctctagtcccagctactagggaggctgagacttgagaatcacttgaatgtggaaggcagaggttgcatgagccaggatagcaccattgcactccagcctgggcaatagaccaagactatgtctcaaaaaaaacaagataaatgtatccaggatcctggagcagccatggggatgcaacctcctgagccctttcctctaataggaaaaaggcttccaatcggttctgcttcttcagcacagcgacagcacaagccctaagttgtttaaccacctaatgaaagctaagaaaacaatttccccttgccctctgcctaccagaaaacacacagaaaggcagctggtttgagagacctgccccaaggccccagcatggatcatgacggttgctagaagagtgagggctctgatctccaaaggctactctgtctcttaggcaacatcccagataccttgaacatctgatgcaaattcatttaaatctcctagtgaatctcatcgtctgtgatggccccatcctttgcattagcttcctctcgctttgcaattttaaagacacattgcaatgaaatgaagtgtacgggttgggctgggttgtgtcagggggtgacaaagtcacatgtcttcagtgtccgggcagtaacagcaagtgaaatggaggagagaccacagtaaattggcccctttaaaggatagtagccactcagttccaactggctcttaacctgatagaataagtatccagtgtttctagatgtttcaatatttcaagcaaatctggagacacaggttttatatgaattaccgccatttaaaaatgttggaaagtaattgaaaactaattactgagtactctgcaggccaaaggacacaattgcagttcagagggggcctatcggctcccaagttcgttcttacctggggctcctggaggtcaagcccttcccttcactgctcctgccttttggcaccatctgctggccatttcgaaattgttacctcctcattgcgccctttaagaaaaacatacatatcatttgtatggaagtacctaactgctctcaaaagtgagcatttgttggtttggggacagggatggaattgctttagcataaatgccgcacttcccctgggaatttcacaggcgttagaggtgaatttgataccaaggctctcttgatgtctgtagctacagcgtcaccccatcagtggctggcgtagtttggtcctctggccggctgggagggatctctcacacttgtctcgccttgcaacccttgaactgtgcagctttgtgaaaaagagcagttttcttaaacaaagaaggtctttggtcaaggtctaggaatgctgtgttaaccacacaagtttctttattgctccagaactactcaacttttctggctttctgggaataaagaacagtgagcaaatgtgcttttgagcctgggaagttgggcagttctaaagcgcagactcgcagggaaaaataagcatggtgtttcctaacctggctgttactgtttctacctctgcatttgtattccctgggtcccattcagctttcctccccatcaaacttctgtcttttcaatcgagggagtctacttaagacaaaaacagcttagaataattaagctatctcggcaccaattctccttcaacatgtgcggtattatataccaaaaatgaactgcagccgcacagtggctctaagtccaataatggagctatcattagagatatacgaaacactagactagtctcaaaagaacaaaaattgaattagaaattcaaatattctttgaactgtgttataaaatagtgaaactgaataaaaccatttgtgcttggcagccagctccagtaattagataattaaatcattggaaaatcctagactgtagagcatatcctatttgagcatttcattttcaaaactgatggattattctcaggaatagaaatttgttgcagacacaatggggtgggtagatttcaatgggacaaggggaacctaagcagaagatcaaggaaaccactaaaagcttgttcatgttatcttctgctctccaatttcacaggagttatcggtctaagagtggttctcaatcctggctactcattagaattatttgaaacccttagcaaaaataccagtgctcaggcacgatggccagagtctgacttcactggcacggactggaggctaggcactggtgactctagaacattccagggtaaaaactactgtttttacctcttggctacaggtaatatgaatgcttagtccatgaagacacctcctggaaatgttgagatagccagctattaccaatgacttaaagccttgacttcaaacaatgcacctcattcccagtggctaatctagtatgttctctgctagctacatttggtatgagagctatatggaacctttatagtgtgatattcccattcccaaataacggttgggtctgtaattagctagcaacaatgggaaagggttttgtcaaggttttgtgcctaacagatgttctcctccaatgatgattatgtttgcctgttacctttcctgatatcattttgaaaaaaagcccactttttctaaataatgaacatctttttcccaaaatgccacagtacttggattttaccaaagtcatcccatatctacagaagtgactgcacttcttcccctccttgtgggtggctgaggagagagagagaagcttctggaagagatggtacaggttctgtggaggccagataggcttggcataaagagaggatggcgacctcctacttctttcatccccaatctctttattctgcttcctgataaataaaaaattgggttgttcattacatttgtaggactcctgagaatttactgtcccttcccaagagaaggaggaggtaaaatatcaacataaaaaataaacacagtagtgcatagagccctatgtatttgaaatgatacaattcaatacaatttccttaatgtgtctttttatgagatggcgcctcgtggaaatgtgccagggtctcatttatcttctgacatgcataacaatggtcacgggaatgcggatccctgagaacagcatattggagtttcccatgtgcaacagacccgtgtcccctgccaagcagaaataataaacggaactagtacagggcttgacgattaggctgcttacaatgtgccaaggtctagtcagatcttcagacaacaagaagctttctaagatggggagacagcaccccaataacatgggttatatagctgtgaccaggcatcccttgtcttgttccctgaagcctgcaggaacagatccaggtgggatcaggagtcgttctgaggtctggctttcctcctgaatctttctgatttgtggtataaccactgttccatgtcactgctagacagcaaaatcagtccaattacattatccattgttggcaagactgatagtcttagattttacctaagaaatcaaaattgagtatgtgagatataggtccattttcaggttgggggaattaggtttaggcatttgctagtttctccatgaagtgatttggataacttatttggtccaattaaaattttaatggacaagagcattatttctgtctcttattttacaagagtgcttataaaaatggcaaagcattttcaataaattatctttctagctatgaggaataactgcaactctacttgccctcccactgtgggcaactagaaaactgaaaaataagcaaatgtatgaaacaaatgttttcagaaattaaacaacacaggaccgtaatccttaggagaatggggggaaaaaacctacagttgacccagctttctgtctggaggcacttttcagatcttggtgcaggaaggaaaaacccaagcatggcactgacagtgagttgaggagataagaccaaagtttagagagagctgaaacagctagaactggtggactggagaaccaaacacaagaaagctctgcagagaaagaagtacatcaataaatgggtctgttattaaatattaagccaagcatgtacagtgtgaaagcaaccgctaagccaggcagaaactaagtcgggggctgtaagccaaaaagttcccgaagttcacacaggcctgggagatgttcacgttttgaaaagcaaaaagcgaagaggccttgttgagcacctgggcattttgtagagatcggagaaggactgtgcctcagtcttaggactaaactagccccagaggaaagactacccttgatttaacctaactgcttaaaaataagcctttaaaggacaaagctgatccacaagtaactggactgtctgccagagaaagtccaaaatctgtaaaggaaaacaacaaaattcagagctccatgcccaatatccactcaaaaattactagacatgtgatgatgctgacaaatgtgacctataacattaagaaaaatttgtcaagagaaaccaaccagacatggcagggataatgaaatcagcagcaaggacttcaaaacagctattataattattctcaaggatttaaaggaagacatgaacataatgaggaaagaaatggaagatataaaaaatatccaagtggagctttcaagagctgaaaaacaatatccaaatgtgcttaacagaagattaatcactgcccaaaatgtcagtcaccctaaaaacagcaatggaaactgttcaaactgaagtatagagagacaagagactaaagaaaatgaattaaaatgtagtgaccagtgagacaatattaataaaagatgaagtggaaagagaaaaatattcaaaaaggtaatgactgaattttttccaaatttgatgaaagctgtaaatccacagaccaaaaaagctcagtgaacccctagaatggtaagcacaatggaaattgcaccaaagcacatggtagtcaaattgctaaaaaccagagataaatggaaaaatcttcaaagcagctgggggtggagagaaaacccattacatacaggaatcacaattaagaattaatgccaacttctcatcagaaacaaaaggcaagtcaggacacagtggaatgacgtctttaaagtattgaaaggaagaaaagtctttcagaaaacagagaatacttcctaactcattttatgaagcctgcattaccctaagagcaaaaccagacaaaaatattataagggaagaaaaccacaaaccaatatccctcacgaaaatatatgtaacaaatccttaacaaaacgttagtaactgaatccagcaatatataaaaagaataatacattatcctggggttttattccaggaatgcaagattgttttaatacgaaaaaaatcaacgtatttgaccttattaacagaaaaatcgtatttcaataaatgcagaaaaagcatgtaacaaaatttagcatcaatgataaaaacagcgctctagaagtagaaggaagcttccttaccttgataaacaatgtttgtgaatgacctacagaaaacatagttaatggtgaaacactaaacacattccccataaaatcaggagcaaggccaagaaacctactctgacatctgtttaacactgtactgaagattgtagcaagttcagtatggctagagaaagaaatagagtcacacaaatcgaaatgtaaaatgtctaattggctttactcacaaatgacatgattatatatgtgtaacattaaatggaatctacaaaacatgctactagaaataagtgacttgagcaagatcacaagaatcaagtcaatgtacacaaatattaaaattttgttatatccatttgtacaatgaaatgccacttagcaataaaagaatgaatcactgaaaaactcagcaacagggctggatctcagaaaaacatattctgaacaaaataagctggacacaaaggagcacatgttatataattccatttttataacgttctagaacacaaagaactcatctataatgacagaaagcagagtggtggtttctttgggctggggcttggggattgattgtaaaaggtctcaaaggaattttttaggatgataaaatatatagctgtctttcagcagtggttacatcagtgtatacatttgtcaaaattcatcgaacggtgcacttaagatggatatgttttattgtctgtaaactttgtgcctcaagacagttgattttaactattgaaatgtaggtatcacctcttaagcaaaaaccaacttaacaatttgagcttccaaaaagtaatttacttgaagcatttagagaaagatggtgatccacatcatatctttagcacttttttacactgtgctcagataagcaggaactgtcctgcagcctggagacagtggcaagaacaccagacagggagggcagggggactgggaaagcagacagagaacctatgtagaccttgttcattcatgattcactcctcattgcccacgtgccagccggtgagctatgacagcttccctctttagtaccctcagcaggatcctgtaaggccccgctttctagacaggaggataataaagcctaggattgaaacagagcctctccctctcctcctcttctagtggagtaagtctagttgtgtttaaacattatgccccgttgtattttccaatatttcttatccttctcagaaacgttatattgcgattcattcatagagcaaatacagttgccccttgaacaacatgggggttggggtgctgacccctcatgcagtaagaaatccataacttttggctcccccaaacttaactactaatagcctactgttgagtggaagccttaccaataatataaacagttgattaacacatattttgtatgttgtacatattatatactatatttgtttttttcacatgcctgctgtgtcaaatatatactgtattctgacaataaagtaagttgaagaaaagaaaatgttattaagaaaatcataagaaagggaaaatcataatattcattaagtggaagtggatcattataaaggtcttcatcctcattgtcttctcattgaatagattgaggaagagaaggggttggtcttgctgtctcaggggtggcagaagaggaaggaaatctacatataagtggacccatgcatgcagttctaacctgtgttgttcaagtgtcaactgtatatgttgggtacctaccatgtgccacacgctgcttgtagctgtgaacaaaatggcatgctccctgccttgatagaagaacaacttggggtggtggggaaattgatgagttgaattcagaagacctggttctaatcctaactgtgctctctaattgccgagcacaccctgagcatgtcctttgacttctcagggcctcacttttcccacctttcaattttatgaattttaaatattccaccaataatttctagcatgatatccattgttaatatccactatctaaccagaccccagatttacgtaagcttgttttaaaatttgggcaggagggttaggtgccctgctgtgccccatagctcatggcacagtgacatcatctgtctattcaaaagcccttttcttagtccatgaaatcatccttggtggcaaatcgaatcatatgaggagttttagaaattcccaacaaccagacggtacctcagaccagtaaaatgagaatctctcagttgggacccaggcattggtcactcttagacccatttaattatctactcattttcccctcacaaccctgtcatcactcattcccgcccccttcaaaggcaggagctctgtgggattggacacagggactgaagttgagcaaatcatcttgatagcacgtggctttgctgtgtgtggttaatcaaccgatatgaacagtgctgacctgtagccctgccacatccccgcagtgagagcaagacaaggcacaggagagctgatcccaacacatatctaagcccatgggtcacagcaggtttcaaccatttagagaagaattttggattcttcattgttgcctgttcttatcaatgttactgattcattcagttcattcattcaacagatgtattttcagttttctgctaatatgccagacacagtgtaccagagactctgtggagggcagaaattaaccaggtggagggaagagcattctgggagatgggaatagcaggtgcaaaggcctggcaaataggagtctggcggaggttgcagtgagctgcgatcacaccactgcactccaccctgggcaacagagtgagactctgtctcaaaaaaaaaaaaaaaaaaaaaggagcctggcccctatgaagaactgaaatgatgtatggcttgagcagagtgccaggtgcatggagggagggagattagccacaagggaagcgaccagattgcccagcgcctggagaatgggctgcagccagagagagcataggaggatgttgttctctgtacactgtctctaaaaatggtgctttttggctgggcacggtggctcatgcctgtaatcccagcactttggaaggctgcggcgggcagatcacttgcggtcaggagttcgagacctgcctgatgatcatggagaaaccccatctctactaaaaattcaaaattagccgggtgtggtggtgtggtgggcacctgtaatcccagctacttgggaggctgaggcagaagaatcgtttgaacccgggaggcagaggttgcagtgaactgagatcgtgccattgcactccagcctgggcaacaagagtgaaactccatctcaaaaaaaacaaacaagcaaaaaaatgatgccttttagcaaaatagtgactgactggcttttaataccacaataaaaagacattagcaaaagtggtgtgagagcatgatcatgagtcctgtagagaaagtaaccaaaagtgatacatttctatgtggttccctcccagacaaaatgccaggctccacccactagttcaccctccctgttagcaatggctggtacgtgttcaggtttagattggtgccagacactttattttattgtctcaccgagtctccatgaccaacctacgagctatgagatattactaccccttttttggatagacacagaggtgaatagcttgcccatggacacacatctactaagtggtaaaactggaaatcgaacccaggcagtctttccccagaggccagttcatcaccatgcagtgctgatgttgggacctaatggtggttctgcttgtggcctgtgttgaaatgttttatctttattcagagaaaacagaaggcatgatgtggctttaagcaggtggtgacatggtcagattgcatttcccctcaatttacatggataatggacagttgacaaagacatcatcacccccatgagatgataaaccagtccatgaaaccggaaaacaggaaaccattgaaatttgttaaatgatatttcagtggaactttggggataatatactaggcataatatcattattgtgatggaggctgattgagtgaattcactcgatggagctgctgttagaaaattgtcctgctccagggactcaagtgctcaaccagactcctgcgaagcctgaataaagctcccacctcctatattctctgggatgagaaacaagaatgttctcggaactgtttggaaattgtgagttctgtatacaggtagcctacctccaatctagagaaattcataaattgccaaaagccctggactcatccagaatcattatcattgccaacattaaagtcctatgttttaagcatctgtgatttcatggtacttggtacatggaaccatgtgaacgaaaaggacacagatcctctttgaactgatactgacgtatttcatagccaaatcaccacgtgttgagttcccattctacaccatgcggtatttcatgtaaccctcaagaatggccaaggaaagtggattccccatcattagaggtaaggaaatgaagaccaagggagtctaaataatgggcccaaagtctcacagtgggctagagagagagtatgggattagacccaaagtcttcttggctccaaagcaggtgccctgtgctgctccctctaaagatacatcagtgagagtttacgcctgttgtccatgatgcattgaccagagtagaaaaaggatcctttgtcttgcaggcagtctggttgccagttggctgccaaaattcagatgttggtggaagaagccacattatgtacagtctttgctccctttcctttctcattgaaataagtaaagattcagccgcagggctgtctacccaaagtgctccgaagacttcaaggcattcactcgcctccatttcaggcaggcagagcccactgaggttgatttttttgtgttcacagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtggtgagtgccagtcacttgcatgttgagctgtttcacctgcaaaggaaaattatcattactaagaaggaggtccttcccagttggtggtcttgccctctctttattgagcacctactgtgtaaaagttagagttctgctgatgctggtatatgtggacacttcagcacctgtccatggaggcccaggaaattcagtggccctcaggtgactgaatttctttaaaagttgcggcattgctgggcatggtagttcacacctgtagtcccagttactcatgaggctgaggcgggaggattgcttgagtccaggagttcgagaccagcctgggtaacacagggagatcctgtctcttaaaaaaaaaaaaaaaacagagagagttgcagcttcatactctcctccagggctcagcaacacacaaaattaaaaggagtaaatggcaaaacccaatggcaaataggaagcctatatttcatctcaataaattaaaactaatggccaaaataacacagctctaaaattatcttcctattattcaactgtagttaaaattgcaaaagaagaatttaaatgtaaaatgtatctgatccagaatgaaaaatgcttccttagctgttatgaatgttatttaaggttcttattgaaagcatctatcaagtcctactattgaaatgagcagaattttattactcccccgtcaccaggcaggcacatcttttatggtaattgtatgttttggtatgcaatgaagatttatcatagaactatctcaccttttagtataatgaatagtaattttgaggggtttctccagtgttgataattctcttgtttcttggaaaacttaaatctttcaaatggggattgtaagggagcagtttgcaaactcttctcatggccataatgagaaaagatttccatgatggaaagcattgtgctcagtcacctatctcctattggagctgtggctcgtgtcgccctggatgccaacctaatgtgtttgattaaaattagagtgtccctctcagcagtctagagggaaaaaaacatcaatttgagttattcttttcctaataaattaaattaggctgctgttcatccatatctcaaaatagcttccaaaattctacttagttcacacatttatagacagagttaatcacccaccatgagttggtaaggctgttatttgtctgaaatgtctttgtgacagcccaattatctaaaactaggtctccagtttcttctttaaaacttcttttaaaatgcatatcctggctgggcacggaggctcatacctgtaatcccagcactttgggaggccgaggcagccagatcacctgaggtcaggagttcgagaccagcctggccaacatggcaaaaccccgtctctactaaaaatacaaaaaaaatagctggccattgtggtgtgtgcctgtagtcccagctactcaggaggctgaggcaagagaattgcttgaacccgggaggggaaggttgtggtgagccgagattgcaccactgcactccagcctgggcaacagagcacaactccgtctcaaaaaataatagtaaaaataaaaataaaaatatatatccttttaaaaacatttatataaattttccaataaaattatgaaaaaaaatttttttgagttggagtcttgctctgttgcccaggctggagtgcagtggcatgatctcggctcactgcaacctccaactcctgggttcaagcctattctcctatgtcagcctcccgagtagctgggattacaggtgcacaccatgatgcccagctaatttttgtatttttagtaaagacggcgtttcaccatattggtcaggctggtctcaaactcctgacctcaggtgatccacctgcctcagcctcccaaagtgttgggattacaggcatgagccaccacgcccggccagtaaatttcttctttttaaaaattgtgtttattggttagctgagataattctcacttctggcctagaaaagccatctttaatctcaataatactctgagattacagcctagcataggaatgagacagaaaaggtagtggaacgaacatatcataagagggctttatctggttggatttgtgggaaggccacagatgagtaaaagaggcaaagagcccttgaggatcttcagtctagcaaaggcaacctgataaataggagtatagccccgaacaggggatttacaggtaccagttgtacccacacaaaagagagactaacccagggatcaggaagacttaacctgaatgaagtcattctttgtatgacccacaggccacaaacagtatcttgcacatagtagtttcagaaatggtttgttaggctgggcacaatggttcatgcctatagtcccagcagtttgggaggctgaggtgggagaatcacttgggaccaggaattcaagaacaggctgggcaatatagcaggaccctgtctctactaaaaataaaaaattagccagctgtggtggcatgcctctgtagtctcagctactcaggaggctgaagcaggaggatcgtttgagcccaggagttcaaagctgcagtgagctatgactgcacctctgcattccagcatggatatcagagcaagactcaatctctaaaacaagaaagaagaaagaaagaaatggtttgttaaactcaactgaggtggccttgaagatggggagattgcatcagcagaggctagagatggaaggacttccaggcagtagaaccctgcaaaccaacaagtttctggcctggaaaatgcaagatgtctttagagaactggggagcagtccagttaggcagcagagttgggtgcaagatactaataacatcccatatttggggagtgtcattcccatttgcacactgacttcctgtatcttagaccatactcaggcctcacatacctgcttgatgcctgtctgggctgtgcctacagagattggaagattctgtaagagaaacctggatttctggcttttcttgaaagttccggggttcaaccccagattcacaatttctgtggatggggcttaggaatctgcagtttacaaacaaagccggtgattctgaagcactttcacatttgagagttactgcctagaatgatgaggaagacactgagtgtttgggtttgtttggtttttgtttttgatcaaggaagtagcaaagctagagctgtattggagagaggtccctctggtgatcatgtgccggactgattaagaggaaaatagatcagtgactaggagaccatatgggaagctactgtatccgtcaggcaaaaggcagtgaggcctgaaccacatagtagaagtaagaaagaagtcaaatgcaaaacgtcctatggtattcaccgtctaagactagctctcaaaattcttctttaaaacaccttttgaaatatatatccttttggctgggtgcagtggctcatgcctgtaaccccagcactttgggaggctgaggtgggaagatcgcttgagcccaggaattcaagaccagcctgggcaacgcaggaacacagggacacccaatgtctacaaaataaaaattaaaattaaaaataaaccctagccgatcatggtggcacacacctgtggtcccagctactcaggaagctgaggtaggagcatggcttgagcctggcgggtcaaggctgcacgatcacaccactgcaccccagcctgggtaacagagcaaaaccctgttaaaaaaaaaaaaaaaactaaaaatatctatatacatatatatccttttaataatggtagtgtaaattttccttccataaggtataaagtaggttaactgattggatggctagatctgaatggcaagacagcaggttataaaagacagctggaaatagctagaagagaagaactagaatgtttctagcatgaagaaaagacaaatatttaaggtgacggatatcccaagtacactgatttgatctgtacaaattatatgtactaaattatcacatgtaccccaaaactcacatctattatgcgtcgatttttaaaaagagcttattttttaaaagccagaaatttcaactctggaatatcagaacagtgatatccctctttccttcccctctccctcctcgttctcctttttgttcttctccttcttcttcttccaagtactagaatataagtctccttgtggagcatgttaggttgaattactggtgagccattcagaaggcagagagaagaaacttgggcctaaaactgtgaagagatgggctgggcacagtgattcacacctataatcccagcactttgggaggccaaggtgggtagatcacttgaggtcaggagttagagaccagtctggccaacatggcgaatccctatctctactgaaaatacaaaaattagctgggcatggtggcgggcacctgtaatcccagctactcagcaggctgaggcaagagaatcacttgaacccgggagacggaggttgcagtaagctaagatcaggccactgcactccagcctgggtgacagagagagactgtctaaaaataaaaaaataaaactatgaaaagaaattgggtctagataatttctacatgaaaataataattggtcttctaataacagtcaagtgaaatacattccaacaaactgcatgcttctttttaacaaagctaggatgaaaagccacttaaacaaatagaatgctgtaaactgtgacgtctatgaatatctgacattctgtggagcaaagctgatattttaaaagtcatattgattaccatgtcaaaaatttatttccagcattcattttagccccatgtctctgttacatttttgaatgaacaaatttgatttttaatgttttatctaaagtaggtatcataaacgtttgcatagaagtgatattgttgtgtacaattgtatcaatatacatttctgtatattccataaagctgtgaagtttaagcgtctccgtatgcaaggttgtgaaatccaagaggcatattgtatagaagagatcaaaacagaattctaggcagactgactttgagtcagatgacagctccttgaagtattaattacgcactgacagacatgttggttgttcacggaaccaggaaaatatttggtccttagctcttccagcaaagctttgcaggactggaccctgtgtccagtcaatacagggaagtcattctgtttggttgtgcaatagaaaagaacttttccacacgaagttaccatatttatttagagcccttcagtgaggtggcacaatctcttcgtgtcaagaatccaatagctgtaggaagtttcccgtgggtgtgttcacagaacactgggcccctttccatagttcacagacgtggacaatgagcagatgaggctttctccctctggtcctgaagtagcatcatttcatctgaaatggccacaagcaattttggtttatttttcataacagaatcaaagacatcaccaaaaactccatcccacttcttgcaggggaggaatttgttattttcccttggatcctgttgaacacatgtggcatcctgcctgaacccctcccgcagctgccatgcgatccagagctccatccacttgcccacctaagtggaaagggccttcgagggccatcagtttgcagacgacactgtgcattcctttttctctttcggacgctggctccacaatccgggctccaggaggtggaatcgctgttcacttactgccccctagtggtccgcatttctgaaagttctttatccctgtttcctttgagatttttctccgtagatttataggtgtttaggatggggttagtaatgtggccaaggaggtggttgttttctcaagggtgagacctcgtctccgatctccgtctcttggagctagcattcccctctatccacagacaccacgtctgtcgtcatttttattttctgcaatcatttcttctcttggtagcttggagaagagttcatccttgttgatgagacaatcagtataaaccagaggttctcatttaggggcaattttgctcccccttccccagggacattggacaatgtctgggtctggagacattctggtttgtcacaagctggggtaggcaaggtttctactggcatccagtagatgaaggccaggggcgctgctaaacatcgtaccgtgcagtttccccacaccacagcgaagaattacacagcccaaaatgtcaaatgctgaagttgaaaagcctgatattaaccactgtgggcttcttgttttactgcaccgcaggtcggtctccctctctctctctttctctctttctccctctctctcctaccccaccctcccacctatccctccttctgtccctctgttggcatcagcaccactgaataaaaagactcggtcctctgttagccaggcacaatcgtccctttggccaatgtagaacattccctggaaaaccctccttgtacctgcctcacaccactgcaaaatgttcccagccactgttaaaagatgagcgacccccctccaccaccaccacacgaaaggcaggggggaggagctggggctctacacaaaatcagaggctgagacgggcactcggcccctcctcttcctctgtgaggcctcgtgttcagctctatgtgctggtgtccttgctcccgcagcgagttggaagactttgttgaagacttgaagaaggactccacggcagccagccgattggttactctgaaagacgtggaagacggggctttcctcctgcgtcaagtgggagaggctgtagctaccctgaaaggtaaactttctgctgggtcgggggaggagtctgagctgtctttcctgcggtgtttaaaaatctgccacatagaggattcattcatgtatgcaagtatttattaaacgtctacatgtgccaggcattgttctggacacttgggataccccacagcacaaagtaggtgcacatccccctcttcttggagctggtattagagtgggtgctgtaagatttcacactaaatgattccagtaacactttctatttgctaggctcttacagtgcaccgggatgcatgtgccaaacccgttaaaaacacaaggtgggaggatcacttgatcccaggagttcaagaccagcctgggcaatatagagagactcacatctctaccaaaaaaaaaaaaaaaaaaaaaaaaatatatatatatatatatatatatacacacacacacaaaaaaaaattagccaggtgtggtggtgcatgcctgtggtaccagctacttaggaggctgaggtggtaggatctcttgagcctgtgaggtcaaggctatggtgagccaccattgcaccactgcactccagcctggcagcctgggtggcagagtgagaccctgtctccaaaaaataaaaataaaaaacaaaaaataaaaaattaaattaaattaaaaacctgtaaccaggcacggtggctcacgcctgcaatcctagcactttgggaggccaaggcaggaaaatcgcctgaggccaggagttcaagaccagcctaggaaacataacaaaaccccatctctaaaaaaaaaaaaaaagtttttttttttttttttttctggccaggcgtagtggctcatgccactttgggaggctgaggcgggcagatcacttgaggtcaggagttcgaaaccagcctagccaacagagtaaaaccctgtctgtactaaaaatacaaaaattagctgggcatggtggcacaaacctgtagtcccagctactcagctgaggcaggagaattacttgaacccaggaggcggaggttacagtaagccaagatcatgccactgcactccagcctgggtgacagagggagactccatctcaaaaaaagaaaaaaaaagttgaattagctgggcatggtggtgtgcagcacctaaatagtcccagctatccaggaagctgaggcaggaggatcgcttgagcccaggtgtttgaggctccagtgagctctgatcatgccactgcactccagcctggatgacagagtgagaccctgtcagccagtcaaattaaaaagtaataataataaccctaatggtcaattggctttatcccaaatacacagacaggaaacaggcctagaggagctttacccttgcccaaggtgagtttctccaatgctcctctgtgctcttaacccactgccacctgaagatgtgtgagccaccctgtggcttgtgaactctgcacttctctgtccagtatcggagtgcgggatgagggttgtcgttctggctttttctcctccaattcacctgctggtttgggcctgcaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggaggtgaccgggccctcatcgtgctgggggtggcctgcggaggggtgcactgggaaaccgagagtggacgtttgggacttcagccttccaccatgctcccaggacacatccagtgtcctgaggaaaagccccaagtccttctcacccttgaacttttattgcaatatggcttgaggttctaattcttcaacacaggattgctaggtggagcccatcctagggtttaaaattaatagacacagtaaacattgttttaaaatcatctgaaaggccaggtgtggtggccactcaggaggtacaggcagaaggatcccttgagcccaggagtatgaggctgcagtgagctatgactgagccactgcactccagcctgggcaacagagaaagactccatttcttttaaaaaaatcatcggaaggtgggttttttaaaataacattttgaagttgaaaaattgattgaaatagtttattagcctccttcacttcaggggcatagatgaattcagttcaaagaaatgtaatagaagtaaacaaagtctttcttaaatgacctcctgaaggagtatctgtgagactgttggtcccacctagaaaagaggaacaaagcattttgagtggcctgggccaggcttccttaccaaaggtaaacctgctcaccgaagaggtcacagtggagtaaagaccaaaagacattcaggaatttcactgcaaagaaaattccaggactccacactcactgaaaacacatatgcatgcaaaatttgtgttgccagaagtaccttcactggccaggcacagtggctcacacctgtcatccccgcactttgggagctgaggtgggtggatcacttgaggtcaggagttggagactagcctggccaacatagtgaattcccataggtattacaggcggtggcgtgcctgtaatcccagctacttgggaggctgagggaggagaattacttgaacccaggaggtggaggctacagtgagccgaggttgtgccactgcactccagcctgggagacagagcatgaagtcagcttcatggagatgattattgaaaatgggaaagatcactgggtgcagtggcacgtgctcgtaatcccagctactcaggaggctgagatgggaggatcacttaggccaggagttcaaggctgcagtgagctatgatcacaccactgcactccagcctgggtgacagagcaagaccccatctctacaaaaaattattttaaaaattagccaggaagggtggtatacacctgtagtcccagctacttaggaggctgaggcaggaagatctcttgaacgtaagagtttgaggctgcagtgggctaggattgagccactgcactccagcctgggcaacagagcgaggccctgtttcttaaaagaaaagaaaatggaagagatggttgaggcagaatgatagggaaaggagagaacaaatccttggggatctctaagaatctaagggattggggtaaaaaaagaaacagcaaaagaaagagcactgagtagcagaagagttatagaatgcaatgtcttttttcaaataaaaaaaagtaacataataaaaaggggatgagggactaactaaaaattagaggtcaagtaccatgtttgacattgcctcacacataactttacaatgttaatgttagtcctaacgacaggtcctgaggaagtcattatcatcaccatcgtcatccccatcttcatcactccattttatgcaaaagcacctgaggcttaaagaggcgaagttctcaacgttatataaagcatgaactaactgctattcaaacacagatctgacaccagacactctgtcttttccactacatcatgggtggggagggacatatagcttcaaatgactccaaacaccagaggaagttgaggaataaacacgaccgttagatttcgagtcactgtgtaccttgtggcaagacttcgttgaatccaggtggggaagccagtgagcaacaggttgagatacagaagagcaaacagaaggaattagaatgtgggcggcccacccaagatgcttggcagtgaaaggaggagggaataagcaaacttttggcttagaactaagcatatttgagggctgcataggccagaatcaggcggaggagttagagaggctgctgttagactcatgattcattttcttctacccaccccccaaacaatgatggagttgcaagggtctgagcacaactgcaccagcagaaagggatatgtctatacatgtccctaagcggctactctgagctttgggatgtgtgactctcacctggctttgggatgacatagcctgcaagtataccaccatgagaaagtgacatgagggttaatgccgctgtgcatggtttctcctagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgaggtagagtcctatttctgtttctcataaccccataaaggagtctgatacatggacctttcccttaaagcatttataggtcagatgatgacatgattgtgtatggatcagagacagggttttggaagtggaagtgggattcagtggccaggttaagagataggtcatgtggtttcagagaagggtgagacacctggcctgtaggaaggtgagacacctggcctgtaggaaggtgagacacctggcctgtaggaaggtgagacagcagtgtgctggtaaatgtttaacaaccagctctctggtagcggttgtggcggcggggtgggggggcagagtgggtgcgtgcagatctgtgtgtggcatttgccaatttccatggtgtaaatatcgcaaccatggctgatttcaagttatgacatgacaccactactgctgaagttgggagaaatgtaacaatcagctctcctgggccaggacaagccggcttcaagcactccactgaggtgaaggcagcctggggagggtctgccacacatctagatgataagtggaacctggttagcatgggagggtggtgagggcatcctaggatactaaaatgctggatcaaagtctgggaccatgactaagcctgtctaagtggaacaagaacgaggacctaagactggggaaatgggctggaaactgacttgagtgcttgaaaaacagtccatgatgtttggagtttatttggaaggtatcagagaaatgctgcagctctaatccgtgattttttttaaatggcatcttctggaaattaatctagaaacaacgtacagaattgattgaggtggtgggtctagaattaagagagctggatgagaaattactatagtcatctaagaatgaacggtagagcagtcagaatgaaaagagaaaactaggtcttaagaccaaatgacatgaggccatgtgtggtggctcacacctgtaataccagcactttgggaggccgaggcgggtcgatcactggaacatgagtgcaagactagcctgggcaacatgacaaagtcccaactctaccaaaaaaaatacaaaaattagctgggcatggtggcgcgtgcctgtagccccagctactcagggggttgaggtgggtggatcacccaggcccagggaggtcaaggcttcagtgagccaagatcacgccactgcactctagcctgggcgacagagtgagaccctgtcttaaaaatcataagatcaaatgacatattatgtttttaaatattctttttatcaagggctggtaccagtgctccgataacacatttgtcttttctacttcttttttcttcttgcctcgtaacttttcctccactcatttgctttatcacccaacaaccttgtcgtaaccctcctgcctctactgaaagtcaccagtggagaggtcaggttgggtatatcgagacgacctggcaaaactgccacagccacggtcgcagcctcggggcctctgaacactaggtggtttctctgtgtcgcaagggccctggcttgcctctaatcagagccagctattttaaaaacgcatatcacaagggtacagaaatgtgattgacagagtgtgattctattcccagtacctagtagggcaggggagggaaagacatttcctcctaagaattggcagatccgtcacttaagacgtcttgccactttaaacatctcaacatttaaaggatgtcagtatgatggcactcttatttaacaaatctctgttgagaacctagtgggcatagttatcattgtgatgtgtgtattttacgctttgagaggagacacgagtcatctctgaaaatgccctgatccacaggtatggaggcctgggtttttctgccagctctgccactgacaaatggggtgagctttattcattcaacagagattactgagcctgttatgtaccaggccctcgtaggctcgggggaaagccagtgaacagaagagacaaagtctctgccctcaagacacttacctacttgtaggaagagacagaaaaaaagtatatgccaggtggtaataaatgctaggaagaaaaaataaaggagggttagaatggtgaaggtggtggctattatttatatgtaatgaaacttgggcaaattctccatctcgctggacctcaaagttcccatatgttgattcaatgatctttgccaattcttaggttataaggttccactaatcttggtgtgaatttccactctgcccccttagaattattaatgtgctggttcaaaagtcacagaaaacattcttttaaaaagtatgcagatgttttaaaatgcattttatgtataactctctgttgtggaacttaaaggagtttacaggtcatctaaataatacctcctccctcattttataagtaggacaatgtgacccagagggcatatagcaattctttgatagaagtggtactaagacacaggatttttgttcttagtgttgtgggttttgtttgtttgcttggacatctcttctacaatgaaaactcaatttaaaaaaattttaggctgggcatggtggctcatgcctgtaatcccagcactttggattataggcatgagccaccatgcccagcctaattttttttttaattgagtgagactcatgtctcactcagggcagaaggattccttgaggcaggttgtttaagaccagcctgggcaacgtaacagaacccattgctacttaaaaaaaaaaaaaattagccatgtgtggtggctgaacatgtgtaatcctagttactcaggaggctgaggcaggaggattgcttaagcccagatgttggaggctgcagtgagctataatgacaccactgcactgcagcttggatgacagattgagaccctgcctctaaaaaaatacatcttggtagtagaaaaaatacttttaaaagcatcttttttaaagttcaggggtacaattgcaggtttgttgcataagtaaacatgtcatatgggtttgttgtgcagattatttcatcacccaggtcttaagcccagtacccattagttatttttcctgatcctctccttcctcccaccctccaccctctgagaggtcccagtgtccgttgttctcctctatgtgtccacgtaacttcctttacgtgctatattcctccagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcaggtaagttccggtcccacagcaggaatatatggaggtacatggctttgggcaaatacagtgccatccacgacagcacatactcatcaacagaaccaatgtctcagttcttacaaatcttacaaaatgtaaaacctggaagagcaaatcctctggtgttccttagatctttactactatctctctctttttgttttttttttttgtttttttttttgtttttgaaatggggtcttgctctgccacccaggctggagtgtagtggtatgatcttagctcactataacttccaactactgggctcaagcaatcctcccacctcagcctcccaagaagtagctagggctgtagatgtgtacaccactgcacatgtctaatttttttttatttttttagagacaggtttcttcctctgttgccttggctggtctcgaacttctggcctcaagcaatcctcccaccttagcttccagagtagctagaattacaggcttgagccacacttgatttcactactactgttttatgctaaccacagtagagaagctgagttctgtgttaggattctagaataatggccaataaaggaaaatttaaattcatagtgtttgcgttttctatgcatttgtgatacttcacagcaagagctgggaaaatattaggcctgcatttaagacaagagcttttgcagaaagaaaatggtagcttttatgagctctcgggggatattagatcataaggcaaaattgcattttttaatcaaaattattagaatatgtatttaaccaactcaactatggaagttaaatgccaacatgtgaataataatataacttctaagaatctcaacctattaaatatcctatcagttacaagccacgcgtcttattctgatcttaaaattatggacccggatgttattttacttgcagtctaatgtctctgcagtgtcacattccacagtgccttatccagcaactaaaattaatttggaaaggaatccccatcttgacttgcatgttgagaaacattaaagtgtattccatttataaccaccgtacagtcatcccttggtatccatgggagattagttccaggactcccattggataccaaaatctgaggacgttccagttcctggtataaaatggcatggtatttgcatgtaacctactcacatcctcccatatactttacgggccagaacacttcagcagtgtgattctgctgcctgcctccatatactttaaatcatctctacattacttatgatacctaatacaatgcctacacattacttcatttgtgtggattcaacatagtacttggcacaaggcaaattcaagttttattttttggaatgtggagggaatttatatatatatatatatttttccatctgcagttggttgaatccacagatgtggaacccatggatgcagaggaccaactgcacttgtctcctccccagttttcatccatttcatcccctaaagttccactcactgcatccctccccctcagtctgtgctaagaggcttttcttacacctttccccaccatccagctgtgtcaggtctgtctagggtcctgggcggggcggctcttctcacacaaagtgactttcctctcacagtccccgtggagaatttctgatggagaaaatgccctagctcatcacatttttttttttttttttgagactgagtctcactctgtcacccaggctggagtttagtggcatgatcttggctccctgcaacctccgcctcctgggttcaagcaattcttctccctcagcctcccaaatagctagcattacaggcacccaccaccacgcctagctaatttttgtatttttagtagagatgggtttcaccgtgttggccaggctgatctcgaactcctgacctcaggtgatccacctgcctcggtctcccatagtgctgggatttcaggcctgagtcaccggccagctcatcacatttttatcttgtgtaattctgttctctctgccccattattaattttgtcatagagtcctttgatgttttatataggtctcataactgttccttctcatgattgaacaacaaaaacatattacattttgttcacttacctcattttggctcttgattctatctgattttttaaatttgcctaaatcacttttaaattactccccaaggtattttgacttagttaaaatgctcttgttttttcttttttaatgcatctctgacctggtctcagaaacagtacagtgatggacaggctaccagagatgtgtaaaggtagcatccgtgacctgtaaacattagtttctgtcattttaatttatttgtcatggagttatcatttttaatgtatttttgtttattaaggaggcaaatttctaagtgtagagttttaaataccatttgtatttccccttgtgtgaattttctgactacttggataatggaggaatatgggtagtgatcaaaaattgataaaggctggcgtggtggctcatgcctataatcccagtgcttttggaggccaacacaggaggaatcacttgaagccaggacttcaagagcagcctgggcagcatagtgagacccccctctttacaaaaattaaaaaatccgctgggcatggtggcacacacctgcagttccagctactctgggctggggcaggaagattgcttgagcccaggagtttgaggctgaggtgagccgtgatggcaccactgcacttcagcctgagtgaaagagcaataccctgtctcaaaaataaaacaaaaaaggcctggtgcagtggctcacacctgtaatcccagcactttgggaggctgaggcagacagattgcttgatcccaggagttcaagaccagcctgtgcaacatggcagaaaccccgcctgtaaaaaaaaaaagaaaagaaaagaaattagccaggtgttgtgacacacacctgtaatgccagctactagggaggctaaggtgggaggatcacctgagccccggaggctgaggcctcagtgagccttgatcacaccactgcattccagagtgagtgacagtgagaccctatctacaaaataaaaaaaattaaaaaatttgtttaattaaaaaaatcaaatccacttcctctccaactttgttctttgttctcatttgcatcccattttttctctggccctccctaagccagattctactctgacattgaccttcagcagaaacccctcttgctgatactgttttttcagactgagggatgaagtatttggaggccaagccaggggctatggatttgcctttgggcttcaattttttttttttatctatccaagtaatactcagctttttccataacaagaatgttatttaataatagtaggtaatactttacatagcatttacactatgccaagctcagcgtataagtcattcaatccttatgacaccccagaggaaagtatattatactacccatttaacagatgagaaaactgagaccgagagaggtttagtaacttgtgcagggtctttttgggatttaaatccagtcactctttagggtctatacacttaatccttgctctatggagagaacagaaaatttttaaatcagattgcattgggtttgtagcaatataccagactttctggatgttttcttgaaaaaagattattcttgtaatggtgcactgttttccagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggtctgataggctaagccctggtaaactggcctctgggttcagatgatacccttagacaaggttctctctgttggaacataaaaagtagtgaggcagagaagtagtaactcgaccacacaagatccccaggaagcaccacagatggaacaatggcagccagtatgattggactagacccagaccatgagttttatccttattttacttttagctgcaacaatatgaaatgcaaatcacaagctatttcccatgtgggcatcataagattgaaaatgagggtaggagggggaaacgcaagaaagattatcttccaaaggtaactgaggtgagctgacaccgttgtgggagtctatacagaaagatgttcaatgagctttaaattccacttaactaaccaagtgttagctttcatgttaaatgtaaaacacaatttccaaagagatgcagtatgggagggcctttcatgaggactgtattagtctgttctcagggtgctgatagagacatgcctgagactgggtgataaagggaagagatttaatggactcacagttccatgtggctggggaggtctcacaattatggcagaagatgaaggaagagcaaaggcacttctcacatggtggcaggcaagaaagagattgtgcaggggaactcccatttataaaacggtccgatctcgtgagacttattcaccacctcgagaacagcacgggaaagacctgcccccatgagtcaattacctcccacctgatccctccaatgacacgtgggaattacgggagctacagttcaagatgagatttgggtggggtcacagccaaaccatatcaaagacactgaatgttgaggagttccaattatattataattatttaatccattcaccaaaatgacaacttatgcaaacacaaatacaaactaaatgcaaaggaataaaatagcctttcagctattttctcagctaagatctaggaagcaagtgttctagacagtgagggaccatacgatctgtcccttttttgctagcacctaggagatgttaaaccactatctgttgtttcaatctcccacaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggtatgtggatgaggtgactgacattggctccttgcctcccgcctgggtctctccagccatggcactcacagatttgttagcgagaaggccagggaagcgcatggaccgggaccatagaagctgtgtcttctggccttagcctttgctttcccaagatggcgctgaacaaggctctcaggatgcctataagatgtgcaaggaatgaccatttcacaaaacaactcacgctttcctacctctggctgtaaaattgactttcctttctttccatcttaagagattctgcttcatttcaaaagcaagtaagataaggattagaaataccagccattgtcctgtcttgataaggacagactgaaggacacgttacgtgggttcccgttccttggctttaccacttagagccactgaccttggatcatggactcaaggccaatgactggcctcctgtggtccataaccaggtccctgttcaatatcaatgtcatcttttcagatattctgaaaagctgaattattttgttttccattttccttggtctatttgagaaatgatactgtatcagttttagatatttattttttaactatgacacagtccactcataggatgaaggatggcgtgccaaggctgtgcccaaaactgatcccacattcccatcacggatgtgattctaccccaggtctatgtcctgagaacttgtctcatcagagacatataaacaattcctagaacaaactttgtgtagagtatttcatttgcctcatgcttcttataggatttttctgtcaatcagatagttggaacaccagcaccttggggctcaaaaacatgttagctttttaccgacgtaccaatggctttgtgccaacccataaattttcctcttttctttggagtagggagaattttcaatctacattgtttttactgcacttgttctactctggtttccatggtaataactgccaaaattgagctgcctggattttgcagggaaaacagaactgctggttgatttgtcacatacgtgagccctttcacacttcactaaaactcacagactagcctgggacatccccgcaaccaatcaggctatttgcaggtttttagaaggcttggataattgttttcataggaactacagatttataaagctggtatctttcaggcttgtggataattttttacacctctctaagagaaatactaaatttgttgcagccacttacagcccaccactgagggacactcttctccattgaagtctaaatatttgatgccctctttgaccactgtacagacattggcatatctggcttcatgtcatattcttggtggttacataataaaagtggtggccaggcatggtggctcatgtctgtaatcccagcactttgggaggctgaggcgggcagatcacctgaggtcaggagttcgagaccaacctggccaacataacgaaaccccatctctactaaaaactacaaaaattagctgggcatggtggtgggtgcctgtaatcccagctactcgggaggctgagacaggaaaatcacttggacccgggaggtggaagttgcagtgagccaggatcacaccactgcacttcagcctgggtgacaagagtgaaactctgtctcaaaaaaaaaaaaaaaaaaaaaagcgtggtgaatgaagtgctctaaccttaacttaaccaaaccctgttagccctctggctgggatagaaacccagcctgctaaatccgcaactcgatcaatggccagtggccataatgattctcttgtttctgcaccttctcaaggcaggacaaggagcagctgtggccccttctaaggacagttgtggaaccactttctgtgctccacatctccaggcatcagaagaaaacacaggctctgaaatcgagggtctaatagctcaaaggagatggcaattggcatttgtaagcagctttctaagtaagcggataaaccaaacacatccggggcaagctaggactggtatgactaaggaacagcaaggagaccaggtacagcagagacaggggagcaaacagtcatggaagaaaaggccagagaaagtccctcatcagccaccttcagattttaggaccagtgttggaatgtttactgagggaggacatacattattctttctgctggcagagatatctccaaatgacaacatttgacataaagaaaacactaggcaattatttaggctgattcatttaaataagtggtctttcaccaggcacagtggcttatacctgcaatcccagcactttgggaggctgaggtgggcagattgcttgaggtcagcagtttgagaccagcctggccaacatggtgaaaccccatctctactaaaactacaaaaaaatcagccaggcgtggtggcgggtgcctgtcatcccagctacctgggaggctgaggcaggagaattgcttgaacccgggaagcagaggttgcagtgagctgagatctcaccactgcactccagcgtgggcgacagggagagactctgcctcaaataaataaacaaacaaacaaacaaataaaaatagtttttaatcctagctgcacattagaattactttgggagttaaaaaaaaatcctacagctcagagattctgatttgtgtattctctgagtggggtctcaagagtatttgagaacaacagtattttttttttaacctgggtggtatatagcctggttgagaaccactgttgtccataaacttgggtccctgagttaccagtctctccttctctcatgatcatattatctgggcattgcccacatgcccgcttcctttttagccctgtagacacagtctatgtctatactttctccctttgtctgagaactgaccttcctgactgaagttcacaagagccaacagttggctcttatagttttcagagacaaatctccagggttcaggcagctcctaggccactcggaatgacatcgttgcttaaaagcatcactttactctaaatgagcctcagaacacctcggagcgcggtagtacctgttactatttcagagaaggattgctaagagtacttttattgtaagacttaaaggtttaaaacgtcttgtgagcttttgctgtataatttcaataaaactcataaaaaaagaggaataaaaaagaaagatagttttttgttttaatttatttacatattgagcattttttaaatgtcaaagcaagaagccctcctaagtaccaatttatgttcaccccagacaggcagaaaaggtagtaatgtctattttatcttggcattccccaagaaaggaaggcagcctttgcctcggactctgcctccaagccagctttgtcaacatgagagcacgtgaggagcaggatttcagggtgctgcctccctggcctaaacctgcgtgcaggacccgggttggggtccacaagcgtctggttgttcctgcctgtttccctccattctcctcagtacccttggatccctgttaacctcagtattttaattccttaggcattccagaagtgttcctttatggatgtaaattcaaacagtcatgctgagccatcccgggctgacagtcacgttaaagacactaggtcgggcgccacagtgccacccaaggagaagaaggtaacgtggcaactgcacatttgccacacggttgggagtccttccttccttgctctgacactaacacggctcttatactcgacctttgtcccctctgtcttttttctctctcttttttttaactaatggagacacaggcataggttaaaatcagagatatcttgctcaggttttcagagcaaacactgtgttccagcccacagcatacaatagtatatgcagaatttagacactatcttcccaaactaaagagtgaacacctttcagtactttctagaacaactctagaaagaaatatatagaaacagcaaccaagtatttagcagtttttctaatttgtaagaccctttgggaaaaaaagaaaaacaactatatatgttaagaaaaataggtaaaaatcggctgggtgcagtggctcacgcttgtaatcccaccactttgggaggccgaggcaggtggatcacctgaggtcaggagttcgagaccagcctggccaacatggtgaaaccccatctctacttaaaatacaaaaaattagctgggtgtggaggtggacacctctattctcagctactcgggaggctgaggcaggaggatcgcttgaacccaggaggtggaggttgcagtgagccgagattgcgccactgcactccagcctgggcaacaagagcaaaactctgtctcaaaaaaaaaaaaaaagtaaaaacctttgatttgggaaagaaaatgcatggtagaaagtatctaccaccacacactggtgtaacctcatggaaacatacaaatgtgtatttgcacaaacgtccaaggatgccaaacagaatttttgctaagtattatccatttataaagtgtaccttccaagatagtaagttcagtatagttttagtgttaacatacatgtgtgatgtcaaaaaaagaatccaggctctgaaacaaagtctgctgtcattgtataagtaagcactctagggaaacgaccatagcctgaatgtttgaaatgcaactttaagttgcacctagagcatctctgattttcagatataaagacatcttacttgaattaagcttccatctaaacttcaggataaaaagcttgcaaggcctaacatttttctccagggacttatctttcagaattcaaagattctagctttccttaaacaaaatcaaactaatcagatgcaagagagcccaatagctactacagatgggtacctcagtccatgtacgacagctcaaggaggtagatgtagtatcacaaaactgaaaggctattctaacacaaccattcaagagacacagttttgggctcccagctcccagccaagaggccttgccaaggaggccagcttgcttccccctggctcataaccaccacggcacccttgtgtaaactctctgccacataaattgacatgtgacactgttaatgggggaagggaatctcgctatatccaaggggggttattgttgataaatgtttctcatgaagaaaacctggcctggcatggtggctcacacctgtaatcccagcattttaggaggccaagacggaagaatcacttgaggccaggagttcaagaccagcctgggcaacatagtgagatgaaagaaagagagagagatatggagggagagagggtaggagggatggagggagggagggagggaggaaggaaggaaggaaggaaggaaggaaggaaggaaggaaaaagagaggaaggaaaaagagaggaaggaaaaagagaggaagggagggaaaagaaagaaaacctactaatttgaactgaacccatgaaaccatgttggaaatatattgatttttattgtttttggttttttttttttttttttgtgagaccgagtctcactctgtcacccaggctggattgctgtgacgtggtctcggctcactgcaacctccgcctcccgggttcaagcagttctctgtttcagcctctctagtagctgggattacaggcgcctgccaccatgcctagctaatttttgtatttttagtagagatggggtttcaccatcttggccaggttggtcttgaactcctgacctcgtgatccacccgcctcagcctctcaaaatgctgggattacaggcgtgagccaccgcacccagccggaaatatattggtcttttcagtatgtggaatttccttatgagggcttattaaaactaactcatggaaggcctggtatagcatgttatacttaggctaatgtgaccatttctgtctagaacactgactgggaatttggactttctcaaagatccctctggagaccattattgtctcattgtagaatttttcttttcttttcttttctttttaattgaaatggagtctcgctctatcacccaagctggagtgcaatggcgccatctcagctcactgcaacctccccctccccggttcaagtgattctcgtgcctcagcctcccgagtagctgggactacaggcgtgcaccaccacacccggctaatttttttgtatttttattagagatagggtttcaccttgttggccaggctggtcttcaactactgacctcaggtgatccacccgcctcagactcccaaagtgctgggattacaagcgtgagccaccgtgcatttctaattggctagaaagtggcatgagatttcttgccccataattagaaatccatatcccattggtctcatttatctcagttgaggatccactggctaataagcaggtctttattgagtgcccaacactgagtttagtcacaggtgcttattctggataattaatctcagtagattaaccttcttcagaatgaccatgtatatcagacttctcttatccccaattctgggtccttattaacctcttccagggctaagtatttacccttccataaatcggatgttttcttaagcattttttctcctgtcatcactgaaactccagcctagttcttcacttgtatgcaattttcttgtaaccctgtctctcgttttggtttattgtccatatgcctattgagtgcttttccagttgtcttcataatccaaatcccagggcctataaatacatattaaagaggcataattacctttcacccagagtcttgaccatctaagactaagaaatcactgtgagtttgcatgacaattatgaccaagctcctgcacttgctttgatacattcattcatttttttctagcccagtgataaaaagtataggtcgtgtgaaaaccaaacttcacatttttatcctagtgactttccattagagcatttatgctactactcagttttaaaatacatatattacaggggggatttttgaaatttatttatttatttttgagaccgagtctcgctctctcgcccaggctggagtgcagtggtgcaatctcaactcactgcaacctccgcctcctgagttcaagcaattctcctacctcggcctcctgagtagctgggattataggtgtgtgccaccacgcctggctaatttttgtatttttagtagagacagggtttcaccatgttggtcaggctggtctcgaactcctgacctcatgatccacccacctccacctcccaaagtgctgggattacaggtgtgagccaccatgcctggcctgaaacgtttaatgatgggaatggcacaggccatgaccaaccaacagacaccagccctaacctccagtaaatagacccccagaacatctgccacgtgtgtgtctttagatcacatgccaaatccatccacgattcagggggcaaattctcatttgggtcctagcatgatatgctgactccatatttggagttgtaaccttaggctgaaaccttttttttaaattcatttacatatatatatacatatattttgagacagaaccttgctctgtcgcccgggaggctggagggcagtggcacgatctcagctcattgcaacttctgcctcccaggttcaagcgattctcctgcctcagcctcccacgtagctgatattacaggcacccgccaccgtgcccagctaatttttatattttcagtagagatgggatttcaccgtgatgaccaggtcggtctcaaatttctgacctcaagtgatccacccaccttagcctcccaaagttctgggattacaggcatgagccactacacatagcctatttttattttttatttttgcgtatatgtgatggagtctttgccatgttgcccaggctgttctcgaactcctagactcaagcaatcctcctgcctcagcctcccgagtagctgggattacaggaagctcaattatttttcttctttaaaaccttttacttgacgtattcattgtttcatattttaaatttaaaatcccacaaaagaagccatgtggctccgctgcagcagccgaatcatggcacttgtttgggggcttcctggggagcaagcagaagtaaaacaggaggtatttggtggctcgtgtaccttgtactttgcacagtatttgcgtgtgattaattctgactgcgttgtttgtgtgtcattcctcaggcgtgtatgaacagtctttccattcttaagtaaggtcataggggttgctctgggttgactttggctgggcccgggtgtttgtgctttgtgttgtcattgctttaaccaagcagccttcatgggaattgtgctccatcctgctataatcaatcacctcagcatgaagaaagggcagcagtgccttggaaccgacaaggcatcactagtgttagtgttatgtcagggcctgaggctactgatacaccttgggaaaggccaggcctccaggtgaagcgccttgaatacctgggtcctcaccactggatccttcactcctgaatcttggtgagaccctaagacatgtatcttcagtctacactggaaaatatagagaatgaaagctgagtcgtgacgtcaccgtcaccaatgtaacctcaaatatctgctttgtgaatgtttaggttctattgtaacagcatgatggatatgaaccaaggttctattgtaacagcatgatggatatgaattgaggttatattgtaacagcatgatcactctgaatttggatttggtcatcgtggctatgaggagtgtgaaggttattttggcacttcgacacctgcagtacaaactgcatttcaatctgtcatttgatcaggggaaaataatgttttttcgtccccaaatgccaaacccaaccaaggcagatgtctttataggataatctccataacagaagcagagggaggactgaaataatgagctgtaaggggaactaaaattcccctgggctggttcctaagtttataggcaagaaaactgaggccaaagaagtaaagtgacttatctaaagtaacacagtttagtggcagatcttgattaggatcaaaactttctgtcagcccatacattgtgcttttcacaattcttcaggttttaaattctgctaagctcacaatctgatgttgaaaagaggacatgttagtaatgactctgtccctttattttcttcaccactcccctacaaaattttaaattcttgaaatcttttgctaattgagattttcatcttgtgcaaacacagggcatttttggcagttggagaacaaagcaatccaaggtaaacagctgtaggctttggattggtgtgtaagaaatatgcgtggcccgcatgtcttagaaatgtaattaaaggaacgatttagttatagtccacttttttggggggatgtggttttgtggagtaacatgtcctacactattctaccagaatttggaatttttccatgaagatgtacggaaatctgatgttgaatatgaaaatggcccccaaatggaattccaaaaggtgagttcaccagatctgggttccgaccaataccatgcacattaagtacctgcctctgcagatccattgctgattaacgtgtgtggtttccctcctccgttctccctctcaggttaccacaggggctgtaagacctagtgaccctcctaagtgggaaagaggaatggagaatagtatttctgatgcatcaagaacatcagaatataaaactgagatcataatgaaggaaaattccatatccaatatgagtttactcagagacagtagaaactattcccaggaaactgtgcctaaggccagtttcggtttctctggcattagtccattagaagatgaaataaacaaagggtctaaaatctcaggcctgcaatactctatacctgacaccgagaaccagacgctgaattacggaaagacaaaggagatggaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaagatagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaagcaactcgccgctctcactcaagccattcgcaccggaactaaaacagggaagaagactttgcaagtggtagtctatgaagaagaggaagaggatggcaccctgaaacagcacaaagaagccaagcgcttcgaaatcgctaggtctcaacctgaagacacccctgaaaacacagtgaggaggcaagagcagcccagcatcgagagtacatctccgatttcaagaactgatgaaattagaaaaaacacctacagaacattggatagcctggagcagaccattaaacagctcgaaaatacaatcagtgaaatgagtcccaaagccctagttgatacctcatgttcttccaacagagattctgttgcaagttcatcccacatagcccaagaggcctctccccgacccttgctagttccggatgaaggtcccactgccctagagccccctacgtcgataccttcagcttcacgtaaggtatcttggtctgctggaaaatgaaaagacccagctgctttcctaaatctgccataatcaccattagtgaaaggtgtcttgtaacttaattgctttctttcaggtggcttttttttttttgtctgttcgccatgaaacccttctttcatactttctccctcaccttccaaacaacaacaactaggtatctaacagctaatcagttctgtttttgcctctgttgctgactggtgttgggtaaacacgaggctgctgggtcagccatgtgctgttgaaatggttgctctgatactcacattaaaatccgtttgatcagtagtgagcagttgattctgtttgattcttctgattaaccccagttggtgtctcctagatctgtcctgcatgtagggctgtggcttctcaccttgagcttctctgcacatcgtggggcagcctcacagatgacctactcatgcgcttctccttctcttccccctctcactggtccttcccacagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttttttaccacgcttttgcatgcttgcaataaaacatcttttactttgtgactccaaactccaaattttaactgttaacacacggtgccagaccaggtggcttttctttggtgaatgtagtgtttcatctgaacacctcgggaagcagagacaaaccaacctgtggttgaactgcccttaacgtcaccactactaacgtctatgttgactgtattgtgttagaagcacattaacactccgtcacaatgcccgacccccaccccagtaattatccagacgcatggcccacctggcacacaggaaatggtagagctggaatgatgggactcctctcacaaatgtattcttcctttcctcctttcccgtccatcctttgctatgtacatggggggtttctaccaggtccagtagagcacaacaagacttagctcaggccttgaactgtgtttggttggttttctttgattgaattattctcagaagggctgtgttgccaggccctgtgggttgatcatgtgaccgcctttctgacaaaatgtctcccgccatctttatttgcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttggctttttttcttttgagtcctcaacttaaaaaattattgttggcctagagggaaatacgcttacaccatatgttttcatttgttaaaatgggaagaagccaggcacggtggcttatgctttgtaatctcagcattttgggaggctgaggcaggaggatcacttgaggccaggagttccagaccagcctgcgcaatataatgagaccccatctctaccaaaaataaataaataaatttaagttaggtgggcatggtggtgtgtgcctgtagtcccagctactcaggaggctgaggtaggaggatggcttgagcctgggaggtggaggctgcagtgagctatgatcacaccactgcactccatcccagatgacagagcaagaccctgtctcaaaaaaaaaaaaaaaaaaaaaaggtgtgggggaagaaaattagtgaaaacaataccaggattatgaattaaccacaggaacaatctcaggaaactacttagatttttcacctcagaatgtttcatttggtgatttcatgtaaaaagcaaatatttttggaactcagttgttcagtgtttctgagtttcaggctttcttacttcaggatgcctccgccagaaatattcatatctctgttcattatgttaatggcagtcccgtgtttcaggtggcacttaggaaagtatttagggtccaacatttcaatcatgtcccataatcaccttaatgacattatattcatttatatataaatatatctcatagctaattcatgccaatttatttgcttctgtttatggacaagctgaaaattctttataagcagcaaaacagcagatggtgggctcactttttcagtttagcttcaggcttcccagagagctctgacaaggtcacagaggtgatggtagtttcagccaatgtcgtgaaggatgggacatgttcacccggtaagggaaaactccacacagtcccatccactgccctgagatccgagccagtgctgcctgcctcttcaggaaactggaggagaaactaccatgattggagaaaccagagtcaggtgttgcaaagacttcctatcacagcacagacccaggaggtgcctgtctaaattagtgcaatatagctcctgccttggtacccatttttaggcctgacctaagtatttattgagacggagtcttgctctgtcgcccaggctggagtgcagtggcacgatcaaggctcactgcaacctctgcctcctgggttcaagcaattctcctgcctcagcctcctgagtagctgggattacaggcgcccgctaccacacccggctaattttttgtatttttagtagagatggggtttcactgtgtcagccaggatggtctcaatctcctgacctcgtgatccgcctgccgcggcctcccaaagtgctaggattacaggcatgagccaccgcacccggccaacctagttgtttgaaaccttgtaccctgccctctatggcctcattaaaacttcgcctcccagtgtggtggtttgaaaaatacagcccaggctccttcctcatcccaccaaccaaaaacccaacatgccccacacctgcgggcccgtggtaaaacctgatgattaataccagagtcgtgtcaataaatttcccctgcgcacgtgttttcttgaaactaaccaatccacgacccccatgggaaagcctaaggggtaacgcccctggaccctgatagaagcacagcccctcaggcttgctcactctcactctctccccacctcttggttgagctctgctgtcactgcctccagacctctcatgaaggccccgccaccaccctccctggaatctgtaagtaagatatttcctctgtttggtgcatttttggtttcgcctcctcacttgtgccttagctgaccaacacacccaaacctaactgcaccccaccccatcagggcttccctaaagaggggctatctcggcttatggccactctcgacagggaaacctcaagaccaagttagaaactgtaacaataaaaactcacgatagcacctcggttctttgaatatctacagtgaatgatgttgggcaggatgagctcagctcttgggttttcagattttgctaaactacacttaacagacactcagttaagacagtctctctctctttttttttctttgaagagacaaggtcttgctctgtccccgcaagctggagtgcagtggtacagtcatacctcgctgcagcctcaaacttcggggctcaagtgattcccttgcctcggcctctggagtagctgggattataagcatgcaccaccacacctgcctgtcttttaagttcaccattcagttattcactgtatctaaaaagattcttagaaataaaccatgtggcttctcaggtttattcaacgatcagtccatccagccctcactgagcatcttctgcacgtagcatgggatgaggaaggcatctggcccacggcatcagtgctgctttctggttgtgccaccttgggtgtgttttggcttcttcacctgttcatggagaataatagcacctactaaaaaggatcattgggaggattaaatacgatgtatacaaaattctgaagacagagtcaaacatacggagcactcaaaagttaatgagggccgggcgcagtggctcacgcctataatcccagcactttgggaggccaaggcgggtggatcacctgaggtcaggagttcaagactagcctggccaacatggtgaaaccccttctctattaaaatacaaaaaaattaactgagcttggtggcacacatctgtattcccagctattcaggaggctgaggcaggagaatcgcttgaacccgggaggctgaggttacagtgagccgaggttgtgccactgcactccagcctcggcaagaagtaagactttgtctaaaaaacaaaaaaagttaatgatgatgattattactgctgcggtgacagctggaaccagttctgcccttgagaggcatcagtctagttggggaaagcgtggcacacataccggggagatcaagtcacagttgatgcaggtgggggagtgcgagcagtcctggcagttggctacaggagtgcagagcaacgggcttgtctggtgcttcacagaagtggtggcacctggcactgacaggtataatacagaacttataatagcgttacagcatttttaaagaagctggttttcttttaatgctacttgtgactggatttttttccaaagtaaaatagacatttacacagatggagaaaagccaaggccctgggaatcatggctcagaattatggttcttttgtgaagtcacatgtgcaggcttgggagaaggtgctcccaggtcaccccaacccatattcctcagatgatgctcattcctgggcttgagtgcaaggggccagacccatggggtaagagggacacatccactgggtgctgagagcaggtctggccactcccctccccgcaggccacatttaaaacataaacctgggcctcttcctgaatgccccaccttgtaattctagctaaggtcctccccacctccaaggctcagtaaatgcaaaggcatttcagagcaagcaggaaattttttggaggaagtagaggaatgacagctgcttcaactgaaaattcaaaaggtaattttgcaaaagaggccagctgacgttgtccaggaaaacatagccctggcatcgggcaaccactcattctttgatctatgctcctaagaaggtaatgtccgaaagaataacccgaaaagcacctctgagaagagagtcccaggccctcccaaggtgcatgtccatctagctccaagtcaggtgcccaccttagaagcaaatgttcgccctgatggaacgaggaaggttaagttatgctcaccactctctgccaagaaggcaggagagcttacagtgcatgccttcgatttgcacaaaatgcttaatattttaattgcccaacgtattgggtggtccttaatccttgtgtctgtgaacacatcagcaataactgccatctgttgcctattatgggccacgtagaatgctaaggtgttttgcatctattgtcttttaatcctcacaaacactgaaaaagttcctgtaatttatccctcccccacttcactgcaggacactgagaacaggcaagaggtgacaagtgcagtatgcacctctgggcactcgccatcctgcttgcggtgggggctgctcaggttgcccctttgaaagaaggtggctttaaggggaggtttttcattcctggatcagacgaatgagcacaatgcagaaaattatccatttgtgggattattagattgcaaattttggttgcctcaccttcaaaagatgcgtaggtagagaccccttccacttaaaaggctaatgttctcatctagtattattgttggaaaggcggtgaatctggattggaacctgggataggtactcctcttcccctaagccccaagtggtcaactacaactctagggccctgagctgggactgcagggaaggcttcacctgccagaaagaccacaccccagacaagccaagccaagcccagcctaggtcctacccgtaccaggccccacctcctcctggccttgccacgcccctccaggtactgcctcaacctgcctcagctaagccacgccccacctttctggtcacacccctcgaggcctcaccacacccctcgaggcctcaccgcgcccctcctgctggtgccttcgggaacttcagctgctggagaccagggtaagcggcccccaagtgcctcctaaaagggttttctcgaagttcggcttctcggcagggacttgtgagtaggcacctcagcctctcagagtgatcctttgaaattcaaggataagtctcaattccaatggatccaagcccccttttagttacaaatgttttgtacgagatgaaattccttatgacatctcctacctactcgccttgtttcaaaaataaaatacaatgtcctagtggcactataacaaaggtataattattaccgtgccatgcacgcacccatcagcagaattcacattcagagacgagtcgtaccggggactcgaacgctgtgaatggctggtaatgtgacttttcccaaatagcgaatgacttggttgaaagctttgaacaaagcagaatacgactctccctcactttacacgttcctgaaaaattttattgcacattttgaggctgcaaaagtgtttaaatataaaataaaattggcctctacactcggatcattataagcagggtttttccttacgcatatgtccagtgggacgtgaccaggtcgtgctgggggtgggggacagtttttcctgggcagctgactgtaggacatcccgattcagcatccctgacccctacacactaaatgccagttttgcctctaacattgggacaaccagaaaactctccacaaatacccaaaactgcctttcaagggcggcattgctgtgactcagaaccactggcacagagtaatgaacaggggcctcattgttgagtcgggacaaaccctgagggcataaggacccaacagggaatcttcaaagtacccagcccagtgacccctccctgtgtaagaacagcccttaggtacacatggagagccgggggtgcctcagtgacctgccactcccgggggattttcaggaagcccatactggtattagcatttctgttcttttccttcatgcctggaagaccaaatggttaaccaggaaagggccaggcgaggtggctcacgcttgtaatcccagcactttgggcggctgaggcaggtggatcgcctgaggtcaggagttcgagaccaggctgcccaacatggcaaagccccatctctactgaaaatacaaaaattatctgggtgcggtgctgcattcctgtagtcccaactacttgggaggctgaggtaggagactcacttgaaccagggaggtgggggttgcagtgagccaagatcatgccactgcattacagcctgggtgatagagtaagactctgtctcaattaaaaacaaacaaaaaacaacatgaaaggaatccaatctctaagcaattggcaggagggaaagaagagaacatcttggaacgatgagtgggaatggatgtcttagggtagagtgctggagccctgggcttagcaagatggaacttggtaccaggaacttagaaccagggccctagcctgccacagacaccatctcctttctgacttaaacgtgaaaaccttgggaacaggtgatcagtgggggacacccctgcaggggaggaacccaagaaagctggaccctgtactggggataggctcggctgctgttccagcttctcaaacccgtctgcacaatgcaatcctcgaaaaagctttcaaaatgctgccgcctgggccctgcccacagattctcattcaagtgctcagaggtgctgcctcaacaaacggaggcttttaaaatacccccaggtgattctcatgggaagccaaggctgagaaccacagtgtcaatctagaaaggtggaggcccaggcgtagtgagaaggtgctgttccttaaaaataaaggtgactgttaccaaccacaggagatccgcgcctgaaaaagtacagctcagccaccacttctggatttttttgaaaactttccaactgtttttaaaataaatagttgaaatgtatggacttaatttttgtcctctaggtagtgtcagttggggcattttagagtctggctttgcgttttgatacttccaaactgcagggaccttccagtgttggctaagtctggagcttgttttatttgccaggagctaatgtgtatacgagtgcccttgaactgggagtaatttagggattagatttcaggaaagtacagacatagccctttccttagcctctggaaattctagtagtcccaaaaatggttcctaatacttggctgaatgagacatttcatgcacgtttgttacagaggttctattaataatgcatatcgttttagtgatgtatttcaaatgtttctccaggcttctattggacatagtgtcaataggtaaagccaaaaattagaagtgcagagccattctttgaaggagagagattccgggagggtggctcatgcagctgtgatttgggatctgaggatagggcaggagagtgaggaaacggatactcgtggtcccagcagaggaaccctgggcaggagagagcccatcccagacttcagccttgcgaggcaagaccccggagggtggcatggaggttccctgcccatcaggttaaaaacataagcagcaccaggcccaaaccaacaggtcccctctcctctccaattgccctcagtgtgtccctcactgctcagaggttttgcactttcagtgagaccctccccaacaccaccaacatccaccccgcgcgtaatcctgcccatcagcatgtagacaggttgcttctgctgcttcaccaccctcagcccttcctcagtttctctatgttgtatgcatgcctggtcttcacaccctgcttctcccacttctcctggttcttgaatcaccgtgaaacgatcacctctagtgttacctacatctccgtatctccatacctaggacacacttttattctttgtctttggctttatttaaagcctttacctacaagtattctatttgaaacaaatgagatgaaagcccctttctatggatgaaggacagtagggaccaaccttgtatcattaccagtcaacacctctgccaggcaacaggaacacagatgatccccaatgttgggaagcgacagttgagccgtcctgtctgcagaagatattaagtccttctctgcagcatgttgattggatcacactttgtttgagccggcattaaaagtggtatccaggactgctccataaagagattggatctaagatagcacattggaccgatttaggattgcagatggattagagattgtattagtccattctggaattgctaaagaactaactacctgagactgggtagtttacaaagaaaaggtttcactgactcgcagttccacaggctgtacaggaggcatggctggggaggcctcaggaaacttacaatcatggcagaaggcgaaggggaagcaggcacgtcatacgtggcgggagcaggaagaagagaaagcaaagggagaagtgctacacacttttaaacaaccaaatcttgtgagaattctatcatgagacagcactggggggtggcactaaacgattagaaaccacctctgtgatccaatcacctcccacagggcccacttctgacattggggattacaattcaacatgagatttgggtggggacacagagccaaaccatatcggagacctaagatttcttagatctgtaaggaagccagaatttgtctttgacctgtttggtctcctcccttgagtgttatctcctttgtggttttgagctcatctgaccacacacaccagggtctgagtctggggcctcagccgcctccttcctcatatccctggtgtcctctgggctggaaaaggaggtctctactcctttctgagaagtgctttttttcacctgacatcaactctaggaagctaagccaagaaggcttagctgagctgtttgattctcaaacagttggctaacttacttggaaatggagtcagggaagaagatgttcaggaataactagatcattgtacagtgattgcagctgcacattcttcagtctcacaaatgaatagaatccattgcacagcagaagttgccctgccaggcctagcacactttccccctcctgcaaaaagaatgtccgctcactgagtgactccagagaaaggggccctgacctcttcctgccccttctgtctaaaatccctcaaaggagacactcccaaggtcaagcgtggcatccctgccccacggaatctggcgtctccctatctttcagtgggcgcctcgcccacctacccgcggctccctctggcccagccaccctgttctttggtctgctcctcctcaagccccagccacaagctgcttcctgtgcctggaatgttcaccccaccacttcctcatcctgatctcagctcacacgctgctcactccaggaaacctggatctcaccctctatgagttcaccctccttcacagcacttagtggaaactaaagcagacagtgggggtgagtggtggtcagtaaattatcaagtgcaggaatcaatgtctgtattacacacagaggaccccaaggcaggacctgccaaaagtcaggtaggttcatattcttctgtggggtgcaggctgggggacgaggtatgaggggcacgtagttcctactgttcacaccatccacatttaacactctttaagacttgagattgaagactcctttaagaggctgcatctcaggaaaatactgttcacctcctgccatctggtggtcatctggaacttgtgcacctcgttgaatttctcaactttatctcagtttttgctgcagctgtattatatagtttcaaatagctagaaggaggatttttttttcctgagatggagtcttgctctgtcgcccaggctagagtgcgatggcatgatctcagctcactgcaacctatgccgtccgagttcaagtgattctcctgcctcatcctcccgaatagctgggattacaggcgcccaccaccacgccaggctaatttttgtatttttagtaaagagggtgtttcaccatgttggccaggctggtctggaacttctgacctcgtgatccgcccacctcggcctcccaaagtgctgggactacaggcgtgagccaccgcgcctggccagaaggaggatattgaacgttcctaacacaaacgagaaatgtcgaagatgatggatatgttaatcacctggatctgatcattataccatatatatatatatatatatatggt

SEQ ID NO: 299 - DNA, 112477 bp, Homo sapiens
gcggtgacagatctctaagcagcagccagctggagtgcctgagcagaaaagggcaggagaagaccaaagggttccctggggcagacatgtcgggcagtctcaacaatcgcacaacaaaggatgaccccaagggctcttccaagatgccagctggaagccccaccaaagcgaaggaggactggtgtgccaagtgccagctggtgcgaccagcccgggcatggcactgccggatatgtggcatctgtgtgaggagaatggatcatcattgtgtctggtatgttggaaacatttggagacttggaaagtgtaaattcatgtaaaactctagttacattttatcttcccttgtgctatcccaaaatttctctccttcccagctttacaccttgtagatatttgtgggttgttgtgatgttcccacttagtcatcagtttttcgagtttcacaaatttagttccttcagtcatttcctgaaggagaataacagaaaacttgtggggttttttttttctcaattttcttttgaatgactcctcatttatcttttcctttctaatagagaaatatctacagttgaatgattttttaaaaaaagaattgatcagaaacagtataagcatatttccctgtgctattcctttttaaacataaagctcaagaaagtgtacccctatttttaggtgactcttttgtccccttgccatacatacttaatcgtttttgatgctaccgatgatttccacttaacattattgaatcgaggtcccaccagataaactctctatttgattatttgcagagaaatgggcttttgtacctgccagttggccagtaacaaacgaaggtacataaggctccgtaaaatatgaagtgcaatgtttaaagataatgttgcagcttcactaaatacatctaaactaaagggactataattaattcagatatgaatgctgtaagtagcatgtttgcagtttattgctcttcaggcagtcgtgatcaatgaattaatgcttttcgtgtctaggattctggtcctgtagcgtacctcctcctcagaaggggatgcaggagagggtgagggtgcagaaaaggctgagaggcattggcgtgggcctcaagtgcatggctcaagtgcagggcagctcttttctgggtccttgtctttagaagtaaacaggtgttttcatttttagatgttctacttctgtgtcttcacttattcgtgtgtgtgtgtgtgtgtgtgtgtgtgtgtgtgcgtgtgtgttccatttacaaatgctggtttgcagaaggctcacctaacagcagatatgtgcccactggagcatcctggcatgcagtgggtagaaggcactccctctacattctgccccacaaatggccatgacacagaactgtttttacctgccaaagagcctgcatgttatcaagttgttcttccccctacgctatgtttctaacctctttggatctttatattactcttcatatatttaacatgaattttcccatactatgtaatacttctgatttagcatttttaagttttcataattctatttatctccctttccttaacatggtgaggacaatgttagatctccatagctgggtaatattgatatttaggaagatttgttagccaggttctgctttttatacttagtcttgtccttaaactgacgatatgattccactttgcgaagagtagagaatataagactgcattcctcagggtgcaagtttttaattccctaaaattgaaaaataagagaacttcttaataactggaatttacattttccctatttaaaaccttgtcttggctgggcgcagtggctcatgcctgtaatcccaacactttgggaggctgaggtgggtggatcatgaggtcaggagttcaagaccagcctggccaacatggtgaaaccccatctctactcaaaatacacaaattagctgggcatggtggcatgtgcctgtaatcccagctacttgagaggctgaggcaggagaattgcttaaccgggacccgggaggcagaggttgcagtgagccaagatcgcgccattgcactttagcctgaactacagagcaagactccgtctcaaaaaaaataaagctttcatgtttattatgtaagttatatcaagaactcttaaaaatgtgtttgcttttttatttctctatgctgttttgaggataaatagctgcgttggagaatcaaatcatcaagcatttatacttgcccttttgatcttcttgctcacctcggtgtatgggatcacactgaccttggacaccatttgtagagacagaagtgtcttcacagctcttttctattgtcctggagtttatgcaaattacaggtgagcagtgggtaccacagtatggaggccccctgggaagtaatgggtgttgccattgacagggactattactacttggttaggagttctcaatcaaaacataggccaggctatggaaatgctgggtatccctggaattgccagcaaaattgtgcattggtgatgtgtgtttttcaagggtgctgttaaaaggattgttgacctttaaaaagtgaagaactagttctctacaaacaggaccaggcctaatcagggacttccagagtcaaatgaccactcataggctcaaaagtcgcaacagtgaaacagaaacaataaacaaaaactagcagccccagggcacatatgtgcctattttgtcataacgatcagaaaccttctcactttactgctgctttctgatgttttttagtccaatcttaatttactgcttccgacccttttgagatgtgctcgacatctctataaccttgcttttctttctaacctctcttggtttttcctgttctactttctttctttttttaatcaccactgatgattactgtgatatgtaggtcaaaatttccttaggcccctttatagattgtgaagatttccaggccatggcaaaatttgggattcttccgcttcggcctcagcgccccctccctgaatgctggggcccccctctgcccatgctctttattcccttcccttcatcatcctctctgacataagtgctctggggtatctgtggtttggcccttttctttattctcactcttcattttcagaacaatccttgctttctttacaaagtatccctttgtggcatttgtttttattagcctgtggacagatctccccattgtcatcctagaaccagacacctgtgggcattattagaatagattggtcttcctcagattaagtttccttcctcactgtgtggagagtatctccagcatgtgaatgaaattctctgctaacgctgcaggtgaggcccgtcctgaagcacagcatgtctgtgcactctcggtgcggaggcgagggaaccgaggaatacagtcctgccattgcttctcaccctgctctgtgcaggcgattcacagcacctcatctttttggttaggtccttggatttaatagtctttgaggtcccttcagcttttacaaatgaagattctgaatgaacttatttctaactaactcttaatttgcgaatgttggaaaatcatcaaatggcagaggctaactggcagcctgtctcattagtgagcctgagaggagcttccctaccttgtgtgattgtgttgggctttaggagggtgaatttggaatgtctcggtgttcctacatccaggtaagcacagggctgctggggttgggagtcgtccatcgtcttttcattcctcagcattggactggaaagaatggagattagtaactttagcactgttcctcggcatccacctgcagcttcctagaagacatttatagcagtcccttggtgcctttgttttctcatgagttagatgtaatttacgaattacttgtttatttaacaaacaggtgttgaacgctgttatgtcaggcagcgtgctgggtgtgtggagggtacaaaatgcaaaaaacagtccctgctattctagtgtaatatactagaaaataggcaccagtaattatagaataaacacacacattctcctacttaagcaggttattggcattctgagtatcttccagttcggagggttggggaagatgccaaagtctttagtaataagtaaaaaaatgtgtaaaacgtgagaatgatgacagttttctgaatttgacaaaaacggcagccctgacagcctttttccctctcctagctcggctctgtccttcacctgcgtgtggtactctgtgatcatcacagcaggcatggcctacatcttcctgatccagctgatcaacatcagctacaatgtgactgagcgggaagtccagcaggccctccgacagaagactgggcgccggctcctctgcgggctcatcgtggacacaggccagtacaataggggcttcctgcggaactggcaccagttctccaccctgggcacacgtgcattccaccaccctgccgaggacattgtctgaagtgccttctatgtggctctctgagggatgatggctcctccttccgtctcccttccattttacacttcagtgtccatttctatccccagtttcttaaaggcattatagggccatgctcaggtttagagactggagtgggaagaagttaatttttctgacgccacaacttaagagacttttatactgaggcagtaaaagtagagccattcctttccagtcacctttttaattgactcagttgcctgaacttgagaaggatgtggattgctaatgcacaaattgatagaagcaattcccatccattagtatggaggaaagagtgttggattaggatagtttctagtccctctttcgattcttaatagccatgtgacccctagctgagtcactttcccaagtctcagggtcatctgcaaagtggggtactgatgcctgccctggctacctcacagagccgtcatgagggtcacgtgagggaagatggatgtggaaagcactaaaaaacaactcaagagccatggaaatacaaagtattaggaaaatattatgatggaagaaaaacgtttatagtctagaatattgaagccaatattattagggtaatcagttttcagcatataccttgttgtacagttatgagaatttctccttcttattagacatgaactactcaaacagagaagatgaccagatggattgatgctaagttgtctcatcttgaaaagacagttgacaacagttataaagataattattgctagtgtaatgtagtgtggccatgagtttaggtgatgagttcttctatttatattttataaattctgcttgggtttcttataaataactccaacaggcattcatgtgtttttcctcttcccatgtttcaccaggtaaggtgctagcacacttgtgactgtggctggaagaggagaacagacactcctgtggggatgctttactctcttttctggtaggaaggctgagtaacatcacgggctcgattattttcttcatgtatttcaaatgctgtcagttatagcactaaattgtgaaaatcagccttctggcattcacattattctggtatgaactttgaggagttgagtgacatcttcccacttaacttgcacattaattctcaattacccctccctaaataacagtatctcactaagagagaagaaacagggtatatgtggtttccactattaatggattactgttcttccctggctcttccgacaataacaagttgtttctttaatcatatcttaaaaccgaaaatgtataaaagattaaatatttatgtacaatgggttgttctactatagaattaagatgagggaatttcagatgaggaaaatacccttttgaaatgttagttttgaacatgtactgttgtgcaatcccaaagataattcatgactccttaaatttgccttggcttatagcttaatatagggaaaatattgccagcgttttcagtcattctgtgcatgctgctttaagcaagagatttatatttgttgagaggaaatattgctacttcctgcacttccaccctctgcagccagcaccgtccctactgttgccattaattggagctgtccttaagatggtcaccatattcttattcaggctgttgtcattttccccagagatggtttgtttaacgaatgataggctctgtgcctggggatgttagcagactctggggtttgtacagtgatgccttctccctggcccagagctgaatattcatctagaattaaagttggatttgatataacaaatttctttctatacaggttttacataagagagacagtaataatgtcaaggatagcctgtgtgggcagaaattggtagtcgtgcttttgaatgtcagctgtagagccaactctgattatctagccattgatcatacaaattgatagaaacattagtcagtaattttagcttcttgccaaattgttcacaacatctaaatgtaatgtgatgtgatgaagataagtagtacaaagagaccaaaataatttgggagaattaggaatgatgacaattttttttaacaacttacctctaatagggttacttggatgagccaactccgcttccttcccatggataggaagggactctgtgtattattcaggtttattggcacgaagatacttgttttaagttccttgagaacccatgatggacagttgacagaatgcttaaacctgtcaaaagatgagtgatcttgtgtgggaaaagccttcccaggcgtctgtaccgaaaggagcagcaaacaaggggctaatccatgagcagtgttctgtaggctctgtgacatctttggtttataggattttggagccttttatgatctggaactatttgaggggtttcattataggccttggttctctccaggggccagatgagtttattgtggaatctttgaaaggacaaggcctctgtgaatgaatcagtcccagggaagcatttggtggtggcggcagtggaggattgcccggtgaacctataaatcagcagtctcttgggcagaggagcaagcccctcgaacatgatttcaaacaagcaggtcctcttctctcatctcacgtccttagtctctgttaatgaacatactggatgtggagtttaataaattacctactatcatctggccacttagattattatcacaccactgtggactgttcctggggggagaagaacagaccgatttgaaagattcaagggagaaagattaaggatcaggattgcatgaaagaagaaaatccttcaatatttaaaatgtttcttacaatacccacggagcacttttatggttccagccgagcgttcctgaaatgaactgaccattaacagcgcctctttgataggttaccctgatgctgctaaagtaaagccttaagtgtgtttttgggacaacgtgctgcttattccacctcagccacatatgtgtttgtgtttaggatattgtaaatctttgctaagtagtgttttccttggtgaatgaagtcattgttgtcttcaagtgtaccatctgcctagcaaaaaattgctacaaactttctcttatgcaatagtccttggtacttctaatatttttagcaagagacaattttctgtactagaatcttccactgccagaaaacacagtgccagtaaggttctacataccactgaccatctgcttaatagacatgtatttcctttgagtaggacattagcttttgattataaagctcaactagtataagcaaaaatataacatctagaagcacagttttagccaggatgtttaaaaattacagttttgtgagacttaagggtctttttaacctaggtaagtttatatgacctaacttaattgtagccatattctggtaccttccattttgaaaagtagaggttgcttaagcaagcaatggataataagagacttttcctgaggcacctgtttggaatctggttttctcagcggcagcttgacatgtgcacccttttgtattaaacactgcaagggtgatgcaggggagcaggaaagccatcctaaactcactactgagtacgattcagtatgttcctgtggatgtctgctgtgactaatataaatttcttgcagaatcagctacacttaattatgttgctgatagacaagcatccacgcttcagctggcactaagtgttttcattgtaggatcagcagcaggttaaagactgaacggttagtgaagacaaatgtcttaagaggctgcgatgtctaggttgggcttgtgacttcttagtggcctagccttcttgatggcaccttgaaagtgaacttctagaaatctacatttaaaaggcaaagctttaaaagcagagctagtctattctagttactgatgcaactaaaattctgtatttcttaagatggagccactgacgagatgtcacagtatagagcctgcagtctcaactcattgtgatcctaatggtctgggtgattggatggtttgagttgttagggattttgagtttttcattttattgcatatctgggttggatgttagactaaaggaaacccaggaatatttacctggtgttacatttaatatttaatgtaactggtctagcaacattaagggggatttctgaagccaactccggaggctgtgggctgcacattttgcactgtttttatatacttgtattcatatcctcttatcacctcagactcagacacaaggccttttacatggaaattttacaaattacttccatttatgtaaaataacgtcctgtgaccaagttgtttaaatggaaaataaagtgctttctttaaggaaaatagctggtgtttcttggagtgtctcctgaagtcttctgatttctgaaaaccctgcattatacctgtgctgcctctgtggctccctcaatgtctctatcctgtggccctgtccctagccctaaactgttatgttcccggtggcaatttctccagttttgtgggtcagggatactgcttgttggggcattatgttaacagtaacattttgaaacatactttcatgatagtccagcaaaaaacagcatcaaaactatttccattgtatctctttagaaggctctgtattcggtaaaaagtctagctggcgccattggaatatgggctgctaaagactcaatttctagttgatgtttgaggtgaggcaaaaataaagctaaggtagaaaacttaagctttgtgggatttatttatgcgcctggcatgttgacttaaggaactcaaccttatgtacaggcttggcatttaaagaaaactggtggctgggtgtggtggctcactcctgtaatctcagcactttgggaggctgagaggatcacttgagcccaggagttcaagactagcctgggcaacatggtgaaactccatctctaccaaaaaaaaaaaaaaaaaaaaaaaaagttagctgggcatgtaatcccagctatctgagaggctgaggtgggaggatcacctgagtctgagaggtccaggattcagtgagccatagtcaggccactctacctccagcctgaagtacagtgacagagtgagaccctgtctcaaaacaaaaaaaacacagaacaaacaaaataataaaattggtatttcatttccgggtgctaatatcagccagtattttgtaaatgtactgtagttaggtttaaactgttagtgattttgatggaaagtgatgtattatgaattacttttagttacattttctttagtggccattcatcttgaaaaacacaggttttttttttttttaaatgacaactgtataatcctattaaaggaaaagctgtgtgggaacagccatgtcgtagaagaaataaagttcaattcaaggtgtttggtcatatcacacatcctccgtgataaaagtatcttaagtcgtgtagcaggtggtacagctagatatcctttctaggaagtatgagacagtaacaagaacattcacttaaaaaaccacagaattttattttgtcaactcaaattttcagcacaccaaataagagtaatcatctcaggactgcacaggactttctcattttaccatatgcatttatggactacttgaatttgttatataataaatgtgtattttataatgaaaaattatttttctagcaggtaattctctaacacaattcatagaagagagcattttatcagtctttatagcatcttaaagatgaaaacattctttgaattcaagataggtatctcaatatctagatcaaactgagctgagtactagaagacaaactgagtgtattattcagcagttgcaggtgggagcatgaacagataatttaatgaattgctggactgtcatgatagagctattaccttttggaatgtccttcatgcttatcaaggtgcacggaagagaagcatctctggtgcctcagtttctctgaaatcaggataagctgctgtcctctgcagcagctgtgtagagaaccttttcatacatggtctgccttcaggggtggtgaaagtggacgaggtctggtggggtgcgtgtcactgatgctactgcactagaaggctgagtgccttggcccgcccttcctttccgagcactcacccctgtttatttctgtttcattaaggtcacatcagcaactcctgtcgtgctatacggacacattttcttcacaggctcagtcaggcaaacacttgtcctttttaaagtttactatgctaaaaatatataggatatatttgaacagacgatctctagaatgttcctttggatgatcccactgtgataaatgctatagtgaatgactagcaatccaggaaaagtcaaagaagggaataaaaattctcaaaataattcctttgatctaagaagtagctcgtagagaataaaccaggtgtatgtatgtatgtgtgtgggtgggtggagataacacacatacagactagtcgagcttcctgtcctaaatattacactaatctggctcattcgttcaccagacttgtcttactcaaggaccaagtatctgattgctgatatagctcgtggtaccttccaggtacctggaagtctggaagaatttcaactaccttcctacgaagttgctgtcgcctttcttcttttactctttcctctttcataaattttacaaacttcttccatgtccgaagggtgatccagaggatcctcctttaagaataaagaaggaaaaaagtgaaatgttgagaaaaagttggctttccatctatagcacattaagaactttataaaaataattcttatgttaataaaatgctgtataaaaggtgtggaaatcacaatcgggattatgacagtgtgaaatgctgtgaaaaaaataaggcaacaaaagggaatgagagtgactgattgattgataggttatttttatttttattttattttatttattttctttgaggcaagagtcttgctctgtcgcccaggctagagtgcagtggtgcaatctcggctcactgcaacctctgcctcctgggttcaaatgattcttgtgcctcagcctcccaagcagctgggattacaggtgcctgccaccatgcctggctaattttttttttgtatttttattggagacggggtttcaccatgttggccaggctggtcttgaactcctggcctcaagtgatctgcctgccttggcctcccaaagtgctgggattacaggtgtgggccactgtgcctggccagttatttttatttttgattgagtggtgaaggaaactgaggaggtgacatttgagcagagcaccaaatggcttccagtaacccaagctacgaggcacactcctgagttgatctgattatagcatacatattgtacccatgccaggaccagtgatgctggcaagggatccagaaaccacaaccctcaacgcaaaaatgatggaaaattgcgtgcagaatgtgccaaagttacaggcattgaggcctcagtgcgtagacatattttaaaagcctgctggtaacctgacctccaacagcagcaataacaacaaagaaccagtcttgaatatcagttgagaaaaaataccctaacatcaggttctggaaacatggtatggaagactgtttaagtgagtgtctgtgctgtcacagggaagcatgcaatggccttttaggatttattagtgtccaccacagctgaacactaggggcatcaaggtaagccaggtaccgtctgccccgggagaggctgaaacaggtgaccagagtttccatacagtgggaaggtacagcagtggagagcagcacagaggactacccagtctggtggtgaggagcagacctttttgaagatgatgtctgaactgaatttttgtcaggcaaagaaaaggctttcctagaggagagcacatcttgagtaaaggcaacgaagcgagaatagcatgccgtggtgtgtgtgtggagttacagtgttgaaacgaagtgcagagtagttaagcttatattttcacaactataggcagagatgggatttgttctggcctcttgaccatctgagggagtcccagaatgcacatcagtcctcattaattttatggctgttggttaatatttttgataatgctgatttttgttggtggaggtactgctttaaaaaaaggcatggctgggtgcggtgggtcacacctgtaatcccagcactttgggaggttgaggcgggtgactcatttgaggtcaggagttcaagactagcctggccaacatggtgaaaccccatctctactaaaaatacaaaaattagcccggcatggtggcaggcacctgtaatcccagctacttgggaggctgaggcacgagaatcacttgaacctgggaggtggaggttgcagtgagccgagatcaagccatggcattccagcctgggtaacagagtgagactcttgtctcaaaaaaagaaaaaaagaaaaaaagaaaaaggctccaaggaatggatttacttcattgcttgcttttatccattcagtccaccatttacagcttcctgtgctcggctgtgggcacactcccagtccttgaccctgtctcccattctcagccattcacatctctcttttggctacactcctgttctctgacgtctgcattttagctcctgctgttctaccctaactgaaaaatgttctcccctttgggtgaaatcttcctagatcatccttgcctacatttctctttctttccctacatttctctttctttccctacatttctctttctttccctgaactcctaaaacatattcatgatcactggtttggcacttatttatagcctatctatagctatctttttataatatttttattgatacataatatacatattttgggggtacatgtaattttatacattcatgtaatgtgtaaagatcaaatcagggtatttgggatatccatcaccttaaatatttatcttttatttaccatggggacattcaagttattctcttctggttattttgaaatgcacaataggttattattaactatagtcatcctactgatctattgaacattaggccttattgcttctatctaactgtatattgtacccattaatcaacctctcttcatccacctcccaacctctaccctttccagcctctggtaaccaccaatgtattctctatcttcatgagattcacattttttagctctcccacatgagtaagaacatgtatttgtctttctgtgcttgacttatttcacttaacacagtgacctccagttctatccatgttgctgcaaatgacaggatttcattctttttcattactaatattccattttgtgtatataccatattttctttatgcatttatccactgatgggtgctcaggttgattccatattttggctattgtgaacagtgctgtaataatcacggacatgcaaatatctcttggatgtattgatttcctttcttttggagatatacctattagtggaattgctggatcatatggtagttctaattttagttttttcaggaatctccattctgttctctataatggctgtactaatttacactcccaccaacactgtgtgagggtttccctttctccatatcctcaccagcatctgttattcactgtctttgataaaagccattttactggcataagatgatatcgcattgtggttttgatttggatttctctgataattagtgatgctgagcattttatcatacactttttggccacttgtatatcttttgagaaatgtctatttagatcttccccccccttttttttttagggcgtcactctgtcgcccaggctggactgtagcagtgtgatgttggttcacttctaccttcacctcctggactcaagagatcctttacacctcagcctccccagtagctgggactacaggcacatgtcatgactcctggctaatagttttttgtttttttttttttggtagagatggggttttgccatgttgcccaggctggtcttgaactccttgactcaaactatccacccaccttagcctcccaaagtgttgggattatagatgtgagccactataatggacttgcccatttttaaattggatttttttttgctattgtttgagttccttacatattctagttattaatcccttgtcagatggcattttagtccacttgtgttgctataaaggaacacctgaggctgggtaatttatttaaaaaaagaggtttattggacttgcagttttgccagctgtacaagaagtatggcactagcatctgtttctaatgaggacttcaggctgcttccagtcatgatggaaggggagctatcatgtgcagagatccaatggcaagagaggaaagcaaagaaaaagggggagggaggtgccaggttctttttaacaaccagctcttccgtaactaatagagtgagaatgcactcatttacagaggatggcattaagccattcattaagcaatccatctccatgacccaaatacctcccattagactccacttccgtccaacattgaggatcagatttcaacatgaggtgcaggggacaaacatccaaactatacagacagtttgcaaatactctctctctctttctgtgggttatctcttcacttgattgtttcctttgctgtgcagaaactttttagcttgatgtaatcccagttgtctatttttgctttggttgtctgtgcttttgaggtcttacacaaaaaatctttggccagaccagtggcctggagcattgtctcaatgttttcttctagtagtctcatagtttctggacttagatttaaatctgtaacccatttggatttgatttttgtgtatggtgagagaaaggggtctcatttcattcttctgcatatagttctcctgtttttccagcaccatttattaaaagagtgtcctttccccattttatgttcttggcacttttgtcaaagatgagttggttgtaaatgtgtggatttaaatctgggttctctattctatttcattggtctatatgcctgtttttatgccagtaccaagctgttttggttactatagctttgtagtaaattttgaagtcaggtagtgtgatacctagagctttgttctttttgcttagtgttgctttggctattcagggtcttctgtggtttcatataaatattaggaattttttttctatttccgtgaagaatgttgttggtattttgatagagattgcattgaatctgtaaattgctttgggtagtattgccattttaactataagaagtcttccagtgcaggagcatggcatatctttctatatgtttgtgtcctcttcaatttctttcctcagtgttttatagttctcagtatatagatctttcacttccttggttaaagtggttcccaggtattttattttctttgtagctagttaaggtgggattgttttcttctttttcagattgttcactgttggtgtatatattaataaatgctgctgatttttgaatgttgattttgtatgctgcaactttactgaatttgtttgtcagatctaacagttttttttggtggagtctttaggtttttctaagtataagagcatgtcatccgtaaacaaggctaatttagcttcttccttttcaatttggatacattttttttaaagacagggtttctctgtcacccaggctggtcttgaacccttggcctcaagtgatccttccatagtggcctcccaaagccctgggattacagccatgagccatcacatctggcctggatgcccttatttttttctcttgtctaactgctctggcaaggacttgcagtattatattgaataaaagtgctgaaagtgggcattttggtcctggccaggatgttgatttttcttttttattatactttaagttttagggtacatgtgcacaacatgcaggtttgttacatatgtatacatgtgtcatgttggtgtgctgcacccattaactcatcatttaacattaggtatatctcctaatgctatccctccccgtccccccaccccacagcagaccccggtgtgtgatgttccccttcctgtgtccatgtgttctcattgtccaattcccacctatgagtgagaacatgcggtgtttgggtttttgtccttgcgatagtttgctgagaatgacggtttccagcttcatccatgtccctacaaaggacatgaactcatcattttttatggctgcttagtattccatggtgtatatgtgccacattttcttaatccagtctatcattgttggacatttgggttggttccaagtctttgctattgtgaatagtgccgcaataaacatgtgtgcatgtgtctttatagcagcatgatttataatcctttgggtatatacccagtaacgggatgggtgggtcaaatggtatttctagttctagatccctgaggaatcaccacactgatttccacaatgattgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcttgtgtcttttggctgcataaatgtcttcttttgagaagtgtctgttcatacagatgttgaattttattgaatgcctttttggacatctcttgaaataattatatggcttttgttcttggttctgttaatgtgatgtatcatgtttattgatttgcataagttgaaccatccttggatccctgggataaatcccacttgatcatggtgaatgttcttttcaacgtgttattgaatttggtttgccggtatttggttgaagattttgcatttgtgttcatcagggatatgtagttttcttttttcttatcatgtccttgtttggttttggtatcaggctaatgctggcctgatagaataagtatggaagtattccctcctcttcagtttttttttgaagaaattgagtagaatttgtattagttcttctttaaaagtttggtacaatttagcagtttgaagccattaggacctgggcttttcttttaggtgagactttttaattacagcttcaatctcattacttattagtggtttgttgaggttttctgtttcttcatcattcaatcttggtaggttttatctgtctagaaatttatccatttcttctatgttttccagtttattgatatataggtgttcataatagtctctagtgattctttgtatttttgatgtctcagttgttatgtctcctttttcatttctgattttgagtcagaaaaagtctcaattcatttatttctgcttagatttatattatttcctttcttctaataatttggggtttggtttgttcttgcttttctatatttccttgaggagcatagttgacttattttttgaagtctgtcaacttttttgatgtgtttattgctataaacttctctcttaaaagaagttactgcttttactataacctatagattttgatctatgatatttccattttcattggtttcaagaaatttttaaattttttcttaatttcttcattgacccattggttgttcaggagcatgttgtttaatttccttctatctgtgtagcttctgaagttcctcttactgattcctaattttattctattgtggtcagaatagatacttgatacaatttctgttttttgaatttgttgagagttgttttgtggcctaagatatggtcttattatggaggatgttccatgtgctgataaaaagaatgtgtattcttcaacagctggataaaatattctttaaatgtcagacctatttggcctggtttctggtttaagtttgatgtttccttgctgattttcttctggataatttgtccactactgagagtggcgtgttgaagtcccctatgattgtattgcagttatctctccctttattgtttgctttatatacttgggtgcttgatgttgagtgcatagatatttataattgttatatcctcttgctgaattgacctctttatcattatataatgacctttctttatttctctttatagtctttgacttgtagtcagttttatctgatataagtatagctattcctgctgtgtttttggtttctacttgcttggaatgtctttttctatctctttcagtctatgtatgtctttacaggtgaagtaggtgtcttataggcagcatacagttggatcttgtttctttatccatcagccactctatgtcttttaattggagaactgagtccatttatattcagttattgataagtaaggacttactatggcaattttttctttccttgtttgctggttgttttgtaactcctgtcttcctttcttactgttttcccttgtggcaaaacgattttctcaggtagtatgttttaatttcttgccttttctttttagaaatcccccaacattttgactttttcttgttttagtttccatgttttatattacctcttagcaggctgctgtagctattactgtttttgctagatgtgtctttctggcttcatactagagttatgagttgattgcacaccacaattacagtattagagtattctgggtttgttcatgtacttaattttatcagtaggttttctactgtcaactgttttctttttgtgttagtgtttttttctttcagattgaagaactccctttaacatttcttgtaagatgggtctggtggtggtgaattctctcagcatttgtttttctgagaaaaactttctctatccttcatatttgaaagatggctttgctggatacagtattcttggatggcaggttttttttttttcttttttctttcagcactttgaaaatctcatcctgctgtctcctggcctataccgtttctgctgagaagtctgttgccagatgaattggagcttcattatatgttatttgcctcttttctcctattgcttttaggatcctctttgtccttgacgtttgagagtttaggtcaaatctgtttggtttctctgactttcctatacgtggatatgtctttgtcaagttttggaaagtttcctatttttatttctttggataagctttctaccccttgttctcattcaagtcccccttcaacaccagtaatttttagatatgatcttctgaggtaattttctatatcttgtaggctgtcttcattccttttcttttttcttttctcttctgatagcatattttcaagtggcttgtctttgggctcactaattctttccactgcttgatccatttggctgttgaaaacatctaatgatttttcagttcagcaaatatatttctcagttccaagatttgtttgactttttaaatctttgttaaatttatctgaaaaatttctgaattgcttttctttgttatcttgaagatcactgggtttccttaaaactgctattttgaatgttggttagagtttacatattgccttctcattagggttagtcactggttccttgatttatctatttgggaaggtcatggttccccatttgctgttttttgttttttttttttggagatggagtcttgctcaagcacctaggctggagtgcagtggcatgatctcagctcactgcaacctccacctcccaggttcaagccattctcctgcctcaggcttccgagtaggtgggactacagatgcacaccaccatgcctggctaatttttgtatttttagtagagagggggtttcaccatgttggccaggctggtgtcgaattcctcacctcaggtgatctgcccaccttggcctcccaaagtgctgggattaaggtatgagccaccacgcccggccaactcgctgttgtttcttgtggatatatgtctatgcctttgcactgaaggattatttatttatttcagtcttctgtgtctggcttgtttggttttcagtgggtatgtttgattagagattgtttgtaatttacctgtttaatttcttttttgttctcctgctatgtggctgcctcctttttggcactagatggtgctttaatccctggttcatcttggctctagtaaacctttctcttgctctctcaatctctctctttctctctaatcttttatgttttctactaaattatgagcaccaggggccatgttattaggtatttttttatgcttggtaaatatgtcttgataattacatgtgggtgtattgtataataagtatgatttaagtcaccaaggtaagggttcttaagctgggtcccataaactccttgacatgttgtgtaaagttgtatgttatatgcatgtatgcattttctggggtgtaggtctgtgactttcattactacctacttcatgttcatactgtggttaagaactatggtagcaagacaatatcagacatattataaatactgatccagctcagctagatttataaaattatccggaagtgatacagatatgtaagattacaagttatgttcttattgagaatcatctttctcgatgttattgcagcttaaaggtcaggcttaagaccaatagatgtctctccttcctttcatccacagctcttctatatggtattatttcattcatataaaattgaatatgaactctgaatatcaattttttaatgttaaagccccttttaaagactggtgaccttaaatattagtgtcattcctgcaataaagttcatctattcatacatttaccaaatatttactgtgttacctatgtactgagcgctgtcatatactgagaacacagtaatgagcaagatgtggtgcttccactctgtttaacatgtaaacagtaaattatatactttcagagagtcttaagtgctgtgaaggaagtagggcagtttaatggatagacagtgatgcaagtagggtggttagggaggtgacatttaagcagagagctaaatgatgagatcaggttatgtgaaagctctgaagcagaagtgagctttgtttgtctaagaaacattataggaggccagtggggccagaacatggtaaacaaaaagcaaagtgggaagagatgaaatcacagcaatgcttttatatcaagtagacattggctgagaatttggttcttgttgattgcatggattcctacattgatttcacaacttcaaatcctaaataggatgactatcttactattttatagtctaaaaatgaggccaggcaagatggctcacacctgtaatcctagcactttgggaggccgaggtgggcagattccttgaggctagagtttgagatcagcctgggcagcatggtaaaaaacgctgtctctactaaaaatacaaaaattagctgggcatggcagtacatgccgttaatcccagctacttgggaggctgaggcatgagaatcgcttgaacccaggaggcggaggttgcagtgagctgagatcctactactgcactccagcctgggtgacagagtaagactttgtctcagggtaaaaaaaaaaacaaaacaaaacacaaaaacaaacaaaaaagacagagggagaattagaaaaatggggaggaagactgatgtagcaagaagagaatgttttagggtcaaaaaacctaatctggagttcagggagcaaccttttgttatctttataccttgacaattcacctacctgcctgttgcttatttctttgcctgaaaaatggaaataatgacatctccccacatccaagttattactgctatcagatgagatggtttgtgcaaaagccccaaatgaatctctcagcctgtatatagtggctgagaaacagaaagaaaacataggcaggcaaaaaggatgtttaataataatatattcacaatgacactaaactaaaaaaaaaaaaaaggttagttattattttgggccaagcagtgcattgagtgagttactatagtaccctgtttagtcttcacagcaatccataagatagatagataggttctgttgctatcctcattttatgagagaggaacagggaggctttgaaaggttatttgttcagggtcacatagatattgagtcctaaacttcaaactctaaagctaaatcatttatccaaagggaggtcctctgaatgccctcacttattgcttatttgttttaatttaaacaaaactataatcaacttgcttatctgttttcccactccactgatttccagtatctgtgaattaaacaaggacaaacaggttttggtggaggtaggcaccctcatggcaataagataggaacactattacaaggaacagaaataaacacccatgcacaaacatgcaaataaaaagaaaacagcaccagtcaacatggtgaaaccctgtttctactaaaaagacaaaaattagccgggtgtcgtggtgtgtgcctgtaatcctagctacttggcgggctgaggcatgagaattgcgtgaacccaggaggcagaggttgcagtatcatgccactgcacttcagcccgggcaacagagtaatgttgagaaaaggggcatttttatacacccacacaacagtcttcatacctcaaaaaagctggaggcatcactgaatacacccggcacactaactgatgctcataatgacaccaaatcaccactcttaaagggaagtgcataatgaaattaagaacattctgtccaaatgcttaaaattagaaaacaaatataaaacttacttatacagaataccttatttctcaaagacaactggattaaataaaacataactgtattttaaatattaatatggcatatagtatgattccatgtatataaagttccaaaccaggaaaaactatagcattgaaggctgcatacttaggagaaaagtaaaaagaaaagcaaatgttcattgtaaatgtcaggagagtagtttaagagagacttgggaaggagcctgtgcgacagcaatgttcaacgttttgacctcagtggtggtaacaaagggtgtccactttacagtcattcgttaagctgtatttgtatgatttaagcacttttctatatttgtcgtacatttcacaataaatgatgttgaaagagaaactgaacttaaaaaataaaactatatttgactaacaaagaatacagtacttttgcttaggtgtgtttcatataggtcacatcattttattctcttggcagtttccgtgaggtagaaagggcaggcctcctcctcctcccacttctctttttaaagatggaaccctggagtcccagggggtttattacattgctggtgagccgggactcccacccctgactggtgtttccccgctctcctagcctccagctcatctctgcagacacattgtaggagcagaatatattgctgagcaattgtgaagtcagagagtgaattttcctcactatcaaaacctcacctgtcactgtgctccgctgcaatctcatgcttgccctgagaatcgatcttcacctccctgaccatgttaaaccaggccctgaaaatcttcttttgaagaaaatgtacacaaaattttcttacttcttcctgcagatcaatcacgtactggggatgaagacagaaataaaagtgagacaaaaaatatcagttgacaaagaattagagcaaataaacagcacaaaagacagaaatgaaacaaaagaaacaaatgacactagagacatacaaagaaaaggataacctggaagccaagaaaatatcctctataatgtatcctaaaaatggtaagagaacacatgaatagaaacagttataagattgaaggggtaagtttctaaatcacttgagcactgtgagacaagaaacaagaaatgactataaaaacaaaagctgatggaatgataacttacagtttatacacactccgtgaaacaaacacaggcttaggattttacactaataaaacactgatttaccattttcacatttatttcaaagcagtgaatgggattgactactcttttgttcttgaaaaaacataatgaccctggacattctggatttcatttagttttcttaaatagaattgagcaatgagatgtatttaaggtacccttccctatgtccttacctgtagccagctctggatgactctcttaagcagtatttgggaataaaattgatcagcctgggccatctttctagccagactttcctgactacgctggaaccacgtcagcatgtatttcctctgcaggaacaaagagtaatgttcttctgccacctggacaattttttaaatgagaaatattattccttaaattttaaatcatttaaacaaacacatcacctttggaaatgatgctataaaacacatttaggcagtcggtagagaataatctgaaggtacatgcagcctgtgtcctaaaagctttgactgttgacctattctatggaggttatagattcacatcatgcatggcctttcaatgccagctccctgaagaccacagtgatttgctggttatggaaatggaacaaccaacctctaagccattacttcacttcccctgagttttggagtgggtagctggcaacattctcaatttgctctcctggagcttggacagcaactccacaacaaacctctctttctcatgacttaaccactgtctaattgaggaaatgccaatactttcaattagtgttgtggaatgagctgtcaccagcattgaaatttagacattatcaataaaccacaaaaccatctgatagaaaataacatgaataatttaatgtcttttcaactgagtatcattctatcaaaataaacatacaaatcagaatttatagatttttaaaagtaactgttatattcttttaagaggcaagaggggaaaagccttctctcttagtcctctctaaacagcgacacatttttctaagccttgtctagatatctggcactgtgaatgtgattgactcaagtgagtctcttggcagtcatatttattggccaaaatgaccaccacggaggtctctgtggcacctgagatttctgcctgtcctggactcatctcagcagactgagagccaaaagatgagataacattttatctattttgaatttttaatcatttagttgcatgcactggataaatttgttagggaaattttagaaatttctgcggtgtctgatttcatatatctctctgcagtagagtgaattactgttctgttctctctaatagaattatacacccataccctttgcaatgtgatttcacagttcctccctgtagagtggatggagctctttctctcctcaatgactttgagcttggccctttgatttgctttggccaatggaatgtggacataatacaagcaacgggtttacataatttggtttggccttttgtagctctgacagttgccaggtgaaaagcatgccctgagtagctgctgtaaccagaatgagaggcttggggagagacctgaactcaatccacaactggcccacagacatatgagtgagaaataaatacttgagctgtaagccactgatatttgggggttgtctgttatgcaactttatcacaggcagaaacctgactaatgtaccttatggtaataacttttcccttactcaaactgagagaagcttctattcatcttaccttggggggatctctaataaaacattttctctcattttttccaacctattcaattacaaaagtccttctctaccttaaaagaccaaatcaaaaattgtatccaaaacaaatacacacattcaattaatttatctttctggctttaaatcaccaaaccctaccctcccccaagcttaactgggcatccatcctatttggaaaagtccattttctaatctgggggataacagtgggacagtgtacctggatgttttgtttgctttgcattctcaatctcttccaaggctctagaccttttttccttagcaagaccctttcataatgttctttggctattgcttccagctgctggttcctcttaattctcttctgcttctcaagttctttctggaaaagattaaaaagcaaaatgctatgatcaaaaaacgaatgagtttcatttcaatgaaaagctaatgaatttaatttgaacatgtaaccattgaatggtgtgttaatcatgataacagagctctggataatagggctttttctttaaaaaaaaggaaataattctgctaagagggtcaggagaagctggtcatgagtctacaagaatcagggctatgcatattcgtggatttattcagtattgttcacagaaataatttctctctcaccaagtaactaaaaggtaaaacatctagttaggagagcaatcaggattttccccctcattatatgaaaaacccagccatacagccacttcatttaaactatgggatagagatttaatgatactccattaaaagtctggaagaatattcttactagtatttttctttttaagtgaagaacaataagtccagaggcaagttaaagatagttgatcatcattaagctaccttccctcttctaagaaggaaaaagatgaactattcctggtaatacactgagaaaagacactccatgaccctcaaagaactgcacccctcaggggtgtgaccaagaaagatgacaaaaacttaatgatcgaccctatagatatcattatttccttttttctcttttaataaaaatagcttattgtaaaggtgagagaaaaagaaatctacccagaaagggggagtgggagcaagtgacacctgcagtgaaagacacaagagcaacaaagactgaagactgctttcatagtcgtcatctttgcagcataaatacaaaaacatttaatttaagctgatttcctttacttcatacgatttcacattaggaaaagggcagtggtgaactggctgatcctggcaagctacttaatgtgcctgagccttctgtgagagaaacattacagagagagcaatggaacatttctaatatggaaggaagaattgctctaattttccaatacaaactgcctatttctgtgaaagctctgaaaaatgaaatgtccatattctcttagccattaaaccaaaacaagctttatactctttatttcaggcacttgagatacttgttgaatgaaatggccagagagaaaatttacaacaattttctcatgcatagtaagaggaagctgagggttaagtggggaggaaaacagaaactgacccttccacatccactgaaatgtcagtgtagcattaaggcagcagctgcatcttgcagagagacatctaatgcagataataacctttggagaagccctcaggctcagacaaaagaacttgttcccatgcagagataagttatggtgtaactatcctcctagaataattactggctggtgttaatcagctccaaaaggaaaattattttcagctgaattgtggggaaaaccagactttttcaaagtctacacttccatggaaaaatataaagaaaaacatgagttctgcttgagtcaaaatgttgtattcttacatagcaatttaattcaaatatgtatctcctccctctattaagggttcctcgatagaactggttgtatttcattaatattaccacattttcaatttcctggtttataaaatgtctttaatagcacctgcatccatgatttactgtgaggattacatgatatgatgctgttttgagatggcacttatagtggggatctatgtagctaggggtttcatagaacacagatcactgaggctaaaaagggatataaaatctgggcttctttctgaaataaatgtgtagctttgtcagctagtatgctttaggagaaaagccagaaattacagctatgttaaaaaaaaaagtacagggcaattgacactgccccaaaactcttggccttctgtcccttgtacgctactctccctttgtgctctagaatatattcctgcttacccactcctgtgatttatactctgctcttctgcatcacgaatttctccctcactactggattattcctatcagtatgcaaatatgtgccagtatctcccctcttcaaaacaaaaaaacaaaaaaaaaaaaaccaaaaataaaaaataactaacaaaaaacaactagagaccatgagtatagatgcggatctctttctcatgagctccacatctatctctgatctcaggagatccgcatctgtactcatggtctctagttcctcacctattctctcctcagcccactggaatgaggctcctttcctagaacaccactgaaagccctgttgcctaggtcatgaatgcttgctgggcttccaaatcaaagaatcacttatctgtgctacttttaattgaactcggtagcattcagccaaattcaccactcccaccactcccctaacagaaatacttttttctcttggtgttttgattctaaactctcctgttctctttctacctcactagctccttatcctctaaatagctatttatagtccttaggacttgatcttggactctcatttctactctatccagacaatctcccaagctgattacagctacttccagaccattataaacattgacttgtttttcacttgcgtacacagtcttgtggtccaggcttatatacccaagcacatatctgacatgttcatttggatgtccaataggtatctcacatttaacatgcccccgccaactagacactgtggaggccgcctcagcatccaggagctcaaatatcacctcctcagagaggtatttcccatactgcttccaccaactataccactctctccctacttctttagtcattactttgattattggcctgttttccccaactagcatagaagctttcagacggcagggctgttatctgtcttcttcattgctacattctaacatctacgtaagtaaatgctttacagatatttgttcagtgtgcaaatatgcttgataagcaattatggaaaaactttaaatcttgccttgtcttctctgataaaattattttttcaaccgcaaacttcaactgtccatcaatcagaagtatatatagccataaaagttattgcctgttaagtataagcatttaataaacatacaggggggtgttaagaagaggttagattattattttcagaaggtcactttgtgagacctctgagtggccaccttactgtggcacccaacatgcttttctggcagggtcatggggacactaagctgtagccatgtcttgcctctgtaccacctcttgctgaatatagaggacaggtctgtcatgagggcttatccctgaagaattcttccagttcctttatctaaaatggtgtcacagcaccctatacacacataactgggcttatctcataatatctctccaaagaaatatatatgattgccccagagactttctttatcatatcaacagtagggtttttttttatctatgtcattagaaaacatggtacctctgttggacaatttgctggtacactcaatgagcaaaaatacccgcccaaatagaagaggttaagcagagttcaaccaaacacatctaggatacaaatgattcagagaagtctcagaaggcacttgttcagaagtgccactatctttttgatatccagaggaataacactactatggccttggaggttgcttactgggaaaagttatataaagcatataaggaagtaaagaattgcttggcagaacttgatgggtaaaaaggaataagacctatgaaaatctgagtggagaagcacactgtgtagagcatctttgtccagaaggaaaagaagacaattgccatgtgcattttatatctaaagttgtcctcaaagaagactcaagtatagccagcctataaatgcacctatctcaatttagatagctccagttgactaatgaaatggaaactagtctatgtgacaaaatcttcttatctattgctatgaactgcagcttctaaaaggaaaatgtttgggcttgatatagtgagagaaataaaatgatctcttggtcagtaatgtatttttcaccattcttgttctgcataagttttcttccaacaaggaaaaagctggtcatgcaacaaattaatgactttttgtgaactgatcagagatctgaagctacccccaaatttggagagacaggcatcttcagggaggcacaggacctaagcatttgtttaccggaggcagaagccactggataccatatgagtaagacaattaaactagaaattttggtgaactgatggaggcagacagtgagtgggccagcatgagaaggttgaagctcctggggatcacagtcatgggggtgcttctcatccctttgaaggcttttcttataagaacgctaccaggctctcacagagaagatcatggagaatccacagaaagtttgcaccatggttctggctggggagaggcacagcagcaactgcaaaatcttcccagagcattcttccttaggaaacaaaaggtttatctgtcctagcaaccaacccagtacactggcagattagcactgcatctgagggaaggggattcaggggattctgcccagacaagtcctccctatctcacttaggggttggggaagccttattctccagagggaaggtctttaaggtcacagactgagacagtggtggatacccactgcggataaagggaaaaagggggcagaaaaaagctctaccactggagtgggaacagaaattatctgagtgcttaaagctgtgcattccaaacactgagacttaatcagaacagagaatgctccccatcgtccacacccaatcaccacacttatataagcttccaataataatagtggattacagctgagaaagctgtaaacaacagattctctctggggagcagcacaaaaggaagacccaaaaccaaaagaggaagcaaaaacaaagtcactagaagacattaaagtctctgatgtctacagcatacagcaacaaacctcaacaatggtgaccacggcaacaacaagcttcaaacatagcccaattcccggctaaattagtacaaatctccacactctaggccaacgtgttgcagtttctattgccctgaacaacaggtctggccttcaacaaaaaaatacaaggcatacccaaagacaagaaataaatacaccctgaaaagatgagccaatcatcagaacaaggctcagatatgacagagatgttggaactatcagagagggaattttaaataacttccaaaaataatgttaaatgttctaatggaaaaggtagacatcattccagatcagataggtaattttagcagagacatggaaactataaaaaaagattcaaaataaaaatgctagaaataaaaaaacacatggtaatagagataaagaggcacttcaactagcttactgctagaagatacagccaaggaaagaaccagctaacctgacaatagggcaatggaaattacacaaactgaaaggcaaaaagagtgaaaaacaaaatagtgcatctgagagctgtgggataatatgaaacaatgtaacaatggcataacaaatcccataaggaaaagaaaaagaatggggtaagtgaaataatttgaagaaataacgggcaaacatattccaaaatcagtaacaaaacacaaaatcatatatccaagaagcttaagaccaccaaagccaagaccaaaccaaccaaccaaccatacctagatatatcatattcgaactgctaaaaatcaaagacaaagaaaaagtcttgaaggtagctaaagggaaagacccacattacctactgtcatgaactgaatgcttgtgtccccctaaagttactgtgttgaagccctaacccctagtgtggctgtatttgaacatagggccactaaggaagtaatgaaggttaaatggggtcctagggtgcagccctaattggacagaattaatgtccttataagaagcgataccgtggtgtgcttgcttgctctctctcgcatgcgctctctccctctcccctctgtctccaaacagaagcaccaaggaaagactgtatgaggacacagtgagaagaagctgtctgcaagccaagaagacccctttccaaaagccaaccatgcaggcaccctgatcttggactttgcagcctctaaaactgtgagaaaacaaatttcagttatttatccacctagtctgtgacattttgttatggcagcctgaacagaataagacacccacaaagaaagaaaggtaagaattacagtagatgtcttgtgagaaaccaggcaagcaagaaaacaatagagtaacatcattaaggtgttgaaagaaaaaaaaaaaaaacacctgtcaacccacaattctatatccggcaaaaaacatactttaaaagtgaaggaaaaataaagactctcagacaaataaaaactgaaggaattcactgccagcagatctaccctataagaaatggtaaagaaagttcttcaggcataaagaatataatataggttaagaacttagctctacacaaagaaatgaagagcatcagaaacagaagaaataaagttaaatataatcatcttatttttaattccactgagaaaactaattgttcaaacaataagtttaacaagatattggctatttatagtatacataaaaatatgacatgacaacaataccaaaaggaatgggaggaaggaactgggaaatactgatagaaggttctttcactacatgtaaagtgttatttgaaggtggaaagagatcattattattatttgagatagggtcttgctatgttacccacgcttgtctcaaactactggactcaggcagtcctcctgcctcagcctccaaagtagctgagattacaggtacatgctacgacactcaggtagaaggagattattttaaaaatgtaaacactagggtaaccactaaaaatattttttaaaagaggaccaggtgcagtggctcacgcctgtaatcccagcactttgggaggccaaggcaggtggatcacgaggtcaggaatttgagaccagcctggtcaagatggtgaaaccccatctctactaaaaatacaaaaattagccgggcgtgttggtgggtgcctgtaatcccagctgttcgggaggctgaggcaggagaattgcttgaacccaggaagcggatgttgcagtgagccaagatcatgccactgcactccagcctgggcgacagagcaagactccatctcaatatatatatatatatatttaaagaggtataaaaactccaaaaaaacacaataaaatagaatcataaagatgcttaattaaaaccagataaggtagggaaaaaagaaaaacaaagaataagtacaacaaatagaaaatagctaacaagatgatagattttaatccagttgtggccgggtgcagtggctcacgcctgtaatcccagcactttgggaggctgaggcaggtggagcacgaggtcaggagtttgagaccagcctggtcaagatggtgaaaccccatctctactaaaaatacaaaaattagccgggcatggtggcgggcgcctgttaatcccagctattccagccaagacgggtggatcacctgaggtcaggagttcgagaccagcctgaccagcatggcaaaacctagtctctactaaaaatacaaaattagccaggcgtggtggtgcgtgcctgtaatcccagctactcagaaggctgaggcaggagaatcacttgaacccaggaggcagaggttgtggtgagcagagatcacgccactgcactccagcctgggcaacaagagtgagactccatctcaaaaaaaaaaaaaaaaaaaaaaagattttaatccagttttatcaataatcactttaaagttaatgggctaaacataatagttaaaagaatgagattatcaaattagatgctaaatcaagacatagctatatgatgtctataagacattcaattttataaggcatatatgtaagtcttttttttttgagacagagtctcgctctgtcaccgaggctggagtgcagcagctcaatctcggctcactgcaagctccgcctcccgggttcatgccattctcctgtctcagcctcccaagtagctgggactacaggtgcccaccaccacacccggctaatatttttgtatttttttagtagagacagggtttcaccatgttagccaggatagtcttgatctcctgacctcatgatctgcctgcctcagcctcccaaagtgctgggattacaggcgtgagccactgcccctggccatgtaagtctttttaaacatacatgcacctaagaacaaaccttcaaagtacatgaggcaaaaccagatagatatgaaaggagaaataagtctcaagtttagttagaaacttcaatagtcctctctcaataactgatagaagcaggcacaaaatcagtaagaatacagatatagataccgtaagacacagtaaaacatactcaaacaatgtgacttggcatttctagagcagaccaatggcagctgagtactatagtactatacatattcttctcaagtgcacatggaacattcactgagatagacaatattctgggtcataaagcaaaactttacaatttcatgcaatgtacattcttggaacataaggaacttaaactagaaattaaaactagaaattaaactagtaaaaagttatctgaaagtcctcaaatatttaaaaattaaagaataaacttcttaataacccatgggacaatgaggacatctcaagggaaattaaaaatattttgaactaagtaaagataaaaatatcaaaatatgatatacaagtaaaagagtacttagagggaaatttacagcagtaaattcacacactagaaaaggagaggccaggcatggtggctcatgcctgtaatcttaccactttgggaggccaaggtgggaggatctcttgagcccaggaaattaagaccagcctggacaacacagtgagaccccatctctacaaaaaatttaaaaaatcaattggacatggtggtgcatgcctgtagtctcagctactcaggaggctgaggtgagaggattgcttgagcccaggagtttgaggttatagtgagctgtgatcacaccactgcattcctgcctgggcaacagaacaaggccctgtctctaaagaaagaaagaaaaagagaaagatctgaaatcaataactgaagtttatatcttaggaaactagaggaagagagcaaactcttaaggaaggaggaggacagaaataaaaattaaagcagaaatcaatgaaattgaaaagaggaaaacaacaaagaaaaccagtgaaaccaaaagttagtttttgaaaagaaataaaattgataaaactgatatccaggtaaaccagaagagaagatatatattgccaatatcaaaatttaaagagaagacatcaatactgatctcatagacattaaaaaggtcataagagaatactatgacctctgttccaagagacttgaaaacttagattaaatgctcaaatttcctgaaatatacaaactaccaagttttactcaagaagaaaaaaagaactgaatagctcaatatctattaaagaaatagaatatgttattttaaatcactttaaaaaagaaaactccaggtgagggataaaagactacaaattaggttcagtatatattgctcaggtgatgggtgcacctaaacctcacaaatccccaccaaagaatttactcatgtaaccaaataccacctgttcccccaaaacctacagaaataaaaaatttaatataaaataataaaaaaagaaaactccaggcccagtggtttcaccagtgaattctaccaaacattttagagagaaataacaccaactttacatactctctttcaaaaaataaaaaagggtatacttcccccattttatgaggctaaccattatcctaataccacaacaagacaaacataatataaaaaaaaggaaatgcaggctggtgtggtggtgcatgcttagaatcccagctactcaggaggctgaggcaagataatttgaacccaagtgtttaagactagcctgcgcaacatagtgataaagcacctcaaaaaaaaaaaaaaaaaaaaaaaaggccagatgtggtggctcatgcctgtaatcccagcactttgggagactgaagtgggcggatcacaaggttaaaagttcaaggccaacctggccaacatggtgaaaccccgtctttactaaaaatacaaaaattagctgggtgtggtggcgcatgcctctaatcccagctactcaggaggccaaggcaggagaatcgcttgaactcgggaggtggaggttacagtgagctgagatcacgccactgcactccagcctgggcaacacagtgagactccaaaaaaaaaaaaaagaaaaacaaacaaacccccccccccaaaaaccaatttcttaacaaaataccaacacatgaaatctaacaatatataaaaataacacaccatgaccaagtggagttcatctcaggaaggcaaggataattttacattggaaaatcaatcaatgtagtttaccgtattagtagaggaattaagaaaactacatgatcatatcaaagatgcagaaaaagctttcagtgaaatttgtaataaacactctcagcaatctaggaataaatgaaaattcccttcatctaataaaagacattcatgaaaacccacagcaaacatcatacttaatggtgagatactgaatgctttccctctagatctgaaacaaggcaaggatgtcttctctcatcatgcctattccatctcatactggaagtcctaactaatgtgataaggcaagataaataagtaaaaggcatgcagattggaaaggaagaaataatattgcatttattagcagacaacctgtttacctagactattccaaataatttacaaaagtacttctggaaccaaaaagtgagtttagcaagattgcaggatacaacaccaacatactaaaatgaattatgttcccatattagcaatgaataaatggaatatgaaagtttaaaaaaaacatttataatagtgccccaaaaatgcagtagttaggtacaaatctaacaaaatgtgagatgtgaggaaagctataaaaacaatgatgaaagaaatcaaagatataaatagagaaaagacattagcaagatggtggaatagcagctttctaccatcatatccccgcagaagcactgattttgacaagtacccatggatgagagtactttgtggaagtccagaagtccagcagtgaagttccagcacatcactggacacactgaagaaggtaagaatagtttcactttatctaggtcacccctcccccaaggcagcatagttcaatgccaagagagacccccacagcctgtgattcctcccacggaggaaagtgagaggagagtgagtaagcattcagctccctcagctgtgtaggctgctgcccaagaggcccacttctttcttaccttacccagattactgaggtaatcagcacagctgagtggttcgaggaggctgggaacagggaagaaaggccacagaccctactaaccaataaacaaccaaatgaacaaaggccacagaccctataaccaataaacaaataaggagattgaatgagtaatttaaaaatctaacaaagaaaaacccaggacttcattggtgaattgtatcaaacatttaaacggggactgttgtgggatggggggagggggaagggatagcattagtagatatacctaatgctaaatgacgagttaatgggtgcagcataccaacatggcacatgtatacatatgtaacaaacctgcacgttgtgcacacgtaccctaaaacttaaagtataataaaaaaaaagaattaatgccaattcttttcaaactcttccaacaaaactgaagagaaaggaacacttccacactcattttatgaggccagcattcccctgatactacaggcagacaaggatactacaaaaaaaattataggccaacatacctgatgaacataaatgcaaaaatcctgaacaaaatagtagcaaactaaattcaagagcacattcaaaggataatacactatgatcaagtgggagttatccctgggatgcaaggatggttcaatatgcacagatcaataaatgtgatacaccatattaacagaatgaaggataaaagtaatatgatcatctcaacagatgcagaaaagcatgtgacaaaactcaacacccttgcatgataaaaaaaaatttcagtaggctgggtcacccctgtgacccaggtgtggtggctcacgcctgtaatccagcattttgagaggctgaggcaggaggatcacttgagcccaggagtttgagaccaccctgggtaacatagtgacacccagactctatgattcatatggaaagtcaaatgaactagaatagccaaaacattctgaagaagaaaaatagagtagcagaattcacaatgcctataaagctacagtaatcaaagacagtattacttgcaaaggaatagacataaagtaacaacagaaaagaacagagagcccagaaatagatccacacaatatggtcaactgatttttggcaaatatataaaaataatttaatggagaaaagatagtcttctaaacaaatgatactggaacaactgaacgtccatataaaaaataaattacagcatacctcacaacttacattaaaattaactccaaatgggctgggcatggtggctcatgcctgtaatcccaatactgcactttggcaggctgaggtgggtggatcacttgaggtcaggagtttgagaccagcctggacaacctggtgaaaccacgtctctactaaaaatacaaaaattagctgggcatggtggtgtgtgcctgtagtctcagctacttggaaggctgaggtgggagaatcgcttgagcctgggaggtggaggttgcagtgagccgagatcgtgccactgcactccagcctgggtgacagtgagaccctgtctcagagaaaaaaaaagaaaagaaaaaaaaattaactccaaatagaccacagacctaaatgtaaaatgtaaaactttgtgaaggaaaaactgaaaatctgaatgactttgagtttggtgattagttctggatacaacaccaacagcacaatccatgaaagaaaaaagtgataaggttgactttattaaaatttaacactttcctctgtgaatgacattgttaagtgaattaaagtacaagccttagactgggagaaaatatttgcaaatcacatatctaaaaaggacttggtccagaatatatgaagaacttttaaaacccaacaataagtaaacaaaaaatggacaaaagatctgaacagatacttcatcatagaagatatatggatatcaagtaaagatatgaaaggattcttagcattatttgttgttagggaaacgcaaataaacaccacaatgatatattactacacacctattagaacatattaaacccccctaactgacaataacaaatgctgatgaggatgtgcaacaaaaagacctttcatttatcactggtaggaacacaaaatggtgcagcctctttggaatagaatttggcaattacctataaacttaaacattgacttaccacactacctagcaatcacattcctaggtatttacctaagtgaattgaaaacttaaaaaactaaattcttttttttttttttttttttagaaacagggtcttgctttgtcactgaggctggagtgcagtagcaaaataatagctcactgcaacttcgaactcctgagctcaagcgatcctcccacctcagcctcccaagtagctgggactacaggtgcatgtcaccacacccggctaatttcttttattttgtagagacaaggtctcactatgttgcccaggctggtatcaacttttgggctcaagaaatcctcccatctcagccttccaaagtgctgggattacaggtgtgaacacctgactgaactgaaaacttatgagtccaaacaaaaacctgtatgtaaatgtttctagcaactttactaataattgccagaaactggaagcagtatcaatagaggaatagataacttgcatatgcagatgaagttctattggaatactatttgatgataaaaaggaccgagcttttgactcctgcagcaaaatggatgaatcataaatgcattttactaagtgaaaaaagtaacactgtatgaatccactgttatgacttctgaaaaaggcaaaacacatagggatagaaaacaaatccgtgtttgccaggggttaggggctggcggatgtcccactgggtacaatgttcactatttgagtgatgggtacactaaagcccagacttcagcactccacaatatatccatgtaacaaaaccgcatttataccccctaaatctataaaaattaaaaaatgaggggtatacagaggaagttgtaacatgaaggaactgctttttataatactctgcatttgttaaaagccatagcactgtacattaccaagagtgaactttaaagtagaaaaacaacaaaatcaaccagaatgtcagggattccaggatggaatgtaccctgtgacaaatgaatctgattgtattaaaaacaaatgacaaaactgtactcaaggagctggggaaaataggtgctgacctagggaaaaataggagctgacctaagtaacttaaaacttattttagtagaatgatttgtatcgctttgggtatatacctagtaatgggactgctgggtcaaatggtatttctggttctagatccttgaggaatcaccactgtcttccacaatggttgaactagtttacagtcccaccatcagtgtaaaagtgttcctaatttctccacagcctcaccagcatcttttgtttcttgactttttactaatcgctattctgactagtgtgagatagaatctcattgtggttttgatttgcatttctctaatgatcagtgatgatgagcttttttctcatatgttttttggctgcgtaaatgtcttattttgagaagtgtctgttcatatcctttgcccactttttgatgggactgtttctttttttttttatacatttaaattctttatagattctggatattagacctttgtcagatggatagattgcaaaaattttctccctttctgtaggttcctattcacttttatgatagtttcttttgctgtgcagaagctctttagtttaattagatcccatttgtcaattctggcttttgttgcaattgctattggtgtctttgcccatgcctatgtcctgaatggtattgcctaaattttcttctagggtttttatggttttgggttttacatttaaatctttaatccatcttgagttaatttttgtataaggtgtaaggaaggggtccagtttcagttttctgcataggctagccagttttcccagcaccatttattaaatagggaatcctttccccattgcttgtttttatcaggtttgttaaagatcagatggttgtagatgtgtggtgttacttctgaggtctccgttctgttccattagtctacatgtctgttttagtaccagtaccatgctcttttggttactgtagccttgtagtatagtttgaagtcaaataggatgatgcctccagctaaagactcatgcgcatgtatatttattgcagcactatttacaatagcaaagacttggaaccaacacaaatacccatcaatgatagattggataaagaaaatgtggtacatatacaccatggaatgctatgcagccataagaaagaatgagattatgtcctttgcagggacatggatgaagctggaagccatcatactcagcaaactaatacaggaacagaaaaccaaaaactgcatgttctcactcataagtgggagttgaacaatgagaacacatggacacagggagaggaacaacacacactggggcctgctggggggtggggggcaaggggagggagagcattaggacaaatacctaatgcatgccaggcttaaaacctagatgatgggttgacaggtgcagcaaaccaccatggcacatgtatacctatgtaacaaacctgcatgctctgcatatgtatcccagattttaattggaaaacataaggttaaagataaatggaactgtacattaacactgtactgtatttggtaatttttttctcgttggggtttgggtaatcagttctgaaactgctttacatctatcctggggttgaacaaataagtaaacagatgaattgtgggagccaggtttcatgctgtcagagggcatttacaaataagcaagaagggaagcataggataaaccctctagtgctggattagagccagaaacatcagtatgaactcatatttaggtagagtttcacatacatatatgtacatatacacacacagatggatagattcagaatgattacagataggtgtgtatacatagcatagcatacatatattacctacctccaactgccaaggtcctagaattagtgacacccagtagcaattagaccctcagtacttagatcttgctttccaaataccatttataactaagaaccctcagagaaatggcttattcatgagggcagggcaatgaaaaaataaaagatgaatagcatcagaaagtaaagtgcccaaaaaacacaaaataatgggggcatgtcaaagggacaataggagccaaccttaaagagctcccagtggccaaagctgaaacaatttgagcaacaaaataaataacacagtatttttaataacccaaagtataaaatacatatacagtcatatgctacataatgatgtttgggtcaatgaaagactgaatgtaccaaggtggccctatgaggttataatggagctgaaaaattcctattgcccagtgatactgtggttattctaattcatagtgccacacattactcaagcagttgtggtaaagctagtatgaacaaacttactgtgttgccagtcatatacaagtatagcatatataattatgtgaactacataatacttgagaatgacactatactttttatcattattttagattgtactccttaattaaaaaaaaaaaagttggctgggcgtggtggctcatgcctataatcccagcactttgggaggccgaggcaggcggatcacctgagttcaggagttcgagactagcctgacccacatagagaaacctggtctctactaaaaatacaaaaattagccaggcgtggtggtgcatgactgtaatcccagctactcgggaggctgaggaaggagaatcacttgaacccgggaggcggaagttgcagtgagccgagatcgcaccattgcacaccagcctgggcaacaagagtgaaactctgcttcaaaaaaaaaaaaaaaaaaaaaaagttaactataaaacagcctcaggcaggtccttcaagaggtattcaagaagaaagcatcgctatcataggagatgacagctccaccggtgttattgcccttgaagacctttcagtggaacaaactgtggaggtggaagactgtgatactgatgatcctgacctcctgagatcgcccaatgggctcataaacaaaatggccatggtggcagaaacagaggttatgcatgggctcagcaacatggacttccactcaccagctgacctgactaaaggcactgccgagtacccaatctgccagcagcagagactaacaatgagtccctgatgtggcaccattccccagggtgatcaggaagctacccggtggcaggttaattacagtgagctgcttccattaaggaaggggttatattttgttctcactggaacagacactctatctagatatggatttgctttccctgcatgcagtgattctactaaaaccaccatctgtggacttacagattcaccttatctactgtcatagtattccacacaccgttgcttctgaccaaagaactcacttcacagcaaagaagtatagcaatgggcccatgctcacggaattcactggccttactatgttccctaccatccagaaccaggtggattgatcgaacaatggaatagccctttgaagacttagttatagcaccagctaggtggcaataccttgcagggctggggaaggttcttcagaagtccgtacatgctcttaatcagtatccaatacatggcatggtttctctgatagccaggattcaagggcccaggaatcaagggatggaaatgagaatggtacactattacccctagtaataccactagcaaaattttggcttcctgttcccatgactttatgctttactagcctagaggtcttagttccagagggaagaatgctttcaccaagagacataatgattccacttaactgcaagttgactgctacctggccactttcggctccttgtgccactgaatcgatggcaaagaagggagttatgaggctagcttggggtgactgatccttcctgccaaggggaaactgaactactactctacatgaaggtaaggaagaatacatttggaatacaggagatttgttagggtgtctcttagtattaacattgtcctgtaattagagtaaatggaaaactacaacctaatccaggcaggactatgaatgttgctgtgactttaggaatgaaggtttgggtcacctgttgggtagagaatcacaagcagctgaggtgcttgctgaaggcaaggggaatatggaggggtagtggaagaaggtatttataaataccagttacgaccatgtaaccagttgtagaaacaaaaactgtgtcatgagtattttctccttattttgctatgaatacatttgtgcattttctttcctcttattcttttatactgtaactttctatcacagtatttaagttactaatattatatcatttatgctatttaagttatttaagtatttaagttatgggatatcatggagaagagtaaacatcacacaaggactttacctcctcttctgaggaatggtttagtatgtttttagttgtatgctggatagttgtatcatgttaggtggaattatgatcgtgctattgtctttatttgcagattaactacggtttaaggagatgtgcatgggtgccatgttgacaaggggtggacttgtgatggctaattttatgtgtcaacttgactataccatggggtgctagattaaacattatttttggatgtgtctttaaggatgtctctcgataagattagcatttgagttggtggccttagtaaagtagattgccctcactaatgttggtgggcatcatccaatctgctgagagcctgaatagaactttcaaaaaggaggaggaaggaagaatttgcccctttttgcttcctgcctcccatctggagctgggatattggtcttctcttgctctttgactgagatttatgccatcaactcccctgattctgagccttcagacttgaactggaattacaccactgggtttcttgggtctccagatggcagatggcagatcatgagacttctcagcttccataattgcgtgagccaatttctcaaaataagtctccctctgtctatatgtcctactggttctctttttctggagaatcctgactaatacaattctccattcaaatttccttttcatgaaaatacttctaatttctccaaattcttcatgaaacataccttatatgactttcttgatctctctctctctctttttttttcttagagatggtcttactttgctgcccgggttggagctcagtggcacaatgacagctcactgctgcctcgaactcctgggctcaaggattcctcctgccttagcctcccaagtagctggtgattataggcaggtgtcactgcgcccagatgattaaaattttttttttatcgaggcagggtcttaacatcttgcccaggctagtctcaaactcctgggctcaagcaatcctcccacctcagcctcccaaaagttctgggattacaggtgtgagccacaatgtctggccccttgatctcttttcgtctatgtagcacatgatgtcaaatactctactacagtgtctctgacacgtttgtatttttaggccttatcttcccaagcagaatttaataaccttagagtaagagctttttctcttatttcttctgtgtgtattattatttctttgtgtattatcacttcttcttccatttgttcattcatttattcactcattaaacacatatctgctgggtgccaatacaatagtgaacaacatcagactgttcccttaacccttatggagatcacagtttagttggggatgtagaaatgaataaaacagccataaaacaaatgcacaatgataactgtcaataatgttctgaagggaagatacttgatgagagtccacaaagggggacccaacctaattctgagtggagaggagggtgggcagggcaggaaaggctaatctggacaaagttctgttttagctgaaatctgaagaatgagtagcttttcactaagtaagatagagaaaagaagtgagggtgagagaagagtattccagatagaagttctgggttaaagaaggtggatagggccacagtatcacacacagcaaacctcaagatacagggactgaccaaatagacaatactaaccattttcttcagtctcttctcttctcgttttctttcaagctgtgcctccttttcttctgcctcccttttctgacgttcctcctcttgggcctttaactgggcctgattgagattagaacccagaaatatcagaaccctcaatttgaacagaaatgtgatcttttatgtttaggatagtcaagcgtctaccaaagtgcctgtcctatctctggaagaagtctgcattttgtgataaaagtagaaaactcaatcaacctgtcatcagttacgtaacttaaaagtttctccaaaagaatccttttctacttgggaaggtaagactgatcataaataagatcaccaatctttcattaaaaaatgattactttttagttcttactgtcatctgtgaaaaactaactccaagttagaaacagtttagggggaaaaaggttttctttcatttcaccagaaaacccccaattgttggaactgtttattttttcttggtagttacaaaatttactttggatagtctaggtcaaaactttggaaaataagaactatccctctttgcaaattcagtaggtcagacatctacctataatacactaatcttggttatgtgtaaatcttctaatctgctgactctcatcaactttcataacattttcttcctgctgtgttaatgatgttgatgtttctgtcccccttattttcctaaaattgtcacggaattcaggccactaggccaaaaaaccatttccaaagttgatgtaactctattgtctcaggagttctgaaaaagcaaggtttcattttttaagaaagacctggacaaatccttcttttttgactcagtttgcattttgaatctattaccaatttttcttcttcttgttttttcttcttctctgccaagatccgcctacattcagctcgttgaattgctctctcttccatagctagaaaatagtaacagagttctaatattttttatattgaaaaaatatgaggaatactgcaagagaaatgtctccatttcatagtaaaatttagtgttattattagggttttcttgtaagttgaatgttcacaatctcagaaaatatatagagataaacagaacttatatactctacaggttaaagacctattatcccatcctcagcaatgaggaacaatttataaattaattattttgtttacatttttattaaaataattgtttactgatttataatgtgccttgatgatacttttagtatatgaaacccagaaaccagaattctaatttgattatatgtttgatgaatgcagaaaactttaattacatctaacaagtactttgagagtagaatcgttcctcaaatcctattgaatctgctaatttttcttaagtcactgtacatatgtctgtatatataagaataacaacaaacaaactaaagtttggggtcacgatgaatatatttgaatctagttttaaggcctggatatacagatgggcaggaaatggaattgtaccaggcatttggagaactggcatctgaatgaatttgagtgtcagactcctgttcttgacaggctattaaatatcgatccaaaagaaacaaatgtgcaagatggtctgataatatgactctataatcagttggggctttcataggaagaggggcatggatgggaggagtatcaagttctgctcacctaagccagccaatagttactttcagttccttgtgccatattttagagaaaagaatttaagtccaagttttaagaattaataaacaaaaaactcaccaggctatttcttacagttattaagtgtctgctttgctgaaaaagaatggtagtgccacagatggcgagagtgaaattgtctctaagaaggcagaaatagactaggggattaaagtaagagacccctaagaagcagagtctctggtaatatgccctttgcccatcttttctagatctaatcatcaaaagactacttgaaagtagactgggcttctaaaatagctaactccttgaccaaacaataattttaaaaaaataatcatacttaactgggtatttactgaccaagcttaatgataggcaaagacagcataaattgctgtcctggcagatagttaatgcaaagactgccaatttcttcattaataggaattgactgcaggcacagtgtctttcatttgtaattacttcttgttaaaccagcaatcttgtcacaggtaaaaaatcaaatttacaaaccacaatataattgtcaaagtgccaaccaccacatgcaaacataagtacagtgaaggactaagcatatagtaaaaacaattagcagattcactaggtgggttctgaagaatgcttctattcgtatagtttagtttaaataagggtttctggccaggtgcagtggttcatgcctataatcccaacacctagggatgttgaggtgggaggactccttgaggccaggagtttgagaccagcctgggcaacacaggaagaccctgcctgtaccaaataaataaatgtttctagatgcatcaaaaatgttatcaaattaacatatctggtttgtaggttttattactaaaatcctatcaacaagttataatattataaaataataacttatcttggattactgtaaactgatcaaatttgaacattaacaaagtacaatgacaggtgtcctttatcagtgtttgtccttggcagttactcagagttttctcatttgtgtaattattcctttttttttcacaatccaaatctcaaattacagaaaaatgatatacctttcagctatgtttttttgtgtgtgtgttggctgggaatgccaaaaaggttggcaaaaggggcaggaaaaaagtagtggggctctctggtgtactccactcctcacatgtctaccattctgagatttttgatgtcaggttctgccaagtctcaaaacctcaagagttgccagaattcagtcccagtgtacacattctactctaggagagaagataacaaccaccaaggccaccaccgagacagccctgccttttagtatgggatgcggtgtcatcaattgctttggtttccttctgagtccagaaagagaatttcgggagtcacttctgccttcagtcccaggggaagcaacaggtgaactagggaaaaaataaaggaaaggaatttagactactaaccagtttccttcaaactcctttgacctgagatgctcaaagccttttacagaccttaatgaatccctactctctgagataactacatattatatccactccataaatatgtgtaatgaggtatggaaaggttgtgtgatcggcatgagtctacacagtgagtcaggtactgtgactcccatcctaatgcttcaaatccataggtgtcaccacatcttatcctaccatttaccacatgcaatgagtatgtctcaagcacaactgaaaccatcttacgtggcttttgagaaacttgggctcttatttgaggctcaaagatgttttgttttatccctaacaactacaaatttaagctaggaaataagccagcccaggggctgctccatgtggacctgatgttgtctgacttggcttctcagcacttaacatagctagaaacccagaaatagagcaagacagcatttttctctttaactggcatagtaacagagatcctcaaaggcagccgtgacccaaatgctaacagtataactggatccttacaggcatccttgactatctgtgcctgtcatatactagtcataactaggcttctttgctttgagagtgcaaaatcaaggaaaaggaacaatcatggggctcagaagcagggcaaagaagctcaggagcccaaagtgaaaaaccccttaaaatgagtccagcgagttctgatagaacagacatacttcacaagcatctggcaggttcttggttcctcttctctgggctttgacagcaggtggctctgtgcttctgtgactgctaaggcatgctctgctgcccactgagcctctgccagctgcaggtttttcttcagctcgagaattgttttctgctgttcctgaagtttcttcttttgcttctcaatcagctgttgctggaagacatggcggttgtggaaatgacccaagcaaagcggttctgctttctggctggtagttctgagtgtctcgttgctgccaggctgttgagagggttcagcacccagggtcttgtgctgcttattgccaggtgcactcagagagacattctgaagggaaccctgcaagttgcctgttgttgttcttcccaggggaggactgagcatacaaccactgcttcccaagggaggcttttcccacaaagggggcacagcagtctcctgagagagagaaacatgttatagctcaactatttaaaggactgtgctgatgaaatccaacatttatgaggtcagtattgttttgtttaatggcacaactgccatgtattgcaggtaaaggtggtctgtgctcctggcctggctacctcagaggccaccactcttaaaacatgcattgctgctcaccatgaaaactgggagagtggccggctgtggtggctcatgcctgtaatcccagcacgttgggaggccgagatgggcagatgacttaaggtcaggagattgagatcagcctggccaacatggtgaaaccctgtctctactaaaggtacaaaagttggccaggcatggtggtacgcacctgtaatcccagctactcaggaggctgatgcaggagaatcgcttgaacctgggaagtggaggttgcagtgggctgagattgtgctactgaactccagcctgggcaacacagcgagaccctggctcaaaaaaaaagaaaactgggagagtggctacagctgtatgaaccattgccatgggccaggacattcgtaatagcaaaaatcttctcttataaatttctaatttggacagttcatttgtgaattaggcaaggttactccagatatatatatatatatatatatatatatataaatatatatattttatatataaaaaacatgaatttaatatgcataaattgactctgaattttagtggaaatttgaagatgttgtggcaaaggatatattctttctcgagaatgtctgaaaaccaaagaatatctttacaaatgaataatatatctcttttctttcaatgcctctcctgacactagtaaattaatcatatgccatagtataggatatttagttatttcagcatcaaggtcccgttaaagcctagctaaccgtttccagctattcctgaactatctatgggtgggaaatatttggaagctcaggatcactgggcaaatatctgcattacaaactatctatgggtgggaaatatttggaagctcaggatcactgggcaaatatctgcattacataagaataatgttacctaataatattttgtattagcatatcactagttttcaaagctttattacataaatcccatttaatagactgaggtaccatactcaattacaagttctatacagaggggaaggaaacaagaatttttatttagaaacagctatcttggccaaaataatgtcatattaaagtgtctcttctagaatggtttgagtccatgttctaaggtctaagtttttgattctgccatctgcaatggcttaaagagaaaaatgctatgagctatctaaatatcagaagcttcttgttctaacaggaccccatccttagggactcaaaaatatttttcacgattatagaaatgctttccatagactcaactgaaatgaaagatgtgatatatggaaactctgacatgttaaacacttttaaaagtaaccttttatttcagtaatgtcagtgaacacttattcatgagaacacctgcttaagcaatttatatcaagcagggtatatgttttaggttcttttaaacttggtggtaatgacaccttattaacctagcaagactgtgtcaaagccctgagtaaagcgacagggtttcttttggatcatggtaactttttaacatgaaaataaagaacatgaaggaaaagcttagtggtacagatagtacttaatagagcaggagtgaatggtctgacttaattagagaaaatcacctattagctaactgataattttggaaaaattcaaggtacagtttgtgtgttcttagtacatgagttcctatgactgtataattaatgagcatctaactaaagattttatattttcacttggtcatgttttgctgtacacgctggaaaaagattagtttacttagtctctacagggtctattgtagccctctattatcatttgctccatttttaacaatactgtcctttcttgataaagtcttttgttcttgatttcagagatttggagtcttttgttcccttgagtctaaatatatataaattactatatatatattactatatatataaattactatatatattactatatatataaattactatatatattactatatataaattactacatatatatagtaatttttctgttttgcacaggtaaaaaatactttctgctgacttttttttttttttcatttaagaacagtggcactttgtaaggtaaaaggttccatacagctctttcttaagatagaagtctgtcttgggtctcaatggagacaaaattatctgccataaaggtagatacattgcctaggggaagggaccaaaatgttacacataagtcccaacaagcatcttcctgatccccccttgctcagagaataagcttaaattaaaactagcctacttgctagcaataatcagggtaaaaagcaaggctggggaccctctagtgcacaatttaatttcacatgtctgaattaagtacttaacagcattatgtggagggtggaggtgagggggtagaagctcttctccacaaggttttctaaacatgacaagagcagtgataaaagaagaagccgacaggattgactttataaaaactaaacaactgtgtataataccaaacaccataactaaaccaaaaagacaaatgacaaaatggaaaaaatgtttgcaatatataataataaaagcatcaatagtcttaaaatataaagaactcttataaataagaaaaagatatcaaatagaaaaatggacaaagggcatgaagagacaagtcactatatatctgtatcttactacatccatatatagatatatatacagtcatgcattgctgaataatggggatttgttctgagaaataggtgattttgttgtgtaaacactgtagagtgtacttacacaaaccaggatggtatagtctactgcatctaggctatatggtatagcctattgcccctagtctaccaaccagggcaggatgttactatacggaatactgtaggcaactgtaacacatgggaagtatttgcatatctaaacatagaaaaggtacagtaaaaacagtatacaagataaaaaatggtacacctgtatgggggcacttaccatgaatggcacttgcaggactggaagttgctctagatgagtgaatgtgaaggcctaggacattattatatactagtgcagacttcatagacattgtatacttaggccacactaaatttattagaattttttttcttcagtgatgaattaatcctagcttactgtaactttctattttataaacttttaaattattaactttttgactcttttataaagtaacagcttaaaacacaaacattgcacagctgtacaaaaatattttccttctttatatacttattccataagcttttttttcctgtttttaaagaggttgttttttaaaaaaattttaaaacacatttttgttaaaaactaagatacaaacacacatattagccaaggactacacagggtcaagatcatcaagaagtcactaagcaagaggaactttttggctccattataatcttatgggaccaccactgtgtatgtggtcagtcattcgccaaaacattgctatgtggtgcacaagtgtatattcaatataaaaatgtttaaccttactagtaatcaaagagatacaaatgttgaagcaataataagatgaaaatagaacatgcattccatttttaggtattatcctaagtaaagcattatggatatgtgcagatttagctactaggatgttcactgaagcattgttcacaatggcggcaaactggaaacaacttaaattccagtaatacaggagctaaacaaattccagcttatggttcattacagagtatcatgtagccattacaaaatggtggcacagaatactagtccttagacaggggatatgtattacgtccacttgcggaacttaaaaaaaaagagctgccccacacccaaaaattctgttttagtagatgtgattctgaggtatactctcagttgagaactactattgcagaagtgtatgtaatgacagaaaatgctcatgttatattgtgaaaacgtaattttttttttagaagaacagtaagtattagtattaagaaggaaaaaaaaacatggccttccttttcctgaattttggcagacgagttcctcaatggcctgactaaagaaaatttaaaagctaaataaaatattaagagataaatttgcatatgcttaaagactagatggctatactttaacatgttattagtgattatctatagatgacagaattataggagtttttctctgtgatcttctatcaaattgctacaattagtacatatgacttttcttattagaaaaagaaaaattttaaatttcccctcttgtaagtcacaaactcatttagaaaggaaatgtctgatgatcaaaaaggggagttcaagagttatagacagtgctttacctgtcttttcctaaacgaatattttacttagttgttttaaatgccctttcgatattaaatccctactaacttccaatgatgccaaagtttatatatgattataaaaagaagattcaattcaaggaaataaacactgcctgaaaggtagtgcattgaggcagctctaatcttctgatagcctagacaaagcaatctgacaatgactgacataccagctataaaagcacaaacctcaaatgcaagtgtttactaagcaggaaaaacaacgtacctgtccattttttactggtggacccaccatggctgttgcctcctcaggtagactgatgcctgataacccattggcactgagtttccccagtgatgctgcctgcagcagtgcatccatcttcttcctagtttcctcttttgtgagagccagctctctcttcaggagctcggcgccatgccaatgctgccattctgtaaagcagtgtcggagaacttgtttccggttatactcagtggccagttgttgttttctaagcaacaaagcacttccattaaaataaagaagccatttacagtttgttaattgataatataaatgaaacataagtccaaaagggttctagaaatgctccatcttagctctcgcttaacattttatattaagctaaatgaaattgctttataaattccccagtgcaaaggatctcctcatagaaggtgtcagcacttcaacagattaccttcaagaagaaagaggaactgttctgttctcatgtcacaagggcatgttacatgtttttgattaccatagtttctgaaagcttttggaggggaaagagcaaaaagaagaggtacacaagtaatgactttaaaaagatgaatgcatgagggagacagaggttcagctatgcacgaaaattttaaaaagacaggtttaggagaaagagaaagcaacaaaattataacacttaacaagttaaattgtcaataatttaagtaaaaggcttacaaaaatcaaagtaacactgagggttgatcttgtgaaagaagaactggtcagggaaaggactgctaaagagaaggactcatttaccaaacccttgaactgaatgcatgtctgccccaagaaggtacttgctaagcactagatgtgtaaagggcaaaggcaaggcccctggtctcatggaactcatttattttctacaccttcctaaggaagagctcactttgattcctggaaactttataaatgttagggaatatgactgaggggaggttgggatgtggtgttactgccagccacattttcttcccaatgggaatctgcattaggagatttggtggcagtcagttgagaattcaaacatagaggtctgagatctatctataagtgaatggttattatcctgaagaacttagctgtgagtgtggaacttattatgtagtatcagggatcagctttgaggttcaaaatatactgtttagacacacactggattgtatcttggaaaggtgactcatataagttctccatatccatttctgttaaacatacataatgcttaagtctcctcatggactctttggggtcatatcaagcaaatcataaagttcttaactcagtgagtcaggagaccatttctacagttcttaaatgtttatacgacttttaaacctttttttgactgcaacctacagtaagaaaaaatgtcacattgtgactcaatatacgtgtgtgtgtgtgtgtgtgtaaaagtttcaccaaataatatttacccttaccacaagagatatactctgatatttctaatctattctatatttcttttaaaaataagcaaccctgctaacagcatatttcattatatttaattgtttccttctaatgcattgataggtactcaataaatatttagaaattcactcactgatggtttttgtaataaaagtataatataggtggtaataaacatttatgtatgttttacttttatgaaaacaaatatctgagactgaataatcttgaaataaaaattttagaagaaataacaataaatcagatagcaacacaggtaagaacaaagctctaaaaatcagtgtataaatagtgaacaaaaaaaccctgtaacactttattcaagtgagtaaaaatcataaatttctacaggatagaagatgtacattgctgtgtctgattaatgtgaaattcaatttccatcaatctgctctggaaggaggagtgtgaaatttacctgatgtattaatttcctgtttttacagcacaaacagccaaaagcagcactggggttttgactgtcaaggagattatttggacattatgaaaaggcaaagagagaaacacttctgtaactataacaagactaaaaaagtaagaaaatgagtaaaaaaatgcatgttcaatatagggcttaaagcccactctataatggttgtgcggggatatgaaaatgtagttggccaggcgcagtggctgatgcctgtaatcacaggaatttgggaggctgaggtgagtggatcacttgagcccaggagtttgagacttgggccacatagtgaaacttcatctctacaaaaaatataaaaattagctgggcgtggtggtgagtgcctgtagtcccagctacttgggaggctgaagtgggaggatcacctgagcctgggaagtggaaattgcagtgagccgagattgtgccactgcactccagcctgggcaacagagtgagaccctgtgtcaaagaaaaaaaaaaaagtaaaaaagaaaaaacagaaaatgtagttacgatatctgtatttgtggtttgaggcagaaaggcagaagcacagaagctagagatccagagacaaggatagttccactactgttttcttgtagctcacttcagcagagtgacaatgttgcatataagccaatttctatactttctaaaagataacactaaaacataaatatttctaaaagcgaaaaatcacttaaatttcttaaaccttagtcagatgcaacttactttggtatgctcacctaaagaaatggtttcagacataggtgccagataatcataaatggaagggcagagttcccttatgaaaaatagcctatcccaatttccttgcaatctgaaatcagggaatttctagccagagtatataaattgatcatcacaatgatatataactgcatgcagagaaaggcaggctctgctcatctaagaatataaaatacaaaaggtttgaataggaatttaagtatgaaccttgctgcccaggatgaacactcaatgatactgggtgactggtgcatgttttggaacttacaagtcagaagaagaatgctaactagacatgggacactgggacagcaactgagtttctaagccccagattcatcctcaaaaacagtgtcagtaagccctattatgctgcctatcctacaagagtttttttcctgagaatctaattcaatttaaaacaaccctgaaaatatagaacaaaattcacatgtaaggtaatacccactgtcttaggacaagactactagatatctgcaaagtgtcttgaacgttttaaaagcaaatgaaaaatgatacataatcacaagctggtgatctgattgagtgctgtaatctgatgcagaacataaaaaagcagtgacatgaacagttacatttgggatgagcaggtttagctggaataggaatgaataagctcatgcattcaataatgtgccaggtacccccagggacaaaatggaagataaaaactgttttaaaaagttttaaagttttaaagcgagccaggctatgaaagccttgtcctctgcctgtgtgacagagagatcaggagtttaccaggtgaagataccatgcggcttctggctgctcacctgcatacccacgtgagcagagggaaggacaattgaacatgattaacaggcacactccgtaaatgatttccaaaagaacactgaaatccagagtactggaaatgagaatatctgacggcctattttcaattcagcctcacttctcctccccacctccaggtgagcctggcgggttcaccctgacctgttcctacgcaagactgcctatgtactagtttactagttcttatccaaattaaaaaatgcccttttctacttagccacattctgcctctttcagaaggtgggtcccatgaatttctatttctagaaagctccccaggggatcataatggaggtgggacccatgaatttctatttctagaaagctctccagggaatcataatgaaggatgtcattcatgtcactcctaagtatttatcttatggtgtcttctgttgcaattgtgttaaatatttgggtacaattttaacttccccatttagataaaaaactcctagaaggcaataatgtttaatatttttgttcccccatcctatccccaggacttaggagaggatctagtatacagtaaacatcagtaaagctggttgactgaatgaatttatcccaatcaaacagtatgaacgaatgaatgaccaaacgaatgagatggtctgaagaatgccaaagggccagtttttttcactggcctgccacagtaccctcaaatctctgtcactcccactttgggcactgtttccagacagtgcctgttaaaataaaaaaaaaatgtcccgggagggataacatatcaagtgagaattacagtaacaaagaacgaagggcttgagggacaaagggaagaggtaaaagcatgttccaggaaaggcccagagcactggtgcaagagaaggcaggattaaagactgtggaggttaatacagagaagggcagagatgcggcccaggaaagaattgagaaatctgggaagcagggctcaggaaggactggcagaagatttttctaaaatttttattttaatttatccatagttattggggtagaggtggtattcacttacatgagtaagtttttaagtagtgatttatgagattttggtgcagatgttgaaaacaaaccatgtttcttcccaattttgtctggggctagctgtaaatgcagacagaaagggggagaggaggaatggaagatctggaaccaactttcaaaaatgaacacactaaggaaattgaatatacagttcaaatttcaataccaccatgtcaaatggtctaatttagtgtgtatactagaattttgttgtattactaaatgaatcctcagggtttggaaatatttgttcatgttgaagctgcatcacaatattgtaaggacattttgtaacattattgccataacttcttttaaaataataaacatgaacaaaaacagagtaaccacaattcctattaggaaaagcaagatgcatttttagaagaaataagtggatgactccttggactgcaagtgagactcagcacaggctcaacaaggaaagatggttgctaaattacgaataaaaagagagagatttgtggttgcttcagagagaaagtgggaagaacagaaagaaaaggggcaaaagaaaaaagcccacaagtctgggcccttcatggcggacaggccagtgagcggaaatcgaggtggcaaacacacacgtcagcgaggggagctagaggatgaggaaaacaactgacatttaaataacgaacataataagtaatttcaatgtccaggtgagtgaaccacagaattacctgtgttttgtcaatctggtcagagctaagtttctatagtgagtaaccacgataataaatgctctctcctatccctgagctgtctatttagaaagaatgcttcaaaaccctatcaagttaaattgcaggagaggaagcaactgagttcttcatttgttccctgacttgcttattattcaacaagtatggatttggtgtccattgaggctgctctttgctttgtgaccttgagtcatttactgtctctgggccttacttttatcatctgtaaaatgaggggctggatcagatgatccttgaggtgccttcctgctctgggattttttttgctctaaagctttatagtaaaaaattattgtaagttaaatgttttctaactctggcagttaaaaaatgtttagtatccattctaaacatttaaaaatagtcacctgaaaataattcacagatacaagaaaaagttctgagaagatcttttttaaaaaattggcacattatgctattatgaaatccctatttagtgcttttatatttaaagtttaattggaacggaatcttaaattttccagattctccttatacaagtttcttctagcatgtaaatctcataggccacttttaacttcaacatccaagtgtccactcattttatgcctgcactcacattgcatccactttacaacctgtttcccttctttatccaacaaatcctgccagctattcctttctgagtaagctatcatcctaattccttgtatcaatcactaggtcctgagattttagaaacaaactatgggagagttttctgtgttggcctctatttttttcaccaaagatttctcccagcatatcataggaaagggagattgactaggtcaccctcctgcttaaaaaaccttcaaggattcactttttttttttttttttttaaccaaagactaccttaactccatgtcctggcattcaaggccattcagaagttgacgtacttgacaaccacatgcttgataatctccagccaatccagatggctatgcttcatgccatcatcccagtctccccatctctacctaggaacatcctattgaccatgaaaagctcagatcaaggcccatcttcttgataatgcctttcctggcactctttaggaatctccttagccacagctacacattcttgccacgttctcagcagcagatggagatgtattattcagtttacaatactcctcaacacctgtacagtctctagatgttgttttgcccattcaactgtgagttctttgaggacaaggggccatgcaccagtctccaggcctgatgctatcacaggattgcacaactttaagaggcaccatgcccttctatgtaacaatactgacatttatcattcatgtgatttttcatcctgaatgaatgacagaactgccagtagagaagtgattacttataaaaacatgaatttctccccaacccctaagtaaacaaatggttccttcacatggacacagagaggggaacagcacacaccagggcctgttgaggggtggaggatgaggggaggaaacttagaggatgggtcaataggtgcagcaaaccaccatggcatacgtatacctatataacaaacctgcacgttctgcacatcatttatcacttttttttagaataaataaagaaaaacaaacaaccaaatggttccttttacatctgtgattttgattcaagaatgcaaacttgaacttgtaaataataataagaaaattatttgattttaagatgatggaataaagaaagcctcatttgaaggcagaattctgtgtcattcacaaacataagaaggagctgttataaaggtgtcaaaaaacctctaaataaggtgtggaacaaaagatggtagagtgggaggaatcactttggcaggttggccctcccagatggatgtgctctgtgtccttaattaacattttatgtgcagacagtgatttctatgaatgagaattattggcatataagccaaacaccctcttttgaattgtaagatggtccagggtacaatgctactacaccagaacacaagggaaaatcctaatacttgcttccattaaagaaagaagatcatgtacaatgtatattttattttattttattttattttattttattggagacaggatctcactatgttccccaggctggtcttgaactcctaggctcgagtgatccttctgccttagccttctgagtagctggaattacaggcacaccccactgctcccggctagcacatttaaataattttgtttacttataattttcagtaaaattttctagtttgagatgtaacatagaaaaactgtgattaccatatttcataagtggttaagattattctagttggcatgtgtaaagtttatttgtggattcttcaggagggaaatatcctagataaacatactagattttcacaatacaaataatgatacctgttttcttccctaagatcattttccaaggcttgagtctcccgctccaacttctggaatcttgtgtagtctctccaggcccgcaggaccttcagctgaatcttccagtcagacagggtcccagctttccccagcttaatcctatgatcaagaatcagcttgtgccaggcagcgaaataccgtttttgacactgcagcggaaatattaggaaaatcaccacccatcagcgctagtgtttctaatatctaacactgacagccctctcctcagattttcccctcacacttttaaaaacaaatacaggaactgttgtcttaatggaaaggaagagacaaagcacaattcctttatgctaataatgacaaggaatattcaatcatgcaaatgaggcattctcagcctcacaacttaaactaaaatacttcattgtcattgtaagccaccagtcccatggggagctggaataagtcacatctatgacatgaaccaaggggcttgtttgagaagcttgaaaacttgtttccaacatgactccccctgccaggtgtcttggagctcaaaataccaaccatttaattcactaccgtttctgacacactagtgtccacacaagtgaacgggggagattccatgaagataggatggagtctctggtccctgagaataagacagctataaacaacaaaatcagctgggctactaccactgaccactttagggctttggtgagtctagaaagactagatgttcaggctgcctataatcttccactacatgcacttgacagcaaattagacaaggtctactgatcctaaggatgtccccaaagcagtacttaactcatgatcctagtctaagaaaatcactgagacctagtccttgcttatatcttctctcttttcagcaaactttacattccttctagatcaaattactttcagcttttggccttgacaccaaccatgccatttcatagtttcctatgttcatattacgttggtgcaaaagtaattgcggtttttgccattgcttttcataaccaaaaactgcagtaacttttgcaccaacctaatattaatttctctgtccctcttttctgccttctttctgcctaactacagtagtcacctctctcaggaagccctcctgttaccaatccctctacccaaatgtaactgcccatccactgtgttcctataacaatctatgctttcttcagccaaaacacccaacacactatattgtaatcaccagtttacttttctcccctagactgtgagcctcctgagagaagggaataggtctcataaatgggaatggtaaatctgacagtggcactgagtgtggggagcattaaaacaaaaactaacctcatagaaagtgactttgtgggaagtatgggggatttgccagtttcaaggatttgcctgatttatcaggcaaatatttactgcttctttctctataaaaatacttaactttcttcatttcagcatttgctaagcaaccatcactgtgtttcaatttggggactctgcacaaaattgtttgatatgacctctacttctaagaggttatagggaaagaggatgtatcaatgaaaagaccaataacataagagagcatctactagaattcttagaaattgtctatttggccagaaatgttttccaaacagggtattagtttatattcttgtttagacaaactaaacaatattcttcattataatttctcattaggagaaaccatggcaaactttaaaaagccctctccatatgtcaaataaggcacatgtcctagaccttcaccttagatcttttggagaggatgaaagggaggaagggagagaggaaggaaaggagatttgctgaatactggatactctttcagttgtaatagggagaagagatacagctggccaggttgaggggtatgccttttgcatcatttgtttacctgttccacaaaatacagcatgaaaaaaatggtgttaacttgtgtgccatggttgaaagaaaatgttctgtgtctgtttaccaaatccccttaagagattcctcttgaatgacttggtaaaatattctatgtgtagctatctctaattttaacttcaggattatttcaaatgatgaaatagaacaaacataatccatcttgataataataacactattaatagtatcctttgattctgacaatccttttctttgtaaagttcaaagcatcttacgtgtactatttttattaatttgtaaaccatcactataaaataaagattgtagatattattatgatttacttcaccaagctaaaacttcaagtagagaaaggtttaatgactaaaatcacaagtaaagagttagtgttacacctaaggctgaaactgaaacattccagcatcctgatgactctaatctattaggcaaaaacatctctcctgaaaaagaaaggcacattttttgctgctttcatagtgaaagaaaactgtatacataacttaccgtggtagaaaagcattggttaggaacatatctgaatgtaggaggggaaattttgagtttataaattctatagtcaatatgtttctttaaaaatacttatgttgagactttgagaccaaaatgatcagttttaaaggcctataattcaggttcaccacacagaagctaacaagagcaaagtgacaaacctgtatggcaactactttcttgaaattgacttgctattggttttttccctgcctgctcaaaaaaaccaatcccattaaaatttaaattaaaaaaaaaagtgtgaatcaagaatagctgcttagttattcttgattcatagcaaacattatccaggtatacaggagtcccataaatgtgttcgaagaaaatatttgggaaaggaatatactcagttccgtcttctctggaaaaagttgctagttctgtttttatttagaagggtggcatacttccacagacctgaactatttattctttctattcctccctccccccagcttacttcctgatgctcccaggcctgcttctcctcgttacttttctatactttggaactacaatagtgctctatccctttgctttttaaaacaagatgtatgatttaaaaccacaactgggttgttctgtttaagccaggagaacttaagttttaactagccaggtaactagtctgatttccctccatttatttcctagttcatttatttttgtaccatgtttttatttctgttagattttcaaatatagtcaggcactcttttcctaacttccatcatctctttatcatagttgtggtaataattaaggcttgatataggtaaataaaatacagaaagtcactgaaggaagaactgttcctaagtacctatctataataatttctaaaataaaatactacctggtgaaatttagaaacttttaaagtgaaatggtgtcctccccacaaaatcttccacaatacatcatttggttgttaaggattccactgaagagaagaaatgacagctcgctctgctaaatttattacctgcactggagttgccctcgttctgttagccagaaaagctcttccctgaagtgtaatcacactactgtcactaggaatgattgacgttaggtggaacagcaatttgctatctaatcttcattgtaattctaaccctgtcactagagatgcttgttctgattaatgaagtgggtaactcatcaaaattcctcagctatttctcttttgtcagaaagctcagtgataattgcatcaaaattctccgtcatggaaaaataaacaatgaattgttaagaggacaaaaatgtcaacaagtttacaatttatttttgctgaatggaactaactttggtgcaactaatggtctagggaagttggcaaaggctggaatgtcaggaagaaagctacattctacacccaggcccctaagtgactccttgctgttctcaggccaaaagaagagaaactctattgctacaaaagggagcaatcctcaacttctcttttcctttgtgggctactgtggctgggcaggagaccccacagatgctatgaagtccctggggattagagaggtagttttaagttgaaatgaggaaggagaaaaaaaattaataaaaaatggggatcctttcaacatagtgttggaagttctggccagggcaatcaggcaggagaaggaaataaagggtattcaattaggaaaagaggaagtcaaattgtccctgtttgcagacaacatgattgtatatctagaaaaccccatcgtctcagcccaaaatctccttaagctgataagcaacttcagcaaagtctcaggatacaaaatcaatgtgcaaaaaccataagcattgttatacaccaataacaaacagagagccaaatcatgagtgaactcccattcacatttgcttcaaagagaataaaatacctaggaatccaacttacaagggatgcgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcagtgctatccccatcaagctaccaatgactttcttcacagaagtggaaaaaactactttaaagttcatatggaaccaaaaaagagcctgcattgccaagtcaatcctaagccaaaagaacaaagctggaggcatctcactacctgacttcaagctatactacaaggctacagtaaccaaaacagcatggtactggtaccaaaacagagatatagaccaatggaacagaacagagccctcagaaataatgtgacatatgtacaactatctgatctttgacaaacctgacaaaaacaagcaatggggaaaggattccctatttaataaatggtgctgggaaaactggctagccatatggagaaagctgaaaatggatcgcttccttacaccttatacaaaaattaattcaagatggattaaagacttaaatgttagacctaaaaccataaaaaccctagcagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttaccagaaaaaaatatacaaccccatcaacaagtgggcgaaggatttgaacacttctcaaaagacatttatgcagccaaaagacacatgaaaaaatgctcatcatcactggccatcagagaaatgcaaatcaataccacaatgaagtaccatctcacaccagttagaatggcgattattaaaaagtcaggaaacaacaggtgctggagaggatgtggagaaataggaatacttttacactgttggtgggactgtaaactagttcaaccgttgtggaagtcagtgtggcgattcctcagggatctagaactagaaataccatttgacccagccatcccattactgggtatatacccaaaggattataaatcatgctgctataaagacacatgcacatgtaggtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacacagatgaagctggaaaccatcattctcagcaaactatcgcaaggacaaaaaaccaaacaccgcatgttctcactcatagatgggaactgaacaatgagaacacagggacacaggaaggggaacatcacacaccaggggctgttgtggggtagggggagggaggagggatagcattaggagatatacctaatgttaaatgacaagttaatgggtgcggcacaccaacatggcacatatatacacaggtaacaaacctgcacgttgtgcacatgtaccctaaaacttaaagtataatttaaaaaaatgaggatctttgtcatggcaaaataaatctccagtaggaagtgcagtattgaattctgcaatgtaaaagcaataccccatgaccaatcctattcctgattttcataattttaccccaaagaaaagagaggaaatcatggtaacctccaaccccaactatatatgctcataactaatagcattagagaaaatacattcagttcccagaacacagtgctaagacctgaacttgctgctgggttccatggaaaagcctagaggcctaaactttgacaaccactgccatgtgaaatgctaccccggctatagacaaaaaaactatgtctgttatatcctggaatatgtgatgctcattttacttctatattaaatttttttctccttcctcatttcaacttaccaaaaaaaaaaaaaacaaaacccaaaccctatcactgttctaaaagcagaaacaaagaataaacctttacccaacttcaaaaattatcaacattctgccaatcttatttcatctctccccccaccaactttttttctgaagtatttaaaaatcacagataccgcatattgtatcatgttatccataaatgtgtcaatatgtaccccttacataaggccattttataagttcttaattctgctaaaaagtttcagttgataatattgctgtaattatctaatagttacattgtttcactctagaaatagaatttcaagaaggaattccttagtctcaccaaatagtaaatgcttaaccagtaaaattctctgggttctttacagaagaatgaccacagtgcagcctatcacctgaacactcatgagttctcgtgacctcaagtctggagaaaaggcagacctacggctccctatcaccttctctttgccttctttcttcatgtcccttagagaccttcttccccatctctaccaaaatccctgttacctgcccacccttcatccttggccacacacataaacacaaactatgccaagaacatagcttacttcagaatatatcagacaaatgcttgattcacctccaggatactgtgatagtaagacaatgacgtgatgtctttcattcctcacccacatggctctcaagatccttataatattcatctgaaatgtctagtgtttaggggggaaatattctactctatacaattttagggaatgggcttcatttgtgccaaagtctcttttttcaatttttaaaaatcaaaatgtaatcagtactttttttgaaagacaaaaaaaatacatttaaaaatagggacctctgtaataaaaaagacttcatggaactttgaaatgcaaaacactagcacaatatttaggtaaattggccctcactgtcacctctgtgagaatgggacatctgggttacttacagggtcaggaaagaaagaacataacaaacaatttctttaccaaaactggtaacattttagatggaaaattcctacagagttagctacataaagtaaaatataataatgctttaaacccctcccaagacatataccacacattgcccttggcaataaacctagaggggagagttatatgaatcccagtaatcttcctatgtgtgctggcatttctctttttctgtcgttttatttctaaagaggcttttcctttatttccctcccctaacataagaaaacattgctgagaggatggttgctatgtgtcagctcagaaatggttttgcctcagtggtgtgtaggcagtcttgataaaactaagatctttggaaaggaatcatggtatataaatgagatatttaactacagttttcgtcattctgtcagagaaaaactccaggcttcttttccatatatagtatccctacatttccttggtttagtttgaggtggacttttggaaggtgctgtgccacaagcataactttaatgatgatttctttggatcattattattttattctttaacagaaaaatccaaccaaataagcaaactaaaaccttcccccaaataattaagatgtaggttagtgtcacccatattttatctttctcttcagttttcacaggcagcaaagatcatagagtttctaatcttattaagaaaaccaaaatatatttcagaactggatgagaatgaagaaggccattttccaaatagtataagagttttatagttaatcctttgttgtttctgctaattagcagtgacacatgaattgctgaatctcccccaagagatttcactgtaagatcaaagagaaaatgggataggctggaagtagaaagcttctacacaaaaaacaaatgtttttgacaagacatgaaatgtgtagaaaagatgcatcaatagtgctgcatctgaacttgagttttgataagagagcctgcactgtttctctcagtctcctattaaataatgtggcccaaataagatgttaagagatactctgggaggaacaaataaaatccagaattaggccgggcgtggtggctcatgcctgtaatcccgatgctttgggaggccaaggtgggcggatcacgaggtcaggagattgagaacagcctggccaacatggtgaaactccgtctctactaaagatacaaaaattagctgggtgtggtggcgtgtgcctgtaatcccagctgaggcaggaaaattgcttgaacctaggaggtggaggttgcagtgtgccaagattgtgccattgcactccagcctgggtgacagggcaagactctgtctcaaaaaaaaaaaaaaaaaaaaagaaaaaaaaatccagaattaaagcacaaacaattacaggaattaaaggaacctaaactatagcaactcctaaaaacagattctttaaagtcttcctgcaaatactctacacagctgtttctacagggtttgtaccagtgaaacattctgagggtgctgacaagagcttccagttatctagtcactccctgcaaggcagctaggcattttcctgttttcatcctgtggtcatacctaggctgctgagtatccaagtttcattactcaaggcagctttaggctcctttagagctgaacgttaactgggaccaagataatgagcccagaaggcttgcctatgcctgtggcctttactggaggactgtcctatctataaccaagtctatgtaagagcccgaggaggctggtagatgtatttttaccatgttaccccatatacgctggggaaaatctagagatctactaaccatattacaaatgaataacataattacactgaaaagggaggggaagaaaagaactcacctaagtaactctggaaaacaatattttgactgaatactattcctccaaagctaaaaccaaaaataaccgtacaatattttgctttagtgaatttattcccactgtggtatgggttagcaattctaaaaatttttttttttttttttttttttttatcgagacggagtctcgctctgtcgcccaggctggagtgcagcggcatgatctcggctcactgcaagctctgcctcctgggttcacgccattctcctgcctcagcctcccgagtagctgggactacaggcgcccgccaccatgcctggctaattttttgtatatttagtagagatggggtttcaccgtgttagccaggatggtctcgatctcctgacctcgtgatccgcccgctttggcctcccaaagtgctggaattacaggcttgagccaccgtgcccggcctctaaaactatttttatagtgtactaggattaccctaataagtaaatataatagagataatgagagccaggtttctcagtgtcagagaaagaaattacaagtgagcgagatggaaagactacactgaaacctgtggtgctggattatccttgacaatattattataaattcacagttattttatatatatttatatatacatatatatgtagattcatagatacagaagtcagttacaaataaggaaaaggagaataacatgacccttgtgttgctgaactcatggattttaatatgtatacagatagacacagaaataaatataatgtgtgtgtatatgtatgttagtatacatacatacatacacacatatatctatgtatatatctatatatattttatatatattttagctctgtctgctgaggcggcctagaaaaaaatgacactccagtagcagtgaacacacttagtgcctagatcttagtttccaaagaccgtttttccaacaaaaggaatcaaagttccatgtagaagtggttgattctagggtgaggacaggtaaaacacaagataagcataaagtatcttgtggtgccaacaaaaaagaaagtgtccaaaataggatggaagcatgttgaaagaacaaaggagccaacttgataggtttcccaatagacacgttgaaacaatctgaataagcaagtaaacaacaacaatattagattatgacccatagaataaaataaatatcaatgagctcatactgaataaaataaacaattgcataaatgaatgaatacataaatacacatatacatacatatacacatagatgaaggagaagggactgttttccttctagaagaatttcaattaagtatagaagaaatgagggaaacgcaaaatcaccattaggcaaatacattaacaattgttgcaggcaagagccaccaatggatgttaaccttaatgggtgacagtttacagagaaacaaaatattttcatagcttcacagtatctcctgaaagacaaggagaaggaaaaacagcaactctacaatggagaaactcagcacacacccttaaccaagtgatcaaagttaacatcagtaattacgtcctccttgttaggatatacagagaagggcacagtatcacatcttatagcattcttaccaaaaatgcataaccttaagcaagggggagaaaacataaaaaaaaccaaaacgagagacaattctacaaaatacctgaccagttctcttcagaaatggcaaggtcataaaagacacggaaagactaaagaaatgtcacacactggaggagactaaggagatgtaataaataaatgcagtgtgaaattatggattgagtcctggaacagagaaagaacactagtggaaaaactggtgatattctcatagggtctatggtttagttaatggtatttaatggcagtgtaccaatgctaatttcctagttttgataattatactatgcttatgtaaaatgttaacattgggaaaagttgggtgaaggttattcagaaactctgcactatttttgcagcttttccatgtcaaatattttaaaactaagtaatctgttttcgattggccactaattttgtaaaactgcatatgtgtctaacattcatatttggcagttccatctaaaatatatatgattgtacagtggacttcaatacaatttaagcattttttagaaaacacactttatttgtctctaatttgttgggaaatatatcatggtattttttccttatgtcttctcaagatgactccctgaatactcgtttctcttcttattttctctttgaaatctgaactgttattatataggaggaatactaattccatctgtctcatgaagaatgcagaatctaagtcctttgctaacttttctcaaaatgttaactgcaagtcttacatttctccctactacatttccttctgttttcctgaagccaaaactctgaccaaatttttgttggttaataactgagtaattacaacctcttatcagttcaaaatatcaccatcaaatatgtctatcgtttttaaaaaatcactttgactactttactttttccttcatatgtttgttatccgtatgatattcaaactcctgttattgatttccaggacctttgtaagtctatccctacatttaccaagctccctcagtatcttcctaacattctcttttctcttgctaaatccattcattcacgtatttattcaattaactttctctgaatttcagcaatgcctaaggccctggggtgggtgttgtaggatatgtaaaatatacatatttatcttttctcatctaaccctctcatttacaaatctgcccagtcagtccttttacctgaaatgttataatcccaaaattcatacttttatcaatcccactttattgaagaaaactgcttaagtaacctgaagaggatattcacttttatattaaaaatcagcaagtaatttttacaaaaagataaagtgaaagaaaggaagaaaaggtaaaataaaatatagaccattaaaaagaaaagcacaggtttaagtgtatcattgctttaggatcagagctactaaaaggcaagtaaccagttcttgtatcttctgaataatccagaacacaatggtccttacaactgtcaaagtggaagccaagatttcaaaaactgccagagagctaccttagtttaaggttaataatagttaaatgctattctgaagaggtaatttaggaagaagtccacaatttacccccctcaccccagtaatttcccaggatcccaccagagtatacaaagaatagcctcagaacaggggatttgtgtactgccctgcataccaggtcagctgggcacaaagaacaaatggcgtgggcagttttggtatttgtgatgaggttcaactggacttagtttttattttatcccatctctgatggagctctttgtcatttatactacagaatgctgagtaaagagacattgcaattcccacctgttgattttctttgaaagtttggattaatacttctttcaatttcctttttctttccttcaccattttttcctcatctggaagaatgtgagtactttgaaacatgactttttctgaactattttgagaattctcttcttgccttttcttctctctattaataacaatttaaaaatacatgtatatttacaatagatttaaaaatgagcaattacaacctactgtagcagaataatcactgaattctccttcggaatacacatatttttagatctggctctaaaactacatagtagggtaatttttttggagacttattttattcctttataaaatacagattaaatgaaataaaattgttataaagtactttgaaaagtagaaagtcttatagatactttagtatttttattgagttgcacactgagccatactttgatcaaaatttgagagttaacaactacaagatagtctctaatatagacataaattatctcccatagaacgagaaaaaaaggattctcaagaaaggaatgagattcttactaaaaggcctcttataaggttactagaaagaggaataacaaaagaatcaggtgttattgaataaggagggaatggaatctagaataattttaaaatagctgaaaagagaaaaaaatagaacttaaaaaggaaaaggactttaggcaagtaaccagaattattttagtaactttgttgctcatctttctgagcatcctcttttttgcccacctatctattcttcctcatccaggccatccctcttttgctcaccaattcaaacaagctcatagctatggccttcctactgtagtgcatttaactgcacaggtatatgtatgtgtataaagtatatattattaatgatgtggtaaacatagcacctagtcaggaatcagaactcatgagctctggccacaaaccagctagtcacctgatctttcttgaacttttagttcacagttgtggaaactaaaatggagaaagatgccagagtaccctaccccttctctcactcattctcatatatgttacagagggtacacagtgttatgttgtattattggtaatgttaaccttcatcacttgcttaaggtggcttctccagtatagagttattatttttccctttgaaattaataagcatcttgaaagagataactttaaaactaggcaatgaggcagatttaagatagcttacaaataggttcaaaaggcctatcaacaataaaaatgttattgactttttccaaactatgaatgccataacaatgttatattacatggttatagacaggtgatagtgattgtcaaagaaatacagttctaataccatgaaactgattttttaaaataacattagaatatatatctattttaaaagaaatatatgctcattgtgaaaaactggagaagtataaaagtcatccatatttcttttttttttttttattttctgtttgcgatggagtctcactcactctgtcactcaggctggagtgcagtggcatgatctcggctcactgcaacctctgcctcctgggttcaggcgattctcctgcctcagcctcccgagtagctggggttacaggtgtgtgccaccacgcccataaaagccatccatatttctacccagaaaaaaagtcagtcctgtttcattgtacagccatgacttagcaatttctccaatatttacgaaagtctgttattataaataatgttgtttaaattatctttctgcacaaatctttgtctggatttctgataattttcttagggcagttttcctaaggctgtaattcctaggtcaagggataatactattttacggctcttgttgtttactgccaaattgctttctggaaagtttaaatcagttcatccacccagaagtagaacatattacctatctcactgtaaccatggataagatcttaacttttaaaataaatgactggtcagtgaacatttgttgagtgcccactgtgagcagagcatcctactaccattaaacgttacttgttttcacaatttattttaggtcaacctagtttttccagggcttgggagcaatatgaaaagcaaggctgaccttagaaagaactcactaaaacaccagtgattgctttctgaaaggaatggcatctggaggaagcctcagcctggcacttgaagaagtaaagcacatgtccactgctgagctgttttaaactgggtagaataagagcaatcaagagcacaggggggaaagctgtgtaggctgatgggggtggaagggattatctaataggtctttgtggcctctcagttcgagtagtcagacacttcagtcatgctgttccaaggcttttgcagttcctgcatcagtgctgtttctcagaataaatacattagttatttcacttatgaagctcattttctgcatgaggatggataatagtactacatcctgtgaggactattttcatcttcctcttatgtcagatattctttttctttatcagtggtagtaaggcagtggtgactttccatatgtttatcagaaaataagacacacaattcacaacaggataagacacaattactgaacatgttcaaccttaaaaatattatctaaccaaagaaatgcaaactaatcaatgtaatacctattaaaagtgtaaaaatattgaaaatgatgatactccctaaggctgagaagagtatgataaactggcctgctgctgatgatacagtaaacaagtatcatcagcaaaacaacccattttgaaagcaatttggcaatgtttcaagagtcagaaaaagacctgtgtcatttaactcagaaattatgctaagaatttattctaagaatataatacaaaagagtgaaaaaactctatgcttaaagatgctcattgcaatcttataatggtgaaaaatccaaaatagctgaaacatttaccagtatggggaggtggtcattacataaattatggtataggaactcaatggagtattatacacatcccaggactccaggcaatgtgttaattacaacaagcagaattacaaattaaatgtactttatggttgtataattaagtatggaaagggaccacgtcaggaggaacatggaaatatgaaattagttaatttgttaagatggtggaatagtgagtgatttctcttctatgttttgttattgaatgtttgtgcacttcaaaaacttcagagcatttctaaaatgactgcttaaacagagaaaccccacagtgcttatcacactggcttacattttccatgctgctttcacagtgcgtctcctctcaattatctccctccgcagcttcaccatctccctttgaatctcctcttcctctttcttggcctccagagccttccttttcttctcttcttgcaccagacactgagcctccaagaaggccgattttttcagggtcttttctattctctggtactccagttctttctcacgtcttaagcgattttcttttaccttaaagcaaatataataaagatgaagtgtggcctttcaagtagaaagggatatgaaaagccttacaatacattttgaagttcagaatacaaccagtttgaaatatgctggcccagaactccactgtttattggtaggaaaggaggaattcatctgtttactgggtaaagatgaatataacattttagatgaagtcagatgaagatgactcaaataatctgggaatgatccacatcacagaaaagttgagaatctaatgagtcagaccccaagttctggattctcatttaggaatgatttctcacttgtaagattgtccaaggtgtacattactgcttttattatacttaggtcatgtctgcattctaatttaagaaagaacagaacttttttggaagccacactgtgaatgatagaacagtgatttattgcctttaggaacaccacaaccctttattcatttctattattattatgtaaatatagcagtgattctggatcatatttggaaatcaaaaacatgaaaaagcacattcatttttttcaaacctattaatcctttagagggcttgagtagctatgagaaaggaaaggtcctttccttcctgcttcacctaactttacccttatcttactcactagttgtgataagtcttctgataagacaatgactatatagcttattgaacgttctctcctctcttttgtcataaatccaaactagaatcatacttctactcatttctctaacatccccagtgctgattacatataccttcattgaataatttaaagcagttattttcaaattcggcaatcagaaatttagtgttatacaaagatggcacacacatgtacagatattaattccggatcagtcttagttctggattctctggcactcctttacaaagtgttgagacaccagtcttttttgcaagaacctactattccctttggagaaaagaaagttctcacatgcttttctaattcaaaacagctgaacttgattcaattcagatctgtcttccattttaaattataataaaaaaatgagtgaatttcagttgtctggaaaagaattatcctgtaacattctcaagaatattaataatattaacgttacaatttgaaaaccaaactcaagcacacacaatctacgtgtttataataggaagtaccacattcaaactaataaggtttatgtcaatactcttggtcaaaatcaattattcttttttttctttttggctatttcttaaataaattgtttcctaccctcagtttatgagaattatttttcttctgaagttcttatattttatttttattctccctaaccaaaccacagatggcaccctttttcataataaagcctatgtctttatttaagcttattaaatgtgttacacaaagactgcttcctgttatccattttaattttgtttttccctcccacctgcttatgtctcatctccatggtaagacgaggatccttctgctgcttcttgtcttggttttccttccttccaagatcttccatcattgcagaatctaccacatttttatggagcagatggtctataaatttttgaacggtggtactttcctcttcttcctccaaatagccacataaatctgggggaaacagaacaacaaaaaagggaatttttttaaaaaattaattttagtattatattcatatttacataaagaatcctagtacaataaaaatacaaagctgcgagtgttcaataaatagtaactgataatggcaactgattgagtatagccctcagcagttaccttcaactaagaataaaaaagctccacttaccaagaattgccctcacccaagtcactaaagagtccttcactgccaaatctaaaagatttcaatctaaacaaccttgagaacttcaatctaaacaatcttgagagctctactgctttcaaaaaaaagaaagaaagaaagaaaaaagctttattgtggtataattgacatataataaactgcaaatatttaaagtttacgataaatttcgacatatgcatatgctagtaaaaccatcaccacagtcaagataatgaacatatccatcagccccaaaagggtcctcatgctgatttgtaaactcttcctttcactcctccccttgccctccactgtgctccaagtaagcacagacctgctgccactatatattagttttcattttccagaattttatgtaaattagatcatacacttatatacactgtattttttctgacctagcttctttcactcagcacaattattttgagattcattcatgttgtgtgtatcaatagtttatcactttctgttgctgagcagtattccaccatatgaatacaccacaaattgtttattcattcatttgttgatagacatttgaattgtttccaggttttggctattgcaaataaaggtgttatgaacatctgtgtacagtcatccctccatatctctgggggattggttccaggacctcccgagaatatcaaaatccaaagatgttcaaaaatccatgatatcaaatggtgttgcatttgcctataaactatatccatccttatactctagatcatctctagattacttatgatacccaatacaatgtaaatgctatgttaatacttgttatatgtattgtttggggaataatgacaagaaaaaagctgtacatgtaagtacagatggaattattttttcccaaatatttttcatccatggttggttgagtccagaaatgcagaacccacaaaacataggctttcttttctgttgggaaaatgtgtaggagtggaacgattggatcatattatagctaaatgcttaccttttcaagaaactatcaaactgttgtccaaagtggttacacaactttacattcccaccagcagtgtagaagtattccaatttctccacatccttactaatactcagtatggtcagtctttcaaatttaagccattttaagatatgtagaggtaactcattgtagttttaattttcagttttctaatgactaatgttactgaacatcttccttgattatgttttgtagttgttccaaagatagtggggtaatgaagtctctaactacagtcatgtgtcaaataacaacatttccatcaacaatggactgcgtatatgaaggtggccccataagattataacggagctgaaaaactattgcctagtgatgttgtagtcatcataatgtcagagcacaatgcattactcatgtgtttgtggtgatgctggtataaacaaaacaactacactaacagtcgtataaaagtatagcacgtgtaccacattttctttatccagtttatcactgataggcacttgggttgattccatgtctttgctattgtgaagagtgtgtgctgcaatgaacatacacctgcatgtatctttataatagaatgatttctattcctttgggtatatacccagtaatggtatagctgggccaaatggtatttctgcttctagatcgttgaggaatactatgcagccataaaaaggaatgagatcatgtcctttgcagagacatggatggagctggaagccatcatcctcagcaaactaacgcaggaacagaaaaccaaacactgcatgttctcacttaaaagtgggagctgaatgatgagaacacatggacacgttgggaagaacaacacacactgaggcctgtcatgggtggcagggggaggaagagcatcaggagaataggatgctgggcttaatacctaggtgatgggttgatctgtgtagcaaaccaccatggcacatgtctacctatgtaacaaaccggtacatcctgcacatgtaccctggacttaaaataaaagttaaaataaaataaagcaccctcaaaaaatcttaagaatactatgcaaaaaaaagtgtagcacatacaattatatacaatacataatacttgataatgataataacaactatgttactggtttatgtatatactacacttttatcattatcttagagtctattcctacttattagaaaaaaaaattgggctgggcacagtggctcacacctgtaatcccaccactctgagaggccgaaatgggaggattgcttgagcccgggagttcgagaccagcctgagaagcaaagcaagaccctgtttcttttaaaagaggaaaaaaaaattagctgggtgtggtggcacacacctgtagtttcagctactagggaggctgaggctggaggatttcttgaacccaggagttcaaggctgcagtgagctatgatcaccactgcacaacagagggagatcctgtcttaaaacaaaacaaaacaaaaaaggttaactgtaaaatagccccaggcaggtcttttgggcgtatccagatgagggtaatattatcacaggagatgacagctaaatgcttgttattgcccctgaagaccttctagtgagacaagatgtggagaagatagtgatattgatgatcctggttctgtataggcctaggctaatgtgtgtgtttgtgtcttagttttttaacaagaaaaaaaaattaaaatttcagaaatagaaaaaagtatatagaatataaaaaaattttgagggtttgttttgacctaagtgttacaaaagagtcaaaatgttagaaaaaattcaaaatttacaaagtaaaaaagttggagtaagttaaagtcaatttattattgaagaaagaaaaatatgtttttataaattcagtgtaccctaagtatacagtgttttaagtctacagtagcgtattttaatatcctagggcttcacatttactcacaactcactcactgactaacccagagcagcttcctgccctgcaaactccatttatggtataccctgtacaggtgtcccattttttaccctttatatactgcatatgtactgtacctttttttgattggatatgtttagacacccaaatacttaccattgtgttccattgcctgtagtattaagtagcatgcagtacaggtttgtggcctaggagcaatagcctatctcacatagcttaggtgtgtagtaggctctatcatccaggtttgtgtaagtacactctataatgttcacacaatgacaaaatcacctaatgatgcattttgcaggacttatcctcttcattaagcaacacatgattgtattattgttgaattccatttctgtcttcaattttgtcaatttttgcttcatctaccttgggagtcttttgtcaggtgtatatatatttatagttgttatgtttttctgatggattgactcttttatcgttagaaaatgcactttttgtttctagtaacaattttttctttaaaagtctatttttgggaaaattaaaaatcaaagaaaaaaataaaaataaaaagtcttatttttatattaacatagtaactgtagctctcttttgcttactatttgcatggtatatctttttccatccttttcctttcaacctatttgtactttaaattgaacatatgtctcttgtagatagcatatgtatttttaatccattctgccaatctctgcatttggactggagtgtttaattaaatgcatttatatttaatgtaattcctgataaagcttacacttatcattttggtatttgttttctacatgtcttatgtaaatggcctttatcaagttgaagaatttctcttgcattactagtttgctgagaagcatttttcaggaatgtatgttagattttgttaagtgccttttctgtgtctattgagataatatgttaattaacatttttggtaaatatcctttttaatggttacataaatatttgttcaatatttcaattaaaaaaaaaaaactctaccagcatacgatgattgaggcctggcatggcactagatgatatcaaccaatctaagtaaagggatataattagatctattagtactatatcaaaagaagtaatagtttcattagattccatatatttgcttcagaacaaatatgaagtactgaagtaccacactttaataatgacattaataaactagaaaatgtccagaaggcagcaacgaggatgataagacctagaaaccatgtggtataaaaaaattgttgagagtactggtgctatttaatctggaaacatagaactatatgagtggtcaaatatggtaacaactcctacaaaaaataaaacgttcttgagagagaacatgttattttagttgtaccatagggtaaaacgttactgaagacaaaatcttaattctcctaactaacggaaacttctatgagaattagagcctcacagcagttgaatgggctctacccaaagtgtaggctcccaatcccggaaggtgttcaggcagaggatacatcactacaagttagggacactgtagaagatctctatctgggttggcgaggagggtagatcagactacctagtcttgaaggattcttctaattttacaagctgatagttttgtgatcctcaagctggggattttgcagagtcctaaacaaggagaatgatgtcaggtgaattcaccaagggtatctgagtcatgtatggggagctgccccactgttaccatgactatccctatgctcagggaaaaaatactcagacccttgagtgtattagataaatccttacacgtcagccatctaacttgtctgacgctggctctgtgcacagtagtggtttttctctcctctggaaaaaaaaactagaaaagtaataacctcccttataagtaataaattgtctgacactggctctgtgcacagtagtggtttttctctcctctggaaaaaaaaactagaaaagtaataacctcccttataagtaataactaacagataaataagaagcattttataaatataaaaatgacatatgagtacttaaatgtagtctgcatcaaacagtccaatgatatatgaggaagaggcactctgaaacagcattaattgctattctaatcataagcagaattataaatacagttggccctccctatctgcagatgccacattcttggattcaaccaactgcagttcaaaaatatttgaaaaaaattaaaaataacaatacaacaataaaaaataataaacattttaaaatacagtataacaactatttacatagaatttatactgtattaggtattgtaagttgtctagagatgatttaaagtatgcgagaggatacgcacaagactagaacatctgaggagtttggtatctgtgggggccagggggtcctggaactaattcctcacagttagttagggataactgtaatagaatattttaatttttaaaacaccatgaatttactgaagatatagcataagaaatttacatttaaccatgataaattaaaaccaataataaaaactaaaaaaaacacagaaaacttaaatatgtatcatttgttattcaaaacaattaaaagacttcttagacacattcattagatgttaaaacttagaacaatcaggtaagttcttaccatcaaacttgtcatatttcaaatggccattggcttccggcataatagtgacacttgacacagtgtttttagcatcaccttcttcctcacttgctaattcttgcttaagtttggtgtctaaccagtcattgaccagctcctgagctacaataaaacaaaaacatgttaagtatttcagttacttcagagattttctttattcactgttttcatttattcaataaatattaattgagtacctatcgtgtcaagtactgttctagatactggaatacaacagtgaacaaaactgaaaaaataagccctagcatcatgaaacttacattccaattggggaagagagacaataagtaaataagagaaaaggcagggacaggaagacatggaagatgggtgttgtagctttaaattgggaggtaaaagaaagcttcactgagaaaaagatatttgagcaaagaagggaagaaagatagagaagtgaggatctataaggtaatattattctctgcagagggaaagcaaatgcagaggtcctgtgcaggagtatctacagtgttggaaaaacagcaaggaggccagtgtggtcagagagaagtgaggaggagacagcaggagatgaggttggaggggtaatgtgcagatcaggtttaggggaatgtttagggcaatgattatcaaccaggtgcaatcttgccccccagtggacttatgccaatgtctagagccattttgtgttgtcataactggggaagcaatactactgtctagtaggtagaggccagggatgctgctaaacatttgcaattcacaggacagcccccacaaaaattctctagcccaaaatgtcaatagtcctgaggctgaaattcccttgcttacactcttgacacaattctagctactttggcttttactctgagtacaatgggaagccacaggagagatgtgagcacagaggtgatatattttaagagaatcactttgaccattaagttaaaataaactataggggataagcacggaggtagggaacaccaattgggaaacaagtataataatccaaaagagaggtgatggtggcctggatctgggagtggaggtattaacaatggtcagattacagaaaagaatgttttgaggtggagttgacatgacttgctaatggactggatataggacatgagagaaagaaatctatgagttttttggcttaagcaactgcaaggatgatgatgccatttactgagacggggaaggccaaggatagcagcaggcttgaggaggaagattaggagttcggtcccagacatgttaggtttgagatgtttaggagacatccaaatagggatgtcaaatatggtattggctacaatactctggatttcaggggagaggtccaagctgaagaaataaatgtggaagttttcagcacgcagactgtatttaaaatcatagaagtggatgaaattaccaaaggaggaaggtagacacagaggaggttcaaggactgagtgctgaggaactccaggatttagcggttgaagagagaaggtggaactaggaaagctgactaggccattgaggtaggaggaaaatcaaagagtgtgatatcctgaaagctaacctccatttggatttctttcttaatgctattaagaaaatttcctgaaattatttaggtatggggaaaatgcctgctttagcatagctttcatcattgttattactatcaaacagctcttttgtctattttctcattaccttcatcattatgatgatcattattgcatagttagttcttagggaatggggtgtttacattaaatgatgccaagaggcatttaatacagataaaataggaaaaaataaatcagagtaatataaacgaagtgttaaaagcatactagcaacaaatgccattggctttcaggggaaggtagagaaagggagaagatatttactgagtagcccttgcatataataattcaaacatttatgtgtatagtaatttatatgcaaaataattcacacctactaaataacattcattggtaaatggggatttactgtgaagtgccccccaaaaacaaataaaacttcccttggaggggttaaactgtagaaataccttgtgttagaccacatgagaagtatacaaactaccttaaagcacagattttcaaagtatgttcctcagaacactacttttgtagaatattagtatagtttatgataggagaaaaaaaatgatataaacctttgaaaaccatgttctatccattggtgttctatccatataccaaaccatgttcctaatgtgaatcactagtttctcaggataatatacagatttcaggataaaaagaggttcatggtctaggcagcatgggaaatgaggcaagtaaacatttcttttcaactgcaggacttctcaaaacccttaacaggctaaagtatattgggtatctctactggcagggtgggaggtggggtgggcaagatcagccaagccaatttcagaatcaatctcctttctctagctccagtactatcaaccactctaaaccactcaccattactgctcacccagaccaccaccaacagcctcccactggttgcccttttctctctttttctcccctataatccattcttcctatatttaatttattatttgtttatttattgagatggagtctcgctctgtcacccaggctggagtgcagtggcaagatcttggctcactgcaacctctgccttccgaattcaagtgattctcctgcttcagcctcccaagtagctgggattacaggcacccaccaccatgccctgctaaatccttcatatattttataaactgtcatattactcctctgcttaaaacccttcaattctatcctgtcatactcagagtaaaatctaaattctttccccaggcttggaaagccctatgtgacataccttctcctcactcccgccagcttctctctgtggggaagctccagccacatgggtcttcctgcagcacaccatgcctgtctgtacttcatgctccctttccatctgcctggatgcttcccccatcacattgttcaactgactccttgctccttgctgactcaggtctgaacttgaaggacttattactactggatcactgtaaaattttctttattcccacaagaaatgtatatttcatgaaagcaagggctttgtctctcttgttcataaccagtacttccagtgcctacaactgtacctagcacagagtatatgtgtgttgaataaatgaagaaataaatggaataactggagacatgagtcatccaaatggaagttggcttgtaggacatcacactcttgactttccatctaccacagtggcctccctttctcagtctcctttgttggtccttcctgattccttctatacctaaatggtagagttccccagggcatcagtaacgaaaataccaaattccagaagagtaaatgcttctgggacataggaaggttaaactgtttttagggtctctttatcaggaataaaactgatttatagactatagtcaaattatctgtataatatctgatcaaattaacatgctaccatctttgtcacaggactaatatcttacagcattcaccaattagctgttgtatcaaactacctctggatgtggttctaatttgggaaacaaaatgaggcttaagtatatccttacttgtaatattggagttaattccagagtaaaatagtttcaggggagtagaaagaaagggaaattaagaacaagagtaagaaaacttccattctctactttgaaatgcatcatgggttatgctttaagaattgttaacatcgcagcagaaaatgcattctcttaccttctgcatagatttcatcatgatcctctatttgctcagatgttttcaaatctgtgatttggccccagggacttctaggtaaatctgaatttctagtaaaaaatgcatttgacactgcaaactctgaggctttctccactctcttcaatataacagaaaaaaaaatccataaagatgacaacaaatttgttcagttagagaatttctctcctactcaagaaactgattttctaccacctactaagattcgttcatttttccatttttggagaaactcttgaggtttaaacatctacccccaaatattctgggaggtttcatatataatattaaattaattgcagtattttaccaagttctaacagatgttcacaattttgatatttgaataaaagttattaagatttagataacttttgtttagggcattagtgataggatcctgagacatggatattttactttaaataaaaaatattatattttattagttttcatgcccttaggacttgcatatgaatatgaaccagaggtagagtaaccacacttcagcaaattagtactcctgaaggaaatctcccatctcatattaggcaatcatatattaggttcaataaaattggaataaacagaatcactgaactgtagccatctagaatgttttaactcaacagcaagagtctagtaaaaacatgaccaaatttgcaggattgggggaagaaacagcagaagtggacaaactgccttagtgtttttatttacctgcacagaataaaaacgcttatattaggctgggtgcagtggctcatgcctgtaatcatagcactttggaaggccaaaatgggaggactgcctaagctcaggagtttgagaccagcctggggcacttagtgagactccaactctagttaaaaaataaaaaattagccgggtgtggttgtgcacacctataatcctagctacttcagaggctgaggcaggaggaatcgcttgagcccagagggttgggaccacagtgagctgtgttcatgccactgcactcctgcctgggtgacaaagtgagactgtctcaaaataaataaatttaattaaataaattttaaagctgggcacggtggctcatgctgtaatcccagcactttgggaggccgaggcgggtggatcacttgaggtcgggagttcaagaccagcctggccaacacggtgaaaccctgtatctactaaaaatacaaaaattagccgggtgtggtggcatgagcctgtaatctcagctacttgggcagctgaggcatgagaatcacttgaacccgggaggcagaggttgcagtgagctgagattgtgccactgtactccagctcgagtgacagagcgagactctgtctcaaaagaaaaaaaatgttaaaacttattttataacttaacccctaacttccccctcccagaaacctgctttctcccatgattgctgtgtttcttccaactcagatagtgacaactacattcctcaggatgaaaactttggcgtccttaatccaatctatctctctctttctcaccccacatataattgatcaggacatctgttgactctatttttaaaatatatacagaatctgacccctttccatcacctccattgctaccatgttggtccaaagcacaacaatttcctgacaggttttctggaatagcctctcaccacagcagtgaatgactcctttaaaatgaaagccacataatgtgtgtcacaactccactcaaaagccttcagtggctcctgatctcaatcagaattaatgtcaaagtccttataatgcgcttccaggtcctgccacgcagccctttgtgagctttccaagactctcgctaatcttccctttgctcgttctacttcagcctcacggacctccttgcttgttcctcctcaaatatgctcagtgtgttcccagcttagggcctttgtacttgcttatcctctgcctgaactgctctcctacagatacgcataggcatccttccctcacctcctgaagcctttgctcaaatgtcaccttcccagtaaggccttctttgactaccctatatgaaactgtaaacactctcctccagctctccttctccccgtcctctgctctgattgtctctatagtacttaccatcttatcgtatatttaatcacttattgtctccctcaggtagaatgttggcaggaattcttatcttcttctcaaggagaacctggcaccaagaacagtgcttggcactcaacaggtgtccaataaatatttgttaaaggaatgaatacatgaaaactttattcagaaaagctgtactttccgatatttatattgtcacctgacctattctgaaaatgacttttcctcctgccctttatggaaagactggtggaacctctgccaaaacttgccatgggcttttccatccaaattcttgtgcgtttcatacattagctttaagtcagacagaagcagaggaataaagctgaaaagtgaagggtaatttgaaaaagatgtagaaaacagaacatacaggcaaagacatgagccagaagaaaacatgatctcattagagttagagtcaagaaaatatcattcactccttatgaagtcacttggtagagacctattttcccatattatttctgatagcctctgatgcatgcaagtttatgttggtagcatacgtcatgtattagattcatggttggcacatggtctttcctttaggctcctaaattctgagacagaaagatgaattttgcatatactgtatgtgttcgtatatgcacatatgtaaataacgtacaaataaattgatcaactttagtgttttaaaaatccacaaacaaaaaattagcaacaaaaacagattcgtagacttgacttagttcctcaggccttgagtgaaagaaataattatgtgttatgtgtcatcctacctgagttggaatttgtacaggttcttaacagaggagggtagagaggttgggagagaagaggagaaagactgaaggataaagaaggatagaggctggtactgacaaggaaataaagacaaatgtttgcttggctttaacaaggcaagtgtttgggatatcacttaaaatgaagatttgaggagaaagaactactggatgatactaaggactatacataatctctatatttgtttgtgttaaaacattacatccttaatattttttttcaaaataaatatgtaagacataggagagagctaccctatatttaagtaaaacattttggcaatttaacaacttattctttcagcaagtcctgattgaaggctagctctgttcccagcactggagtgggcattaagtggaaacaaaagtaaaagtttctgttcttaaatagcttactttttttgtttgtttttggtttcctatatcatgtgtgcaataaacaactcaaggacagttctgaagcaatgcagggtgatttaagaaaaactgaacaccttcaaaagcgtatcatagtaactatgttatatataaacatattacttgtaaaggaactatctcagttattcccacgatcttataaatgctcaatatgtgttccttgtgtcccacagcagacatcaatcccatggtccactacagatcctttgtagcctagcaacatggatggcagagacagcagttacaatgtcatccttcatttcctcaaaaccagtggatacaaacatgagcttcttgacatactgcatgctcatatataataaatagttctgtgagtaataaatttttgaagctacccattcttttttaatcactttgtacaaaagcaaatgcttgaggctgtatctgtgtatataaatgccaaaataattctaggtgaaagagtagtacaagatgggattaggaggtggaggtaggtaagggggatttgtccacttagagaggcatctcaagttgagctacaagggaaggatctggattggcctctcagagaggaggagtattccaggctgagggatcaacgtgagtcaaagcaaaaggaacacctgtctgatggaggggaaggagactggcttgacgggagtcatggaggatcagtatagggactgctacagataaattgatattataggttgactgctagagggttgtcaatactcatctggaatttatagagtttcgtctgatggcacatagaataactgatgattggagagtagggaaatgatttgattaaaatgtttagaaagctcaatcaagttacagaatgccctggagtaagatgagtcagtccatctcatcaagatgaggataaattgtaaatcatggtggactgttgcattttgggtgagttgctgcaggactcacagttttacccaaccatctacctgattctaggtgatttcaatgtccctgaagatgaatcaccaacatctcagccttgaggtttggttgttcatctgtattccaacagctttcccctcaattccacttcagcaacctattgacatcgtgaccccgaaccatgtcacaaagcatggttcacaacattttccattgctcaaaccaaactgataaccccttctccaacatcaacctctgatccatctccctgtttcattctccctactcctatgacactgaagttggacctaaccaagtcttctagtcactgtacacctccctcttctaacttgagtccttgaaagggttccttcctttcctactcagtgtggatatgcagctactatcttactgcatcctcgaaccccttgttccttggctgttccagagaaaacctccaagtctggatcaatctgatctacctatttttagtaccataaaatattatgggccaggcatggtggctcacgcctgtaatcccagcactttgggaggctgagcccagtggattgcttgagcccaggagtttgagactagcctgggcaacatagtgaaaccccatctctatttaaaatatatatttaaaaattaattatggttaactgcttcagccatgtccccagtgccactgagaaatcttccttttctgttctgaagagaggcctttctcaatttttactatactccataccctttccatatattctccccttctttcacataaagaggtctcagctgattttgaaagggtggtccactcaagtggactttgaagtcttcggtccagaggttataactgtttagggtacacccagagttagcaatgaaataagaaaagaagacagagaagtgaacaaggaagtattagaagcagcaggaaaaaaacagttacaaaaagaccatggaggagaggatttctagaataaagcaatggtaactatgtcaatgtaacctgaaaaagtttgaggactatcaaaagactactggatttggtcaggaagtcatttatgacaacagtttctgtggaatggtaagaaattaggacgcaggagaataactgtggacacaagaggacaagaaaaatacaaaggcaaggagtccaggttatgtatccaaaacattagatatgaaaaagaaatcgttcaggaatcagaatagattacaggatcaaataaagacttattggtttttttcaagacagatttgatgacataatggagacagagccaatgcagaaatgttagaggaatgataaaagatgataaaaattgagtcaagctggctgaaaactatatgaaaacggacaatgtcacagacaaatcagagcaaaattttatcttcctgttttagttaaatctttgcctctgaagagatggtaactaactgtgtgactaagccctgcagggacttggcactgggactctcaacactcacatgcaagctagtcttactagatagaggagtggccttcctagagactagcattcatgatggtagatccactttagtcgtcatctaagttaggctttctgcagtagccaggaagcttcccctgactccatttaaattagtgcctctcaccacatacttccattacatctttaattctctcatgagctttagtaagttgtttattctccactggactgtaaaccctgggagggcagggactgtacctgctctgttttagctccaacacccaacacagtgggctagtacttagtaggcactcaaataccagctgaataaataaatgcttaaaaattattacatctggcctaggatctattatatctatctgggatctggtgctcatgatgcatgtcaatttagatgagtaatcactcttcaaaatactgtcagaatggtcttttcccgggaaaatgctgcatgattttgaaacatgtggtacacgatgaattgaatatggcaagttgctaaactgacacgcagaagcacacacctgaaatgatttaatggcactttcaaattaaatggtactcagactcaaaaatacatatctcaggcctggaagagatgtcagaggttatctaacacaatctccccttcactgaatcctcaaacatattgttcattagcctaacattaagtgaccagttagagtccattaaaatagcttcagtggtagaaaacacatctctataagaacacccagtccacttttggatggactagtcattagaaaattcttatttgtgatgcacacgtagttttcacccattagtccctaggtcattgtaactacagtgcagtctttccaacatctgaggaaggccaccatatcctctcccaaggcttcttttcacaactcctttaatcctcttcatgtgatactcatggcatttgaaacgaagtctacacacctgttttcttgtcattcctacttaaatggtatcatgagaggcaacagaattatgaaaaaaaatactaaaaagtataaaattaaggcaacttacatagtcacacgggaataaaaatagcagagtatgtgcaaagtggagatctattcatatttcttttccatctgattatgcttgactcttaatactctttttattctaaatttgaaatatccttacctttatccagtgttccacactgtcaggaccaaaagtaggctgtagataacatatatatgatatcaatacgcagcaatatctttatcaactttgccatttaaatctatccttctgactaaagcatatggaacagtgtcctttattatttccccaaagcatttcattagaaagttcagcatgattagcaataaaagacacagaatagcagtatgaggagaaaacatgaagccttcctgggacactgattgtttttatttcttgtctaggtccaccttgatattgtgatttaattggtctgggataggaccctggcactgctatttttttaaacctccttagggttaagagtcaagatatagaaatgctaaatataaagctactcattaaaaaaaaaaagcactgattaattagccagattatccaagtaatctttagcttaaagaagggtgtgttcctctccttactcctttcataagtagcctgtagcaagaggctttctcatcttacccagatcagggatcttgtttggcccaataaaaactgaaggttaaaaaatctgacttctactgttttacaaagcagaaaatataaatttccacccagatcagtcaggtattaatctgaaattagaagtaaaaccatcagggcatttcctttcttcactctctgtaactcctagaagcttggagaattccctctaatagtcacttaacaaatagagttatcttctttgccaaaaatgcaggtgtgttttggccgggagcagtggctcatgcctgtaatcccagcactttgggaggccaaggcgggcagatcacaaggtcaagagatcaagaccatcctggctaatacggtgaaaccccgtctctactaaaaaaaaaatacaaaaaattaaccaggcgtggtggcgggtgcctgtagtcccagctactcaggaggctgaggcaggagaatggcgtgaacccgagaggcggagcttgcagtgagccgagattgcaccactgcgctccagcctgggcgacagagcgagactctgtctcaaaaacaaacaaacaaacaaacaacaacaacaacaaaaactggggaatggggcgagggttaatcaatctgacttttactgttttacaaagcagaaaatataaatttccacccagatcagtcaggtattaatctgaaattagaagtaaaactatcaggacatttcctttcttcaacctctgaaactcccagaagcttgcagaattccctctaatagtcacttaacaaatagagttatcttcttcactaaaaattcaggtgtgtttttaaaataaggggatatcctgatgatttgtcattggagcactaaatctcttttggtttggcgttcccagttcatgaattgcttcttactcaaatatactctttaaaataataataataataataataataaaataaggggatatctaaactagcatactgacacatggaggtgggaaaaatataatactctttcacttacctaacactttaccttcaaagcatcttactgataactaacgcagctgtactgcttaataattttgtcactgcaacaaagaaagagctgatctaattaaaatacaactgaacttgaagaagccctatgtttttacctttttttctctaggcagtaataatgagcactagcagcaaaaatccttccttttggagtcctaagaaattattctaaatttttacctttcatcatcaagtccatatctatatcctatcttggatccaatacattatgcaactgatgtattgaaatagcagcagcctcagtttccaagtctccctgatgcttcagtctgtgccctctagtatctagggcaacatatttgtcatgtggaatatgtccaatgcatttagctggtaaatttagaataaatcgcaagaacaatcgcctggggccctcaaaaaggccacatacatctacagaatattatttaggaaagtataacttaagggtgaaaacagctggtgaaactgctctgtagctgaaagctgagaagcttctccattttagtactctcatttagattttaagcatctttttggggactgttaaaaaggtagtctgtggaaagcacacggtgcaactgtgactttgcacatgtcacatatgtttcaagtttaaaatggggttattatttttttcttatcttcaggtgctaatgcatccaaatgggtgatagatacggagagaatctattttttgaaagttggttgaatttagaaattactatgtgaatcaagtattaatgtattcaatatccatttgcactcctgagtttatttagatactttacgtaaaagtgaaggggcaggaatataggcagggtatttaatgtgaagctctctcccgttaataaagatcaattaccccaagatttgcaaaaaaaaaaaaagagagagaaaaagaaagaaatgtgcgagaagtttcctaaaatttaaggtagggggaacggagtttgcaaactcctttcaccccgatgggcattagcagacacctccggttttagaaaagcgttacaaacagttcttccacgatgctgcccaccaaagccgtaatgtgcccagaccccagagctcctagagcatttcactcagggtaatgctggctttggggcggtcaaggcaggggcgtgtcagctcaggatgaagaggcaggaagcacagacgggccgcgactggcttcctgactgcgccgcgccttgggaaagtccccgccctccaaagctctcgattgggatcaccttgggactcggcttccttgtgaaccgtttccagcgattcagccccatccttttctttgagaaggaccttccctgaggcgccaggagcattttccaagttcgagcccgaacctcggccaaagctgcagcaaccgcccttctgcccgggctgcctccgggtcacgctgggaattgtagttcctccgcccgcaaggaaagcaggcataggacaccgtcgaaccaccactcccacgaggctctgcgcaggccgctcgcgttggctcagttaccatagcaacggcagaggtccctcgctcttgccgtcatcaaggctcgcttgaatgtcggctttgctttttttctggcgcccagtgatgacgcagtactccctgattggctctgcactggaggcagtgattttggggcagagaattttgcaacacgtggtagtgaactgtgaggagtttgaggggtctgaagactgaaagagtcgaatggtttgttggcaggtaagtgcccctttgccctgctggtgtgggagctgctagagatggatgagtcacgtcgcgtccagacgcttcctggttgtgttgcagtaacggtgattgtactcccgccatgtctcctctgcttcccttttcagggtgtcctggtggattggtttctgtaagttcagattctcataaatcgtgtgagcgtcgccgacacctctgagataaaagggcccctttcgactagcctctgctgaaaggtagagttttcaggaagtttttattccgaactgcccatgggagggtgggaccgtcttcaatctctgagccaggtgcctagggaggtctggggccatggagatggcccatggagcaaagataaatccaggcttattggcttagccgaggtgtttccagagacagcccatttaggggtgataaatgggcttataaagcagagtaaagatttagaacaggagttttgaattcaactactttgtggctatatgaccctaggcaacttgtttaataactcagagaccctgttttctcatgcaaaatggggacgataatacctgaatcactggagtgttgtaatgattaaaaataaatgtatgtgaagcattctgccaggaaatgtaaactaaagttgatttgaaattggtgaaaatgaagttagggaagctatgccctcggactgttgcagcgatcctaggaccagctctgtaactggtctgtctgaaaggcggttgaataaattgtgctcatacaaactatgcagtaccacgaagtagtttttttcaaaagggtaagttagctttatgtctcttcttcaggaaagacgtctaatgtttattcttgagagaaaagcaaattgcagagaagtgcatatattatagtataatatgtttccatttttgtaaaagcaaaccctgaccaaaacactccctcccatatgcaagtatgtttaaatatttgtatgagaatggagaaagattgcagagactgggaggatggattagaggcgggagggagaaagggaaaagaagaagaacactatagcaaaatggaaactaagattataatgtgcttgtgtaccagatggaacttctaataagctcccagcctattagagtacagcgctgaaaactagacttcaataattaaagtccttgctctgccacttaccagctggggattttatcagcctcagtttatcatacataaaatgcagataataatggtatctatattatgcatttgatctgaggattaatggagtgaatatataaagaacagtgcttaatacatagtaaatacccgataaatgttagttgctattattgtctttctatatgtgaaattaatttaacttttattgtgattactgacatttggaattctaccatcttattttgtgttttctatttcttttttttggtctcttttcctttcttgccttttattaggttaattcatttttctttatcttcccacttccctctccagtgagtttggaaattatgcattctgtcattaatcgtttaacagttacttctgaatttttaacacacatactcaacaaagtttaacgtcgtcgttatctctttccccctaccaaatggtgtaacgatttccgaatgccttggaaaaatcttcatttactgttttctagaattgtagcgttcttcatttcttttttttgagacggcatcttgctttgttacccaggctggactgcagtggcatgattttggctcactgcaacctctgcctcctgggttcaagtgattctcctgtctcagcctccggagtagctggtattacaggcatgtgctgctacacctggctgatttttgtgtttttagtagagacggtttcaccatgttggcctggctggtctcgaactcctgaccttaggtgttcctcccacttcggactcccagagtgctgggattacaggcgtgagccaccgtgcccggccagcgttcttcatttctgtgtgtcatttctgagtcagctcaatgcaccacattgtttaaaagtccttcagtcatttttctatgcatatactatgattatagaaagtgtacatgtgtgggagagaggggtaagagatgctgatgtgtacttatatatacagctttcctttcacaaaaaatatgaccatcttttgccttaggaaattttggacatttccatggcagtatgtagagaatccagctaggaaacatttaaaaatccattctctcctgataaatgaagagtggaggtggtgggtcgcactggaagtgttaggacaggtacggtgttgccagaagtgcagggaatctttgttagtccttgtaaaggtacagatccactgacagcctgtcatttgtctttacactcttaagggtttttccttaagactttctcaggaatgccatctgtgacaccagaaatattagagcagacccacaacaagtgaaaagggaagggatcatgataaaggcaaataaaaactagttagtattttggagactgttgatctgtttcttgaactttccttggcaaaaaaggaaataatcactctcaaagcatgtttttaaaaatatgtacatgaatatgtgtatgtgtgtgtactattttattacttcatagtaacaatttattgtatttgagcctctagaaaagaagtgtaattataaaaaacatttaccataacctgaacaatgaatgaagaaaggaagacttggttcttctagctctggacaaaattccatttttttaaaaaaaatattgatttccagctgaagtatagtacatctctgatgttttcctcagattttaaaatatttgcattcatccccacaaaacagaatcactgaccatggcagtttattttaatactttttcttaaacccagtcatctgcttttgcttccttatttttctcttcgttaatatgttgagttactgtgattagggtggaacttttatgaagccccaaacaacagaagtgagtatgtagcaccaaaatcgttcactgtagagaaagccaagtaggtatttctctccagctggctgagtgggttcagtattctaagctgaggattttgaatttcatctttaaagttatttgggattaaagcattatatcacaggagagcccatctctgcctctaagaacatggtggccaatgtcctttagagttacaaaggacctctaattacagactttcagttaagaatcaagaaagttgtttcttcagttgaggaaagagtgggaaggggagatgagagggaaggggagatgagaaagaagagagaagatgccttcaggactgagtggatgattaatcacacttgagactcgtttgttaaaagatgggaacttctagaatatgttcattctttccttacacaaggatgaaactaagaagtctttgagagaaaggtaagtcttggaagccaatggtctgggcttccaggtctggctgcctttatactcttagagaatccttgtgtccaaccttggagaatctgagattggttgtttggtcatcttcgcttatctgtggggaatatgttccaagaccccttgtggatgctggaaactgcaaatggttccaaaccccagatagataggtaggtaggtaggtaggtaggtagatagatagatagatagatagatagatagatagatagatagatagataagatagattagatagatagattagatagatccaaaccctaaatagatagacagacaatagacagacagtatgatgtttcctatctatacatacctataataaagtttaatttattaattaggcacagtagtagatgttagtcacctcggcaaacagtcttttttcttttcctagttggagaactttaaccttttctcataagggatcactttatggcttccctttggcatatccgtattgccagcatcacaactcttgtgctgtggggccagtcgtaagtaaaataagggtaacttgaacataagcactgcaatacagtgacggttgatctgatcaatgtgacagctcctaagtaactaaggggcgagtggcgtctacagtgtgaagatgctgggcaaagggatgattcacgtcctgggtggaacagagcaaaatggtgagagatttcattatgctactcagaatggcatgcaatttcaaacttatgtttatttcaggaattttccgtttaatatgtttggacctcggatgtccatgggtaactgaaactggaaagcagaactgtgaatgggggtactgtgttaagaaaaccgatgggtttccttttagttgcctttatgtaccttcttcttcccattctgattctatgcttgcatggcatatttggcttcatgtattgcattctatagggcaaacatgccactgactgatccactttgcttttttcgattctcagagtaaataattgtgcatactgattttattgtttagtctctgaggttgataggtttgagcctgaccctgagtgatggctctgtgctgggtatatagaaaagatcaggctcagcttaccaggcagaagcctaaatcccttaccagtggccagccagccctccaagcagtacaagactgtaaggcactggagggagcagcagcaggtggctaatctttgagcccctgtgtaattctgttggcacaggttaaagaacttgacagctgctttcttttatctcttttctttctctttcttttcttcttctttgtttttaagacaggatctccctctgttgcccaggctggagtgccagtggcgtgatcatggctcactgcagtctctgcctccctggcttaagggatcttcctacctcagattcccaagtagctaggactacaggtgcatgccaccattcctggctagtttttgtattttttgtagagacagggtttcattgtgttgcccaggctgctcttgaactcctgggctcaagcgatctgcccaccttggcctcccaaactgctggaattacaggcgtgagccaatgtgcccaaccaaagccactttctttttatgactttccacagtgtgttctaggggaaaaaaacaaaaagatgtttcatagatttcacatatacttttgaaaaatcttgttattttcagtggccatggtatgctgcaggatattctaaaaaaaaaaaaaaaaaaatctgaatgcatctcctagcatgttaaatttactctcacataaaagccataattggatgggtgcagtggctcacgcctgtaatcccaacactttgggaggtcaaggcaggaggatcacttgagcgcaggagtttgagaccagcctgggcaacgtagtgagactccatctctccaaaaaaagttttttaattagttaggtgcagtggttgggcacctgtggtctcagctacttaggaggctgaggtgggaaggttacttgagcctgggatgtcaaggctacagtaagccgtgattacaccactgcactccagcctgggcaatagagtgagaccttgtctcaaaaaaaaaaaaaaaaaaaaaaagaataaaaagaatacaggccttttgcaggaggcccaggttctagacaagcctatgactaagcaggcctagtctcagactgattacaataaaatggcagaaggggtgatgtggtgatgaggaattcccaggtaggggtctctggtagtaatggaactctataaactattttcagtatttctaaagtctaatggtaattatacaatactgggatattaagcacagttttactaaagcaatggggtttgttgtttttacctggaattcagttaacacaacatggaaaagcagattatctcatgcttgtcagaagctttggttgtcagtcatttgtgtcatttattaataaactggagaaacgagagcataaatttgatgaggagagataataaaagtaacattctagaatcctatacttcatttttcaaacgtattagttttacccaatgaaggttcttcgtgcctttatatgaatttaatttaaaaaacactgttcatgtgtgtacatttaaactctttacatactttacacagctcagatgagagagtatttttggagtaagatagaatttttggaggagccagcaagttcttgtctctagccctttctgaaatagcttcgggcaacacagtttcttccgttctcagacgtatgtgatagtaggaaatgcgtaagttactgcagcatttaaaaattctggtccgtttaattttcattagttcttatttgtgtttcaagaaatctagtgttccatattggttgatttcaatattcagtcagaacaacaggtattgattcatgaagctttgaagtacatttctcatctttgtgcttccccctgcttcaattctccagagctacttagattacaaaagtctgtcttaaatttcacattagaactctgttggtttaaaatataaaatacatttttatcacttgaaatcagtattatctgataaataaataaagattacaattcttttatattttctacagtatgcttttattagcttataagtatagttttacagttttcttaaatgaaccttcttgttttagcagttttaatgtgtaacaatagggtatgtaaaaaaatagcttttatactatttattaaaatataacctttttttccttaccagtctccatttatgtgggttctaatgacacttatttgtatgtttctatcttagtgataacttgaaataatgatctcatagttatagaaaattgaccaggctttcatcaaacacttatattagtttttataatttgtgtttagcataaaatctcttcttagaccatatagaaagtagttattctttttttttaagaaagtagttattcttatgtctaagattctaatgacaaagatggctattttatttaaatttaagaatttatgtctcctaaaaaaaagtaatgtttttattcttgaatatatttaactaatgatagatatgtcttatttatttggtgacattttaacaatggttgactttcagagtatggtatgctataatgcttaagaaaatgggatctggccgggcacagtggctcatgcttgttacctcagcactttgggaggctgaggtgggcggatcacctgaggtcaggagttcgagaccagcctggccaacatggtgaaaccccatttctactacaaatacaaaagtcatctgggcatggcggcacacacctgtaatctcaactacttgggaggctgaggcaggagaatctcttgaacccgagaagcagaggttacagtgagctgagatcgcttcactgcactccagcctgggtgacagagcgagattctgtgtccaaaaaaaaatgaaagagagaaaagaaaagaaaattggatcctctctgatagctcatttgtcaactaataaaactgggcctggcccagtttttaagaattccagaagatatggtacttgctgtagagatgtaatgaagtatttgtaaaatgttggtatgtctggtgacatttagccgatgatgtgtgtgcttatcaagttctgtagtgcattttaaaagtggaacccagtattttgcttcactgaatactaaatcatttaggagcacccaacaagtaattgataatgttttctgattttttttccctgtatatctatagaagttagaaagtgtatctttatttttttctttaaacacatattagtctttcccagttataaaagtaatgacactttgcttatggattgcgtgtatgctccacacagtttctcacttctgtttggataccatataagaacaaattgggaaataatccgacctcagagatctgtttatgttttgacatttatttttccatatattttcataaacaccaggatgctcttttcttcacttaacagcattattaggaaaaaattgctatattgcttagccttccctcaaattggagaaagaaaaaagtggattatatcaataatcagtatggcctaagcagtgttactgttctctgtatacattttcaaggctgagagagccttggcttcatggcattctttccatgattagtctttctaattctgttctttcatttgtttggttttcatcagctcagacaaaaattccatgactaaatttaaaattagttgatgccaatatgtggttctgggaccttagggaagatgtcttattctctttatgtcttttcccattcccccgttcctgatatctatgaaaatatttagactggaagcagtaataagcatgctatcattcattttcctgaagattttttttttttgcaaaatgcttggcctctaggtgttgtgaagctccttctatacttaatgctcttttcttgacaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctgtaagtgttagaaccaatgattcaagtatcaactgtggcagcagcttagttaccttaggtgcaaaaaagagaaatatttttttttgttcatatatataaattgtcgattttcataatgaaatcagaagagaggtttcaaatattatacatcttctggccctaatctggaagccacaggccagacctatatgttagatctgcttcacttttcctccaaacctacagtcccatactgccatgtcgccactgctcccaggggtgacagggcggggaatgttctgtgagagctgcatttggagttcaggagctgttatcatgcaccagcctcaaagttttttctgcctttgcacatatacttgctaatactactttatggaaacagaactaaagttagatcattttgtgtaatgtatatactgactttatacttaattgaaaagcctactatatgaccaattaacataatagtctgcagcgttgtgttaacaacagagattttaaaggggcaagagaaggaagaaaattcaagtattctgaaggagttgatctttgccagtttcatgtctcacagaaccactagcaagttgaaggccttcgttctggctaatgaacctagcctaattagttagaactcttgaataatggtgtaattcaagacagcatttaccatgatgtaacttatttgggtgaggagaagagggctccagttgtacagagtatttacagaatgacacattattatgttatgtatttttctgttttgcttacagagcagaacatcatgaagtcttgacagaatataaagaaggagttggaaagtttataggtaaaaattaagttacttatatgtgccttgtgatgtgttaatttggagtttggaggtgctgttacctctttgatctttcattcatatgtttgtttattcataaatttaataagtattatttgaacatctaagagccaggcattggcaagtcaagattgaataggaaacagttgctgctctcatggaatttggagcctagctgggataaagatagagaattctagtaaaaattgtggttactgctttacaggattagggatatgtatggatatcatgacaggccagagggcagagcatataacctgctctagggtatatgtgcaaggtggt

SEQ ID NO: 300 - DNA, 114619 bp, Homo sapiens
cctccagggtttctaatgaaactcccggctctcagccgggactgtcccctgtgtcctccaggaaagacactggcttcagggcccgttcccaccggagctgctgcatccgacacgctggtcggcttctgtgggttaagtttgggtttgtgggatcttcgaaggactgattatgcattcaggaaagagaaacttccagactgtccacgaggccccaggcccctgtcatttcctcctggcagcaccccaaccctggggcacggtgcatgagcgggccggccgtccacaccctgtgtgccccaggcttccctgcagctgggcttccaggtggccctgccaactggaagggaagctgttcggcctccacaccagtgaggctgcacccctagggacccagcggccccctcccatcagcagccctggcccctgtgcactgtgggcctccctgaggctgtcctgctgggctctcatctgtgtggggtagaagctccccttcttgggagcaccctgtggtcgtttcccaggctccatagcaaagtgcagtggaaggctgggtgcagtggctcacgcctgtaatcctaacaatttgagaggccgaggcgggtggatcacttgacatcaggagttcaagaccagcctgaccaacatggtgaaaccctgtctctactaaaaatacaaaaattaaccaggtatagtggtgagcacctgtaaacccagctacttgggaggctgaggcaggagaatcgcttgaacccaggaggcagagatggtggtgagctgagatcgcgacactgcactccagcctgagcaacagagtaagacgccgtcaaaaagaaaaaaaaagtacagcttaaagcacagaaatgtcttcccttgagatttagagacctgatgtccagaaccagtgttattggagccacgctgcctcaggaggctccaggggaggacccgtgtctcttcctgttcctggtggtgttggccttcccgcctgtgtggttgcgtcgctgcagcctctgctcccgtccccacacaccgtctcccctaggcctgtgtgtcttttcacaagggggccagtgtttggatgtagagaccagccaaatctgggaacttcattttaacatttgcaattacatctgcaaagacccaatttccaaatagtgttacattctggggttctgggggttgggactccagtgagtgatactgaggacacacggtaacccataacacagcctcctcacttccttcacctccagcacaactgtgttagtcaggggtctccagagagacagagccaacatgacacagagagagaagtgagcagggtctgttaggggaaccagatgatggaggctgggaagtcccacaacaggctgtctgcaggctggacaacaccggatgccggtagtgtggctcagtccacgtcagaaggcatcagaacccgggaagctgatggcgcgactcagcccgaggccacaggcgtgagacccggggctgccagtgcgagtcctagagcccaaaggctggggcgcctgcagttctgtctgagggcaggagaggaagcgtgcatcccagctgccgtggggagagacacattccccttttctgtttctgttctctccagaccccagctggaaggtgccacccacactgagggcaggtcatcttcacctccgccactcggacacacactgcagtctcctctggaaacacctgcacagaggcagccaaaaatcatgctctgcaggtcaccaggagctccccagccagtcccattggccctgggagtgtcccagccccctcatgtccggtcccattggcacgagagcatcccagccccctcgtgtccagtcccgttggcactgagagtgtcccagccccctcgtgtccgcgatggccgcacagcccttccgacatttgtgtacctgtccccacgttaaatgcctctctgcctgaatacagacatgtttttgtttccccaaactgatgctgtcacgttgcagccagaggccaaatccataggatgcaagtaacagaacatccaacaaagagcagctcaaactgtacggacagctacttcccggatgaaatgtctggaggtagctggtccaggccgccagctccccattctgttgtctctgtctttctgccccactgtgtcagcacgttggctcttcctcctggagctcgctgcctcatgagtgcaaaaaggctgccacagctctagggagcatatgctcacagggcagcattcaaagccaggagtggggcgagtgggcaggatgaaaaacggatgacatctttgtgtgtccttctctcttcatcacagaggggcatcttccccagacgcccttgcagacattgccttatacctcacaggcctggctcacccatcccctggtctcacatggggaaacacagtcacccaggctccagccgggcatgactcctccctggggtggatgggagccctgcagctgacctgcagagctgagaagaatgtgagcgctcacggccgcagacactgagatttgccatcgctgggacacagcaatgactgacagatgcgcccagacctaactgggacctaacctggaaataaccggaacataacaggacctaacccggacataacccagaaataaccggaacctaacccggacataacccggacataacccggacctaaccgggacctaacgcgacataacccggacctaaccgggacctaacctggacgtaaccaggacgtaacctggatgtaacccggacataaccaggacctaacctggacataacctggaaataaccgggacctaacccggacacaacctggacataaccgggacctaactgggacataacccggacataaccgggacctaaccagacataacccagaaataaccggaacctaacccggacctaacccggacataaccgggacctaaccaggacataaccggaacacaaccgggacataacctggacataaccaggacgtaaaccggacataaccgggacataaccgggacctgctgggcatgggaggtgggaacagctcgggcccaagaaccaacagtgtggcacaagtagcagaaaggtgtccagagagctgcccgggcctcagagacttgtgtggggcagccgggacacgatgtccagagagctgcgtggggtggccgggacactgcggggaggtgggtaggtggggtgcagactcgagccccggtgctggtccagtgaggcaggtgggcctcaggtggggacctggccccctacggtgtccgttcccatctagttttagggcccgcctctgcctcctcagtctgtggtctcggtagaccgaggcctgtcagtcacagcttcacacccccgagctgcagggacttggcggcctgaagatcccattcagagaggactcgggactttgctcagagcttcataaaattctatttttcctgtcgacattgaaccccttaactccccacttaaagctgaggctgctggaacccctgtccctgaatccagccctgcctgaagccagggcgtgtcgggaaccccagcgggtacggggtgctgcctgaatccagccctgcctgaagccggggcctgtcaggaaccccacggggtacggggtgctgcctgaatccagccctgcctgaagccggggcatgtcgggaaccccagcgggtacggggtgctgcctgaatccagccctgcctgaagccagggcgtgtcgggaaccccagcgggtacggggtgctgcctgaatccagccctgcctgaagccggggcctgtcaggaaccccacggggtacggggtgctgcctgaatccagccctgcctgaagccggagcctgtcgggaaccccacggggtgtgggctgctgcctgaatccagccctgcctgaagccggggcctgtcgggaaccccacaggtacgggctgctttgggtttgcatttctgccactttcaagggaaagagcccaagctaatcccggctgcttgtccctggcctctcctccttcccacagcctgaccccacaccaggctgggcaccccactgcaaggggcagactcgggggccagggcctggcacaaggaccctcctcccaacctgcaacgtccctttctggtgtgagcacctgtgcaagcttgtgcactctcacactgcacacggagcatggccagctgaaacactctccaaggagagccagggagtggctgccaggagagaaaggtaagtgtggtaacggggagagccaggcgcatgggagctcacggacatcatgacggtgacatagcgtcctgaggaactgactgggagactccagtgctcctgacacagactgggaggggcagtggcaggaggtggctggagcccacggtgctgcaggcctggaacggcccaagcccgctgaggtgcggggacagggggtctgcagcagtcacacgacggcaggagtgtaacctggctgctccgtgtggctccctctgccttctgcattccactcctgctttccaacatgcctgctggttttctgtggtcagccctaacccagagccatctggcgatgaaaattctaagaaattctctgctgctcagcagggcccacctcacgcaaagccaccatcagcctcaggaaggagtggcattgggttagggcttgggggagagggagggtccaggggaaaggacggcaggtctcaagcccctgcggagggaacacgcctgctcccctgggtgaacagggagggggcggcccgcagagctgcagcaggctcggaaccaggcaacagcacatcctcaggagcaggatgactggaagggggcacgttgaggactccaaacactcaattgccttgacatgtggctcaaggcacattctaactgcaatgccaggaagaggccacctgactggtgtcacctgggtcacctgcatgacaaactgagccatcacaccccaccagagcagaaagcacgacttctctgccccgtggaggctggtcctagccttgaaacttccttgacagacacaacatgaggcttcaagcacgggcttctcctaggtttatatggctctgctcagcctcctgagccactgagggagaatgaacgcctgcatcccacagaaagaggccagtggattatagctgggcctaaccaaagtccaaatgaagaagcaaagcccctcttgtcaccctgcaaccctgtgagcaaggcattgtcactgagggcccaggggctgtttgttacacagcgttctccaagcaagagctgactgacgttcctttgttccttttctaggggagcatggggccttaggacctgctgtgtcaccagacggcacccacaagagcagactatgcatccaaaatacactgaggtgccattacgggaaggaagaggggtgcatgcggagggctggagctgacagccggctcacagatggggctgggggctgcaagaaatggaacatactttctactttttggctgtcaccccacaggcaagtttgaaacccaaagggcaaatggcttagctgatttatagagcctaatttggatccgttgccccaaattgaattttgaatacaatttcacatcaattaactttgcacagagccttacagatggcagggaaggactctctaaagcaaaggccagtggctacgatggaggagctgatgtgccatcccggagcccaccgatgctcatagcaccactcagggctctgacccgggcgggttggaaggatgagagctaaggggtgtgacgtgagcaggaaagggacccgggctggttggaaggatgagagctaaggggtgtggcgtgagcaggaaagggacctgggctggtggtggggccagagagctgagccctaggggctgggaaggagttgtgggcaggagctgtgggcctccagcagagtggagagaaaaggggttttgctggcaagagctggggaagagggtggggaggggctggagggcttgatgagcacccacctacggccctgattgtaccagggccctgactgtggtgcattcaaacccatggttcccagagtgtggtccccgaccagccccagagaacctcagacgtgaggggtggggaaccctggggtgggctcagctgtgtgtgctcacacctccctcccgtcgtgggtctgaggcctccattgactcacacaccgattcacacacacccaggggctttcacacccccgacggcgggacgcctcatcgccacgccacccccactttatagacgggacgatggaagcacgttaaatcatttgcccaaaatattctaagtgggtggcacagctgaggctggggcccaggcgagccggtctagaacttccctgtccagcatggtagccaccagccccacaggctattatattttagattaaagtctgtaagtaaaatgtataatccagttcttcagctgcacttgccacactgcagaggcttgagccactcgtggctggcggccaccgtccggacaacccagccattccctccacttccgagctctgcaggccactggcctggaggtctcctaaccgctgcagtctctaccttccaaagcaccccatcctgcccggggcaagagagggcagatgtgtgagcacacaaactgaaaaaccaaacaagcacaggaggtccaacctgcaccacaccaagaagtcagtgggagtgtggggggtggggttcgtgctgcaagctctgcccagggccctggcaagccccagggaggttcggagtcctgggtgggatgtccggtcactgtgatgcgtgctcccggagacacacagcccggtccgcaagcaggcaagtacgcatctgtcagaaaccacccccagaaccacccccagaaccaccatccctcccaagggcttcccatccagcacgtagcccagctgctttcttctgtaagagaaggttcccaaagcaagccctccctggggagcacctgagcccagaactccagagacggcggctggtccctggggagcacctgagcccagaactccagcatcggcggctggtccctggggagcacttgagcccagaactccagagatggcggctggtccctggttggccatctggacacctggaaatggatcaaaggagagaaggcacctggggacgccttccccaggacagccagggaaacccgggggggagcccaaaaaggaagcccctgaggaggtctacagagcccctgcccttcactggggtcacacatctgaacatcttcggagatcagataaacaaacagtgtatgtctataatcagaaacttcaggctgggcacagtggttcacgcctgtaatcccagcactttggaaagctgaggcgggtagatcacctgaggtcaggagttcgagactagcttggccaacatggcgaaaccccatctctactaaaaatacaaaacattagtcagacatggtggcataggcctgtagtcctgggtactcgggaggctgagacaagagaatggcttgaacccgggagacggaggctgcagtgagccaagatcacgccactgcactccagtctgggtgacaaagtgagatctgtctcaaaaaaaaaaaaagaaaaagaaaaagagaaagaaacttcaaatccaaaacctcagaccttcccaagcaattcttctgggggggagggggtgcccacaggatgccccttgcagtctgactgacctctgggcccagcctagggtgggatggcctctgggagcctcggggaacaggtgaggactcccaggctacttgggaagaggcctgtatttaaacaagagcctcaaatgccacctgggtgaccctcgcccacatttcctggccttctgtccagggaggggaattcgggagcaggcgtgcatggagaaactactcggggtccgtttctgtcttcctaatgaggcttttaaaaatcaaaagggaggatgctggagggtgaaaccacggtttaacaaaacccggaatgggaagagggggagggggaccctgcccccaccctggggaggctttgacagggaaccagagagcgggctgggtggactggaggaggctgggtgaacaggaagtccccccaccccagtgagctactttcccaactgcctcagcccagcaaacagccagtggtgcctggaccacacccttcctgccctgcacaagaggccgccagtaggctctcccagaggcagggtaaagtggaccccgcagagtgggcgaggacccgttcccactaagggcaaccgagggcagggtcccaccactgtcttgggcaccctcccctccgccctccagcaaaccaccattcttctccgagggcctgtgcaggggtgtagccccgacctgaaacagggtgcccatgactgctggggctcggagtcgtcactcctcggggaggccctctggaccacccaatgcccactctctgtgacacctccccgttcgattttcttcagattatccttggctgatattctatttggccctgtgttcagggtctctctcccacttctaagagggtagtctatctcagccgctgcggggtcaccaacagagcctggacacaggaggcatctggcaaatacgcgctgcatgaatcaatgactccagtgcccacgcgcaaggggcccctgggctcagaaaaccccaccaggcgggcccctccgagctcggcctgtcctgggggtggaggaggaagttcgccccgcgcctgcctcgcaaccgcagccgcctccgtgcgcttcctgcccgcgccgccctccacactgcgctccgtgtctggcagcagcccccgcctcgctgggcgcgttcccgggggtctcggtggcgggagccgccttcttgtgggacttgggggcacgtggcgcggggcggggacgcggacagacccctcccgcatcctaggaggcctgggagggtccgcggggacgcggggagggggcaccgcctggccgaggaccctcccccggtcctccccgccccttccccgtcccttccacgctcgccgagggcaggacttcggttccgcgagaccggaggcccctcgtcctcctcggaagccgcccgcggccggggaccccagtcccgcagaggagggcggcgctgcccccgcctcccgcttggagagcgccgcccgcaggtgcccacggaggggccgcggcatcccagcgccctcccaggaaggagccgagcggatcaccgccggctgcagcggaggtcggggcgccggggaggggcgcggctagggggcgaggtcgaagggcgggcacctgcgggtggggcggggcctgaattagcgggagcgcccgggaggggcggggccggggcctgcgtgagcgggtcggggagggggcggagcctgcggggggcggggcctgcgtgaatggggcggggaggggccggagccttgtgagcggggcgggccgcgtgtgcggggtgggggcggagccttatgagcggggcggggcaggggcgtggtcggggcggggcgcgcgggcgcccgcggcggccctcacttcctctggcgagcgcagccgggcggaagtgcgtcagttgttatctgttcggggcgccgccgccgcctcacgagcccggtgcccaggagcccggccgcctcccgcctgccgcctgccgcgcccgcccggccccgcccgctcggcccgatcgccgcgccgcgcgcatggggcgcgcccccgggggggcggccgagggccgctgagcgccgggcccgcccccgccgatgcgcccagccgcccgcgccgggggtcccaggccgcgccgggcccggggctgagccgccccccgcgcccggcatgcccggcccggcccgccgcccgccgccgcccagggcccgagcccgcgcggcgcacactcagcccggcggcgccgcgtagccgagggagcccgcctgctgcgagccaggcgcggggcgtcaaggtcaccggcccgacggggcgcacgcgcggccatggaggccaaggtccgcccgagccggcgctcgcgcgcgcagcgggaccgtggccggcgccgggaggccgcccgcgacgcccgcgcccagagtccgtcgtcgggcgacgagcccgagcccagccccggcaaggagaacgcgggcctccgcggcgcgcccccccgaggcgccgcccccgcgccccgcaccgcgcgtcccccgcgccgccgccgccgcgagtccagctcgcaggaggaggaggtcatcgacggcttcgccatcgccagcttcagcaccctggaggccctggaggtaggtggacgggtgcggcttcgcaggcgttgaggcgagaacggggcccggagttgacgcgtcgggcgatcccgggacccctgggcttgcgaccgcccgcgccgtgggcagccctgagggaagccccggccacttggtacccgttccagggaccctgggtgcccaccgctcgcccagaccgtcgcatctggaagacccagcagcgtcgggtgggtttggggacgttttaagttgcagaggcaaaaaaatctacgcttcgaaattgggggctgtctgacagcaccgtcggccttttatcagttgtgtttctgtggccagcatatcgctctgcctggttcaggacgtgctagggagcagtgctggatcttagggaggtggtgataaaatggatactccgcgggccatcccgttccctcctcccttcgagggctctgctgagaaggggagaaggagggttaatctcaagacccctcttggtgactgctgcctgctgcatggttaatagattggccaaaaatattgcttgtctggctgacggacagtatttgctgagcaaatactgctcctcttacatgaactcagctgagcagagaaggaaattaaatgctgtctgagagttggggcaggcgctgtctccccaggactggcatgggcaggaatgctagcaagttgccctgcaccagggccgagacccgcccagcgaggtgtgccccgtgcagcacttactttgggggaccctcatctgctggactttgactcccagaatcaccccatttccaacccctctcacttttccaggggcttgggagcccatggcctgggatcccccagtctcagaagctgagctttgggaaaaggggagatgcctactgcaggcccctgaagcagcaagtcctcttcaagttctcatccaaactctggggactgtagagagccttgggtcagggccggtggccagggaagtggccccagaacaggtgccgcatcgtgtcccgagtgcacagtcagagctggggcttcgtgtcccaagtgcacggacagagctggggctcctgtgggcccaggacggggtgggtggtggccaggctcatcacacaggctggccatcctctgtcctgcacattattagatggctccagggctggcacacgccattgctctgtgctgggacgggatggccctggggctgtcttctgccctctcagtggtgataatgacacagactgtacgtgtactgagcaatactgcaagccaggccctgcgctcggctcctgcactgcagctgagaccacgaggatgcccactttccagagctgtcgccacccacctgcacctcctgggtccctaaccgcggcttcctcactgctccgagcgggtcagcccttgtaccctgccgttctctgtctgctttatgtttggtgccattgtgtctttgcaaaaacgtcacctcagactcctctgaagtggtgccccccacccccgtcgacgttgcccaccttctttttgtcatccccactctgcaaagctgttttagaatgtctttgctctccattttcgtctcccacaagaacttgtaagctgaaagagagcagacactgtgctgtcctgtgtgtctcctatggggtctggtgccgggaagagctcgatgtgtagaaagtgccccagatgcgtgtgtcaggaatctgagtgaggagatgaactgtactcaggagatccagggccaatcccaggcccacgtgttttgcccgcagcggctctgactggctgtccacctgctctggcagggtcacgtgcccccagcctgcaggcagtgggttcagtgggttttggtgacttcggcttagaccagctggcccctcaggtcatagtgagacaagtctgctgctgcgtggcgttaacacagccacagcaccccagggtggtttcatgtcccttcctctgcccttcggagcctgcctgggaaagtacggggcttctgcacaagtcataacctcgtgatcatcccatacgtgtctcttggttgtctacattttttgccaaagtatggtggtttttccccaaagttcagataattcataattatatcaatagtagtgactggttcagtaagcattctctccatcaggcagtgttctgagctgcctttcacagacatcaactcatttactcctcaaatgacccacgaggagggctggatgcccccattccacagatggggaccttgaggctccccattgaggcagagcaagagcaaggagcactgggtgccacgcctgtccggccttagagtgagcgggcgctgccctgcgaggccacccacacgggacaccgagggagatgtggccaccaggacccagcccagaggcacagcctgcccttggctctgccgcctttgctcacagtccctctgcccccacccgcgtcttgagggctcttcctactctgggatgctggaggatgggacgctcaggagttggaggaagcccttgtaaccccagaggctggcttgtgcccgcgggacactgcagtggtataaacaaccaaacacaggtgtagacttgccggggaggtgcagcctgcctgcaggagtcctgttacctcaccccagaccccacacacactgggaccaactctcggccccagccctggcccctggggcagacccccactcgcagccccttctgaccccaggcagaccaccctctccgcctgtctgaacaggcaccccttgccctgtgcccggggcaggtctctgtacctgttttgtgcccccggcaggtccctgccccttttctgtgccctggatgggacacacaggctgttctgtgcccggggcaggcccccgccccctttgtgtaccctgggtgggacacataggccgttctgtgcccggggcaggcccccagcatctgcacatttatatgtgctcctgtaggggaggaggagtccccgcttgtcctgggcctgtgtgtgctgtgaacacagcaggcactccctaaatggtggtggtggtggttgtgggctgaggagggccagggtctggcctggctcagggtgtgcctgcagccctggagacagcattaatgattaactgcccatagagatgggagccctgtggcagggctgaggacctgcagaggggcgtgctgggctgggtgtgctggggtgggtggggcggcgcggcagacctgagccagcccccgcttgactttctactctgtaaccaggggccgtggtatgtggggacaggaggcctgaggaagccccgctggcctctcccctgctcttgttctgaccgggaactctgggtgcttgggaacgtggctcttgctgtcccttttgtttcctgtgacaactctgtcccctggttgtactgaccagaggacactggaagccccctacccctggagcagtgctgtggccatacgtgcctggtcagtgctgctgttctctgcctggggtcctcccaagaagactggggtctgagaggtgtatccagggctgtgtcagaccccatcttcccacatagcaaaggccatccttatctggcctcaggccacagaacaggttgtgccggtccctgtgtctcctgggagataggccaggcctgcttagcccagtgggctgcaccgcccactcccacatgctggccgctcggccccagtgacgctggccatggtgctctgggctgcgcctgggccacagggaggtggcagggtgcccaggagcacattggccactagctccaggcggacaccaccattctggtttggtgtctgtgatttttggttaatttgcatttttcaaacagcaaatcactttcacctggtgactttcacttggtccacacgtcaagctccataagaaggtgcgtgctgaagcttgagctgttccctgactggcacacgggccacgcagaaggtccacgtgtgtcccaggaataaaggcggaaggaaagcacccagcctcctggctcggtggccagcggtctcctctaacgcctgtgcttccacattctctgctcagcataaaccacaggacatgcacccaaaatgctgctgaacctgcacagacggttgtgcttaagaaaccccaggctactgatcgtgtgcggcccccggcctcccagggctgtctgtgggcgagctgtgacccctgctgaaaatggcccagaaccctggtgggcatagggtgtgagcctggagccggtgggccttggccaaggggagggtacaggttttgagacacggcccgtcgtggggaatgtgagggtgtgagggactggcccagacactgccctgccctgcatcctggaggctgagccaggtggtctctctgtgagcccctagtgggcctggtgggcttcacagaggggccagggttccaggagcaagagcccaggcataggatctgggctggaagtgtgacctggccatgtgggggcggggctgggcccggcctgccgagcaccgcgtgtggggcctgacagtgtcacttggacctccggggaccgctgaggccacactgttggtggtgccagtgggggctgagtttgccaggggcactgtgagtccatgcctggcccatctctcagatggtggtgggggctgagaccgcagacatttgggttcagtgaggagagccagggagagggcaggcttcggcccaggaactccttgtggctgcttcctggtctccaggtggggaaactgaggcacagagaggggaagtgctttacccacagccatggggcaggggtgcggagctgagccggggcctgccctgtgacaatgaggggctgcctggaagctgcatggattcctgttcctcccacagagtcccacagctgtgggcaagggctgctccctccggggaggtggactcagaggccctgaaagcagcgtcgctggcccctcggtccacgtgggtgcccgccacctgtccaggccctgtctgggggccagcagctcctcaggccctgccatggctggagcagggcttgcacctggcctgctttggctctgggaagggttccacgtcctctgcctgtgcttctgcccctcacgggcccctgcccagtggcttgctggcctcggggtcggggctgttacagcaggagtcaccggccctcttccccatcccctccctcccggctgcttgggcctgtcagttcttggctcaggtttccaaggccttcctgtccttgccgtggctacgccgcgtgcctgcacctccgcacgtgctgcgcaccttcgcgtttggggcctggtgccggctgccctttgcctggaggggtctcccggggtccctgtgagtcaccgcacagtcctgcagcagggagtcagacccacactagaccctccttccccactaggctctcgtgccccagctgtccttacggggaggtctgtcgccagacgtccgccatatcccgcctttgtgtgattgcttctctggagaaagagaagtgcccagaactggccctgctgtctgtggctggcagttttaaggctcctgatggttgtgagggtctgttccctgccgaggggcccgtgttgcgtatttacccgggcttgtgtttttgtcactctggaagcctcgtttcactgtgttttctggctggttgttgctgtttgtcttcccacctgacatctctacctgggtactttgttggattccctcctcagcacaggcagtttctaggggactcttagggggttgtcattggccctgctggcgtctgcacatggctgtgacgttgctgcttccctgcggctgcgctggatttgtgagtgtgtccagagcgtgaggattggtgttgctgtttgtgggtatctgtgtccctccctccttccctgtttccccacattctgatgggcgctctgtcttgcacgggacgcatctctggtccagcatcaggtaggggtgaccctgctcacccagcttgtgccgccgccccgcgcttccttcccaggccctgcggtgtcctgtgttgcgcggggcgcgtctctggtccagcatcgggtaggggtggccctgctcacccagcttgtgccgctgccccgcgcttccttcccaggccctgcggtgtcctgtgttgctgtcaggctgtccgtgaactccggacgtggccctggcgggccgtgttggtggagtctcatttcgggttgtttgccgacggttcggatttttgccaccctgtttctagtaaagttagtctggtagtcttgcttccgctggttttgctgcattttggttgggaacttttcatttttttctgtaacgtcaaaatggcataagaatttatcactttctcagcacctggacagaatactcgggtcccagcactccagcccatttactggtgaccagttagagaccccaagtcagcatggtttggggtggggacacgggtaatgagggagaggtcatgggaccacctcgctaggagtggaggctgggggagaggagcccggggtggcctggctggctcaggagggccctctaagtaggaggaccacagagctggcccaaggtcccagggcagacccagtctggctgccctgagtcagaggcagccacgggaggagcccagcccacctgagtctccaggagtccctgagtgacccctgtgtcccaggctgccccctccctccggactccccctccatactcccctacccagatggcaccaggaccccctctggcctcagctcctgctttcaggagcccacgggcctgaccacccttcagtgcccccaggcctcctgcccctgtccagatgagctgagtgagtggccccaggctagaatccaggctctgggcctcgggacccctagggcgccgcctcacacctgctgaggcaaccccgggctggggatctaacccttcttagtggcccggggtcaggccctgactcccgccatgtggcccatgacaaagccatttgtccctaaagaagggtgagcatgtaagcagcccccaggtccctgagggagggccagggcttgtggcgtgcgatgtgtgtgtttgtgccacgcatgtgcctcccctagagacccctcgggcctggtgtcctccccggccccaccccaggagtgtatggcatctgaagtggtcgtgtggcagcagctgggaggcccattgctgagcctggcctgcacccctgggagagctggggggcccgtcacagcctggctggctgcaccccgggagagctggcccacagggcctctggggagggtgcctgctgtttctttgggagcctggggaggtggctggcagggaaagccggccgtccagatctgtcaagccccacagctacgtgccccctgtgtgggtgtgggtctctctccgggcccctcgctcacagtgaggcctgtgtcgggggcatggggccgggggctgtgttgggatgtgacagcagtcggaatgttccagtggggaggcctgcgggacccacaggcccccagccacccttgcagaggcgccgcagcagctacctgcctgtcagacaccttctggccaatcccggctggaggctgagctacaggctgtcgaggaccgcagcagagtggatctgtggctgccgacccctcccggcccctagccctccactctcatcctacagaccctccagggaaatgaggaggatgggccatccccacacacctgtcctgggctgcccccaccacccccatgtggggatgtgggtcatggaagtctgggttctcctgctctacagcctggaatgtccagatcccctgggagctttgggaggtgccggggccccttgaggtgctactgcacagggccccccatcctggtcagcaggcggccctgcgtgggccttgcagagctgggtggggctgtgcttgggtggccaccaacctattctaggggagggaggtcagaggctgaagagccatcaggtgctggtgtccccgtgggccaggacagctggaggcgcagctgcagctaccctgtgtgatgcgtggaaactgaggcttggccatggtactcaccccactgggggctgggcagagaggccgacaaccccagccaggtcccgtggccacctgcccatgctcccgtctgctcagcgggcttcctctgctctcaccacggcaggctgggccccttctgcctgtgtatgtgaccaagggtacctgccacctctgctgtcccctgggacagtgctctgcaaggcctccaggagcttgggtggccagactggtccctgggactggtgggcctcatccggcctcggcagccgccccgcccattccagatctctgctctgcccaggtcttgatgctgcacagtggagcctccagggccggccaggcagggatggtgccgggcaggggtggtgccgggcaggggtggtgctggacctctgggagaggccaggtgagccgctggccagcagggaagggccagccaggcaggggtggtgctgggcagcagtggtgctggacctctgggagaggccaggtgagccgctggccagcagggaagggttctgagctgttctgctttccctgacagactttataagcatttattgagcaccggctgtgtgccaggccctgggccggcccccaagatacacccacaggccccattgccagtgagtattgggatggcagtaaagagtctgtcgtcgaaggctaggagtcacagaggaggccacgagggcttctggggaagagtgcaggctgtgaggggcagcaccgtggcgtggcggttcccgagagcccgtcaggaagggcacatgtagcaggtggtacaggtttggggtgccggtggcaggcaggctggagacagctgggggctgtggctggggggctgcagggctggggggtggggcgctgcgcagcacctaaactccgtgagatcaggtgctctggggactcagggcaaatggggtacttggttccacgtacctgtggaggacggcaggcgtcctcaggagtgtgagggacagaacggcctctgagccccagctccgttggcgcagcagagctgtgctgatctggtttgtgagctggcctgtggggtggatggggttccccagagctgtgctggcgtcagggaggaggctgggtgggctactgggctctccgcagcccagacaggtgtgaaggtctccacgcccgtcttcccggcccacgtgtgtaccatgtacgtgcacccgggaccctctggccggaatccgtggtgtctggctcaggaggcgccggcactgccctctagactctgcgggagccatcaagcgtctggggctgggagccgcacgccgtgaccctgccccactgaggccagagggacacctgcccagtctgtggccgccaccttccctctgttgagaacttggtcctggctggcggctttagggagcagagcagccgagtgtgtcccaggcttacacccccactgtgggtgctgtgctgtccccatgctgcacatgaggaacctgacgcacagagccgtgcagtcacttcccgtgtctacactgctggcgagtggctgagcaggatcagaactcaggcaagggctggaggctggggctgcccctctctggcctgggctcatggggccggcctctctgctccctgtcctctgtcccccatagggccagccggtcctgctgtgtgtccagaccagcctccggggagtcctggccctgttgccatcccctgtcctggcccctccacccacccagtccatagtttcctgaatccgacctcatccagctgctgtcctgcctgggagcccagggccctgcagactccatccagcccgggacagcccattcacacccttacagggatcccaggccctgcagactccgtccagcccgggacagcccattcacacccttacagggagcccaggccctgcagactccgtccagcctggaacagtctgtgtcctcacagggagctcaggccctgccacagccccaccctctctaacctctcctgccgcagtgtcccccacagcccttggcccctgccccagttgctgctgctcataccccagcaggcctctggctgtcctcggccagaccctcatcccatgcctcactcgcctgcccctcacaccctgtcctgtggccggcgtggctgcgtgcctctccccagggaccatgtggccaggagctgggcggggaaggagcccaaggggcctgcagccactgccagggaggggaccctgatgtggaccgggcccctgacgtggactggactgggtgggggctacattggtccccctgcaactctgctccctggggccctgaggtcagaagtgggtcggcctcgtggtcctgttcactctgggagcccagcccctaccagcccctagccccaggggtcgtcagttctgtgggcacagctggactagaattccgggataaagctggggccgagcggcggctgcccctgtggtcctcgcgccccaggcctgtggctttagcgacacctggctagcgtgggcccgggccgccctccccatggctgaggaagaggctctgtgtgtcccaggctgctgcgtgggatcgccagtggcagctgtcagcaggggtgatggccgggggaggggctcccagggccaggagcctcagagaccagtgtgggctgacaaagcccagccccagtggttggtgcgctgggtgccctcactgctgtcatgagttcacaggggccagtgtgggccatggaaatgaagcctgagcctgccttccgctcggggcccaaggccttggacaggagtgagaggggctgccgtgagcaaatgcacggcccattcctgtgcaggggccagtgaggggaggggccaggacaggggcctctggagagggtgggaccccagtggtggattcctcgtcccagcagcgctggccacacagcagggcccagcatgcagggcggctgagcaggagctggcggggagcaggacacccaggcccgtggctcctctccttccttcgactgcccagatctctgctcacagggtcctgccctgcgtcccccctttggggacagcctcacctgcccggtgtctccagcacctggcttctttctgttgtcttcctctaaatctaaatccaaatgacttgcctttccttttattcttttcgttattgtgaggaagtctgtttgtacagagagtgcatggacgggacatatgttggttttgaagaggtgacctcccgggtctgagtgatgcgtcccactcagtgtgttgaccaccatcctgatgcgtcctcatgccccaacctgcggcagccccgcatttccttagggacagagggggcagctgcctgctttcccccacctgccagcaatggtgtggtccgtccttctgggggcccttctagaatccttggcagaccccactggtggccggggcaggctccagccctttgtcacctccctcctggcaaactgccgccctgggccatcttccctggtgccacctcagccctccacccccggcccttatggccacccagaggaatcctgcggaaggcctttggtttgaagggtgagactgcgggccacagccaggtgtgatccgtggtcttccagtaaatcggagctggagggaggaacgtccgagtgcacagcaggactgacctccaggcctggcacgtgacagtggcctcccagtcgggctggtcagagggtgactgggcagcctctttcaccctccaggctcagcccctatcagacggttctccaggcgtggctggactggaaccctgggataaaaccagggccaagcagtagctccactgcagtcctcacaccagcctgccccttacaccatcccccacctccctgcttcaggcctcgagcccgctatccccatgcctgcctgtccccgccccctcctgtccccgccccctaccgtccctgccctctcctgtccccgccccctcctgtccccgccccctcctgtcctcaccctctcctgtccccgccccctcctgttctcaccctctcctgtccccgccctctcctgtccacctgccgtgccccctgcattcacacccgtcctggcaccactccatcccaggcagcactgctgttctccatgacaccgtcaccaatggtctgggtctccgacttgtctgcaggtagctcttcccggcccgcacagggccaggccacagcctccatagctcccaaggggtggagtgcagcagtaacggccaagctgggcctcacagtgccccgcctcccaccccaccccccaggagccctgaccctacctccttgcccctagagtgcagccacatgccctcactgggtgcttgggaatgtcagccagccccgagaggcagcagccaccatgcttttggtggtcctgcaggggcagcccagctcccagctgctggtccgttgctaggcgagagccgcaagcccgcaggaccacatcctggaggccataggagcagctgggcacgacctggaggcctctggaacaagtgaggtgtcagtgaggcttgccggggcagtttctgtgggtgcgtgatgtggggtccccatcagaaaaaaccggccaaggcgacattggacatgggacgccctgggcggggggagatgtgggggctgtcgcccaccaggtgagtgtgagccatgggggagatgggtcatggtgggaaagggtcccgttcccaccttcgcagctggaggggtaattagacccagtccccacacggggccatgggtgggcctccctgtagggtctcctgtgccagtttctgttcagcttttgacccaaggcagagaggatgtcggggcacaggccaccacaggtcccgggtatgggaggcagccatgccagctgggtgctgagcagattttcaggtgctctgcagggagagctgtggggtttgcacacagactgaacacagttgagagtcagaggctctgggctttgggcctgagctcttggaatgacagagacaagcctgacgaaggtgtgagccaacaaggttctgggagccaagcagctgcagcctccctcagcctcctgcccccactggagagcagcttccaacccatccgagaagacccctgggggctccctcagccccctgcccccatggagagcagcttctgacccatctgagaagatccctgggggttccaggcctgactttgcccaggggaacatggtcatcactctaggtgggaagcagaggggcctgccagggaggtgaggtcttgggtaggtggttctccagagcctcctgcctggtgccaaggaggggagaggcccttgctgtggtttcaggagcagggcgtggccacctggctgcagggggtgggccaggccttggtgcaaacaggcagccccgtcccaaagaggggcagcagggctctgtgtgtgctgaggtagaattattttatctctccgtgtctggttcactgtagcgtgattaggaatgttattggtgctgtatggtaatgacattaagagagccaaaagcagtcgcatagaattgctacaggaaaatctgtctagcaatgtcacggcagcctgcgcccagccctggtggtcctcctgggagaggagcagggaggtctggggccctagccactactgggggtgctggcgccactgcagggcagtggcgttgcgcagggagggcctccaccgcgccttcttggagggcccctgtgtgcgcaggtgtggtgccacgggtgctgacccaggtgtgcactgcacacctgtggggggttcaaggcctccgctgcctcagcctagcaggggttcctgcagctgggacagtggcctgaggcggccctggctggcaccccagggctgggctgggtggtgggtggtgctggggacagctcctggagcctttccaggcctctctgtgtctcttgtgtcttcattcgacactggggtggtcactgcgaccaactcatggggtcctgtttgtgtggattagataagcggggcccaggccaggcacggtggctcacgcctgtaatcccagcactctggggggctgaggtgggcggatcacctgaggtcaggagtttgagaccagcctggccaacatggtgaaattctgtctctagtaaaaacacaaaaaaattagctgggcgtggtgacctgtaatcccagctgctcaggaggctgaggcaggagaattgcttaaacccgggatgcagaagttgcagtgagccaagattgtgccactgcactccagcctgggcagcacagtgagactccatctcaaaaacaaaaagataagcggggcctgacccaccacttagcagagcacctggcacagacctcactgcggtgaacacgatgaagtgggtgagcgcggccgctgctggtctccttggcttggtgcagggcccccacccggagctcatgtcacttccccatgcgaaccttctgggcccttccttccacggagcccaggcatccttggggtgtggtggttggcaccgcccatggggtggggctgttgcctagcttacaaatgaggacactggggctgcccagggcacgcactgtccctcagtccctggggactgccccccgtctggcctggactcctgtcccggccccacccccacccgtggtctgccccaaggggaactctggtcctcacaggagcgggggtgaccacgctgctgcctgtcatggtggccttggacgggacgctgtatggtctctgagctgcaccaccaacccctcaggtgtacgtggagtgactgagcgactgggcagagtggggtgttgggtgcagcggtggggctggcaagggcccctgcctgggcctccttggtcgtgcctctctcagcagctgggcagggcagtgctgtggcgttgctgtggggcctctgaaacctgccaggcgaagcccacagggccagccttaccctggaaagccccggagtgaccagcagaggggccagccgcacggctctcccaggcctgggtacctttcccaccgtcttaaggtagcaggcgaagcgctggctggcatctcaagagcagagtgctgggacagccctcccagagcttcctgggaatggcctctgttctctgcagtgagcgtggctgcagtgctggctgggggtgtgtgggcacaggggctgcgcctggagccggagatgtcggaggcctctcctcctcggtgtgggcacccaccccatgctgtctgttctctagaatgttcactcagcagcacttgtgagccctgtctggggctgagcagggggcaggacagatggacattctggtgggggtcagacgggacaggaaactgccttgtgcttggtgtgactgtggccggggtggggagggagctggagggtgggtctgtggatgggaggaggggccggcagaaatctttatatttttttgaaagcagagtaacactagagcaggtttacagaaaatgtggtaaatttaaacaatttgcccttgacacatgcgtccttctggccagctgtgagcactgtggcaatggggagaggtgtggagcgggcctgggggagcgtctgtgccccgagggtaccacccggtcccgcctcctcagatctgccctctgcctgtcccctctgactctttgcccagtagaaagacaaatcccagcacagtggtgccctgcgtggcaggctgcccttgcaggtttcctagttactgtgaaaggtaacaccttgatttgttcctgcttttgatccagcgctgcaaacagccgttctctgggctgcagcctttgattcatccaggctgagaccctcagagctcactgggaaccgtttctgcagtgttagcagattgcgtccacagctgcctgggatgggcagccctgacagatcctgggtgggcgagcaggaactctggaggccatgggctctcgggcttgtgcaggagcaggccgctcacagcagggctctgggccttgagtggtggctctgcagagagcatatggcgggagctgggcctcggggaggcaaggagtcttcctggagccggaaacagcaaagagttggagtgacaggatcagccctcgtgggcagggggcccggaaacgctgctgggcctctcagggcctccagctcagactggtgggggtggcgcttgtgtcatggggcgggcgcccagccggagagggcgtggccggcaccaccatggctcttgtctctgtcgtctgcccttaccggagggacagccaaggtccttctccccagggacaccatggctctatgcgggggcgggtcctcctcggggacactgtggccctccgtgggggcggatcctccccagtggcttcccagggttcttggcagcagctctgacatgggttctgtcctgggcttcactgctgctgttttcctcacagctgtgccctccccgagaggattctgtcctttcgtggacgcttctccctggccggctggctcctctggaccctaaacttgacgcgccgtatctgtctgcaccagccctggtgccaggagctgagccagcatacagaaggtgcttactagtggtttatcgagtgtggaggtggggaccccagaacctggggctgcccgatgtccaccggcagggcggaggctggagtgtcctggggctgtccgcaggctagaaggtgctctgaaggagtcgagatgggacgagaggggaccaggggaggccagcaggtttacagggggcctgggggtgtccccagggtctggtagcccaaaggtgaacacggggaagcatctctgtcccaaatccacagacccgtctgggagcactggccagaacccctcaggccctctggaatatggtgtcacctgggggagcacttcctgtgggctgtcacctgggggagcacttcttgtggggcctgggtgtcccctggagaggctcctgtggtccctggcccccactgcagggcactcgctcttgaaaggtagccctggtctcagcagggaggggcagtcctgggcagccctgggctggcctcctgtgaagcttactggagactccctgctggactaagctttttctcgtctggccccttcgatggctgagccctgggaaactcccatcccccatcccgcagcagcatctcacctgccatcgtccttcccctcccatcccccgtcccacagcagccatcttcctttccctctgaggtgcccctcccaagtggggaggctccttcccaagagctgctcaggtgggtgctgtcctgggcccaaggccctggggtcccgccaattaactggcgtttccctgtctccctgcagaaggatatggccctgaagccacatgagcggaaggagaagtgggagcgtcgtctcatcaagaagccccgggagtcggaaacctgcccccctgcggagcccagtgagaacaggcggcccctggaggcaggcagccccgggcaggacctcgaacccgcctgcgatggggcgagaaaggtcccactgcagccctccaagcaggtgagcaggtccctccccgaccggaagctctgcggcgggtcagtgctcaccgccccagggccatgccagcacctggacaccacgccacgtggcccccgggcctgcctggcagcgcgcccatcgttgtcaggcttggggtgcaggacacgtggacagggctggggcctagcagaggcaggagccggctgggtcacggaggggccgtgacgtgcccagggccacagcaggagaggtgcctgtctggggcagcaaggcgcgcgttccgggctggggcgccaagctgataggccggccccgtttccctgccgtgtccatcaggctccgccgactacaggtgtccagagtgtctataaggagggggtccaggctcattgccgagggctgtcctgtccacacgcagcgccatccgctcacgtgtgcggcgtggggaagggaatacttggtcccggcagtggctgcaggcacgtgactgtggtcagtggtcaggtgcgtggcccagctgggaacagggctctgcctgccctgcccaggggcctcctgcccaggaggggctgtcagagcaggtgggggcttccccagcgcgtggggctctgtcctgggtgcagctcagcctgcagctgcttcctccgcgggggtccgctggtgtgcgccttccttccagggtggggctctgcgcggtgtcctcggctctcctcggcccccttgggaattgggctgctggagaagggcagcatgcctcctgggcccgggctggacgggggttccgcgggcggtgacacctgcccaggtggacacgtgctctttcttccatgcaggtgtgctccccagaaggggggccgctcccagccagccactgggaccagaacggcccggcccagcgccagcaacagctccagcccagccagtccagccagccccaggggtccctcccagccccgtcggcactcccggaccctgggcagccctgccagccctcccagcggccactcctgggtcagcgcagctggccccagcggtcacttctgggcctgaaacagccctgccagccccggcggtcacttctgggccccggtcagccctgccggccccagcggctccttccatccccagatcagctctgccagccccagcggtcacgcccggcccagccctgccggccgcattgggcactcccaggccccaggcagtgctgcaggcgcctgcggtccctgctgaccccgtgtcaccactgccggcgcctgcggtccctcctggccccacggtccctcctggtcccctgcctctactgccggcgcctgcggttcctcctggccccaaggcaccgctgcaggcgcctgcggtccctgctgaccctgtggcaccgctgccgacccctgcggccgtgggccagcccgtgtcactgtggccagcccggtagggcatcctcaggacagcgcagccggcccctgtggtcgctgctagcccagtgccagcggtaccagcccccgcggccactcctcaccctccgaccacgccgacggcccgccagcttcctcccaggacagtgctgctgcccccggcgggccttcctagccccgtgtcagtacggccagccccgaaggtccctgctgggccagcccagccgcccccggcggtcgctgctgcgccccaggcagccccagcggttagtggaagccccagagcagcccggcccactcacgccttcactcctgggcccgggacggccgaggcagcagaagcagccgctcatgggcccggagcagccctgcccacccaagcggccgctcatgggcccagagcagccctgccagcccctgcggccgctcatgggccccaacaagccctgcaaaccccagccgttgctccccattcccgatcgcccttcactcctggggcagccgggcccaccctgccggcctctcctggggctcctgtgccagccgcggcggtccctattggatctggtgccggcccgtcagccccggctctcgctcctggccctgggccatccctgccggcccctgcggtcccggtggacccgatcctgtgcccccgggatggcccgtcaggccccatctgtgagccctggagcctgatgcctgcaggcacctccccatatgggttttccagcccactccagtgtgatctgcaccctggcagggccccaagggccaaggccgcattgcccttcgggctggagatgctttgccggactagcctgaggccttgtctagacagggctgagctgtttgtcgttggaaattgaggctcggccagaggcgggagcccctacagtgccacgatcaggctgaggctcaccacaccaggaagagagatgaacccgcgtctgcctgccgccccgccatgctccctctccccccactggcgtcacagtgcccccacccgcgttgctgcctgtggtgtgcgtgccctgggaggggaacacagcccctgagggcggggaccttgctgggggcccctcagcgtctttctgtgcctctgaattgccaatactgtccttgcatctctgagtctacgtgcacgcttgcccctggcgtgccacctgtgcggagcgcgtgagcctggtgtgtgcgtgctgtgtgtgcatgtgtgcgagagggtgtgagagtgagtggcgtgctgggcatgaaggatctgtggggtgctgcagttcctgcagagtggcccagtggcgaatggtgaaggtgtgggtttcagtccaggccctccccctggtagtcaggaggtgctggtgtccacctccagggcccccaagctacagggggcacatgggcccatctggtgggtcaggacctgcaggggacccggaggctcccacccccacctctcaggactctgcctccaccacccccgtgggcatgcactgaagggttgcctgcagggtctccaggcgagggggaccccacagggtgggcagcgccttctcccggcttccccacagtcccctgcagcgtcccgtctggctgttgacctacatgtggtcgggcacacctcacactacaaggctacccctgggcccatccctgccccttccacggcccccacctgtggtcaggtgttgccaccccctcaggacctggtctcaaggcagccccactcgagtcttctggagtccaaggcacgccactcgcccaaaagggagggggtgtttgggggggctttgactgtctccagacctcaggggagctgggcaggctctaaccagtggtcctccagagagcagcgttgaccacctggacccctgcgccacgtgacaggaggctctggtcctgcaggcctggtcttgcccagctgggctgcctcaggtgtcaggaaggggatgggtgtccctggctcccaggccaggcagctgctgacctccagcaccccgcacttgctcatgaggaccccacccccgcaggccctcccgggtcctgaccagcctctggtgcagcatctgctttggcctccgggccccctcgctccccacccacccgggccccttcctccggtgctcacctggggcctccatcccagaagcgcagggcttatttttctgattaaagaaaataaaaagtgccgtgccactattttttataacagcatcagcgtttgtaatttaaacagacgagcatgtgtcttacgtgatttattcccacaaagggcttttgtgctgggcttggctcgggattcattgcactctgaccgaacagaggggagacctggagcatctgttcctgaccttcctgcccacccatctgaggcctggaatgggggtttgtactgtgctcagcatgggggcaccggcctccagatccccccaccgcaaggctactgtgtgggccagtgtgacaggggtcgagacccccctctcggctcatgcctggggggcacccatccccgggatcagtgtcctggggactggtgagggagggtggttcagctcagagtcctctgcatggcctgggcacgcgtgagggagcatggttcagcccagcatcctctgcacagcctgtcaggtgcttgtgttctgctcacggaaggccggggcatggaggggccgagtcctggctgcagcgccctggctgagctccaggctggacctggcacacttggggtgcgggcttggagggcggtgccatctcagagtcacccacacaagccattgccccgcagaggggctgaagttgccttcagacgtccctgttgtcaggcgtggggaacagtgatgatttaaacagtctcctgccctctttccactttcaggcccctgcccctacccccgggctcctgtgagtacagagggggccgagtgagtagagccatgtctggggcaggcctgaacgggctgagggagtggggaggggccatccatgctggagctgagcagtggcacttggctgccccttaatggggaaggccaggctgccagggagggctgaggagagctggaaactgcagcctgggtccctgtggccaacagctgggggtgcagaggacacccgtggaggaaacattcaggacccagaggggctctcgaggcctggccatgaccctgcagcctccagctcgaacccactgtctgcactggcttgcggtcggggtgccgccatggggagggcagagacaccagggcgctatggtgctggacatccatgttgtgtcctggggcccgcgccctggtggggacactgctgccaggcgtcgccctgggaaatgcagatttcgtgtggccagatctttgatgtttctgaagagctgggaatccaggtttctctggatttggcaatgttgaaatgttggtggtcaattctaatttttatgactcactttgctgaccagaagatgcagctgtgggcctgcgaggcctccggcaagtgggatttggctcccatcacaggcagcagattggagcctgaggcctggttggaacatggcttgttcccttgtttctggaaggggttggtactcagtggggctgcgcctgcccaggaagatgggcttgtgtcctggctgctgtagagggggtgggggcagcccagcctgaaggttgaggatggaggtgtcttccggggggtgacagtggggatctgggggaggctgcccgctgcccgactacagagaccctgttgctgcctcaggaacccctctggagactggggcctgcgtgcagtgctttagtgaccatcagccctctggtcacctctgtgggggcctctgcccaccttgttgttgttggcacaggcaggctggtcccctcccatctgcagaaggggttatggggagggcgtgagccttctgggagaggccgaggcgtgttcctgcagagcccacggcagacgagggcagtggttggtttgttgttgggggaggagaaggggaggtcggggtggattcctggaagatgggtgacactgagactgtggcggtggggccaaccccacgaggggcctggagctctaaggcccttgggtcctccccaggtcaggccaagtccatgagccatcgctgagcagcccccagggagggaggggtgtgagcgtgggtgggctcccggcacctggcccagcatccacgcctggtgtgtgggcatctgcctgcagaccctcgtccgagggccccgtctctctggacccctcactgcaggtgaatagccacagtccctcccccaggccctgccctgcgtgttggaaacaccacctcctgggccttccccgtttgctcattcgggatccttgtctgggcactgaggacgatgagctccgcctctgttctcgcgtcagggctcggctcctccgtgtgtggggagacaggctgggatagcatgctgggcgactgtggtgagggcaaagacacagagggcatgagtggggggctgggggggcacctggatgttcagaggccagaaggcaggactacccgcaggtgcccaagggagacccagggccgcccagaagtccagggggagtcctggggcctcggagggatctgagcagggctgcggcctgacccaggatctctctggcctccctggcgtcttcccaggtggcccaggaccgcagtaccagactgagctggactggcattgaccaggccgaggccaccggccatcctcctccggccagaagctgcagtgataggggacatccctagcagttcacaaagctgtggggagaccccgagggggaagggtttccatgctgagccacaggcccggccacggtgcaaagctgtggggggactccgaggaagaagggttttcatgctgagccacagtcccggccatggtgcagggatttggcacgaagcctctcctagggccggtacacgacctagagggctccctggtgtaccctgggacctggcagagtgcagcttctcatccagcaggggtgggtagggccctggactctcctagggcagcactgtttaataggagtgttatgtgagccacatatagagttaagaagaaataagtaaaattcattttaatgaagtattgcgtttcactccatgtactttgaaaatagtatttcaacaatgtaatctatataaaaattgtcacatcttttttactcttttttttgtagagtctgggaaagccagcaggtgttttacatttacaacacttgagtttagactggcagcttctgcgcccaataaccacaaggctgacagcagggaggtgtggggggtccagaacaatataccctctgtgagtgcttatctcatgcccatgctgttcccaggcgcctgctgtctgtctcctcatcctctacctcatcggctctatggtttgaggccagacctcatgcatcaggccagagtgtcctgccgagacccaggatgcacccctcacttggcacagacaaaccagacacaccagcttctgtctttccccatttcagtgggtgaacctggaaccacccagatgactgggctagaagttgacagtcattctcctctcctcactcccctgtcctcccacccagcacacccagccaggcaggtccttagcttccacctcctgaatctctgacctgaatttcactagaaaataaggaatactacgtcaaaatttatgggatgcagctaaagcaatccttaaaggaaaactagcttgtgcttatatgggaaaagaagaaaggtctagaatcttaaggttttaccttaagaaaccaaaaaaaaaaaaaaatggaaggtttgtaaacctataaaggaaagccatagtatagacaagaacagaaatacagaaattaatgaggcaggccaggtgcggtggctcacgcctgtaatcccagcactttgggaccccaaggagggtggatcacttgaggtcaggagttcaagaccagcctggccaacatggtgaaacccgtctctactaaaaatacaaaaaattagccaggcacggtggcgcacacctgtagtcccagctgcttgggaggctgaggcatgccaatcacttgaacccaggaggtggaggttgcagtgagctgagatcacgccactgcactccagcctgggcaacagagtgagactccgtctcaaaaaaaaaaaaaaaaaaaaaattaataaggtaggaaacagacaatagaggaaatgaacaatgccaaaaggtgttttcaaagttgagaaatccctagctagatcaatcagaaaaagaaaacacaaattatgaatattaggaacaaaaggggaaatatcattacaggcactatagacacgaaaaaggtgaaatggggacaattttattccaacaaattcaacagcttaggtgaagtgggcaaattacttggaaaacaaaactgacacaagatgaaatagataatccgaatagtcttttttttttttttttgagatggagtcttgctctatcacccaggctggagtgcagtggcacaatgttgcgcaagctctgcctcccgggttcaagcagttctcctgcctcagcttcctgagtagctgggatcacaggcaagtgccaccacgcccagctaatttttgtatttttagtagagatagggtttcaccatgttggccaggctggtcttgaactcctgacctcaggtgatccacccacctcggcctcccaaagtgctgggaacaggcgtgaaccaccacgcccggcttagataatctgaagagtcttacatctgttagatggagtttctggatgtccacgttttctgtcttcagtgccacctcccccagcctgctcagcaccctgtcgccagcctagcctaacacttgaagtcttttctgatcgtaccaggcacatttccaccagttaacatgcatcagcttgtttaactgcaaccctgtaactattcccatttgccggatgaggatgctgaagaaaaaaagccgcctgtaaataacttgcccaaggttcacacagtgagcagctggaccaggattcaagcccagcggcttggctttgttgtggaatctgtaccctgggccattacctggagggcagctttctgggcctcagttttcctgtctgtaaaacggggatgttactaaatagttcatttgttttcgggttgttgagatgataaaatgagctaacatgcaaggtttgtactgtctacatagctgccatgatgatatcgattcctgcttttattattatgaattctcagagtaatttctcccgcctcctgggcccagcctggctggtttgaggcccagacgctagaggcttatctttgtcccggttgccaggcaagggtcctcctgtgcagggcctgtggagagaggcactcagttaatcagtgccttagacactgggcctgggcctgccacctgcagggagcagcaggctgggtcacagggtcctagagcttcctcccacctgacagggccctcctacaaaccaagagttggtccaggggaaggggccactcaggagggctgggggccacgccggccagggtgctgttaggtgggagtggaagaggaaggctgagcacctgggcctagcaggcactgctccccacagcctggggctagccgttccggggcgagcatggccacctctgctttcccagcctcactctggtcgggaaggctcttccgactggcatccattttgtacttttggtcattccgcccctgttctgggcctggggctgcagtgacaaacaagacaagtgaccgtgctgccctcgagaagttaaactataactgggacaacagcagagcgggtggagactgttctgagtgtgagcacagctgtgcctgggaaggagagaaggcaccgttagaccaggcggtcagggaagagcgctctgggtagagggtgtagccacccaggcctctggtggcgtgtgcctgaggagccgagcgggcatggggtgggcagacagggctaaggaggggcctggtctcatacagagggaaaccactgagggttttaagccagggaacaacgtgagctcctgtgtttttacaaactcgtgggggaggcagcacggttgtgggggtggtggcgcctgtcgggaggctgctgcagccgttcaggagggggtggcagtggcttgaattaggtcattcttctgttggacagggcgccaactgagcaagaccaagtgatgcagcccaggcggcaaatgtggtggagccaggagtccagtggccccaactccagagctggcggcacacacctgctggagtccactctgacacagcatagctgctgttcccacccctcctccggcacacaggactgcacaggcagggccttgcagacacttacctgcacttgcccacacacactagtgtccccaagagcctgctggcaacgcacttcctaggccttaactcagccagcatccctcatatcatctgtagtgtatctcatccatccatccacccatctgtccatcatccacctgtctgtccatccatccacccatgcatctacccatgcatccatcatccacccatctgtccatccagccacccatgcatctgtccatccacccacgcattcatcatccactcatctgtagtgtatctcatccatccatccacctgtctgtccatccatccacccatgcgtccatcatccacccgtctgtagtgtatctcatccatccatccacccgtctgtccatccatccacccatgtgtccatccacccatctgtccatccatccaccatgcatgcatgcatccatccatccatccacttgtgcatccatccatctacccatctggccatccatccacccatctgtccatccatccacccgtctatccatgcatccacccatctacccatctgtccatccacccgtgcatccatccatccacccatctgtccttccatccacccatctgtccatccatccactcaggcatccatcattcaccccatgcatccatccacccatacatccacacatccatccatccacccatctacctgtctgtccatccatccacccatgcatccacccatctacccgtccatccatccacccatgcatccatcatccacccatctgtccatccaaccacccatgcatctatccatccacccacccacccgtctgtccatccatccacctgtctgtccatctatccacccatgcacccattcatctacctgtttgtccatccatccacccatgcatccatccatccacccatctgaatcacaatagaagaaggtggagcagcgtactggagtgtcccgcactgggcgggcagtaccctgctccctgacactgtgctgactcagggaacacttggtctctcccaaacattgcctgagtccctgtttactgtgtctgcctgtgctaggtaggcaaggataaaagacagccccgcccactggatgcttacagtctactgaagagagacacagaaacaagcaaccccacttctcttttagagagacacttaggggactgtgggagcctggaggagctctttacctagcctggttggcatgtggagtgaatggagtgtcaggaacggtttcaggaagaagcagggccacagccatactgcgtggtgttagcctggaggaggggatggcatgctttgctaataccagggtcctggagacagacaacagagtttccctcattctggagcttctgactccccactcccaactctgagagtcgttctccttcccataggctatgcagtctcatacagctgggctgcagtgccacacctcaccagtaggtgctgccttcagctcaatgtgactccagcctgagcttcgagctgtgggtgctaagaagtggctacccctggctgggcgcggtggctcacgcctgtaatcccagcactttgggaggccaaggcaaatggatcacgaagtcaggagttcaagaccagtctggccaagatggtgaaaccccatctctactaaaaatacaaaacttagctgagtgtggtggcaagtgcctgtaatcccagctactagagaggctgaggcagagaatcgcttgaacccgggaggcagaggttgcagtgagccaagatctcaccactgcactccagcctgggcaagactctgtctcaaaaaaaaaaaaaaaaaaagtggctactcttccagtctgagggttgtaggttgagtatgtgtggaagagagcccagaggctgtgcaggcagcgtgtatgggtggtgaggaagttgggcccctcttccagtgcccccaccagcaggtacacagccttcctcgcactcctccagcaccccctccttgcacccctccagcacaccctccttgcacacctccagcaccccctccttgcacccctccagcacaccctccttgcaccctccagcaaccctccttgtacccctccagcacaccctccttgcacccctccagcacaccctccttgcaccctccagcaaccctccttgcacacctctagcacaccctccttgcacacctccagcagctgtgggagagctccctttccctggctgctcctgctgtctgggacgctccccagggctctcccatctctttctttgcagatggcaattttcccgaggcagcccctgctcaggttgaccccggaactgggtcacttcctttccccatcaggctcaccttaggagtacaagttctggagcagcaccagtgactgccacaaagcccctgccctccaaacgcccgagggtggggacaacagtccacaaaacagagcaggatgcagtcgctggtgtcacgtgctgtgggtgcggcatcggctcctcccgaccagggacatgagcccagcccccaggaggtagcagcaggggactgtggtagggctgaaggcagggcgtagcatctgcctgcaagtccctgtggcctgggcaggttcgggacagaggggccccagagtcgggctctgctcttgctgaatgtgaggggcccatagtcatcatccatggctcaaccaggcctggggacactgtgagggctctgggactgtcccttcgggagcgaaggcagcggagagaggtaccacccacccacagttgtgccaggcacctgctctcaggattcggggacggctttgtgggctcccaaaacaggcaggaaaccaggaccagctgggagctggtagggactgtgggaggtggggaaatggagtgttgtggacgaaagcagccactccctctttgccctgccctgccctgccctgagccagggagctggacacccactgcagtcccctgaggctgctcaaccttggtgggtggggaacttggaaagtctcaagtctggacccatgacatccagtccctgggggaggcccaggagtcctgaaagctccccgagggagcactgtttgcactgggccaggagccatgttctaggggctcagctccttaagaggaagcgggagctgcgaggaggagggagcgcaggctgtggggctggggcaggggtgcgctgtgtccacactcatttccactcagacacggatggcggcagctccgcctctgcatacctgtgctccatttctgcaggggcgtcgcgttcccgtctcctgctggaactgtggcccagcccaactagggggtgtgggggcctgacctctgccccatctcccagggggcctgtccttggcctggcaggtctgaggaagccgtaggccccttctcagggttctccagggtctgcattagaacagcagcccaggcagcccccgactctcaccctcgctcccaggcctgcaggtgcagaggctggaggcatcgtggccggccagtctcagttcatgcccctgtaggatagtccttgtctgaatgtgatgccatgggatggggtgtgagagtcgccctggtgtgatccgattggtgtgagacttcaccagggctgcagagtatggctgtcagagttgtgcactgcaccgctccagggctgccattcccaccgtgccgtatgtagtgcgtgcatttgccctgaccattgcacattccccgggagggcaccttctgctcagtttgcacaagaggacacgggggctggtgtggggcctcttgggtgctccactttgggcggggcctgcgcaggacagtgcgtgcttagagccttggggcgggtctggggagcaggtggggcgatgagtccgtgtgcatggggtgaggtgtgtacagggccagtgtgactgctgtggtagagaggggtgtgggtgtgtgtatgcagccagcgtggcccctcagcctgccggcgcctgtgggtctgcgtgggtctctgtgtgcagccggcgcggcccctcagcctggggtggtgtgtgtgcctgcgggtctccgtgcaccctagagggtttcctggctgcatggcggggccactgctggctcccgtctctctggccccttcccagcaacaggacagctcaagggcactagaaccggacaggccaggccgcacctgagcccccgactgagcccgagcctcccagtggaaccatgtttctgtgggcaacccagaggcagtgatttttggacgtgcagcctggagctgggggacggtgtggagggagggggttggtgaggggaggggaccttgggggaggggctctgtgcgcctggagccaccatgttcctacggttactgccagaaccctcagggccccagtgctcctggtcccaccagcggctggtctgcggctgcccagtggagtgcagcttgtaggagcaggttgctgagggttcaggaaatttgaagccggctgttaaactgttagtggcttccatcagctttggtttggatactgacgtcacagaaactgacaggcgctccatgctggcccacagggagctgttcctcctgccctgctcctgctgcacgccccacctgctgacataactggacagactcagccttccttccccaccccaggaagcacaggcttggtggagcagcagggtgccctgtgaggagggcaactcagggctgcagtgtgtgtgctgggccgttggtgccgtcagtgagctgtgtccggggccctccccggcctgcgctgcctttccccccgcacctgccgcctggcagacggagccaccttctgtgtgcactgggaacagtcactcctttgtcactctagggggggcaggggcttgggtcggctctgctcactgcccagaacggtacctggctcgtcagggctccataagcatcggttggacgggtggacagataggtgggcagaccacaaggctggggtgggcacaggtgcagtagctcctgcccaccctccagggcaaaaggggccccctctggccccagacgtggacttgtcatccagggactgtgatcttgtccctccagctcctgctgggagtggacgtgtggcctccccggcccctggtgtggctggcagcactgagaagcggctgggctgagggcagccaccttggctgtttgaggtcctgcctggggacagagtggggtgaccaggacacagattcccagttctacagggtttttcgagacgtgggactttcagagctaaaaccggccacccgaggaaggggaagagaccccaccccacgaccggcctggccacctttcagggcctccgggtttgggaggagcacacgcagggcagcccaccgagcccctctgtggcatgggggtgacgcgttccatctgcgcccagccctgaccggaggtggcttttgtgtgggtgtgaagtgtagagaggtgccctactcctcacggctcagctgtgtgggtgtttccgacccacctcccttcccatcggccaggtgtccttgggcagtgagcagcctgcaccactatactcagcagccctgtggcagcctttcccatcgctgccaggtactgccctgagcctctgtccctagaagtgagtgcagggctcatggggccatcgccaatggtcagactccccagggggccggtgatacacggttcctggagcgggctggaaactcattccttgcaggctctgggagacgatgatgcattcccgggaccccgcgttgagaaccgctaggagtgggacacgtggcttcctgcagaggtggacagaacccctgatggccccagcagggcagcaagtgtgggacccggtgggcagggctgcccagctgggaccgtggtgccagctccgggggtgagaaaggagaggttgtgagagtccagctggtgacaacagtgacccctggtggcctggaaggtgccggccccgggctctgctgcacaggccgtgcctccacctaaacctcattgcaccgaggggccctgccagggttcccgaatgttacagttacagatgccgaaactgaggctggggcaggccagtcgcttgcccgaggccacagtgccaggaagagccgggcagcctggccagggcctgtgagggctactgtgcagctgagcaggtcactagcccaccaccctgcccccggctcccgcccagtaaggctcagactcctcggggctgcatccctgcccggccagggcctcctccagtgtgggtgcctgctactgtgcggcttgatggacctcatgggccgggggcatttgacctcaggggcctgggtgacatcccttaattcgcactggcaccgtctgccttgtgtgcaccctgtcagccacccagggaggcctgttgctgcaggaggtgcacagagcgggcctctggctgagccgaaggtcggcagggagccaggctcatggctgcagcgagccacaccagccagtcctgggacgggtttccccgggctggggcgtgctcctgacttggatgactcaaagtaaagaacctcaccaggggccctggcatgcgaggcctgggggcccagatgtgctggggcgtgtcactacaaggtgcagaattgttccagatccaagttggccagagagggagaccgctgggcttccacgtgagtctgggcgctggctgtgcaggggcgtccctgctgggcgctggccagcaggagctctggcctctcacttccctcagctttgtgcaggtttgaaattatttccaagtaaaaaaagtaaatacatgcagggctcggggtctggtccctgcatggtcacttaacctgtctgcgcctctgttttctcatccgtgaaatgtaaaggaaaatagtttctactcggggccaccgtgtgagcaaatgtgtgagtgtgtgcaaagcgcccgggccaggccctggcacgcatcggcgcccatgttggctggtgtcaggggtggtggcggtgggcgtggggcgtgggggtggggtgaagggagtatgggtgctcccttcagcaggtgatgaaactgaggcacggggaggccgagcagtggcccaagggcccatggccagggtcaggcaggtcccaccaccacctcgctgcttgctctggcatggagccgaccgaaggaggtgctgtgggcacagccaggggacagtgggtggcactgaggctcgacctggaggtcatagccctgtacagccagatggggtggtgcgaaccagccagggtgtgggtggaggccctgcctgtggtccctagcacccccaggatgccttcaaagtcagcggcttgtggaaggggcggctccaagcacgtggcggttctcgtgtcactgagccggtgggtcctgggtaggtcctccccgtcctggtagagtgtgttatcagtgtgtgcgctgtcagctgggatggcattcctggctgtgcagagctctgtcctgctgctgctcccgcccccagaccaggacccagcccaccacagctcgtcacatcccaaagcgcccagcggctgtcggggcgcctggggccggggtgctggggtgccgggagcaggcatgtagccctagccagggggccccgatgcggacgcggtgaggtgggggtttgcctgagacagtgtctctctctgtcccagatgaaggtcaccgtgtccaaagggggcgaccgggacagtgacgacgacagcgtcctcgaagccaccagctcccgggacccgctcagcgatgtgagtacccagctgcccgcgcccggaggctccgagtctgggccgcctgcccgctgcgccccgcacaagggcgtccagtccgagtctgggccgcctgcccactgtgccctgcacaagggcgtccagtccgagtctgggccccctgcccgctgcaccctgcacaagggcgtccaggaagccgctggttagggtccggtttcccaccaaggctttgtcttagcaatgagcattttgccttcgttaaagcgtgattttttactcattaggactttcccattaggagagatttaaatgaagaaatggtgagtgagctggcaggagcccagaggccaaaacgttaagccttggacgctgtgcctgcactgctggcctgtgggtggagggcaggcggacggccgccgagtcttgagatgggcactggcggggcagtggggaggtttctgctgactggaacttgaggcatctcattatcatttaaatgaaggcctcactgcccggctccccatcttgttgccacaagttaggaaaataggctgggaattacctgggactgccgctgccttggtttgtcctctaattgccagcccctggtgaaggaagtcacattctgggcacaatgcagcagctggggctgaggctcaaactcagggcaacgaaggccctcccacccctctggcagctgggagctggcgggtgggcccatcgggacccagggccttgggctctgtcccctgacatcctggggcccttcaggagctgacctgtccccggcaagggtctgtcttgggaaggggagggggtgtcctccctgactctgcagtgggggttgtggattgatttgggagagtggaggactgccgtcagctggccccaaagccctccttttcttcctctgccttgcccctcagagggggtgttggatctttgcatctgccccccactcctcagggggctctggaccctccctgtgagccccacttgcccagctcagtgacccaccccatccactacagcagccctgagcctgtttccccacccctcctgctgggggaggccctggtggtctgagtgtgtagctggtgtgatccatacctctgtcctgaagacctcacaacacccactcgagccagagggatccaagggtgtgggggacctcagcagcccctgcaggccagagggatccccaccagaggtgtggggggcccctagctgcccctgcagaccagagtgtgccctgatgtctgaggggcccccagctaccatcccccagccccaacccccaccacctgtcaggcccctgtggtgaaccctcctttgagggctccatctggtacctcctcccggaagccttccttgtctagccagggcaccctccccaaagtcctgcaaccatggacccctctggcgggtgggcacggagggaggtcagcagaagctggggccctgggctgacctcccccaggtcttcctgcctcctctgaggagcatttctggtggggccttccctcttggggacagggagctagccaagggcgtccctgtgggagcctcctcgggtttggatcccagagctgctgcaggggagcctcagactggctgggcccctcaggaggacgacagcccctggggaggaccccaccacgacgcctaactctgtcctcctccctgcggcctcagccctcgtggcccctgcctgagaggatgtctcgctggtggtcttgggtctgggcatctggacctgtccccatccgagttgagggctgcggggctgcggggcagggttgagggctgcggggctgcggggcagggttgagggctgcggggctgcggggcagggttgtgggctgcggggctgtggggcagggttgtgggctgcggggctgtggggcagggttgtgggctgcggggcagggttgagggctgtggggctgtggggcagggttgtgggctgcggggctgccgggcagggttgagggcttcgggtctgtggatctgcggggcagggctgtgagctgcagggctgcggggcagggctaagggctgagggctgcagggcagctgtcgggtgcatccctgggagtttgttccgagtggcagcctcactgactgtcccctcttccttcctgcagagctctgcgcatgcggtctcggggagaggctactctgtaagtctcccagcacccctcctccatctttgtccccctggggccttaggaccaggtccccacctcacctgtccgaggccccacaacttagctcaccccagtcccgtgcccgctttccctctggagccccagactggttctggcctcaaacaccatggggttggtggggggtggacaagctccagagtgaagatttgggggtgcgtcctgctcacggtttgccagggggcccccaggctaacatgctgccccagggggacgggctggccctgtggctgtggccttgccaggagcctcagagtagtcagcctgcacagaccccagctgcagctaagggtgccgggatccgcggggccaaggccgggctgcttcttggggtcctgttgggggcctgggacatttggtgtgggaggtgcccatggtgtgagcagccacctccaatgccctgaccggcacctgcctcaccccggacagaaaggcctgggcccaggctgggcaacacccagggagccagcaccccgtggcgggcagggggaaggagacctgtgtgcagccttcatgacgggtgtgtgcccagggggagcgggtgtgtttcccggggggagcgggtgtctgcctggggggagcgggtgtgtgtccgggggagcgggtgtgtttcagtgtgtgctgtgcctccccgtgggtgcacgggtgtgtttcagtgtgtgcctgagagaagcaggtgtgtttcagtgtgtgccgtgcctccctgtgggtgcacgggtgtgtttcagggtgtgcccgggggaagcaggtgtgtttcagtgtgtgccgtgcctccccgtgggtacacgggtgtgtttcagggtgtgccatgcctccccgtgggtgcacatggcacggtggagggctccttgcacatgtgcctggacttgctgtgggaatggcctgggaggctgggcgccgacccctgccccccggacctggaggcccagcaccatctccccggcccccatcaccactgtcccctgccctcctcatgactgtgtttcattttcccttaagtatcaggaggaacattaatgacaacataaaacccagagctccataaaagccatttctacagattgacggcctgctgggctcgtgggagggtgggggcctggactctgcccaccccatccctgcagcccccgaaatttccaggccgtagaggctccctcactaaaccacagcagctttttatagggtgtgtaattaaaccaggaatgacccagtgtggccaggccagaggggacacagcctggtggggacggccccccactgtctctgtcccacagcttctgctggtggcagagcaggaagcggcaagggagcggcatgggcggcgcggccacaggccaggagtggaccccaggatccctggacccagcctcatgggcaggaattggccacttggctgggtcacagcaggggctcagccaggccctttgcacccccaccccagctcccctgaggctgccctttcacctgaggttctgtctaaagccctgggctcagctctaccatcctgggctcttctctgccaccctgggctcggctctgccaccctgggctcttctctgccaccctgggctctgccaccctgggctcttctctgccaccctaagctctgccaccctgggcttggctctgccaccctgggctcggctctgcacccctgggctctgcccccctgggctcttctctgccaccctgggctctaccaccctgggctcttctctgccaccctgggctcagctctgccaccctgggctctgcctttggcctctcacctggtttggcccagagtccgtgagctgttgacctggggtggctggagctcacttctgggcagtggttcctggagcagctgcctgcccaagggccctcttcctagggtttccttcctcctgtgctgcatggggtctcaggcagccttgctgttgtcacctgtgcgcgggggcaacccctcagaggtggctgtgggtgtcctgacagccatggtcatgagtatgatgacactcctccgcccttcccattgtcatgagtatgatgacactcctccgcccttcccatcatcatgagtatgatgacactcctctgcccttcccatcgtcatgagtatgatgacgctcctccgcccttcccatcatcatgagtttgatgacactcctccgcccttctctgggcagtgtcctgacagaccagctcctggtgtgcgtgttcagggtcagagtgtggaaatgggctaaggccacctggctccggctgctgggaggcacctgggtcaagtggggtgtcctgatgcagactccatgggcaggaggactgtggcccccacataggtgccagactgtgagtgtcagtgacatctccgagtgctgggcaggactcctgtcggctcactgtgggtcagggggagggccgggtcttaagctctggaaggtgggctctgccccctgttgctggtgaggtgtgcacgtggccacctcctgtggccaccccagctggtctgaggtccccagggcacctgggtctctctgccctgagccactgggtgcccttctgcttctgggtctccactcattattcaagtcttctccccagagcactctgtgtttcctgagaaagcccgttattaacttgccagctgcttgcagcttaacccccacagccgaggcacacaagtgacagatggcggggtggggggtggggctggggggtggggggagggggaaggggggaggggctggcctgctgcactggggatggggttcccctccaagccgcaggagcctgggaggaccctgagggctgcagagggtcctgtgcgtgtgcactgggccccagcacacacatacctgtttcagaccctggtgcatacagatgggccctgccatgtgcaggtgtgcacccggggccttggtccagtgtggccctcagttgcccatgctgtcagccctgcgggccccttgtgtccagtgtgggggggggggtgcaggtgagagcccggggtgcaggtgagagcccaggctccaggcagagagcagggaggtgcctggcctccttggaagtgctcttccccggcactgaggactggaggcaggtggaggccagaccaccccaggggtggaggaccaagaaccggtcccatgggacgcatgcccaggagcaggacaggacccaggagcaggacaggacccaggagcaggacaggacccaggagcaggcgaggggcccaggcgagggtctggattgtgctgaagcctgggacccactagtgggggtttgggacttccctgaggcctcagactcctgggttgctccctaggctgaggctgccatgtgtgtgtgggcgtgtgtgtgcatgtgcatgtgtgtatgtgtgtgtgcgtgcatgtgtgcatgtgcgtgtgggcaggtctgtgcctgtcctgtgtgcagctcgtgtccgtggtacccccgtgtggtgggctgcatggggctgtgcgttgccttgtagaacagtgtcacgggttcctctctgggcctctgtgtgtgcgtgtgtgtgtgtgtgtgcacccgcgtgtgtgtgacctgtgtttgtgtgtttgcatgctgtgcatgtggcattgtgttgtgcacatggcgttgcgtgttgtgcacttggcgttgtgtgttgtgcacgtggcgttgtgtgttgtgcacgtggcgttgcgtgttgtgcacgtgtgcaccccttgccacctgcctgtgactggggcctccagcctaatgagaaggcacagccaggccagcagcctcccgtgttgctgagtggcacaggcattcatcacctggtctggttttatgaaccatccttagagtggtgtaattttgtccacattggtggccagcaaagccccagctattgctcatcctcagcagcttgtgccccaagtgtgtggtttggccttctcagccaccgtcagtgctgtaaggtagagttgcttccacccaaggatgtggtgactgactccagcgtggcagggggctagtggatcgattagacagaatgaggatccacaagagcttgctggggttggagccattcctgccggcacaggaccctggcttgccctcccacacccatgcacagaatgttctggaggggcctttggccagcaggagccagagtgaggggctgggtgagctgcagggtggtggtggcagcccatggtgaggcccaggcctcagggacccatctcaccctgcacacggcatttagttaccagatcatcccgttctccagacaggatcacaggcccagagaggccaacagggccccccacctcagtgactgggagctgagaccctcagacctccctcaccactcggccatgcccacccagaattctcctccatgcggctgcccagccccttgtgcccatcaagaagagccatctgcctggctatgcccacatgccctactctgcccccagtagcacccacttggccacagcccccccaggcccttcctgtccccactggcaaggtcctccatcagggtcacagatgcccaccctgcacaaactgaggtgtggagaaatccgtccccttgcctcccctccagcccatgtgtgctgagcgtgtccatggccgggcatgcacacagggagaaagatgggaaagacctgggtaagggaagccaaggagtcgctgtcccaggcggggtgttaagcgcagtgcaggagggtgggagggggggccaggccagccgaagcaggcataggtttgaacagaggggccggtgagaggccctgaggcccctgaggaaggagcccaccccgtgtgcttgggggcatgcctgggacagggaggctggaggtgggtgggaggagcagagacccagccaggtgggacactgcagatgcccaccagccgctggggtcccgctgccctcgctctgtgccagggcccgatacaggcgctgtctttacaaggcaggtttgtgacactcattacggggctccttgggcctcttctgagcagccacaacttgtacagaagcaataaaaacccatcagcctctccctggagtcagagagccacggtctcctcccaacccagcctctccctggagtcagagagctgcagtctcctcccgacccagcctctccctggagtcagagagctgcagtctcctcccgacccagcctctccctggagtcagagagccacagtctcctcccgacccagccacagtctcctcccgacccagcctctccctggagtcagagagcctcagtctcctcctgacccagcctctccctggagtcagagagcctcagtctcctcccgacccagcctctccctggagtcagagagccacagtctcctcccgacccagcctctccctggagtcagagagcctcagtctcctcccgacccagcctctccctgtagtcagagagccacagtctcctcccgacccagcctctccctggagtcagagagccacagtctcctcccaacctctgagcatagaagggtctttcaggctggctgctgtgtgggtaccgtaggggtgggggctgagccatgtcctcgccccatggtgggcacagcccgcacccatctgctcacccatttgtccatctgcacccacccacatccatgcacttaccacctgtccctcgtctgccacccatctgtccgtccatgccacagtgatcatgtgcctgagggcagtggcctcagcacagcctgactctgggctgggctccatgccaggcactgggttgtgaggagcacgtcacacagggtccctgcccccagggagctgccattccagaggggagaggagccagtcagtaaagagagcagcagctgccaggtcggaaggaaggtggccggggtcagggcagcatctcagaaggggcaggccagggtgtctgagtaggggcaagcctgtgtgtgcagaacctgaggcgggtgggtgccactgtgggagagaacagggaggggtgcaggggagctgggccgtagaggatgggaggctgtgcagatagtaccactatcccccaccaccccaggctaagtgacaaaggggctgacccacccagtgctgagaggggcagggtccaggccaggtttgttccagcagcccaagcaccaccactcagccctgggaggtcagcatgggggcagcagggacttggggtcctgggaggtggccatcctgccgtccgcctccactccagtcctggcctccatgggctgcgggagggtgggacgccacgtgcgttgtcgggccccaggtgaagggagtgtctgcgtgtgagaacaccttcatctccatggcatttagatcatctgactcctccacctgtggtatttgattgcaaacaggtgaggtccatgaggagacctcgcctccatctgcagatgcggaagccgaggcccaggcatcagctgcacctgtcgcaccctctgccagggcggggtccagatggggccaatggatttggtcccctccctgtccacctttttctcctcgccacctccctgccccacatgtgcccacacagggctcacttcccgcagcgggcacgcgctcttttatctcctgttttgtgggtcagaattgagcaaggctcagcccgggtggctcctccatgctgcactgtgctcactggggtctcctggggatggtggctgggctgggtggagggttcagggtggctttgctgacgtgcctggcttctgggccttggtggctcaaggcccaggcagctgtggccagcccttgcagagccttagccaggctggcagcaccattccagcacattctgcaggtcagagccccccagcccagcccaggttctaggggaggggttggaccctggcctggaggggcctcatgagtgccgcctttcaccccacccacagctccctgcagcgctcccaggtatgggggccacagccatccaccaggcaggacagccccacagggcagggagatgcctgaccaaggagggtggcacaggcagtgaaggtggcggcgcacagccctgctggagagggccaggccagagtctggggtgcccatcaagctgaaatccaattatgagaacaggccgggctgctgtgacacgggggttaggaattaatgttaacactgtttctggttaagactttttgtgttgataaataattcatgaggcagttagcactttgagcctgacaacacgagaatatattaatacggtcggctccaagaaaggtcagccacgtgcttggggccagggggccatcttttattcattccctgacacaggctcattaattattctggcccagccggagctgtgctcggagggacactaatgagaaaaaggagagtggatttgagatccacacgccatccgctgtggggacgtagagggagagatggaaagaaacactggtgaggcctctgaggcgggatggggcctgcagcctggctccctgacagtgctggttgggtgtgaagaggtgagcggagctgatccgcaggtgtgtggggcactggctgccacatcccagctctcccagagagatgaggaacaggagcagatgcagccagtatcagagagcaggaggtgcatggggaagtgaggctgaggctgtgggtgccccaagcacactaggcccagcgggtgcaggaacccccagagaagccactgagcagagacccagaggggaggctcgcagggccagcggttaggagtcctgcatgtgtgcacgtgtacatgacagtgtgagtgcacgtgtgtccatgatggtgtgcgtgagtgcacgtgtgtccatgatggtgtgagtgcacgtgtccatggtgtgtgagtgcacgtgtgtccatgatggtgtgagtgcacgtgtccatggtgtgtgagtgcacgtgtgtccatgatggtgtgtgtgagtgcacatgtgtccatgatggtgtgtgagcacacgtgtgtccatgatggtgtgagtgcacgtgtacatgatgcgtggatgtttgtacatggtgtgttgtttacatgtacatgacagtgtgtgtgccacgtgtgcatgatagtgtgttctgtgtgtacatggtgtgtgtgtgtgcatgtgtacatgacagtgtgccatgtgtacatgatggtgtgtgagtgcacgtgtgcatgactgtgtacacgatggtgtgtgagtgcacatgtacatgatagtgtgtgtgagtgcacgtgtaaaatggtgtgagtgcacatgtacatgacctcgtgccatgtgtacatgatggtgtgtgagtgcatgtgtacatgacggggtgtgtgagtgcatgtgtacatgatggtgtgtgtgccacgtgtacatgacaatatgattgtgtacatgatggtgtgtgtgccatgtgtacatgacaatatgattctgtacatgatggtgtgtgtgccatgtgtacatgactgtgagtgcatgtgtatatgacagtgtgtgaatgcacatgtacatgaaggtgtgtcgtgtacatgatggtgtgagtgcatgtgtacatggtgtgtgctatgtgtacatgacagtgtgtgtgccatgtgtacatcacagtgtgtgagtgcacgtgtacatgacggtgtgtgtgtgagtgcattgtacatgatggtgtgagtgcacgtgtacatgacctcatgccatgtgtacatgacgtgtgagtgcacgtgtacatgatgtacatgacagtgtgtgtgagtatacgtgtacatgaaggtgtgtgtgccatgtgtatatgatggtgtgtgtgagtgcacatgtgtatgtgaaagtgtattgttatgtgtacatgcgtacgtataactgcatgtgcatgcatgactgcatgtgagtgcacgtgtgtacataaatgtatgtggctgtgcacatgtgtgtacgtaacggtgtctttgcatgcatgtatatgtgatcatgttgtgccatgcctgtgtggtaacgatcacagtgaggccaggggctctgcaggcactcgggggtcttcaggctgacgtggggtggggtagagtggaagcggctggtggccagctcttgtcaccaggaacccccttgctgtgtggagacagctggagggccagagcacaggggccccaggtggccacgctcgacaggatgtgagggcagagggttagggatggccgccctgtcgtgtggtgggtgccctctgctgtgggtgtgaagcccacggagtgtgtggccagggacatgtacttaacaggaagaggtggcactcgggtgtagaatggaaagctgttcagagtgagactgttcctgtccagtgtgtgagtcgggccgagcccagaggtggctgaggtgggtgctttccccacccacgtcccatggcgtcacagcacaaatgccagtccagcctgtccagtgtgtgggttgggccgaacccagaggcagctgtggtgggtcctccctggcccgtgtcccagggcgtcgcagtgcaaatgccagtccagatgttcctatttgtggcagtcgcgacttgagaaaattaaaggtgattttgtgcattttaaagcatttagacccaaggctcaggtggtgctaagcaggtgtctaattctgcacatgtctgatggaatgttctggaattgtattggggctgggcagtgctcccttgaggactggcccccagcacctagtgccccaatctttgtgacagttgggagcccccacgaggatagttttgtcccctccaaccacagtgtggggcaacaggcaatgcggacttcagagcccaggccgcccacacgtgtgcctgctatgtctccagctaagtggaccccatggatccttgggaacaggatccatgttctcaacagacaagaccatggataacaaataagcagctgatcggagatcatcgctgggtgggatcagggtcctgagcaggagctggccacactcgtgtgcaggcgcagtggccaccactgcacggagagctcgggggaggggccgcagagccctgagtgccaggaggagccagactggctgggactcgaagaagagcattgggggaacgggctcacccagatccctggtcagagtgagcttgggtgtggctgggctgaggccctgtgacccaggggccggtccctggggccaggcctgggagggagttagtttgattcataggaggtcctgagacggaaggggcctgggagggtgtgttctccagctgcctgtccttctaaccagggctccagccccacgttctcgccgacgcagggctctccaggcctgctcccttggcagctctcagggaaagttcagaaatgcatcgggagatcctggggccagaggcaggggtgccagccctgcagccccaccactcccctttcccatccccagctgtctcttcacgggcctggactggaggtcaagggctgcctgagtcctgcaaggcccaaggcaagcacggactgtgccaggtgcactgagtgggggcctccagtgggcgacgcagagcccagagctttccctggcagtgatggccacggggccgccacgtggcacagcctctcctgagggcttgagcccccaccgggaggcaccctcgcaggcgggcgcacagcccatggggccttggcactgtggggagggtgcacaggcaagtccggctctggcgtgtctgctccagagcctcactcacctgcagctcctggaggctgtggctgttggctgcagtgacttgattgcttgttaattgctcattaattgggtaattagtgctttgttgtgctttgaagcctaaatactcataaaaactgaatttgctgagtaagcaaatatagcatttttcttcaggacccaccacccggttatcttgtgtaaccaggttgcaagggtgcctccacctcccaggacagcgagaggaaggtgggcctcagtgtggcggggccctgaccggagggtgagagtggcctccagggcttctgccacagattccagagcctggattcaggattcagaacccacccagtcacccccggtctgtgccctggtgggctcccatgcactcagtcctcagtttccccatccggcagcaggtgggtctgtggcgacttgcaagtgagcccagtgtgagccgcatccccacacactgcccggcccccacccctcgggctccatggcagctctttccaggcgcctgctcttccagtctccagagaagaaaggcctggggagcgggcggagagtgtctatgctaggatcagggtcagagagggaggagctggccgtcaggtgggccaggaagcctcagtcccatgccccggccctccagcccgatgcccacccagtcctgccctccagcccgatgcccacccagtcctgccctccagccccatgtccacccagtcctgccctccagccccatgtccacccagtccagtctcccagccccatgccccacccacccagtcctgccctccagcccgatgcccacccagtcctgccctccagcctcatgcccacccagtcctgccctccagccccgtgcccacccagtcctgccctccagcccgatgcccacccagtcctgccctccagcccgatgcccacccagtcctgccctccagccccgtgcccgcccagtcctgccctccagccccatgcctacctagtcctgccgtccagcccgatgcccacccagtcctgccttccagccccatgcccacccagtccagtctcccagccccgtgcccccacccacccagtcctgccctccagccccgtgtccccacccacccagtcctgccctccagcccccatccacctagtcgtgtccttcagccccatgcccacacagcccagtctcccagccccgtgccccacccacccagtcctgccctccagcccgatgcccacccagtcctgccctccagcccgatgcccacccagtcctgccctccagccccgtgcccacccagtcctgccctccagccccgtgcccacccagtcctgccctccagcccgatgcccacccagtcctgccctccagcccgatgcccacccagtcctgccctccagccccgtgcccacccagtcctgccctccagccccgtgcccacccagtcctgcccttcagcccgatgcccacccagtcctgccctccagccccatgcccacccagtccagtctcccagcccctgcccccacccacccagtcctgccctccagccccgtgtccccacccacccagtcctgccctccagcccccatccacctagtcgtgtccttcagccccatgcccacacagcccagtctcccagccccgtgcccccacccacccagtcctgcccccagccctctctcagttgaccccaggtccctcccgccaggtgccacctcccctcggccttgggccccattccctgtgggccaccctgagagtgcgcccagctggtcccggccacctacccaccctggcccgggccacctacccactctggtccctggcacacctccatctggcctggtgcagcagcagagcccagccccacactgtctcctgcacccaaccctgccagaatggaggccagacatcccctctcagtggactccacacgccccctgacccgcccaccacacactgtcactgccagccatcccgtgggcttccgagccacctgtggtgtgtgtggcgcctgctctgggctcaacacatcagcacctggaaccaggctccagggcaagcccactgctcactgcacctgcctcacccgggggggcccctccccgatggcaggaggactcccagccccacacctatggccccacaagcccagatccccagatccccagatccccagctctgagtcctgggctcagctccaggcccttgctgagtagccatacagctgaagaaagttatttccctctgaacctctgcttcctcacctatgaaatgggctgatactgctgtgacactgggggtacagcctcccaccacacccctaccccaaggcacgtcaggtgcaaatccactgtgagcctggggggcagagccccacaccacacccctaccccgaggcacgtcaggtgcaaatccactgtgagcctggggggcacagcctcccaccacatccctaccccgaggcatgtcaggtgcaaatccactgtgagcctggggggcacagcctcccaccacacccctaccccgaggcacgtcaggtgcaaatccactgtcagcctggggggcacagccccacaccacacccctaccctgaggcacgtcaggtgcaaatccactcagtgggccccacccatccattctatgccagtaccgtggatggccaaaggtgcctcaccctcaagtgccagatttgggccctgcagctccagcacccacacccgtaaccccctgcccacgaggggccagcagccccgccagaggtcatgcacccccccaccccggggacagctgcccagctgcgtggggtgagtgcacaagtggctcccacctggcggtgcccccccaggcagcccagttctgcccatgcaggggaagggaagtggagcctgggctaagcccacatggtggaggggtgcggattcacaggactgaggcggccgaaaggggctgagagtgacctttccaatcgtgagacatttcacacagtgtgaagctcaactcgaaatctccccagctgctctcagccctgggggctgccggtgccacgccagcccctgtcccttatttcagccgaatcgcttgattggaatgcattgcatatcccgcccgagcgtgcggcccaaatgaaggtgggccccttggcactgccatctgggaagatggggtcccacagggcagggcacggggcccacagccactcatgcttctgccccatcccttccagagctgctccccccaccaccccgaaccatccgggttgctggagtttctgggctgcaggttcagacagaataggtgaagcagccaagctgccgtctgccccacgagggcccagcacaggtggcgcaggtggtccttttccccactcggcggcacgtggctctgtggcaggtcctgaggcacccacatgccacgtacagacattgggacacgtggcaggacactgagggcagaagccaccaagggcaggatgaccagatggcacagggaggggccaggaactggcacacgcaggacgcgccacggcacatgtgcacacggcagatgctcctcgtatccccgggcacctgggtgggcacgcgaggctcaacagggccccacggaggacacatgtgcacactcaggccacacatgctcagccagggtggggcttccgcaccggtgttcccagcagctcggcctctcacccgacactcaggctgggcctttccactccatcctgcccacaccttgccactgttagaggtacctcgggttggtgcaggcgcccgtgttgttggggtgttttttctgctggtgaggaggggtcagggccccctgccccaggtagttctgctcaggaaccttcatgcagtgcctcagagcagaaacccggccctcactggccctgcctcagcccctctcccacccactgggcccagacagctctcctggatgggaagctggggaggtggaagcagaggctggcagtgtttccagcacccttccccaatgctgggcctagaccctccgcaggacagccccttggcccctctgtctcctatctcctccccaccctgcctggtcggggccagacactgagggacccctgggagcagcaacctcagcgcagggtccctgcttatgaatttttcatgcctttgtttgagcagtgggatcaggcggcccctgagcacaccgaagccataattaacacttgcactgggaaggggaggcatgtgttctttgctgcttaatagccgtgctgctgatttgtgtctccccatgtgtggggctgacaggcagccccaaccccaacccgtagccgcccagggtctggaaggggtgcagggaggcctgggtgatgggggccaagccccctccaggctcttcgggtagcaagggtgcactgcctggctgtggggtgggctcagatgcctctgagggatgagggaagggggaggggttggtggcagtggtggtgacagtgacagtgaagatgacactgatggcagctcccatttatgaagcctggccgccagcggctgctgtcctgagcctgccacgcacgttgcctcctccgactcagaagccccatgaaggtgccactgtctctgcagatgaggaaacaggctcggagaaacgaagagacctttgccacggtgtccagtgtccacgaagcagtggggccaggacctgcccacgccgggctccgtgaagcagtggggccaggacccgcccccagactgagttccagggtgcacgttaactctgggctgtgcccagcattcgacaccccagggctggggcccagaagctgggggaggtgttgggaacccacagggagctgtcaggtggggatgcagtttcctgttctcagcaggaagcagccatcggtgctcatgagaagtctccaggtgctcaaatgttggcagccaattttaaaaaaataaatcaggccagaccaagcccatgtgcccccctacccagcttgtggctctaaaagccatgtctcaaggccgttgtccacccacgggtgagggtctgggaaggccgctaatggagcctggaggtgctaagcatccccaccgcatagccacatctgtgaaaacagtgacacgcagtggcccctggggtggttggggaagccactctcacggaggacgaaaccggtgcctgtgcttccgagccccactgcggctctcacacccagcccgggatggaggtggggcagatagagcttcccagggcctgggggagctgagctgcgggcttggggtggggagccctgactcacgcctggcctctgactcgtgccgctgagtggtctggaacccctgtcgggtgcctccctctggccaccccacaccttaggcgtgagggccggggccctgggcaggaggaaggaacagagcccagtggttcaggggcagagcctgcccccacggccaatcaccggaatcacccggctgctactccccaccccaggcacccgggtttaagtggtctaggggccccgagcctcggtgcggcttaaaaccagactgactgagggcgtgggtggagacaacaagtactgagaagtggtcacgagggccattattggatggtgaggtccgacagactcagaggggccttgtaggctggcagaccatggtacagggagctgctgcctcctggctgccattggagctcaggacaagcagagaaggagagacttgatatcggggtctcctcgtggctacaggaaggctcacctttccagccttggccatcagggtcatagacaagcgtgagcactgccagggctaagagactctaaaactcccagaccaggacttcacctacgccagggtaaatggcatcttctcgttcttggctttgtgggcagacaatgatggtgatgatggtggtgaggatgagggtgaggacgatgacctgatggtaacgacagtgatggtggtgaagataactgatggtagtgctgttgaggatggtgacgtgaggacggcgatactgatgatcatggtggtggtaatgaggatggtgttggtggtggtggtgtgaggatggtgacgatggtgatggtgatggttgtgacaatggtgatagtgattatggcggtgatggcgatggtgaggatgatggtgatggtggcaatggcgaggatgatggtgaaaatggtggtgaggatgatggtgacggtgatgagggtgatggtgatgaggatggtgatggtagtgatgatactgtcatgtgtataatgtactgactatatatcaagcactgccttagtgctttgcacatattcacttatttaagccacacagtaatcctatgagctgtaagggacaaccctgtaaattgttcctatttacagaagcacaaactgagacacagagagctcagggcctcgcccagcatggggccgtgcggcacggagctcagggcctcgcccagtgtggggcagtgcggcacagagcgggcgtcttctttggagcctgagtcttggcctcctgaccatgcccagcatgtcccttcggggcctggggtctgtcctctgctcccaggcattcctgcctatcacaaacccacaccagggtgacgttccctgagcccccgagcccagccccggcgccgtgaatggtcgcctcactcgggcagcttccgagaggtggatgtgtctctccttttctcctcgccctgattaattgcctcattcaatgccgactccactgcagttaaacattaattcagtaggacttaataacacgaattcattcacgcccctgcctgcgcctggctgacagtgccgtgctatttggttaatgagaggatccatgcagcgtcctctggtgcgcttgctggaaagcacccctcagtgtctccttgctgttggatgcattaaaccctcgcctgtgtggtcagcctggctgggtccagccacagacctgaaacccacggggagatccgtaaccaggtccgggcttgtgggagctgctggctctggcccatgggtctcggggccaacccaggctcaagcagggatctgggtgcggggataagagcagaggctggactgggcaggtggcccccaggccacgggtgcacccatgtggccccaagtgtcaggctgctctcgaggcctgattggccagaaccctgacagtctggtgggattgcagtttccaagtcaaaggctctgcagcgcaaattcagcagggagaggcctcactgggggtccccagaaatcccactgtgaggctagaagggcacctgactcccctgcaggcctctggatgctggtggggctgcctcctgtcccacctccagggcgcactccctctcggccctccccaggctccccatgtgcagagggcatccttggcacagtctcggctcctgctttgccctcttccggtcccctcagccctggcgtgttctggcatgttcctcccctcccctgcgctccccgcaggagcttgtggctttcccctgccccacgtcctggtctttgcttcctttgctcctggctgagcctgggcagttccatttcatactttcctcaccaaacaccaaggcccgcccatatcacagcaggggagatggaggactcagaggcccagggccaccagcaaagctggtctgcatgtcggggtcctgtggcccagcccttggtgagctccgcacctgcagcctccggggcgggatgggcccggttctgacttggagccctcagttcttgtgtggtgggccgggctgggcgggtgcaggtgggactgaggcccttctctacctctcaccctgaaggccagaccgggggaaccctaggagagggcttggccacggctgaaaggccagaccggggggaccctaggagagggcttggccacggctgaaaggccagaccggggggaccctaggagagggcttggccacggctgaaaggccagaccgggggggaccctaggagagggcttggccacggctgaaaggccagaccaggggggaccagcacacagccgggacagacagcctgggggagcctgtcagcctcaggagaccccccccacaggcccaccccagctgcccagcttccccaggggtcccagctggggtcccacttgtaggagccacctggagtgtgactcgtcatgcgctgggagcagcacgttctcgctgcagagtgtctgctaaagcgcatttcacaccgtactgtgagctccgtcgctgaacactcggcagccgcggctgcacatggagggtggctgtgcgtttggttccctgcattaacccagtgggctccacataggagggcgccgcccacacatccggctggcactcaccaccctccgtgcactggggggtttattcttccaccaggtcattcattcgacgtgaatgcctcataattgcagttgccaggaggggatttttccccttttgactgtttcgggggacattgcagtcagtgtgttcttcgtagagctctgcttactgaaaacggagaacggacagtcagtgtgttcttcgtagggctctgcttactgaaaacggagaacggacagtcagtgtgttcttcgtagggctctgcttactgaaaacggagaacggacagtcagtgtgttcttcgtagggctctgcttactgaaaacggagaacggacagtcagtgtgttctttgtagggctctgcctactgaaaacggagaacggatttgttttcgggattatcacacccccaccctaaccagccaagctgacaaatggcgctggcatcgagtgtctaaccctgagcggccgtggccctccgtgcgctgccagcccctcctctgcccccggctgtcctgaccccaggggctcccaggctctgcccaccatcaggagctggggtgcctggatctcccagcccatgtggtgccatcgatcccctcagggggtcactggggacagtggggctgtcctgggccggaggctgccctccttcctggtgtgaggaaggctctggctggcccaggatgggggtcttcatggccgccctgctctgagggtctggccagtgagggctcctctcgggctgcagggccagtcttgtccccatcgctggctagtcggcctggctgtgcccctttgtccatcccacccggggggctgtgatccaggtctgtctggtgcagcactgggccctggcccaggttcctcctaaccgccccgaccacctgggcctgctggtacctccctctcctggcagcagccagggccgccccacccgtgcccctgcagcctggctgctgccgtgccccggggggtgacactggttggtggggccccgactcacttctgtctctctgtccctgcagtgtgacagcgagagcggcccggacgacaaggtaagcccagcgtcctcctcctgggctcggctgacagccctgcccttccctgctgaccttggccctgtgaggtgggccctggagaccaggcagaagatcgggccttggggggatccccccgcccggtgggtgcagggggcttgtggcctcccaggtatgggggtgctggcctctcctggctgtggaagagcctgtccagggctggggccggtaccgtgtctggagggacacaggcccaggtgggcatcagtgctgccccagccaggagggtgccctgggcagggctgccatggggtcgagcacatcagctccagctcctgggcagcagagggcagctgggcctgtgccccaggactggccccatcagtcctgagggagcaggggcagagcccagcccccaccctaaacccggtggaccccagaaccaggaggtagatgcgcagcctatgaccacatcacagtcaccctcagtgctcaggagcaagcaggattcctgcagcctcagccaggagtgaaccccccgggcagcccctgagccacgtcccctcagcctcggagcagcctccgggggggctctccttctgccccgcttgccccagagccctgcggggaggaaccgtcacctgctgtggccgaggagcatcaggccccggagggcgaggaggccaggcaggtggcgtgaggtcccggcccgtaaccactgcacctcactgtctccctgtgactgccaagggctacccgggggcacctggacgggggtgagggccctgccagatgtgccaggggaatggtcaccccggcctcagggacggccctgcagaggcccgaggcggactgcatgtgtgcgacgattctcgccctgagccagggagacgctgccctgggtttccaggcaggtttttatgaatggaacagttccatgaggggtctgcacaggggttaggggacgcccactgtggcccgtggcctggcaggagctgtctgggctgtggggtctcacagctgagggcccggtgggggtccagatattggagtcagtggcggtggccgggggaggagggtctgggcggttcagttttcgacgtaccaagaagtcaaggtaagtcgccgtggaagccagaggccgcaccgtcgccgcggcctggggtctggggcaggcgccgtgtgggccgcagtgccgggctcagccgtgtctggggctccagcatcctgggctgcttccagccacgatgtccctgcccaacacacctctcctcgcccgtccgcagatggacactgttggggacgcgtcctggtggtcacaaagcccataggagtggcctcacccgggaccccgcgtggctccgcgtggccctcagcccctgcccacagcttccgcgcccgaaccgtgacgggcctaacatttcagatgagtaaccttgtcctgatctcaggaatgaaatgaggtcacgggcacccaggaaatagccactcaccccctccccacctcctttcatttaaaagcagtttttggggaagacaccctccacaaccaagggttgctctgagagaggcaggaaggaggggatttcgggagcctggggcctactgggggctccctctcccctccccgcctgccttaccgagatgaggcaaagccacctgtggccccggaggccaggtccacgtggagtcggcgatgccggcggggaaggctgacagccgcccccataactgcacgccccccatgtccagcaaccaagggtaacgccagcctccgagacccaaacgatgtctgtgcaggctgtgcctgcagagatgcggcccctgcccgggcctgggctggaggccgaggggtccatgggagagcacaggctgaaagagggttctagaatggggtcaggtggagtctgcacactggggcgtttatttctgagacgcccaagcagccccaggggagatgaccagctctgggcggtgtcggggaggctgagtccagtccagggctctgcacacggagggtcccggcagggcgagtttggcattcctgcacacggagggtcccggcagggagagtttggcattcctgcacacagagggtcccggcagggcgagtttggcattccgtgccgttggggccgtgttggggcttctagggctgtggtggccacaggtcctgaggaggacagcaggggagggagaggggctgcggaggacggcaggggagcggagaggggctgccagcctttctccagggcagaacttcgggtcacgcccactctggggagagcagagaggcctggcggggcggggacggagaaggcagctccgccaaacactgagtccccgtgatggtggctccttctggctgcggcaaggtctgagcgccggcgcacaaagcgggggcacggtgctggcagagtgggtgggacctgcctgtggccccgtttgcttctgttggggggcagctcccggaggctgctcggggagagcagcagggtgggccaggaaaactgcaggggcctctccttgttggcccgtcagcctgtccgtctgtgtgaccttggggcatgctctgaggggtgtgtcccaggctgactcaagacagctaagccagaggtggggacgaccctggtgcgttctgggagccggcagtgcatcctgggctgcagcggagcgagagagaggagcccagagccggcagcaggagtttccgtttccctccgagtgcatgggatgctgcaccgtaggactcccccgtccagacgtctccgtttccccatggcatccagcccctgatgctcagaaattagcttcctgagtttgggagagttgggagggcaggaggcctcaggtccctcctggtcttctctgcccggcgctgggttcagggggtcaggaacttacgctgggcggagggtgtgcgtggagcccatccagacgcacacagaggcgtaggcaggtgtgggaagtcagccagcaccccactggccgtccccagccctcctccctacccgctgggagcagaggcacccagatctctgtccctgggcactgctgtgcgaggccggcacccctgccagggagcaggcaggagggacagagccctgcaggctccagatggcagaattcccggctctgagacaggaacatgggggtgcttcgcatcagcagtgcccagagcccctcagcagccccgggcttgtgtggaacccgtctgtgaactggatatggaaggaaggtccccgagtgcccacatttacagggaccctcagagacctcactcagacctgggaggcccattgctcacatggcctggctgctcccggtgggcagaagatggagaagccacagacagcgtcctgcgtggggtctgtgggcgctgacccagcagccgtgcagggaacagccctgcccgcagaagcggatgccggggcaggtggcagtgcaccccgaggaagccttctggacggagtggtggggagggcgcgggcgcatgtctcaggccagtgcacttcacatctcatcccacacctgcgggtttgagcttggtttggggtgccagctcccacctggccagccaccccttggggactcaccctgggctctcctgccaatcaaggtggagactttgggacagccctcctccacgtgaacagactgaccgagacacctctccaccacctccctcacactgtgcccgcccagccgccccctcccctggcccttggcaggaggctccttggcagctgacgggaggctcgggcactgccagatggccccttcgcaagtcttcggtttgtgtctaaccactttttccttggaaaagtgtggggtgaagagcgatatgggactccataggcagccgccaggtggtggtggcctcgctcctcctgctgccgggggctgccacggccacctccagggatggctgtctggcccgtctgtggaagcccatcaggaagcacccccagtgccgggcctcagccaagagcaccggcctggaaggggcagggctgggggacagtggcatgaggtcagacatggcgtggggccgaccccgcaggcagcccaccatccacagcctccatgttctgtctgcaaaatggggccacagtggggcctgggcagaggagagaactgcccactgccccaagcacggtccccagagagctggaggccagccagtcctccacacccagcccctccccagcagacccttcttccagtggggcgctgtgcccgactgggtcctctctgaacctctgccttttcgtcactgaagttcgtaggttcttgttcttgggaactgtgagttcaggcactaccagcacgacagccagagggacggacggacggctggacaggctggaggcccctgccatgggcactcaccccgtgggacagacagaaggatggatggacggttggacaggctggaggcccctgccttggggcactcaccccgcaggatggacagaagggcggatggatggctggacaggctggaggcccctgctatggggcactcaccccacgggacagacaaaggatggatggacagctggacaggctggaggcccctgccatgggcactcaccccgcgggacagacagaaggacggatggacggctggacaggctggaggccccttccatggggcactcaccccgtgcgacagacagaaggacggatggacggctggacgggccggaggcccctgccgtggacactcaccccgcaggacagacagaaggacggatggacggctggacaggctggaggcccctgccgtggacactcaccccgcaggacagacagaaggacggatggacggctggacaggctggaggcccctgccgtgggcgctcaccccgcagttgctgggcctccgtggggtcctgggaaatttcaacagcagtccagtgtgcgggccgcgcctttgttctgtccagccagcggcccaggctgcgcctttgttgtatctggccgccggcaggccaggcaccttctgaggaagggttgctgcgtgtctgtggctcacggaggccttcctctgtgtgtgactcacaccccccacccaccccagcccacttctgggagcatcttcctgggggctttggaggcccatccattcttccctagggacaaaagtgcagggagcggcgtcccaggtgccaccgtctctggggaacgtgggccaggactccctttgctggacacagaccctgcccacaccgggtgaccgtggggtgacctcacagggtgtgtggggttccgaagccgccaccctccttcctgagcctgcactttgacctgggactgctgagcccagaagggccttgagagggctggctcagtggcacgtgggggccttgggtggttgggtccccgagacaggccatctcgctccttgtgtggcaggctgcggggccctgcttgcctgggtcccacgtggtagaactcggcgtttggtgggggcctgctggggacaggaagggacagcaccccaccctgagctggcactcatgcttcactggagccaggcggaggggccgagggcaccggcacaaggtgcagacgtgtcggtccctttgaggaccgagatcatgaccaccacggagcaagcgcccgggtcctcagatcaaaggcccaatagccagtgaggcttctctgcactggtcccagcagaagcggggcctggctgaggcagtggcatcagagactcggggcaatgggagtgcgaggggggtctcagcgtcccacagctgctgtaacaagtcgccgtaaacacagtcactcaaaacggcacgagctgatggcagcagtggagctggaggtccaggatgggtctcaccaggctgaagtcaaggtaccgacctcaggggaattggtgtcctgcctttcccagcctcagaggccccacttggctgtacctgggcagctgctccgctccacgggcctagcctcgctcacagggctccaagaacagagcctggatcgtcctgagggccccgtgatgtccccgtcacagcaaaggaagatttaggatgcactggaagcccagaagtccagagaaggggctcagagccatcggtcgccacggggcacctcgggggtcccacgaacactgcagcgggcgtcagaccctcaagcgtcggtaagggcctcaccgccttgggaggggtcagcagttaccggaggactctgggcagtggcagggagcagcaacaagggccccccattcaggccctcacccccggcacttggaggaggtgccgcccctgcctcggaagcctcgagggcaacctgcaccctcaggaggcccagctgggggcgtcactgcagggcaccggcagaaactggggtctgaaaacagcagcccagagtggatttggaacagaacagggtgtcacagaaaggatgtttcatgaggtgggttttgatgagtatgtttaaataaatgtaacttaattgatgttaaatatgcatcttaatgcttttctaaaatgtgcaattgggccagttgcggtgactcatgcctgtaatcccagcactttgggaggctgaggcgggcagatcacttgaggtcaggagttcaagaccagcctggccaacacagcaaaaccccgtctctactaaaaatataaaaattagctgggcgtggtggcaggcgcctttaatcccagcactttaggaggccaagcgggtggatcacctgaggtcaggagttcaagaccagcctggccaacgtggcaaaaccccgtctctacaaaaaatacaaaattagctggctgtggtggtgtgcgcctataatcccagctactcaagaggctgaggagggatggtcacctgaaccccggaggtggaggctgcagtgagctgagatcgcgccattgcactccagcctgggcgacaaagtgagactctgtctccaaaaaacaaaaaaaatgtgcggttggaactatatctcgaaatcggaaaccagacattctgaagacaagcttgtgtggcctttggcgccatcctgccccctgctgggggcgacctccaccgcagacgaccttctgagccctggtttccttgcctgtaaaatggagtagcgcctgccaaggacggctgtggggatggctgaattcaatgcatttgggggaggtacgtgtttcctgtgatttaatatttcacgaacgttaaacctgtgctgggcacagctctccctcgggtgggagtgtagctgtggtgtatctctggaggggggtcacggctttctctggcaggcagcatggggccctggtgtcccgtggcctccacggtagccgccccacccgagcgtgagcgtggcctccacggtagccgccccacccgagcgtgagcgtggcctccacggtagccgccccacccgagcgtgagcatggcctccacggtagctgcgccaccggagcgtgagcgtggcctccacggtagccgccccacccgagcgtgagcgtggcctccacggtagccgccccacccgagcgtgagcgtgggggccacggtagccgcctcacccgagcgtgagcgtgggggccacacccacaagtctggcatcatggtgttgggttcatgctccctccagaggccccagaggaggatccttcctgcctcttcccactcctgctgactccggcatccctggctggtggttgcattgctcctatctctgcccctgtccgtcctcacatggcccctcctgtgtgtgtgtctttgtgtctcttctcctcaaaatgacgccagtcctcggatttaggtccacctggataacctgggagggccccatctgagggtcaggatgggtgtgggcttggggcctgcaggcggccccacctttctccccgcaggcactcgtgcctgtgtaccagccttcagggccggttgtggcctcggggttccaggaggcgctgccatccagggcctcgggcacagcatccctgggctcttcccccagcccctggggtcctctcttctcagaggctttccctgggtttctgtgtttccgcgaagttccggtgccttctgcactttccctgggagctgaaattcgctaggatttgcatttccaggccggcagcctccagggatgctgagcagcatctgaacatccctataggtggttctggcttttgcttttctcccgacattccgggtggagatggtgaacacacgcttctccgggctccccctgatgctgccctcaggccttgggggtctggcctacccctcacctatgcaccacagccttgctcagagagtgcacacctctgcgacagacagaacctcagagtcgttccatggcaaagccacactgccagcgtggctgtggcctacacaggccgggcaacagcaggcgcaggccctaccccccacgccacgactcaaggcccaagcctgctgggtgcgtctgagtgttcgtcctgtgggacgctcctctccaggccttcgtgctgcaccccaacccctgtcctgtgggacgctcctctccaggccttcgtgctgcacccccctccacccacccctgtcctgtgggacgctcctctccaggccttcctgctgcccccgccacccacccccctcctgtgggacgctcctctccaggccttcatgctgcctccaacccctgtcctgtgggacgctcctctccaggccttcatgctgcctccaacccctgtcctgtgggacgctcttcttcaggccttcgtgctgcaccccaacccctgtcctgtgggacgctcctctccaggccttcgtgctgcacccccctccacccacccctgtcctgtgggacgctcttcttcaggcccttgtgctgccccccaaacccccgtcccgtgggaggttcctctccaggcgtgagaggacacggcccaattcaaggacacgtgccccgcggagtggcagccttgaggaagcagtcttgtggtctcctggccccagcgctcggctaaccatggccgaatggaggttgggtgccccccagggtggtttccagggcgatccggtgtcctggggtggctggggcagcatggctgagaggaccctgtgtgctctgcactcctggttaatggttggggcctccagcaccttcccatgccttcccatgatggcaccccctggccacccgctgcgtaacgatggcagacgcagttacagtgttggtttctgaaccgtaagctctggataaatgtgcctctgaacaccaccgtcaagtccctaactggattatgtatatttggcctggaagcctgatacttaatatcagcctgctctccggtgaatgcctttcttcccccggataatctattcccactccgcttccttctagacttctaacctcactacatctttcatatcagagctactctcctttctaaacaaaacacagacctgcccctggttctgagtctagtttcacccccaaactggggcgcagggctgtggggcggggctcggggctcggggctgggttttcggccccgttgacccaggccaggatctctgcctgttccaggatggtcagtgctgaaggcggcctcaggactgaggttagaaagtggggttggaagcctcgtttgtggcaggaagatggcttctcctgtgattccagtggtgaggtcccaagagaggagccggccacattgagactggccgtagcccaattggagctggccagttgctgcccctcaattccttcttcctgctcccccaactccccagccccctggggtctccagtcagcagggagagtgggcacagcttggcgggaccgaggcctgctgggcagccgcttcccgtgccctgtacccagagaaggagctgatggcagcacagcttctcagggggctgaggatgcactggatccatctgtgccgagtccccagagcagggcctggaagaggggactggggatggcatcctcccagggccaggcacgcaggaaggggctgagctagggttctgcctgagtctgtcttctctcctcccctccccccgcccgttccctctctgtgggcctcaccatctggaccccccatggacagaaatgacctcgtcacagggccccttcacggcctttgtcctcacggcccctcctggctggctttgcccaggccagcaccctgggcctgaccttaaccctgacttatccctgagggctccacgcatttcaaatggagcggccccatccccatctcaggagtggcccaccaccttcccaggggagtgtccctgctgagccatgagccctgcggccagcctgccggctcagcccagcccagctctgccacagagcagccacgccagcagcacgtctgttttctcgtcggtgagacgagtggtggcttatccaagtcctcagagtacaggcttcagggccctgtggcttgcggcatgcagtgcgcccggaagtgcctatgtggacacagtgtgtgtgcatggacgcaagcgcgtgccgttttcatggcaggaaacagcagggctttgggggcgacttgttggtaaagggagtacgtgtatttggtaagtagttcaaatagaacctgagggctggaactccctggctgaggccgaccttggtgattccttctataccgttggaggcatcctgcgaacgttggcgcctttgggagcagaaagtgctggtccagcttgcagagggctccatcgaacccgtgtgggagctgctcccgcggtttgaatggctgcgggctccgccatggataggccctgcccggggccaggccttccaagcccagaaatagaaacgtggccacagctcccacctcagtcccgaaactggagcccaagccctctgtccctggccgcaccagagccggcctccctgtgtgctgccagccacgcagcagcttggagaggacccgtccttaaacacttcccgactgccgggtccagagctgcgccctccctcccttactcatcgcgtttgagttcgcagttggtgtcctggttttccacctgagtgggcgctgggatggaagggtcccgcccaggcgtctggtgcggtcaggcgcacataagcagcctttgcaggaagccgtggctgggcctcgatccgagttctagcgccccaccgtaagggagagccaggtgcttcctgtccctcccggccacctcaagtgtaaaatcacggggttcagggcggtggtcttgggggctgcgctgcacagccgtttgcagctacagcagctgctcggagctgtctccgactttgcacccccgtttcacagagggagaaaccgaggcccagggagggcggggcttgcagcggacgggtgggggaagggctcctcctttcaggtcccaactctccacagtggcaatgaggtcgctcttttttcctttttttgagaccttgtctcgctctgtcacctacgctgaagtgcagtggtgcaatctcggctcactgcagcctccacctcccgggctcagttgatcctcccacctcagcctccccagtagctggggccacaggcgcgtgccgccacctccggctaatttttttatttcgtagagacgggcgggggtggggggtcttcctatgttggccaggctggtctcgaactcctgggctcaagtgatccgcccacctcggcctcccaaagtgctgtttcaggcgccggccaccgcgcccggctgtcgccctttctgactcagtttccccttctgggagcggggtggcaggtgtccgtaacttcttgttgtgaggaccagaggagcagcgcccacacagcgctcagtgaggccggcgctgcgcgcctttccccgggtggccgtgatcggaggcagcgcgttcggaccccgggccggcggcgggcgcgggtggatcggcgcctcggggctggattagtcgggtctgcccgcgccccgcccccgccccgcccgcgctcccgcctcccgcgcgcccagctccgcgcccgccgcctcggggcccgcgccgcgcccgacgtccgcccgggagcccagagcgcaccgagcgccgcccagagcgcgcagagccggcgcggcggacatgcgcgtccccggcccgagctccggctgagcagggcacgcggggagaggggtcgcctggacgggccagggccacccggggctcgcgctccacgcccgcgtccatgcagcccggctccggccccgggactaggggcgactgcctggggcgccggcgaggtgagtgcgcgctgcggactccagagagggaattgggactttggggggacaggggagggggagcgaccgcccccccagaagagcgggacgcccgagatctccgggccttctgcccacaccgcctctcccggagccaagcgcggagaccgcgtcctcccgggggcgcacgtggcggcgggcgggcgggggtgcggcgcggccgagggtcccaggcccgggtcagggcacccggggtccgggggtggaggcggggccgagcgttgtgggtggcgcgcgcctttgtctgcgcccaggtgcggaatcggccacccgggttcccggcgccgcgctcacctgccccgagttggagttctttgtctggggcggggcgcggctggcccaggctgcgccgcgtgtctggccgaggctgctccgcgggtcgggtcctcgcagacaaagcgcgccctgacctccgcccgccgccgggattgtgcacctcgcgggggctgaggcttgcccgggcgcccccgctgcctcttcgcagggaccctgagcctgcggacccggagtcctcccacctgtaccctgggcttgagtgatcctctaccccacgcgggctaggaggcagaggcggctgctcgtgcctgggtcacgtccctgcagaccatggccgagaagttaagcgggtctggtggcccctggggctgccaccccatttgggtcatctggccactgccagaagccctgtcctagaagggaaagagctgagggaccgcgtggaggaacgagccccagaaggtgcagctgctgtgtgtggtctaggaaggggttggagcctgggccaggcccccagagggccggcccctgttctgctctcagccctcccggatgggcgtggctgcacctggccaggtgttcaggttctcactgtgaggtggaggccacctgcctccggggcctctgctagggccgaggacccctggagcacccattctcagcctccctgagcaaactcgtctgctaagtgtagggcccactgtggcgtgaccagaatgggtgctggatggccccagccgcgcggcccgtgcggaagaccctccccttccttgcagccctcttggcttcgctggtgtctggggcgcccccttgtggccctggggagcttgtgttcgaacctgggacgtggagcggaacccactagagtgtttgggtcccagtgaaggggagggcagcagagccccagaagggctccaacctgtggttaccctagagacgagggccggctttgggggctgtgctttggggtctgccttttgggttggccgtcaaactgcgggctaagctggcttctcctccctctgcccacctgggaggcctcagcacccgcctccttcctggcccctggagagtcctggcggcgtggtggggcctgctgccccaaccacagagggggcagttaacaggtgggccacctggcgaagaggccactcaaacccgggacgccagccaagaagagggcccgcgtgcgtgccagagacagtgcagcccctcagatgaggggtccagaagtcctcccaggaggatggtgcaggcccaggagagaccccaggggtctgtggcaggcctgggtgttcagtgcctggttcatggctggcatggagcagcactggatccccatccttgctgtgtgaggggcccagatttgggagcctggcccaagggagcacttggtgctggcactgctgggggatgggcacggccaaggaggtgccgaggcctttctggggagccgcagtgccccctggaggcccaaaggctggtctggactcctccctgcccacctgcacaggccccttcactattcctcctgtttctctcggagtccttcctgtttccgatgctgggatggtcactgcgtagcctgggtcaccggcagtggctggacggggcagggaggtggaggcggaccccatgggagccacacttctgggggatgatgttgaggcgagcagagaggagaaagccacatgccccaacctccaggccccctggcttcccaggggtgagaggttcctgtccttctttctttgtaacaagccaggattctaggggtggtggccgcaaggctgggggagggagagggtcatcggggccctggactggggctgggagggtccctttctggggtgccggggtctcctagcttccatccgacccggcccctgtgtggttgagctgggtctgagcagaaacaacctcctcagaaggatgtcctacgtcactgcctgggggttggtggctgggggcgctggacatagagttggtgtttcaccctgcagaagcctgggctgcaggaccccgaccccggggaccgcacagggtgagcagaccaagtagcgtcagtgccaggagctcagcatcccttcccaccagctgcaccgcagccctttaacacacgaacgtgcggggcccaaccgctgctcctttccgaggggcccaccttcctccagtgcaggggcccttccggcgcgtgtgggtgtggcaggcccgcctcggctcttgccatcttacaggcatggacctgctgctcttctctgtggttcaggcccttgcgacgtgactaggaagggcttcccattccagcaagaaggtggaatccacacctggtcttctctgatacgttgatggtttttcacttctatgtttgcgatctgtctggaattattttcagataagaggtgaaacaggagcttgctctgaaggacctacgccacacctggcccccacagcctgcaccccacacctggcccccacagcctgcaccccacgcctggcccccacagcctgcaccccacgcctggcccccacagcctgcaccccacgcctggcccccacagcctgcaccccacgcctggcccccacagcctgcaccccacgcctggcccccacagcctgcaccccacgcctggcccccacagcctgcaccccacgcctggcccccacagcctgcaccccacgcctggcccccacagcctgcaccccacgcctggcccccacagcctgcatcccatgtctggcccccacgtctggccccccagcccgtaccccatgcctggcccccacagcctgcacctcacatctggccccccagcccgtaccccacgcctggcccccacagcctgcaccccacatctggtccccacagcctgcaccccacacctggcccccacagcctgcaccatgtctggggtttctcattcggttctgtggatctctgtccgtcgcggcatctgtgggaactctggggcttctcattgcgctcttggatctccttccgtctgtccgtttgcctgtccgtctgtcccagcatcgtgtcacatctttttgttggtttccaatgctgtcatttactggcagtaaaattcacctatttatttttgcagtaaatgcagctattttaagtgtgtggtttgctttttgacacatacctacgactgtatacccacccccgtcgcccctgaacccccgagctcctgtgcaccccctgcacccctccggctgacacatacctacgactgtacactcacccccgtcgcccctgaacccccgagcttgtgtgcaccccctgcacccctccggctgacacatacctacgactgtacactcactcccgtcgcccctgaacccccgagcacctgtgcaccccctgcacccctccagctgacacatacctacgtctgtacacccacccccgtcgccccgaacccctgagctcctgtgcaccccctgcacccctcggctgctgtggctggggccgcgctcacggtcacacggctgcgtgctctttgtggtctggctttggctcctgtgatgtttctgaggctcacagagcgcgtgccgacagcaattccatatgtggctgaggcagacgcgctcactgttgatccgtctgccagttgctggacacgggtgtccctctgggcagctgggcctggcttcaccccagccccacaccaggccccggtggaccctgagccgcctcccttctgccctgaacagcagcccagctcccttggctgggccacgtgggattcaggggaagcagctcccacagtgaggacctagtaatccacgtgttccagatccctgcttgggattttggttggggtgataggaaacgtgtgctgtggcatggggacagcaggtctcttcccagcaccagtgcccctctgggctggctacgcctggtgagcctcctggctctgggagggcccctgccctcgccctccaaggtttttttttttgagacggagtctcgctctgtcgcccaggctggagtccagtggtacgatctcagctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgccctcctcggcctcccgagtagctgggactacaggcgcccgccaccacgcccggctaattttttgtatttttagtagagacggggtttcaccgtgttggccaggatggtctcgatctgctgacctcgtgatccgccggcctcggcctcccgcagtgctgggatttcaggcgtgagccgcggccggccgccctcctaggttttagtaggttggagagctgtgggtctcgcacgcttcaccagccaaattcctaagtccctttttatcgttttaaccctaagagtcacaggtcgtgttacagatcagggggacagacaagcacagaacccccatctcccagcacccagcctccgagtcagatgccccccgccctggtctctcacagctgtgctcactaggcaagcctggccggcccctccctggtagcagtgaagctgttgattatgtttgtcgttgttgcatttcagttacacaagtgttaccagaatgcagtctcctttatacaaacttaaaagtatgagtttaagcctagtctcttgtgccctccacccccgccattcccagaggggactgctctctcctggtggacacattctacaatttcaccaacatagacgccgacacgcgggcacctacgtaaacacacatgtgatgctcatgtaaacaaacatccatgcacacactgccacccaggtacacacacccgagaatgtgtgtgtccctgtacgtgaacccgagtgtgcccacgtacacgtacccaactgtcctcatgtacacgtacccgagtgtgctcatgtacacgtacccgagtgtgcccatgttcatgtatccgtgtgtgtacgtacccgagtgtgtgtatgtgcctgtgtgtacgtacttgagtttgtgcccatgtacgtgtacccgagtgtgtgtacgtgcctgagtgtgtgtacgtgcccaagcacaggcacattgtccagatccacataacactccttctttgcagttgcttcctccacacacagagtgtcccccatctctccagggtacacactgcagtgtgggtgaacgtcaaaagccgtgcagtgagagaagccaatcacagtaggtccgtgccgcctgacagtgttcacatggaagttcggaaaagacggctctgtagagacagacagatttgtggtttcccagggttgggggtgacggttaggagtcagggtttctttttggggtgatgataatgttctgtaatggatcgtggtgacaggtgcatcactgtgaacatactaaacgctagtgaattgtaagcgttagacggtgagttggatggtatgtgatttacatctcaagtcttagtccgtgcgggctgctctggcccagttctgcagcagacattcacagctcacagtgctggaggccgcaagcaggtcaaggcatggcagagtccctgtgagggcttcctggtccatagagggtgcctctccgctgcgtcctcacatggtggaaggggctaggtggctctggggccctttataaggcactgatgccgctcgtgaggctccacactcaagacctcatgacctcatcaccttccacctcctgatcccatcacctgggggtgaggatttaaacatgtgaattcttgatagacagaaacgttgaatccacaactcaatgaagctgtttaatcaaaaaaaaaaaaaaaagaagaagaagaaactaggagggaaatatctatttaaggtcattcttatgaagctcattcctggaaactgccgtgaagtcccccagagcatggggccctccgtccacccctccccatcagcggccacattctcgccacctgcttgtggcaggtggttgagcgagtttctctggaagagatggaggagtggggctgagcaatttctgcgattgaccctctgagagctcccccacatagcctgggacactcagctgcctctcagcaacactgggcaccaggcctagagcttggccggcctgggagcatagcgcagcattctgtggctgctgggagcttggccggccgcaggcacatagcgcggtgtcctgtgggctctgggcaccaggcctagagcttggccagtccccagcacataatgcagtgtcctgtgggtgctgggagctcggccgaccccaggcacatagcgcggtgtcctgtgggcgctgggcaccaggcctggagctcagccggcccgggagcatagcgaggtgccctgcagccttgcggacccacatgtccagcctggtcggtatcctggttctctcactttcgccagggcgcctgtgctgggcagtggttgggagcaggaggtgtgtcccggggctctccatcatccgcctctggcctgatgggtgggggcccagcagggcccacagctactggtgctggttctcctgggaggggtgcagatttgccaaatgccggcgctcccccagtccacgccagcagcagccttggttcccgatccccccacaaaccccgtcttcactcagaccccctctaggaagcctgctgctctgagcagagaggggcctgtgtgcccccagcgtgagcacatgtatacacatgcgtggagctcaggactaagcgtgttcacctcgtacacgggggcatccacaagggcacatcccgcctggccctgctggaaaaccacccagacttgtgtgtgggcattgggcgcaaggtccacgaggatgaggaccaccctgactgcccctgaccccccttctctctctccaggcatccgtgggctctgagaagctctttgcgccgggaaccgataaaggtaagtgggtcccctcggcccagctcctgggcctctgaagagacacaatgcgccctgcgtcttggcggcaggacatccccctgaagtcaggggagagatggtcttggcacctggggtgcagagctgggtgggaccagggtgctgggattgctgggaagcccccaggagcaggggagagtagacgaagccactgagccctaggcagggcctgggctccgctcgtagcagcggctcccagagtggaaccgttaggaatgtgtgctctcaggccctccccaggttcgtggggtcagatgctcggtactgaagggccacctgccacgagcaccacaatcacctgtggctgctgagttaaagagaaacgggactgagactcacttccctggctctgctgcctgcgcgcctctgtggtgcagtggaggggcctggattgctgttccaggccaggccttcgaaacctgtggctgtgagctatgggacagggtgtctacaggccagcaaccctctccagagggggtagccccggcgtcttaggggccttcgtaacctgtggctgtgagctgtggggcggggtgtccacgggccagcaaccctctccagaggggatagccccagcgtcttcttagggcctccctggcgctgggatcctgggattcccacaccaaggcctaggcgggcagcatctccggcagggccacggggtctcggctcctgcctccctgggtttccagctggaaccacccttttgctgggacggcttcatccggatgtgattggacaggacaggccctgccaatgccggcaaggatgggccctactgcccttcagcaggcatggccttcacctgccttcaagttggaagcctgttcacatcagagcatcacagcaaagcaggcgcagatggggtggtgtcagaaggggcgtgcatgggacgggccccggtaggagaggcagctggcttcgcagacggtgtcacgcggggctgctgaatactcagctcactgccgcggctgctgccgcatctggacggacaatgtcccagtgagggctggaggtgctagaagggcacaggaggccccgcacgtggggtctagtccaggtctgtgcggcccaagcctctttccatcctgatcacagctcttactatatgcaaggctggcttggagatgtgggagagaggaggagaggtcccgtggggctgacccagggagctgggaaagccggtggagatagtgcccgtgggctccctctctcctgtgtcctccgcgcagcctctctgtggtcgctgggtggtggctgctgtggaaggcctggccccaggtgaagagtgaagatggggctgcttcctgctgcctgttttcacctgggaggaactccttgaggccccagaagaccaggccccatggtcacatggggcagggacggccgcagctgtccccatgggccatggctcactgtcccaaggcctcaggaaggaagcagggtctgccggggacgtgaacaggaggcatgcggcacgtggaacgttgttttgtttctcctgcgaaactggccccctgaccgtggcagctcctgaccccaggcaacaggagctccaccacatggacgctgccctctcctgactcctggggacttgatctgagacctgcccgaaggggcctgaaaaggagggtttggggtgtgcgggggtggggggggcaggccccaggggctcagaggggcccacaggacctgcgggggacgtgcctaggtgggcagaagggtggccagggagcagggctgagggtggcgggtgacgggcagtcacagtagggggaagcctcccacccagtccctgcccaagtttccaggaagtggtcaagccttccaccagggggttccagaaagaaaaggtggttacagctgtgggcgctgctgttggggtggggcagacccatgccctgggctgagggcacatccaggggccgtgaacatgaggcctaggtacacaggccctagctcccgtgttcaaatccagctcccctcttgggccaagtccttgatgtatcttggttttgtctgttaaatgaggtcatagcagcccctgtccagggactgactcttgcagggcctgtcctgtccctgccagtgatgcgtcttcgggcaggtgggctacccacccccacccctggccacggcccaggctcccaagccagctccctccgccgggcggggcctggagcctcgggtgagatccagctagctgtgtggcctccgtgcctgcctcctcatctgaaatgggggcatagccggagcccagacatagcctgggcaccgggcacgtaccagggctccctgggccacaggaggggcagggacgaggccctgctggtctgaacgcagccaccctctctctgcaggcccagcgcttgagaagtcggaggccaaggccgggccggtgcccaaggtgtcaggcctggagcgcagccgcgagctcagcgccgagagcttcctgcccactgccagccccgcgccccatgccgcgccctgcccggggcccccgcccggctcccgcgccaatcccttggtgaagaaggaaccccccgccccgcaccgccacaccccgcagccgccacccccgcagccccgcggcctgctcccgacacacgtgcctgcatccctgggcgccttcgcgggccacagccaggcggcagccaacggcctgcacggcctcaggtggggtccccgcgggggacggggcctgtgtggtctcaggatgggggctctgcaggggtcgggctggcaggcactgagccccgtgtcccgcagcaggagcagcagcgcccccctgggcctggggaagcacgtgtcgctgtcgccacacgggccgggcccccacctgtctacctcacacctggcgctccggtcccaggcgcagcaccagctccacgcggccatgtttgccgcacccccgacactgcccccgcccccggcgctgccggccagcagcctggtcctcccaggacacccggccggtaggtgtctcggccacaatctcgcccagggcaggggttggggggtgcggggacacggccaccggggaggggcgcacagcctggccctccacctgctgtggtctctgcggaccctgcgcgcctctctgagtggttcccccaggtgtgcctttccccaggagtctctgctgggccacaggccatctgtgtgcggggacaggcaggacacgtgcccatgcacgtacagacgcgtgttcacactgagacgggcgcacgggcctcccctcctggggccaggcctcccccgcagcctgctgggtcctgagccctgggaggagggggccgcacatcaagcaggcgccatcccagtggaaccccgaccgcgaaggcttcctccctcggcccccaggcgcttcctgaggctccgagtcagcccggcccaggctggggacggccccgtgtcccgggatgggaccaggatgctggcctgcgggtggctggaccctggctcccggggaggggctcaccgtgttctctcttgcctctagatgccagcctggcggtctcattcagccagccaatcatgtattgccagcctcattcgggaattctgattggtacttggtcacaggctcctctcttacctgcacccctgggcccgcacgtggcgagcggccaccccggcttggcctgccgaccccgggagtgccaggtgactatccgcctcgccccgccgggagcccgcggccaacgtgcctctctgtctctctctctttttctcttgtagatcacgagctgctcaggcaagagctgaacacgcggtttctggtgcagagcgccgagcggcctggcgcctccctgggcccgggggctctgctgcgggcggagttccatcagcaccagcacacacaccagcacacgcaccaacacacacaccagcaccaacacacattcgcccccttccccgcagggctgcccccgacgccgcccgccgcacccccgccggtgcgtaggcccgcgtgctggcagggggcgggggcgggcgtggggcggggacacgcagcaggcacacacagacacacgctcgcacacacaccagcccaggaggaggtggggggccggcggcacctctctgtcgtctgtccggtccccaacgtgccttctggtgtccccaccccaagctgtgccatgaggcccccaccctcggcagtggtcctggacttaggcaggcaccccgtgcccacgtgcatgggacaccctcacgcctgcactagatccccagtgccagggctggaggcccagacaggcctgagggcacagggaccatgactcagggtgcctcccgtgttccccgccccggaggcccggtctgaggagggagttgctgggggctggagtcccctccactctctcgagttttattcggaaactggccagtttgtcagtaacccggtgtgtccccagcgcgacccagcagccagggcttcacgccccaggcctcagccaggcacacagactgcctgggggggccgagttcccaccccatgcaaggggacccttagaatggcagggccgccctggtctgagactgagttcagagccgtggggctggcgctctagaggagcctgggacggctggccgaagccgccagcctcaggaagcacaacgccgtcctgtcactgcccagcccggccaggtgggcggggcccggggcccagcaacggtgtcgtgtgtgcggggcctcaccctcctctccttcccttccagtttgacaagtatgcgcccaagctggacagcccctacttccgacattccagcgtgagtgtgagtgtccccgaggggcccggcgcgtgtcgctgtgcacgcaggtcctggccacggggcggtgggtggggctgcccctcgcctggcctcgcccctgctgcattggtgccaccttctggttacaggcagagggtggggtgaggacttgggccccccctccatccgctctccttctcttacagttcttcccgtccttccctcctgccatcccgggactgcccaccctgctcccacaccccggccccttcgggtccctgcagggcgcttttcagcctaaggtaccgctgcccctggcaggtggggcgggcacagcgggtgggtggattttggggggagtgcatgacaacctcgccaaactctctgcccacaaccacccccctttccctcccttgtacctgtcgtcatctgggtgctggcgtgagcagcccctgccaggatggggggccctgcggtctgtgtgtggccaccgtgggagggacagggggtccagcctgggagcagccctgggaggtggtgggaccgtgtggagagcacactgtggaagcctcgaaggagaacattccagtccttggcaggaggccctggtgtggacagcagcctcacaggccgtccttaccgcaaggaggttcttacggggccatccacactgcgaggaggttcttacggggccgtccacaccgtgggggacccgggccttacggggccgtccacacccgcaggggacctgggtagcaggaggttgtgtgccatctcagccaggggagagggaaccccgtgaccctcctcactgttcctggccttgtgctgtaaccccaccctctgcggaggggcacacagctctcagtcctgaagccgcctcacctgtgggcctcaggttctgaagacggggcctggaccatccccggtagctgccaagcccttgacctcccaggatcctgcagcgcccactcattgcccacagctgccctgaagggcccagcacgcacccctgggctcccctggggcaccgcccacatcgtggacgggcagatagtgcttccgaggaccaggcacccctgggcactagagggtcttggacccccagaccccgtggttgaggaattcagaggaatggagaagggatgtatgtggcccacctgcaggtgtcgagcagggacccccagactgggactcgggggtactgccctgagcccagacagccaggacgctgaggccctgagtctgggagggaaggaatctgtcccggccgcaccccgagcacagctgcttctgggcagggtggtagcccagagggaaggggcggtagagccagtctggggaggagggggctgtggtgtgatggccggtctttgctgtgggacccccctttccctggcgcccctggtgggaaacgaccatctccccttggcccatccaggctcacagcagctcctcctgggctggagactaggtgtgcaccactccccctctgggtggggctgtctcggccctggtggcaagtggctccccggggagggtcgcccaccttccctggcaagagcacctgcttcccacctttgcagaaactggcgggccaaaagtgtggtggtcctgcgagggagggcaggctgtccctgggagacagcgtgcggggccccacggcaaggcaaagcagggcacaggcccacgccagaaccaggaagcccgaggcgtcctcctgcctgggcggccccaggcgcacacaagctgtctctttctcccctcagacttcaagccccattgaggtggcccgccgggctggtgcggttcacacactcctgcagaaagcgcctggggtaggtgttagtgggcgcccgtccccaccccgggggatggcctgccccggccgggccctgtgcgggctggtggccacagcagacgggctgtgtcccctgcacccccaggactcagcctcctgaggggcccggacctcacactcctttcctgtctccacaggtgtctgacccgtaccgggcggtggtcaaggtgagcacgtgttgggaaggcccgtggcaagggaggactctggtgcccccggggcggcctcggggggcccgtgacagcaggagtctgcagaaaacatgggtgggggtggcaccagccccactgagcgcttccatcctgtcgcagaagccggggaggtggtgtgccgtgcacgtgcagatcgcctggcagatctaccgtcaccagcagaagataaaggtgagaccacctgggctggggcagggcgcttgtgaacccgactccagcctggtcgggccctgaaggccaggcatgaggctgtgtgtgttcacacgcgtgtgcacgggtgtgatcctcacgcgtgagccgcctgccccttcctctgggtactgggcttttaccgtaagcaggtcagcgaggccacagggcagtgctgggtgcccgggtgccgcaaggccctctcctcggcaaggtgtgccggctgggccacggggagcagagcaggggcacggggtgccgcaccagctccccacgtcactggggtgcctctggggtcctctgccgcccccactccccacagtgattgagtgtctgctgtgttcttcggtcttcagcagtgacccagggggaccgtgagtgctcacaactgatgtgcacctgggaaggctgaggaaggcgggagccccgcgggcagctcggtgcaggtcccaccaggctaggagctgcgggagcgggagagggtcctgggaggccaggacagggggactgttgcctcagccccgtgggaccctgcacctctgctgtccctgcgctgtcctgatgacgcacgtcacctccgcacacaactctgaaaaatcattgtcctaaatgccctttgggacgggactcagagcagaatgctgtatgtctttctttttttttgagacggagtctcgctctgtcgcccaggctggagtgcagtggcgcgatctcggctcactgcaagctccgcctcccgggttcacgccattctcctacctcggcctcccgagtagctgggactacaggcgaccgtcaccacacccggctaattttttgtattttttgtagagacggggtttcaccatgttggccaggatggtctcaatctcttggcctcatgatccacccacctcggcctcccaaagtgctgggattacaggcgtgagccactgtgcccggccagaatgctgcatgtctttatacttgcatgtctgggtggaacttctggacacacagcagagggatcaggtgctcctggtggggggccgtccacggcagagtcgggagacctcatcactcctggttttgtccttggaactcggggcatggttgctccacagaggagggcagatcctgcaagaggccggcggtccagggagagggcgcacacagggtctgcccagccctcacgcctgcccccacgtagtgccagagtaccccagcatcatcatggccagtgaaaccaccccagtgccagagcacactgcagggaccaggaggggccggcccaggccagcctgagtgcgggtcagaggcaggacaggcagaggcagcgcagtcaccaggacagtggggtcttgtttggctacacccctcctggctctgggcccctctgctcccatgggagggcatgggcatccccagtctccacccaagcctggccctgcctcccacagccgcctggcagcgtgggcacctgaagtgtggccagtgcaggtgaggggcacatgttgtagtttcatataatttttaacacatttaactttgaaaactgataccaaattcagtcactgagaaacttttcagcatatttggaacaacttgggcacgtgagcatgctttttcagtttctttttttttttcttgagatagagtctcgctctgtcacccaggctagagtgcagtggcatgatctcggctcactgtaacctccacctcccggcttcaagtgattctcctgtctcagcctcctgagcagctgggattacaggcgcccgccactgcgcccagctaatttttgtatttttagtaaagacggggtttcgccatgttggccaggctggtctcgaactcctgacctcaggtgatccgcccgtatcagcctcccaaagtgctgggattacaggcgtgagccaccgtgcctggccttaacttttaaaagaatctaaatacaaaaaaagtaagttattttccatgacagcgtagcatcccagctgccatgtgccaagtacgtaccacagttcagaggacgtgagctctcccgttcagcttttttgctgatcatgtgtaacatttccgtcatcctgagtagagaatacacccttgaaatccatcccacctgctccccttactggactggctcacacccagtccctgtggcccctcaggcctgggctccctgtgttcagggccagtccccgggcaggcggccctcacccgttctatcctcccaggagatgcagctggacccccacaagctggaggtgggtgcaaagctggacctgttcggcagaccccctgccccgggcgtgtttgcaggcttccactacccacaggacctggcccggcccctcttccccagcacaggtgagactggagtcgggccaggtggggggcacagaaacctcccgctcgtgcccagctgagcctgccttcctgtgccaggagtgagagcgctctctggaccgcagcaccagcctttgcttcttgatgctcaccacttattcaggtcaaagcctggcaactccctcacctcaccccacccctcacctctcttctcctcacctctcctctcctgtcctccccaccagcctccccagggtggacctgggcctggggctgctgctcctccccaccaagtcctgcccagtgtgtcctggggggccttcagcccacgccacacggctctgaggcggctggtcctggccacccctcctccctggggctccctgttctggccccaccagaggcaaaggaatggcagggacccaggcccacgcgaggctgcccctttctgtctcccagcccccgctttcccaggaggagtttggcctctcgctgaacagtaggaagctgctcctgaggccaggctgggcccacaccccagtgccccttcctcacatgcatggttgctcccggggtcccaggacgggcccagctgcggtggtttcctaggaagggttccaggacttggcctgtactgtcctcagtagcacggcccagggtgggatctgccgggagcagcgagggcctccctgccctcagtcacccactcccccgagtcaccccctcccccgggtcacccctcccccagcaacacaacgtgaccacacccgagtgtcatcctccaggcacgcagaggcacgaagactctggggtgctgatctgtaggcaccactgcctggcacaggcccccaggaggaaagtgggctcgaagttcaacccacagtgtgggatggacacagtctgggtgcctagaggctggctgagggccagctgtgtgcacagacctttccaaagatggtgtctcagcctgcacggtgcacgcctttctacacatacacagttacacacagttacacatccacatccacgcgtgtacgcacacgtgaagcatgagcatccacatacagctgacccttgaaccacacagaggctgggacactccccaccacacagttgaaaatccaggtataacttttgactcccccgaaacttagcctactgttgacaggaatccttacgatagcataaacagttgctgaacacctgttttgtgtgttacatgtatgatggactgtattcttacaatgaagtccactagagaaaagaaaaccttatgaggcagaccatgaccaggcgtggtggcgcacgcccgtggtcccagctcctcaggaggctgaggcaggagggtcgcttgagcccaggaggtcaaggttgcagtgagccgtgattgcaccactgctctccagcctgggcaacagagcaagaccctgtctcacacacacacacacacacacacaaaatcatagagaaaagatatttgccattcgctgtgtggaagtgaatcatcctaaaggtcttcatcctcgtcctcacacggagtgggctgaggaggaggaggggccggtctcgctgtctcaggtggcagggatgggaggaaatctgtgtctaagtggcccgcacagttcaaacccatgttgttcaagggtcagctgcatgcacacgtacatacccacgtgtacaggcacacgtacacacaggcacaggcacacacatgggcactgcgttgcccagttgtcctgctgatggaacctttcccagccaccaggtccttgaggcctgtcccttcctcagagctcccaacccccgctgcagccccccctcactctcccctcaccgtgtttggtctcttccatgttcatgagcatttgatggcacgttgcatgtggacgtgtgaaggcagagccctgtccacataagggtgatgggcgtgcccagcagccacatgaggctggcttcacaagcatggtggcctctgggccatggagcatcccagtagtctggctttctcagaaagcagaagtccaggctgcagtttctggctgtccgcatcctggctcaagccccccggacacgtgctcagtgtggcgcccagttctgggccctccacactgcccgccccaccgaccctgctcctcccccgcctccccttccctcctctggatacctggtggctgtccctcggtgctctgccatttgtcctgcgaggctgggccccctcagtcccggggccagtgctgcctcctccatctccttggcaggtcttgatatcttgctggcagggggcaggatgattccttgttgctcttttctctcttccatataaactttcaatctgcctgttaggttccagctttcactggagttgggttaaaggggtacatcgacctaagagggattcgtacgtcatctccggtatcattttcctatccctgatcatggtgtatctcatttatttaggtattagtagaattactcatagatgctttatattttactaatattatgattggaatttgtaagttacattcttaagctgttgctagaaaacagaagtgcgtatctgttttgaagatttgtatgccatctcttgatgctgtaactagcaatcctgctaaattcttacgaatgcaaagacatttgtctgtcaattcctttaccttttctgtgtagaaagtcatatctaggagtgggtggtttgcccccttgtgtaaactgtcggtacgtttctggagccactgttccagcgctttgttccagatgagtttcctgagtaagcctggcctttactttcctgtgctgcacctggcaggttttgtcacgagggctctttgccgtcttcagtgagttaaggcgctttccttttttctgctctctggaagagctcttgtgaggtctgatcctcactgccttcaaggcttggaggctcacagttcaggttccaagtactgattttttttctccactgggtgtggtattcctcaagctgtttcttctggcatcggtttcagtaacgcgagtgtttccagtaagttgatttggggcaggctccgtagctgtcggtgtccatccgtcacgcctgaactccgcaggccctggcaattcttaatgttgcttggctgtgtcgtcttttttccttcattaatctcaccagaagtttgtccatttcaccagtattttattttaatttatttattttgagacgaagtcttgctgtgtcgccaggctggagtgcagtggtgcgatcttggctcactgcgacctccacctcccgggttcaagcgattctcctgcctcagcctcccaagtggctgggactacaggcaggcgccactacacctggctaatttttgtatttttagtagagacatggtttcaccatgttggccaggctggtctcaaactcctgacctcagatgatcctcctgcctcggcctcccaaagtgctgggattacaggcgtgagccactgcgcccggccaatttcaccagtatttttaaaggagcagctctgacctcgctgccttctctgtgtgtttccctgtgtgtcgctcacttttctggccctgtctagcttgatctggtggttgagaatattaattcctcagcctctcccagtgcgggcatttgaggcagtgtactctccatctcctcctgcacacgctttgacaagctgtgttttcgtagcatggggcaggctgtcttcctctctagtttagaagagtggcatcagctttcatgccacagctcagtggagaccagaagctctgaatacaacttgccgcgtcctacatgggaggcatgagcaccccatctttgaggtccctaagattagggctgggagggagtcggagtaacctaaagatgacgccctgctggtctttaccagaaacctgctctctggacccatgtggaggacggcccctgaccaacagcactgaatcccctgcagcagcccctcccagggcccgggcccaggccccacacggttgctctccaagggttgttggggggccagggctgatgttgacgtggtgctgtgggctgggcctgtgcccaggaatgccacaaggggctgccatgtgcagcctccaagacagaaccgtgtccatccaggcctgaggcccagcaccacattaagaagtgaggaccatctatcagctcccaggtgaaagctctgagataaaggcttcaggagtggtccgatcaaggtgcatgttacttggactttgtctctgcccaagttgcagcccctttgctccgagggttgcatcgcactcagcacctccctccctgccccccttggggtcccaggatggctgccactgcggctccaagtcaaacctcctccgaattgtggggtagattccacctcttactctgactggacacgcttcacccctcagggcatgcgagagaatgggaggtgaaggttcacagaggaaattggggtgctccctgtgaacagagctgcagatgggaggccctggtgctctctcctggcttctgtcaaacctggctgccccccccaggtgccgcccatcctgcctccaacccatttggaccctcagcccatcctggcagcttcctgcccactggccccctgacaggtgggtgtctctgaattcagcccacgcagcctggctggttcctcagcagccttgtggcgggggaattaggtgggcgggaaggtggccccgagccccagggagccccttgggtcatgcaggcagtacccaccaggcccaaagcctctacagcagcccccactgggccaggtgggagccgcagcccacgcctcacagacctctgggtcccgcggttgcccccacagaccctttcagcagaccgagcacctttgggggcctgggcagcctgagcagccacgcctttgggggcctgggcagccatgcactgggtgagtgacccagcctgtgcccccctcccccgatgcccgcgcccctcccccatgcctgtgtcctctgcaggaaccccgatgcctggctgacctccctcctctctgggctgggcctccttggggcacccccttctcagtgtcagcctgggacccttctaaaacccctaccgggttctcctggggagtggctggggagcagacagacccaacctcatgctccccggcctctgcccccagctcccggtggcagcatctttgcccccaaggagggctcctccgtgcacggcctgcccagcccccatgaggcctggaaccgactgcaccgggcaccgccctccttcccggctccgcccccgtggcccaagtccgtggacgcggagcgggtgtcagccctgaccaaccatgaccgagagccggacaatggcaaggaggagcaggaacggtgagtggccctcttgttccgtatccccaccacacacccctaccccgttctttcccccctcccgtcatccccggttccccctcccccgttccctcttctccccgtttcctctccctcaccgttccccctccccctgttccccttccccgttccccctcccccattccctctcaccctcctcgccccactgctgcgcactcacagtctgtccagctctgctgagccccggggtacgggggccaaagctctgctccccggcgactcctccctgcggtggggagtgaagcctgggccctggggctaggaaggatgaggagggtgaagaccccaccacaggcacccacacctgccatccgggagacctccaggtggccgcgccctgacccacggagtttgagggaggagttcgggggtgcggctgccgggaggcccccctgtcctaacagggaggggcccgtggggagccgaagtcgctgcaggcggctcatcccgcttccgtctcccggccaaggtttccaggccgcccagcggggagaggacgcgtaggttttgggagcctgtgggggtgcgggagctgtgggtgctgaggggtcaccggccacccagaaactggaggccccgacaagcaacgggaacatcccggggctgcgccgcgcggcaggacggaggtctcgggagtgacgggtccgccctgccgcccccagggacctcctggagaagacgcgcctgctgagccgggcctcgcccgccacccccgctggccaccccgtcagcggcctcctgctccgggcccagagcgagctgggccggtccggggcccccgcggagcgcgaggccgaacctcgggtcaaggagagccgctccccggccaaggaggaggccgccaagatgcccgcgcgcgcatccccgccccacagcaaggcggcccctggagacgtgaaggtcaaggaggagcgcggggaggacgaggcctccgagcccccggcgggcggcctgcaccccgcgcccctgcagctcggcctgggccgcgagcgcctgggcgcgccgggcttcgcgtgggagcctttccgcggcctggagctgccacgtcgcgccttccccgctgccgcccccgccccgggctccgccgccctcttggagcccccggagcgcccctaccgcgaccgcgagccccacggctacagccccgagcgcctgcgcggggagctggagcgcgcgcgggccccgcacctgccgcccgccgcccccgccttggacggcgcgctgctgccctcgctgggagccctgcacttcccgcgcctctcgcccgccgcgctgcacaatgggctcctggcgcggaccccgcccgccgccgccgccctcggcgcaccgccccccctggtgacggcggccgggccccccacgccccccgggccgccgcggagccggactactccgctggggggcctcgggccgggcgaggcgcgcgactactccccgtcccgaaatcccccggaggtggaggcgcggtagccccggggccgcagacgcctctccgagcggagcgcaccgctgtccgtctctccatcagttcctagaactcaagcacagctcccgccgatcctggggcggcgccgcctctccacccgcagcctgcggaggcggggacttgggtgtcggcttttctgagggtgatcttttgttttccgagtttgggattcggctgttgggaaaaaaaaatcgcgtttgtaccttttccccccacagatgagaagtgtttgtaatggatttgtatttttcttaattttatgctctttagacgtttaaaagaaccaaaaaagaaacttttgcttcttcgttttcggttgggatttgcagtttaatggcctcagatccttctccagatccccagggtttctttgtcttatttatggagaaaaaccggtcactttgtccagcgcactgtgaggcccccactcaggccagccctggcccccccttggtacttggaaccgaagttacagattatattaaaataataatgtacaaaactttgtttttttgccttattatgcagaagtgtaatttcttttttggtttgtttttttaaaagcaaacgaaacgtgtaaatagtctgttgatataaatatatgacgttactaaattcttaatctagatagactttataaaaaccgtttccagaaacccctctggttgtttgtctaacatggtcacaaaaacccaggcgctgctggctgtaaacattatcagaagtttaatggcagcaactttccttcaactatgcaagcgcttcccggcggctctgctggttgggggaggaaggttccgccagcgacctcccagcccctgggtccgtggaggggttgggtcccccagcagagcccctgggccagcagaacagcactcctgggcggctcctgtgggcttcaggactggccggctccagccgcaagggcgatgctgtggacgtttgtgtggatggtgcagtgttcttggaatctgtagaccagatcggtggaggtatagaagtgcaagagtctaaaggctgattttacacacacacacacacacacacacacacacacaaaatcactgctgtgtgttttcttccgcctgaggcatcagcgtcacctcggtgtggtcgtcgcctcccaggcccttggcctggcctcctctcagtttgggttttgccctcacccacatgagcccccccatgccctgccccccttgcggccttttgtgttccccgatgtctgggctgtgtccctgccgggattcccagccttcggggtcagccgtcgagccacttgctttgctcagttctgtgtttcagccacatttccacggtggaccctgtttgttttaaatattctgttcccatgtcaatcagtgacgataaatacagccttgatttggatgaaactgtggtcgcgtgttctgtggtgttggggggccaggctcacccaggctgacccctgcagccgtgcgtccctcctgcagcaccttgggatgctgggcgcctcggcggccccacgctgtccggtgccatcgccccggaagtgaagcacagcaggtcccagcttcccagccctgctgccaccccggctctgcccagccccctcccccagtgccacctctcccggtggaaaccccagctcctggctctgccggatgccccattgtgctccttcgttcttgggggtgtcacgcggcctcccgtcgtcccacccccagcgaccccgctggccgccttccctcacatccacggggttttctgcatagaaggtgctcttagttcccgcctttgtgccagagagttctggccccgcagggacttgtgggattggctttgccctggctgtgcccgaaggaacaggagctcagagggcaggagccaggtgcagaggtggcagcccccaccctccagtgcagtgagcgccaggcccacctgccttgagtgatggtcaggaaagctccaggtgcacacctggccttgacctgagtgtcacccccaccctgtccctgccaattcactcctcactaaggggccccagggctgcaacctaagaaggaggcctcgtgggcccaccgcgcgcccagcaaggagtgccctgcgtcccacaagacccttccaggctggcaggaggggcaggtcccaatccacgccccaccaggtcattgtctggggcctggaccatctgccatgtggggcttctatataagggtttgcttcctatggagtcagccccaccaccctgcaggcctgtgtgtcccaacttgggcttcagcctttacggtgagctgccacttagcgatggggagacactgggaaatgtgtcatgcgattttgccactgtgtgaatatcacagcgcgtggcacacacctggatggggcagcctattgctcctgggctgcaccccatgtgactcctgaatcccatcggcagctgtaacccggcgcatgaaaaggtacagtaagaatgcagcattctggccagacgtgatggctcacgcctataatcccagcactttgggaggctgaggtgggcagatcacctgagatcaggagtttgagactagcctgaccaacatggtgaaaccccatctctactaaaaatacaaaaaattagccgggcgtggtggcgctcgcctgtaatcccagctgaggcaagagaatcgctttaacccaggaggcagaggttgcggtgagctgagatggcaccactgtactccagcctgggagacagagggagactctgtctcaaaaaaaagacagaaagaaaagaatccagcattctaatcttctagggccgcccctgcctatgcagcctgccctttcccacagcgcggctggacggcacatggctatgcttcacgtccccttgtcttggttattccaacctatgcatctaatcttcaggaagaccccaggaatgcatattctgccctgagtgagctgattgtgttagtcacccacacaggcctgctctgccctggggctggtctgacccaaagccccaaggcccctgcagggcagcccagcagcgagtaggaggcaaggccaggacccagcggcgaggaggaggcagggccagggcccagcggcgaggaggaggcagggccagggcccagcggcgaggaggaggcagggccagggcccagccctgtggccccagagatctgggaacatacctgtaaagcgcagctggaaggtggtcagcagtgcggctggagggagggcggcagtgcggctggagggaggacggcagctggagggtggacggcagtgcggctggagggagggcagcagtgcggctggagggagggcggcagtgcagctggagggagggcggcagtgcagctggagggtggacggcagtgcggctggagggtggacggcagtgcggctggagggaggactgcagtgtggctggaggacggcagtgcagctggagggagggtggcagtgcggctggagggagggcggcagtgcggctggagggtagagagcagtgtggctggagggaggacagcagtgtgactggagggagggcagcagctggagggtggacagcagtgcagctggagggaggacggcagtgcagctggagggagggtggcagtgcagctggagggaggacggcagtgcagctgaagggaggacggcagtgcggctggagggaggacggcagtgcggctggagggaggacggcagtgcagctggagggtgggcagctggagggtgggcagcactccagggccatccgctggccagaactacctgcgagcccagggatgccatgtgaaggagtgaaatggtgaaatgtccgcctttaagtcaaagcacacagcctgcattgaggcacagagaaggggggaggggaccccatccaggcagtccctctgggctgccttccaatgtagggccagccctggcactgaggcagccatccctccccaggcatcatccttgaggggagtaatctctgatggtgcagaatccaaggtagacttcttcccaggagcactctgtggggggtacactcctgggagcactctgtgataagagtaccttcttgggagcattcgtgagggagcaccctcctgggagcactctgtgaggaggggcaccttcctgggagcactctgtgagggagcaccctcctgggagcactctgtgagggagcaccctcctgggagcactctgtgaggaggggcaccttcctgggagtactctgtgagggagcaccctcctgggagcactctgtgaggaggagccccttcccgggagcattctgtgagggtacacgctcctggaaacactgtgagggggcacacagctcagaaggtcagcagtccaagcaacccaccccctggccctggaggattttggtcaggctatttccatctcacctggtaacttagaacttgggctaagttaccctcctgtaaaacttggaacctgggtaacttagaacttgggtaagactgaccctgctgtaaaaatcaggagttgaaattctactttatttcaacaagacctgaaagatgcggtcaggcaaatggaagtacatctgatgttgacagaaaaataaaggttttaatatatgttttaacattctatccttcatagaatagatacagggttttaaaaacactcaacctgggtgacatttgtcaagcagctgcagtgactcctggccagcccaggagagagaggaacagcatcaaagtccattctgttactacgagactcagggcctggcacgcaacaggggccaggtgtgtcctggacgggcaaaggcaccgaagaaggaggaagcctcccagacgccctgctgggctcctcctggcaatgcctggacccctcaccagcaagggagtggagtcccaggacaggcatggaccctggaatgccctgggtgtccaaactagcctgttctccgtgccttgtcctcaggtggccacctctgtgtcggggcttcccctgctctctcgtgaggactagtctgcgtttacactctacctgggtaatccaggaaagctgcacagcctccacatccttactttaatcacatttgctcagacgtggccttctaggtgacgtactcgcaggttccagagatcgtgccatggagatcttcctaccactgacgggaacctggaattcaaggatcttgacgcaggctgtaagtattcacagctgacaacgctgagttctctgcagcgtcggctgggatcctatccacagcccaagggcacatggcgctgctgggagaggccagtggccagtgctcttgtgtccaacaggctctacacgctggggaaggcccagagagaaaggagtgtgcctgcaagtacaggatctatgaccacgacgctgtcaacacacagggttttcccacaggacacgtgttctggaggcagaggttcaggaggtgctgcaggagcttgagtcaggcctggcatttctgtgattctcttggcctttccttgctcattgcctcatagttatgaaatagctgctgtagctccaggcattacatccacctgccaaggagagagatcagtgaaggggagatggtgagtgccaaccttgtctggaaagacagggcctccccagggttccccctcaccaccagagggtctctgctgaggtgtcatcggctgacactggggggcctgcacccctcgtcaacagggcaggggaggtgggccgcacctggcctgctggctaagggcccaggttcttggtgggagctggactaacccaggggcctttgggaaacctgaaggtcattttacatccggcatccgcacacctgagaccttcatggacttcaaatccacaacattttactataaattatttttatttttctgttataccacagtttggggcttatatatttgggggccttagatattttttccctaaaattatatgtgaagcttttaagaactgaatttcatttctagatagaaaagaaagcatcataaaatatttaccatgaaggcttcagaccgactgcctcacactgaccccaattccttccttcctgggtggtctcggggctgctcggagctgaacagggtccccttcgacagggttcggggggatggatgtggccttgctgaacacagcagcaaacaggaaaagaggcctcatggaaacagctgagcccgtgtggccccctggaaacctcaccccagccccacgagaggctcagcatccagccgccaggccggagggttctgggggcagggagggtcagaaccacatctcgtaatcctgcagcggcttgcggctgaggattgtgaccgcctgtccccccaccctgccactagggaggccaccaggacacggctgcctcctagtcaggaagaggctcgagggctgagttgaccaagcaggggccaggtgtctgcacctgggcggcccagaggctgcatggtccctgggcctgacactcacggctcctgtttctgccccagagaagcagatctggcacccctgctcatcaagttcaacgtgtaaatggaaacagcaactcaactgttgggatttccctcctttacatttttgttctaaaattttttttttggagacagaatctcgccctgtcaccccggctggagtgcagtggcgcaatctcggctcactgcaacctccgcctcccacattcaagcgattctcctgcctcagcctcccaagtagctgagattacaggcagtagctgagattacaggtgcccaccaccacgcctggctaattttttgtattttattagagacggggtttcaccatgttggccaggatggtctccacctcctaacctcatgatccgccagcctcggcctctcaaagtgctgggattacaggcgtgagccaccacacccggcctaattttgtattttttaatagagacagggttttgccatgttggccaggctggtctcaaacttctgacctcaggtgatccacccaccctggcctcccaaagtcctgggagtacaggcgtgagccactgcgccagcctagattttagaaaaagaaattataggactgatgcatgttccttgtcacaagcaaaagaatccatgagtgatcaggaaagcagccactccctctggggacactacctgtgctgtggaaccgtccgagggagctggactcctcatgctccaggaagaaccgcgggtgctccatgatgccagcccctgtggctgtgtccggttcgtggattaagtcttgtctatcaaactgcaccttctgggacaaacattttttgtgggatttgattctccaacgtggaactgtgggttcagaaacggtgcttatctgtaacttgtatttgttattttaaaaatttcagcttgaaaagttgcaagcgccgttcacataactctttcctgacctcagagcgagctggtaaccctccaccttcgctctcggcaccttctgtccgttccggcaggcaggctgtccgtcccagtccacaccgcagccccccagcatcaacgagcagcacagctccctgcctggtgcagggcctcagcattcacgctgcttcctcctgggagagcccgccccgcctctcagggactctcacaaccttggtgcgcagaaggttctggaccgcaattcggggacgccctcactggctttctccggagcgtgggcattggagtggaaatacgtagaattgctggggatcctcgaagccgccggcagcgcccgatgccagcttgtcccatcaggcgttggtcccgacctgcactcagccacctgcccccggttttgtaattgagcattgaggggaagatgcctgaacccatatgaaacctctttcccctcaaacgttccctgcacgcatcaattacatcagcgcagctgggccttcccctgagcgtgatgtccaggggcgaggccagtggcttcctgcgcgtgcccgtccccactcacagcccctgacctccggggcccccacgcaccaggcgctccctgcccggccccatctcccggagccctggaggctcagcctgggtgtcgtgtgtgcctcgtgctcttgggaaagttacctgtgtttcttcacatctatatttatttacttccaaaaccaccaaggtgtgttgaaaaccctggaattccaggccaggcgcggcagctcacgcctgtaatcccagcactttgggaggccgagacgggcagatcacgaggtcaggagatcaagaccatcctggccaacatggtgaaatcccgtctccactaaaaatacaaaaaaaaaaaaaaattatccgggtgtggtggcgggcgcctgtggtcccagctactggggaggccgaggcaggagaatggcttgaacacgggaggtggaacttgcagtgagccgagatcgcgccactgcactccagcctgggcgacagagcgagactccatctcaaaaaaagaaaaaaaagaaaaccctggaattccagtccgaccgcacagggctcatcccgtgctcctggcatccactggcttccccacggcggggagcccgcctgctccccttgcagatgcccctactcctcacctgagcccagcacccacccggggccgcccacccggcacagcgcctgccctctgctcggccccggccaccccaagccggcgcagggtccatgctgtactcccaacccctggctccccacggcccgtgaggatgctcagcctcatgcaaaggtctcaggacgaaattgtccaggaagggaaggcgagcgggaggaagggggcgggcagacaagctgtgcggcctcttctcgcctctcctggctgcgccctcaggtccccgattcgagcttcctgcccccactgcctgcatcctaccggcgcctgactgcacttagggcctcctggaagtgcagactcgcctctccatctcaagacccttaacttacttacacctgcgaagctcctgttaccacatgtggcagcactcccaggttccacggcggggatgcgtctccgtgccgtcgctcagccgaccacgcagccctcccggccccttcctgtcttggatgcggctgagatttctggagcacagcagccgtcctgcagctgcagcgagtatttagagttcatagcacaagcctgcccctatttaagttgcagaaataacacatttatctccaggatttgccccaacccttgctcatctccaggcctcagccttcctgacacaattccacctccctggtacagatgctcgtggctcctcaagacacattttaaatcttttttctttattgagctgaaattcacatcacataaaatgaaccgttttaaagcgtacaattcggtagcatttagtccatttgcgatgttgagtgaccctcactcccgtctggttccaaacgctctccacctggaagagaactccctccccgtgagcatctctcccaccgccgccctggcaacccgggcctcctcccgcctccggacccgcctgttctgggcctgcatagaaacggaagctcacagtcggggctgtgtgtctggcttctgtcccccatcgccattctccaggctcaccccctgcagccgtgcgggcctcattcttttcctggtggaatcctgttccctggtgtggagggccacgctgggcttatctgtcgatcgtttgtggacacctgagcagctatgaagagtctgctttgaacatctgtggacaacaatttgtgtgacgtctgtttccgattctcttgggtttgtcccaggagtgagctttggggtcagatgtccaagttcacagtcacactcgagccgtgacctcggccggggccttgccaggtccagtcctggcctcaagatgccccttcagggtcagcccgcagccaggggtcccagagcaggcaagggcttgaggagggcctcccggggctggggcacctgcctttcaggtgaaatatcagagtgttcaacccagaccataccaatggcacccgcgcggagtgcagtcaccagggaaccgccctgcggcgatggccccggcggggagagggtgggtgacgtgcgctgcggagcatctgccctggtggaggtgcagccccactcaaaaaggttcaccgtgtgagttaaagatgtttactgtgaaccctgaagcaaccactaaaacaacaaaacaaaattctggctcataagccaacaactgcaatcaaacaggatcatcaaacagaatccaaggaaggaagaggaaatgggaaagggagagccggtgacagcagcgggagcagagagcaggacggcgggcgtggcctctacacagtgagaccaatgggagcagagaacaggatggcaggcgtggcctctgcatagtgagaccaaagggagcagagaacaggaaggtgggcgtggcaactgcacactgagaccaatgggaacagagcaggacagcaggcgtggcctccacgcagccacagccacaccggagcaagtggtcagacagccccagttaagagcagagattgccagggagggtaggacagcaaaacccaacgctaaactgctcatgagaaatgcactttagatatggacaccaataagtcaaaaggacaggaaaagctatgccatgcaaacaaaaatttttaaaacctgcagtgactatgtcaatatcaaagtaacttcaggggccgagcacggtggctcacgcctgtaatcccaacactttgggaagctgaggcgggcagatgacttgaggtcaggagttcgagtccagcctggccaacatggcgaaaccctatctctacgaaaaatacaaaaagtagctgggcatggtggtgggcgcctgtaatcccagctacttgggaggctgaggcaggagaatcacttgaacctgggaaacagaggttgcagtgagccgagatcgtgccactgcactccagcctgggcaacagagcgagaccttgtctcaaataaaataaaataaaaacaaatatatattaaaattttaaaaaattgcagctggacacggtggctcacgcctgtaatcccagcacttcgagaggccgaggcaggtggatcacctgaggtcaggagttctagaccagcctggccaacatggtgaaaccccgtctctactaaaaatacaaaaattagctgggcatggtggcgggcgcctgtaatcccagctacttgggaggctgaggcaggagaatcacttgaacccaggaagcaaaggttgcagtgagccgaaatcccgccactgcactccagcctgggcgacagagtgagactccatctcaaaaaaaaaaaaaaaaaaaagaattcccaggcaaagagctatcaaggatgaagatgctctcaggcagtctcaggcaggcaagggttcaggcacacatttattccctgcatattttctttggaagctaccagaggaaacatt

SEQ ID NO: 301 - DNA, 22990 bp, Homo sapiens
ctgcaattcttgtggccatgtgggcagatagggcaaacaccagccactgtttaagcctctgtaggtccacagcccagtccccacccacttacctagaagaggaggagagagagaggaagcgtcagccaaggcccagctattgagaaagagctcagccagtaggggtactgcccatcccctcacacatcaaaggcacctctaggggaaggaggacaaaaagcaccattgcctgtgtaggtgctgtaaataagtatcttatttaaggccaaggtggctcctgacttatcactgaatccccaccctgcccccaccccaaacccagcacaacacctggcccagaacagcctctaagtggacttggactgaattcactggcctactgctagcacccaccttctctgcaagcctgatcaagtcaaacaagaccagggatcttctcaccagggaagatctatgcagaggcggcacagggttgggggtgcagggcattctgacaccccacctactggtcacgcacccttgagtaagtcgctcagcctccctgagcctcaatttcctcacctgtaaaatgggatgagtcaggtgtgtggagatagcgaggaggccttgcagggagcatgcagggagaaggcatttgctccagctcatctttaggaagcagaacacagctgcctgtctgcagccttgctgccagaatcaaatcaggcaataaagggttgggcaacattaaaaattgtcaaacaggagagggaagcaacaaaaaatgtttattgggtacatactgtgtgttttatccaccctttatctcctctattcctcaaatgaactccttcagataaatactaataccctaaatgtacggatgaggaaaatgaaactcacagagaccaggggcgggtggaggatccctccaagttcacgctggaagttcagcttcaggttagcctctgccctccccccagctattcgacactacctcctgcaaaggactgtgatctgatctttttaaaaaatgttttctcttggttatcagttttaatttgtatagttatattattatctaagcataaagtaaattaaaaatctattttatgatcacataaaattgacaggccagaatattagtgcatgcaatctgtttctaattaggaagtcgatgtggtattcaacaaattaattgattctttggttcttaaattgttgtttagtttctttattcatatacacacacacacacaattttatgcacatgtattaaaatgtgtgtgcactctttttgttcctttcctgtttttcttggctccccttttcccctcaaccactgccacccacatcagccttcaaccccacccccacagtaatctatgttcataactctgtatgtatcttttcatattgttggtgcttatataatctcacagacacatgcacatgcatttacataaatgagggatgaggggttggctgtttatttcacataagtgaaatcaatatcctacatgtacatttctgcattccacatttctctctctccaatccctggaggaatccctccttgccatccaataaatagctccaatttattgactataatggctgcttaatactccagggtagcagtggaccattatttattccacctgtccactatcaacttttaaaaatgtgtttgccaccttctgtcactacaaataaacagcagtaaatatctttgcacatatgcctttttatactggtctgttatttctattaatttaaaattaagtgaagtcccttaaataatttgaaagtcatctttgctgtataatcacatataacaaagctggaaaagaacctggtagaataaaaggtctggtgacagaacaatggatgagtgttttcattttctatatttccttttgtttcgtcacactattcatatggtagataaaagctagagacgtatgggattttttctgttgttttttgttgttgttgtttgagacagggtctcactctgtcacccaggctagagtgcagtggcacactctcggctcactgcaacctccacctccttgattcaagcgattctcccacctcagcctcccaagtagtggggctatgggcacgcaccaccacgcctgtctaatttttgtattttttggtagagatggagtttcaccatgttggccagactgctctcaaacacctgacctgaggtgatcctccctcctaggcctcccaaagtgctgggattacaggcgtgagccacagcaccaggccgacgcatgagttttatgtgtaacaatcctaacatggtaggagaaagagggacccttgcaatcaacagtgtgttaactaggggtgaagtcagaaatggcgtctcctggatagctgccactattgctttaacaccccttgatctgctcaaagcccttcgggggtcttggactgttggggattccaggatgcagacagcacatcagaggaggggccagataaggagctccactgcctcatgcctcagttctgtagatggggctccatccctccagggctcaagaagatatttgctttcacatccatgccagcttgtcaatacctacccatggagacctccctgtgccaacacaatgagaagcacatggaacccagagaagcctgccctcaagaaattcttctgagcaagttctgtggagtcctgaaagagcagagacttctaaaccaaacctccacggcctgactccacaagtctttactgagtgtcctttatgggctgggtaccatccaggggctgttggtaactagcaaaacaaaagtttcattactgtttatgtttcggggagcagacagaaggtcttaaacaacaagctacagcagtgaaaagacaagcacaagaaattgcttatctcatacactaggagggacactgagcttattagagctctcagaaacaatggacccaaagaaagcagagctttacaagcataccactcattcatttacaacagcagatgcactttatgggctgccattaattctcactctagtcattgtttttgcacctcatgcaattatctaaaacaatatttgccgaactttgacagtaagtcaagcataaggaatctgaaggtaccttcaaattagacagatttcaaggaacactgggagttctcaaccttctcagctcaggtgccaggatcttaggaagtgggaaagaccaggcaagagcaaaaggcagtctgatttggggcttgaatcatagtttgagaaatccaggcagcaagccatttccagatggaaattctggttcccttattgaagggaaaactcatatttctgcacaatattgtccttctgtttaaaaggggctcatgatttgtttctacaagataacagcaatgaagaagagataagtgatttctgctctccgggagttttgctaagtgactgtgagaccccaagaaagttttttttttaattttcctttaactactgtaaacctgaatttctgcatctgtcaggtagaggcctttcgtgatgagctttccaaggatctgctcctgggggttaggcactcggaagatacgggtacagacaacttctttaaaatagcacccatgcccaggctgggcatggtggcttacgcctgtaatcccagcactctgggaggccaaggcaggcagatcacttgaggccaggagtttgagactagtctggccaacatggtgaaatcctgtctctactaaaaatacaaaaaaaaaaaaaaaaaattagctgagtgtggtggcacacacctgtagtcccagctactcaggaggctgaggtatgagaattgcttgaacctgggaaacaaaggttgcagtgagctgagatcgcaccattgcattccagcctgggtgacagtgagactttgtctcaaaaaataaataaataaataaataaaataaaataaaatagcaccgcatgcccagttggagggtattctacatcctctgttctgacatctcattaatgaacaactcatgaaagtgtgtgccagcccaggagttgtttagtaacccaggccaggactatgtctctgtgtaagggtccttccacaacatcatctttaaaagaatcagctgaatcaatttaccaaagaggtttttaaagataatactcacagttgatgagcatgttttgaaataggcactcccattccctgctggcaagatatgcaaattggcacaatttctctttaaatcaatttggccattcaaatcgagaatcttaaaacatctgtatcttctcatctagtatacatctaggaatctagcctaaggaaataatcaaaaatatttgtgggagctgaggcaggagaatcgcttgaactcgggcagcagaggttgcagtgagccaagatcatgacattgcactatccagcctgggcgacacagtgagactctgtctcaaaaaaaaaaaaaaaagaatgaaaaatggtatagacatttagtgtaattgttgttgtaattatagttggtaagatatgtttacttcatttttacttcatttatacatatatatgtataagtacataaatatatatgcataaatgtattttatttatacatatatgcataaatgtatatatgtataaatgtgtatatatatgtacacagtcacggattactttacaacaggaacgcattctgagaaatgcattattaaataattttgtcattgtgtgaacaccatacagtgtacttacaaagacctacatggtataacctacttcataccaaggctagatggtatagcctattgctcctaggctataaacttgaacagcaggttactgtgctgaatactataggcaattgtaactcagtggttggtatttgtgtatctaaacctatctaaacacagaaaaagtacagtaaaaatgtagtattataatcttatgggaccactcgtgtgtatgtgtgtgtatatatatatatatatatatatatatatatatatatataccatccatcactgaaaaacaacatgttgttatatggtgcatgagtgtatatatagagagacagagagaaaaacttgtaaaaatactatcagtggttacctttggtatcgagatttggggttcgctctgagtcataggctcaccctagggcttgggagacagggtgaccagaaaaagggaaacacattcgctaaactaccaataatgccaacaatgattgtgcattatagagtaatgaatcaggctcagcagccttgaaagatgaatatggttttgtcatgtaaagcagagacttcagattaaactcaggttaaacttgcagtttatcttcacctcctaaacactactaaaattactataaatggataaaacccatggggtcaaagagatcaggaaactagattatagcaatcaagttttggaatctggaaaacaaagacaaataaagcccagcgcttgcccagagagaagccaagaggcaaagcatatttacactctggaactttttaactctgaatttttaagaactctggaaactctctggaatagggggcaccaggtacctctgacagtgaggaacaagtgaactagaaatgggagggtgagctagagatctgtataaaaagcagagaggcggccgggcacggtggctcatgcctataatcccagcactttgggagaccgaggcaggtggatcacgaggtcgggagattgaggccatcctggctaacacggtgaaaccccgtctctactaaaaatacaaaaaattagccaggtgtggcggtgggcacctgtagtcccagctactcaggagattgaggcaggagaatggtgtgaacccgagaggcggagcttgcagtgagccgagatggtgctactgcactccagcctgggggacagagcgagacaccatctcggaaaaaaaaaaaaagcagagaggcccctgtagctcctctctcccctccttgtctgatcccaaccactccacgattactccaggagaaactagatgtttatgctggagaatttccccagagggactctgaatcctgagacaccaagaagggccaataaactataatcaattagtaacagagtagctgagactgagaccttctctgcccccttcccgcactcagcttccagaaagctggtagcttttacaatccagacagaaaattagaggtattccttctggggaagaccctacccaagaaaagtcctacagataactgttccccattgaaacgcttattctccaccagattactctatactgagacctatcagtggcaagctcccatgctatccacacacatatacacatattccaattagtttctcagtgacttactcttaaatatgaacgactaccaaggaccactagacatctgagaaaagcctctggcatgaaagatggaggcaagacaaacagcaagaaaggaactgaggaaactgagccgatgacagaaatagaagcattgctggagccaggactaataggctcaaagagatagagaaactattgcatcttgaaacaagaacaagagactgttgaaaaaacatgcagagctatgagatatgaaaaatataaaagactgctgttgtttttaagacaggatctcactctgttgcccaggctagaatgcgatggtgtgatctcagctcactgcagcctcgacttcccagtctcaagtgatccgcccacctcagattccctagcagctgggactacaggcacaagccaccacatccagctaatttttgtatgttttgtagagacagggtctcactatgttgcccaggctggtctcgaactcctgggctcaagcaatccaaccaccttggcctccaaaactgctgggattacaggcatgagttgctgtgcccggccaaatacagcagattttttaaaactctgaataatggagttagaggtcaaagttaaagaatttctcagaaaacagcaacaacaacaacaaagaaaagacaagatggaaaataaaacagaatacccaggaaaaagagccatttcagaaagagagaaaatggagggaggaaatcatgaaacacgaaaatttgccagaattgaacaacatgagctcccacattagaagtttctgctagagtccagccggtggatgaagttacagctgcatcaattcaacacatggtatttcagcctgctggagagaaagagaagaactgaaaagcttctagggaggagagtgggaacaggataataagaaatgatctcgagtcaacgtggcataagacttctcaacagcaacaccagaagccaagaaacagtgaaactgtaccttcagacgctgagtgcaaatgatttccaagctagaattctatacccagccaaactatcagtcaagagtgaagataaactgaagatctttttgacacaaatggtctcaaaaaatttaaccccgataactccctttccaggaaactacttgaggatgtgcttcactaaaacaaagggaaaaataaaaacaggaaggaggaagacattggatccagaaaacaaggaatgcaacacaggaaaaagaaggaatttcaggatgatggtgaagagagattccaggatcacagctgagcagaagacccagacagcacccagaacagacaagagcaggacagaaggccctaggagacacatcttcatgaggatgaaattgatagaacacccagggttctaaaatactgaggagatttatacttccagcagtgaatcaggaaacaaattaatgatcaatacatagaaagtttaggcaaattgaaaaggagatatttattccaaggaaatttaatatagcataaaatgtaacatagtataatatatggtttgactatgaataacatttaaatagtcttaataatgtaaacatttatctaacaaaaatatgaatatattgagaaggtgggaagaagatatttaaaaaagaagtgggcaggcacaatgctgtataacagatctacatcctcatccttcacagccagaagtcaagcgattaaaaactgaaacacaaaaatcaaacagtaacaaggtaaagcctgttatttagaagtaaggagacaaatcccaaaagaaacagctgaagttgaaagggggaggcgggaacagagctgtgatatccagtctggggatggctttttcattaaaaaaaaaaaaaagaagaaagaaagtcttattcacaatagcaaagacttggaaccaacccaaatgtccatcaatgatagactggattaagaaaatgtggcacatatacacattggaatactatgcagccataaaaaagggtgagttcatgtcctttgcagggacatggatgaagctggaaaccatcattctaagcaaactatcacaaggacagaaacccaaacatcacatgttctcactcataggtgggagttgaacaatgagaacacatgggcacagggtggggaacatcacacatcggggcctgtcgggggtggggggctgtggggggatagcattaggagaaatacctaatgtaaatgatgagttgatgggtgcagcaaaccaacatggcacttgtatacctatgtaacaaacctgcacattgtgcacatgtaccctagaacttaaagaataaaaaaaaaaaaaaaaaaagtcttggctgggcgccatggctcacgcctgtaatcccaacactttgggaggccaagacaggcagatcacgaggtcaggagatcgagaccatcctggctaataaggtgaaaccctgtctctactaaaaatacaaaaaacaattagccaggcatggtggcaggtgactgtagtctcagctactcaggaggctgaggcagaagaatggcatgaacccttgaggtgaagcttgcagtgaaccgagatcacgccactgcactccagcctgggcgacagagcaagactccgtctaaaaaaaaaaaagtcttatgatgttgtacatacataacatttttttaatttaaatagttaaaacatggaaggcatccaggaagaaggaacggcaactgagaggtatgggccatatctcagtcaggtaggggtgactcaggggtttggagctgggaggggcaggaggacaccaagctgagttgagactgaaggctgagtgctgcaggggaatgggatccatcgcaggctgttaagcaggggggtcctgatctcacccttgttcttgatcttgaccacattctggtggaaatcattcagtggaaatttaatgtggatgagattgactctcaaaggggacccagttaggctgtgcccaggtctagggagagaggaagaagatctaaacatggcaatggccatggggcagcaggtgtttcctagggtgctcatcagcacgcaattcaccagctgatggaaatgaggaaggaggagttgatggggtgtgaggagaagcaggctgggagaaggaggatttcaggtctgacgaggacactgttcttaaggaagaaagaactcccttccaccctccagcgtagaaactgtgtgcagatgtgggagagcccatgggtagagttaagattcaagcatgggagtctttgggttaaaatacctaaaaaggtagagtggtgttaaaagaaaggcatggactttgcagacagacagaactgagtttgagctccagccgtgccacttactatctgcatgattttatgcaacttactgaaactctctgaattctgggggttgtcaattccaaaatgggcctgaccatacccacctcacagggttgcaaggaaaatatcataaataacctctgtagaatgcctccatggtgtcagtcaacacgtgtggacactcccccatcctgtgtcccacctcccacttccatagagcatggaggtcttccaggaagacccttcaagatcttctgagatttgtcccatttcccacatctctcaggctgtgaggctccagaaggtttctggaaagcacctgcaactcccctcccatcagttcaagaacagagatcacacaggtttgcatcaaccagaaagtcagctttattagcccaccaccagcagaggagcaggggagatagctgggaactgcgccaggagagcagggtcctgacccgggccttcaggaggtgaggccagctggtgggcaggaggctgtggtagaggcagctcagttctaggagctctggccctggctgaagctggatgagctctgctccttgaggatgggccgggtctgacggctcgaagaggacgaggaggaggtgaagactgtgggagagagaagaggaggtgagaaggggtctgagagctaagctgactccagggcagggagaagggagggctgggagctctgaggagaagggcccagcccccactccatggaaacaggcagaggggctgcagtgccggggagcctcagaagccttaccctcgcgggaagaataggattggccagatgcttgctgggaggaaaggctgtgggagagaaaaagcagggcagtcagttgtgctgagagcagcaggggggctaaagggtctgggaggcagaactgaggggcctgggactcactgggcatcctcgccctccagcaggcggcggtaggtggcaatctcctgctccagccgcgtcttcacatccagcaagatctggtactcctggctctgctgctccatctcacagcgtagctgggccagctgctcctccacactgccaatcagtccctggatctgggacagctgcatgcagtagcggcctttggtctcctccaggctgttctccagggatgctttctgcaagtgagagagagaaaaagagtccatggaggtggtcactcctgttcctccaggtctctgggcatgttttttgagagatgcctggattttgatcccagttggggtactgatgggccagacaatatggagaaaagctagcccactattctagggcttagtttctctatctatataacggtcccatgagtcccctggtcccatcctgagaaaagaaaggtggaactagactgtggctttttgagggggtggtggccattactggtgacttgggggctgctgctgtgctgggtccttcataccatgctgagctgggactgcagctcaatctccaggccctggagcaccctccggagctccgtcacctcactgcggctgctctgtaccagttcgctgttggaggccacttctttgttcagctcctcggtctgaggcaggaaagcagagtgaaaggtgaggctctcccaaagcccccagctgggaagtgctgcaggctcactgcgggcccgagccccaccttgctcaggaaccaggtctcagcgtctctgcggtttttctctgccatctgctcgtactggtcacgcatctcattcaggatgcggctcaggtccacgccaggtgcagcatccatctccacgttcacatctccgccggtctgacctctcagagcaagcatctcctgggaagggatggcaggaggcggtcagttcagcagacttctctcctggccctgggtgcatctggcaaccccaccaaaccagcctcccaccccggaagccagcagcgaccgtacctcctcgtggttcttcctcaggtaggccagctcctccttcaggccttcgatctgcatctccaggtcagtcctggccagggtcagctcatccaacacccggcgcaggccattgacgtcggcctccacagtctgccgcagggccagttcatgctcatacctggcaggacagaggtcaggtcctcaggctgcagccctgaggattctgaggctcggggtctgctggccctgctgggtggaccgccccactctttgtcccttgccctctgcccccagcccaccatgctggctgctcacttggtcctgaagtcatcggctgccagcctggcattgtcaatctgcaaaatgggctgcgcattctcaatggtggccgcaatgatctggagtggggatggaggacaggagccctggtcagccaaggaccttactacttgagcatgaaaggcagaaaggggcaaaaggaaccgccccaaatctggaagtcttctggctggcagggctggcatgccttctccaccagctcaggctacgtagggatgcactccatcccgatcacccccttcctgggcccaaggcagggaagctgaacttgcagctgaacccttgaaggaaataagagatttagggtaacagccccagtccgggcacagagatactgaaaagggaccctctgctaccacttccctgggtgatcctggccactccccaaaggtgcccagtctccctgtttgtaaagtgtaattgctaaaaagaggtatcccaagggccactgtagccccagcctctctcagtgctccatacaccaaagtcacccaccttgttcctcaggtcctcgatggtcttgaagtagggactgtagtctttgatctcactgggccgctgcctctggtaccagtcacggatcttcacttccaggtcggcgttggcctcctccagagcacgcaccttgtccaggtaggaggccaggcggtcattgaggttctgcatggtcaccttctcactgcccaccagaagcccatcaccaccagcaaaaccaccaccaaagccagcacccaagccaccaccgaagccagcaccaaggccaccaccatatcctcccccgaagccactaccaaagctgctgctgctgctgaagccaccgccatagccgccccccagcccgcaggctcccccagaggagaagcgagaggagacagacaggccgcccccgtaggtgctgggggcacggcaggaccctccggccaggacggaggagatgcggctggagccgcccccgatgccgcctccgatgccgcaggagcccttcatggagctggaggaggtgaactggcggctgcaggtggtcatggtgccaaggagggaggtgagcgagtgagcagttggctgaaagaaggaaaggtgctcaggaaggctgagagcgtgctgtggctgcctccaaccccagagacctttatatgcagctggggaaggcggggccctcctaactgctgactccaggttcccctctggatttcatcactcccggtcccgtccaactcctcactctggattattcagcccaggatcaactctgctgtgtgccggctcagagttcccacccagctttgggggtgtggggccgagagaaaaacacagaaatgcgagttcggtggtgactcaggctaggcggtggggaatcaggctccctttcctggagccctcggggccagtcgggccttggcacaggtggctttgtggcaactgcgtccccaggcagtgagtcagcccttcagaagaactccctgccccacagtgacagccttggctgaaagagagctcagtgatgccatcctgggctgtcttggggagcagttgtggggatcccacatgtcccactctgggcaggggcagagttcctgtcttcactctgcttgctgtgtggcctgaggctccccacctcccacctctgggcctgtttcccctcagtgaccaggctggactgggtgactgcagagtcccttctgttctaaaaatcctataactctctttcccctcttggatctaattccagttccagaggctgccttgagcccccgggatctccagaagtgtgtgcaccatacaaacagcactggccatggagctagacaggcggcactgagtccctgctctgcccttaccaactgtacagcacaggctggtcctatagccccttggtcctcagttttctcatctgtaaaaggggatgacacaccactagccacaaagaaacatgcgcgaaggaccccaccggcccttccccgagggccagccctgcccctcagcctccccatcctgcccctccagccacctgctcctcacactcacctctacacactggcaccatcccgcacccctaagcagggccctgcgccccccacactcccagctgaagaacaccacagccccacacctagctctgccactcctctaccgccctctcctaatcacaggcaccccacctgcaggctggtgggagggagccccatcctgccactacagccaggtatgacccctgaccccacctgggcctcagagtccccccctaccctgtagaaacaggactagccggggatccgttcccagcagttctctctcctgtgtccacagatcccaggctaggcctggcagctccattcatccagctgagctgggggagagcactggttatgggcccactcaggcatgcatggagagcccagtgtgtgccatacagttctgtgagcgtagagattcactcaaagtcactctgctttaagctgcagagctgcaactagaacccagaactctggccctctccaggctcccaccatgcctgcaggcggggccagtatacccaactctcacccacctccccacgatcactggcaggaggtctgcccatggtgggcatggccttggcctgagagcctggtccagcaccgaggactggagggaggatggaggggtctgggcaccaagacggggcctcctcagggtgctgtggggcatccctcggtgctggccactggccttgctctgcagtgtctctgttgaggtgaggagcccagagacagcctgcttctgcctgagctccactggggcaggcaattccttgtctcagcagaaccagggttttgtcactgctacatctcccctggtcattcatcccagaggtaagagcagaacggatgcacatcccttcagagtcaaacctgggagagggaacctgacactcctcacccctaccccaaaaaggggcaaaggggaccccggaatcttggacaaaaacctcagtgttcaggtgtcaggttgggcctggagttctggtccatccacagacccatcaccctcagaactgaaaatggtcttcaaggtcaccaaaggctattaataccccaactggagagagcgaaagccttatccaggttaagcagcacaaaagtgagagagcagagactcgagccagctctaactcccaagccaggattcacaccgactctcgtagtagagtctctgagaactcttcactctctgcccccatcgtgtgtgcatgcacacacacccctttctcattggctcactgccccccaccaagttccccattccaggaggtgtcagggcgggattatacacaagcccagcactgcagacctggggatctgcatgggctgagaagctgcaggaagttgctgaccaacgcgccaaactgctcagccaactccatagatcacgcacctgctgtgtgtacagctctcgggggctgggggtgaagagggagatgatgacatagtctctgaccttagaagaacttatcatttgaccctggagggaaaactaatgctggaaaatacagaacctggctagaaaccctggggtgctgggcttgcctgccatgcccacaccacaggaggcagctggggtaggcattgccccgctgagcctcagcagtagaggagggggctgccctcctggccttgatccctgaaagggtcctagcagagagaggcaccagcagggcctcagaggatctgagttgacagaggaggaggaggaggcgtttcctgtgcaccagtgatgcacacctgccccaaggtggccaagagccaggaccactaagcctggtgagcacagagaagcccagtgggcatcctccaggcagaggattcctccccacaccctgcctccttcctccctccttcgtactgcccatgtcaagcatgaggcatgagatcatggcatacctgaggcagccgggaaacaccattggccaatgccacgccttgacttgcagtgattctccaaccagacagatcgtcagagtccccatgaagatttgcagccctgctccaactcccgcatcagcaccgctcaggacaagcctgctggtggggctgttttacaagctccccagccaactcagactgggaaggcaggaggcagcttgggggctaaggaggggggcagagaagctgaggggagagagggggctgctgcagggcccccagcctcgggtggacaagccagagccacaggcttcagggcaggaggaaggaaaagtagagccccactgagccaggacagagcagcctagaatcggggcaagcaggggcgaaatcttgggcaggacattcagcctctctgagcctcagtttccttctctgggaaatgggaataacagccttgcctcacaggcatattaggggattcgaggccaaataaataaagcacctggaaaaggctggtggctagcgttatgtttatgagcaggtgtttataaagtgcctactatgtgcctggcactgtgctgggcactcagactcaaagaacaagacagagaagccctggagacacagtcttctgggggagaaggtggtaaagacaatcccaatacactaatgtcaggccacgatggggtactggggccctgcagagaaacagagagagcagggtccctgggggagaacaaatgtccaggcccaggctctgcccctgtgacggctcccgggatctggggaaatctgtgagtgccaggcccacctctggggctcctatcccctcctgcatgtttgatgccccccttctgaaggtggggctgtcatagcccttcacaatccaaccacagatctgcagcttctgccttgatgatggggtgaaacattctgtgcattgggcagggtgggtgtggacgaactgtgagtccctccatgagtcccatagctgggtctccagtccagcccaggcacatgtcctcagcagcctgggcccacttggggtgcctgttctgcacaaacaaggagcccggactcctgtgtgagtctcaggaaacccacaagaggggctcccattgcccccaccccaggaatgtgagcaggaagctggtgcctccagggaaggctgcggaccccagggggttgtgggagaaagagtgggcctctctcagggatgtttcttcaaatggtcactacagctcagggtgaggacgggcctctgtccagctcagttatcccctcagctctgtgcatggggggagacctgcctggctctgttccctctgttcccctcatctccccaaaacctgggttgccacaagagacccacactgcataaaggctgagggactgttttcagtccctcaggtcccctcggggcaggcactatctcttggggtcaggaccggtgtctcctccttcccctggcaggatgtcctgcagggagatggatgtagtgggggacactcatctccccctggacatgctaccaggtcagcccctgcaagggggatccagaggtaggctaccactggcatggacctggcctgagaatcatatgtgtgtgtccatcactcaagaccaggtgtggcagctccaagggcaaccacagatctgcagcttctgccttgatgacagggtggaacattctgtgcagtgggcagggagtgtgtggatgaactgtgagtccctccatgagtcccatagctgggtccccagtccaccccaggcacatgtccccagcagcctgggcccacttggggtgcctggacagacaaagccgctcaagtctccccaccatcccctggctcagctgtctgggcacaccggggggctcccccattctggcatcctgagccccccacccactcactttgtggagaagggtttcttccccagcagaggggcacagtctggggccgtctctggtcctccccacactctgacccctcctcacttgtcccatcagtaattgtggaccccaggatctacagaggggagagagagccctgcctggaacctgaggtggggcaggaggtggggctgggctcctcttcccggcacggaagcggggcccactcccctcccgtgcctgtctccactattgaccccctaggctccgggacaagggctgagtcactgctccttggagcctcagtgtccccatccacacaacgaggtgccttcccccaggccctccctgcttcctgggactattcagataaacgaagtcaccctccggaatgagccatctgcagcccagggctggttcttctggttgtggcgggatgtgtggtgggggcctggtgcaaacagtgcctccctcctgccctccatggcgccacatttgctgccagacaacagggagacgtcagcctctgatggagcagagcctgcccttgctttcagtcgtgcagatgccgctgcaggtgcgagtccccgactccaggcagccatctcccctgcagagagaaactctctcccaggatgtcttagctccaaggtccagggagggcctgtgaccagcccaaagtcacccataccccagtggtcagtacccacccccatccctggcctctgccagtcccaaacccccaccaacccaggctcagagggctctggtcactcccattttcctcaggcctgggcccaacccccagcctccaggcacgaggagagagagggtgtttgggggccctggtctgattccgcagcagcagagacaccgcaggtccagcagtgatgaggtggaggcaacctcctcctcccacgaaccccctgcttgaagaaaaccaggaaagcaggccaacccgcctggcagtttccggatttactagaaggaagatttccaggtgtcaggctcatctcccacagactgttccccacagccacgtttgctgccaccagcaagagctggggttggtcagctcagagggtgccgggagtggctggagcaggactgttccttctcattttcccaggaggcagtttctaccctccctcacgccacccctgtccctagtggggaaccaaagaggacccagactgccagggagagtggcactgctccctgggcacagccaccccatctgcagtgcccccccactccaccccgtccccatcccgagcaacagctgaccatgtgaggaagcatccctgagagaggccccaccctttctcccacacctgcctggggtccgtagccttccctgaaaacgccagcctcccactcacattcccagggcggaggcaatgggggcctctcttggggatttcctgagactcacacaggagtctgggccccaaccacccagcctgcctcccccacccaccctccctttgtgcttatcccagcccttgcccacctcctgccccatctaggggtagggcacggcccacaggaccgggaggaacaactgattgagtgagtcatctctgaggattcaggctcccacacctgagatcttcccatccgtttatggatgagaaagcaaggctcagtgaggggaagtgactgcctaacttctcgaggtcacagagctactcacagggcaagcagtggccacctaggaccgcacctgatacaccaactccaccccaggtctagcgcagcctggaccaccccctgaaaatctccagcccttgggagaggcaagcacccccttccaaactctccccagacttactctttatgccggtctaagctgacccctgacctgccaatcaacaacggtgggtctccaagcaccatctcccctcaccctcactccttcccatttcacccttttgtccctagtccccacttcaggggccagaacaaggacacatttcatagctgagtcaacaagctttattgtcatcaggcaaggaagcatggggaagggactgaagcagggggctgaggctggagaggccggagactgtggggcagatggggcggctgcctccctgcctcctgggtggccggccggggtagctgagtcctcagcgggtggtctggtggacctgctcgcgggaggagatgaccttgccatcctggacctcttccacaatggtacgcacctgacgggtggtcaccgctgcaggagaagcaggcaatttaaagtgggtaggggccaggaggccctcgcttgccccctagccctcatggacaggagccggctctctccctcatcctcccccaggtgctgtgagtgcctccactggcacctcgacatcacactgcacacacatccctcctgtccctgccaccacctcccttccatcccatccctctgccggtggccctgtgtgagtcttgcctccccagatgggttatttgattctgatccagtgtgtcctgccagggaggagccatgtagactccatgaaatccgtctccatttctctgcagtctctaggacatagattttctaccatctcccccatcagactgggatcgccaagacaaaaaccaggcccctatctcctccattagactaggaaccctaaggctaggatcatatattctccatcagattggaatttggaggacaaggaccatgtccctatctcccatcaggctacagaccccagagacaggactgtttttgctcatccaaaagctgtcaagagcaaagatcatgagaccatgttcctatcttcccatcagatgacaatctccagagctgggacctgtctcctccatcagactaggatctccaaggtaaggaccagttccctgccccacccccatcagaccagacagtgtctctctcatttgatcttttcctgagtatcaatcctcagtgctaatgagtcacttctccctgctgagggacagccatcaactcctggagctcctggggaccctgccccagcaacgtgcaggtgggctgcctgtcccatgcacccaacccccagggccgaagccacgcagatacttacgttctttcttgtactgagtcaggctgaaagaaaaaaaaaaacagagaggaaattagatgtgggtctgagagccccacccctgccaagagacccccagccctgaccccaggcgcccccactcactgggcatcctctccctccagcaggcggcggtaggtggcaatctcctgctccagccgcgtcttcacatccagcaggattttgtattcctggttctgctgctccatctcgcagcgaagctgggccagctgctcctccacgctgccaatcagcccctggatctgggacagctgcacgcagtagcggttctctgtctccgccaggttgccctccagggatgctttctgcaggagggcaggaagaccaggggtcagtgaggatggtcaatgccctcttctgggccctcccccatgcacaggactgttcctaccatgctgagctgggactgcagctctatctccaaggcctgcatggtgcgccggagctccgagatctcactcttgccactctgcaccagctcactgttggtggccacctcgcggttcagttcctctgtctgcagacaggacacaggacagggcggtgtgagcctggatccctctcccaagtcaggcctcctcccaaatctaactgtggagagagtgtgccttctcaccagcttcccacatcccaaagcccagaaacatgccatttgaaatgttaactttttatggttaatcccagcgtgtgggaggcacagaccggaaacttgagaacaagccagaacatgtagcctggctcttgatgctagttcctgacttcttgagggagacgtggggactcccaaggtctttaccctctgcctttattctgagggagctccctacctccccacccacccgccagatcccagcttgagctcagctccatgtctgttgatgcagtgggtgaccctgtggtccatgcagcttactgaggaggggcacctccaagacatctggccgtgggcttactgtcagtgctaaggcccctgagccccagcccctaagagagccctctggcctgcagcaccccccaccttgctgaagaaccaatcctcggcatccttgcggttcttctctgccatcttctcatactggtcacgcatctcgttgaggatgcggctcaggtccacgcctggggcagcgtccatctccacattgatctcaccacccacctggcctcgcagggcgttcatctcctatggaaaaaggggatgtggatgtgcgcatctggacccatcctgacctctcactcccaagccttcccccacaaggggaccccacttcccacaaggacccctcctttgttctccctctgctctatctgaccctctaaatgatttttattcatctgctcagtattgcctccaccatcagactctatctcccccattagaccaaggactctccaaaataaaatctaattattaggcctatgcccccaaaagttcccctctaatttccaagcttctatgtagatgttcagctttgagagtttgaaatgggacaagatttccttacttatcccccaccctcatgagggaggcagggtaggtagagggagcctctgcaggcccctgggaggttccttgtgtacagagaagcagtgtggtacaaagaggagtctgccctgcacactggaccccaaggatcagggctctgcagacagggaagccctctaaggtgactaatcccggtgcacctgctctgctctctcccacggcctcagccattgcccagccccagggctctgccacccactcctcagcatctttgaccttctgccccagccacctcacctcctcgtggttcttcttcaggtaggccagctcctccttgaggttctcaatctgcatctccaggtcggctctggccagggtcagctcatccagcaccctgcgcaggccattgatgtcggcctccacactcaggcgcagggcctgctctgtctcaaacctgccgtgggaatcagagacttcagcccaggctgcttggacctgcagatccaggtcctggctgctcacctgccttcattttgccaggactctaaggagttggaagggctgatgagagggtcgagtggaaacgaattccagccccgggaccccgggaccatcacagggccagatcccacgcccaccagcttccttacttctctctgcctcccgcctcccgcctcccctccttctcttctattccctgcctaagctca

SEQ ID NO: 302 - DNA, 20624 bp, Homo sapiens
acactcattcagatacattgaggaacttcaagaaaaagaggaactcaaacttttgtcgctctcttggatacaggtgtccaagttaccattttactcagtccagtggaggtgaaagggaaatacttgaatacagctaatgaggctttggaagagattacagatggaaaggaaaaataatgtgactttctaggtggagccctttgtgtcagtttaatgtacaattgacccttggcatctttgggggactggttccagaatccctgcagataccaaaatttatggatactcaagtacttgttataaaatgatatagtatttgcatttaattcacacacatgctgtcatctactttaaatcatttctagattactaataatagctgatacaatgcaagtgctatgtaaatagttattatgtgttttctagggacgaattataaggaaaaatgtctgtatatgttcaacacatatgcaatcatctttgtttcccttaatgttttcagtctgtgattagttgaatccacagatggtgaacccacagatacagagggcaaactatacttttgctgttgtgttatatgactatgttaccccgttccataaattacaaaagggattccactgattgtgaagatctgtattcatagaagtgctagtacttttggggtctctgtgagttacaagtcactgtgactgatgattttgttattggagcacttagcataggtagacgcctccattcactgaatgccacttggagtcttgttaatagtattctaacctgaatgatatatgagatatattaaatagatttggttgcagcctctattggtcagactaatcggagtggtcagtggaatgtcattctcatgggaaaattcaccaggagcagtgcagtgtagagataagagttgggtattgtttcagggaaaataatccccatgggtctcttgcatttctgcatgtcttcagtgcagtcactggctccctttgttctaaattaacttttcaagcatgtttttagagaaacagtcttggaaaatagatacagtgtttctctcagggtcaaatgtcaaacatgcttactcttcatgatgtctatgatccagggttcctaaactcaacattcctctcctgtgaaacaacctgctgcatatgcaggtgtcagctggccctatgggaattggagctcagggatctggtgtcaatgctaacactctggcttcggctattgccataaatgataaaggcctttgtctctaacctaggcttcttatgtcttctgcctgcattcccgaaactatgacgggttaacttgttagcatacaaataggataaaatttctgacttttcacagttctcaatgccccttccacaggtttcggttttctagttgaaattgtggcactgcaacgtcatcataatcaccaactctattgctttgacaatcttttaataagacacagacattttagtcaaagtataatatagtcataataatattgaaataattatgggcaatttatgcagtaataactagtagagattaatcgaagctattagaagataaagaaagcaacttgataccatattgaaaatacatcttaaaggcttataaggcattaaaagaaaaagctgacaaagaaaagggacacatgtgaaccacagtttagttaataaacagtctgctcatggaataggagagcaataaataggtctgtcacatattttttacagcaatccagccatataacatagccctccatgagactgcccattttccccaactatgctagatagaaatgtttggatagtttacttgggaattgacaattatgagggagtactcaaaatacccccgtgagctatataagcaacagcttttgcccctgacttccatattgtatataatatatataggtatacaatatgtatacaatatgtatagatatggcaatatgtatacaatatgatgcatttgtatacaataagcataagtatacaatatgtatacatacacagtatgcaagtcaggggcaaaagctgtttattatatagctcatcatttgttaacaagtgaaggtgctgcacgacggggcagcagctgctaaatcccaatcatgaatgagatgcaagagccagcccaggggttaatagctctaagaccagtgaatcctgggacagccactgctgtccatgtagtccaaaacattgatcacagattgcttggtggaaggaagtaaagacttaggacgaaaaagattgtatggcaggttctggacacatcacaagcagaggagtacagggagtggtttcacaagatctgggtccgcggcatgctgttggcagctggggatcccctcaggtttcttggcagtagttcaggagctggattctgccatagctgttcctggcttagcagaggacatctctgagggtcacatgaaaaaaggggctattagaggggatgacagccccatggcaataacccctgagggaatgacagctgtggttttcacctgagcaattattgaaagacaagatgaccttagtttagattataggtaaagtactcgcacttacttaatgctatttctccttctttgctgtggcttctagaattttttagtaatgactactagcattcagtgtaggttttattctgactcactatttcaaatgtggttatgaacatagctcaattattcagatgtcaggaaaatggctacttattactatgaaaaaagtactcagtgaatctctaaagcaagagaactgtggtcttgtttactttttaacaaaccatgcatctagaaaaacaatatttcaagttttattaaaatatatttaaaattctgtggctagatgaatatttattacacctggaatattaatttaaaataggttacatttatgacctaataaagacttgtatatgtgttaagtgtggcctttaaggtacataaagggctcactaaaattattgtgcttcatatgtttaaatattcttaataaacttctcatgagagatacttcaatgtacaatcagtaggacactaggttgagcatcacaaggcttgagttctagccctgatcggctggtaatgagccacgtgaaattgaataactcatttaacctcagcagatgtatttgctcaactgcagaataagtaaggttcactaaagatctcttacacatttagacatgattgtgattctatgaaaacataactgtgatagaaatgaggcagcttcagaagaaaccatgcaaaaatggtcactggtctttgccataaatacaaaggccacagcatttcactcagatatctgatggaagcttgggaaacatttaactctgattaggcatctttcagagcaaaacacagcttgggctgatatttgtcctctaaggaaaactcaaaggctcaaagtgtagaatattgttttttttaattgcctaacatttcatttgtagccttagggccatggagcactgaccttgcattagaagcccctccaggaccttctcaagatcaatggtttgatctccaccatcattcactgctggaaattaaaccagactcctgaggaccaagccaccatcagctgtagcctcagggagatgggaatgtgggagcaggcccactttaagcaagctgctgaataaatatagacttgaaaaatggaagaaacacatgaagcctgtttctgttttctaagaaagatgtgtttctttcagtggtaatgtatattctaactttaatctggtaagtacacctgtaatcactacaaaccttgtgaatatcaacagctaaaatttaaaatttatttattgtacttgctcctgcagtttaatttaataaaatatgaggtctagaggaaggtactttgttcctaagaatctcaacatgcattattagattggtttcctaacatatagagtgtgaaagtgaattcgctcatgccaagtgggagataagaacaatggctaataactctactctaaattttgacacagtttattgtgaaagagggctttttaatccaggtgtttcactctgcacagtcaatttaaataaggagcatgcaactgtccataaagtaatagtgacaaggcactgcaataataagggtgatgctattcttagctttctctttgatttttagccttcttttctcattatctttgtcaattagtagttactaaactccttcagggccaacgacccagtaccattgagtaatggaagaatagaaattggcttaactattttctgaaatttaccctcaacatttctatgttcttaagtttggatacaactacattagttttgcctctgagatccaagggacaactctctttgaatgccatcagtgactttgtttccgtaaagctagaggaagttatacaaaaagtcaggcaaataacttattcttatgcaactacaaaaagatttgtattttattttaaaattgagctttagatgtttagtgtatttgtacctatctacctatgatgcattttatacttcatcaaggccgtatctctgatataaccagaatatgatttattaattatattagctgtttccttcttaaatatttttcaatcaactattatttgagtccaagtggaagattttagaacaactctctaggtaaaagaatttcaaatgaggaagtaagtaagactcctggaaataaaacagaaagcacaactagggaaggatattgtggcttcaatagagatatgagtgattctcatctaacatggagcaaagtcctgtccaatcctattagtgtctacaatgagctcaaaattttcaagagaaatagtatttaatttaaaaagaataaggactaaaggatatggaaaatgaaagtactaccattaagacgataattgttgtattgtaggtgaatctgactccatgccatctaaatccttttcctagcatctagattctattgatgacacatgacttgaagttagtatttgtttttttctaagatatttcaattgcataatattttacaaactctaatgaaaatatgttcatttcctttattgcatttatttttgagttacaaatgagccatccagtcaacaatactcagttctctgggtgtttcttctgcagtctcacagcaatacaatataaccagaccaatcatttttagtcaaattatttgtatcggtcctccacattgcacagatatttcttccacatttgaagctactctaatgactagaagtataatataagtaaagcacaattaaagtattacagtgttatactcaaactttaaagattcatgggttaaaaccctcgttccaccatttacttcctgtactggaaaagttacttaaattacagagtagggagtaagtaagactcttgaaagtagaaagacagagtagaactagggaaggatatcgtggcttaaagaaagatatgagtaattctcttctaacacaaagcaaagtcttgtcctccacaggacaaatttgtgcctttgtcctcactggaaaaagggggatttactaatgttacttataccactgggttatttgagtttaaaatgataaaatatgtacaaagtgttaggtaaataataagcacccaattaataagagctattttatggctcttgacccagcactgtacaggcaagaagacattcttgatagtcattatgctttacttctaagagaaaaacatgtggttaaactaccaatgtcttgaggtgttcaggataccaatgtacaaatcctaccattctttttaggcaggaagaagtcccttggtctatgaagaatgctctgtagcatgcatatacccaccggtatgttttgacattgcttaaaaatgagtcctgcatagaatatcctggttatgtcccatactgcttacattcttttcacatggaatgaaataattttcttggtctctgccctggattcaaatgcattatagacaatcataaaaacaaactgaaattgaggcccaagagaaaaatatcagacgaagtatcaaatgatacctagcatatattgtgctcttattatgtgccaaacagtccactaagcatttaattggaatcatgccatttagttgtcataatcatccaatgactttaatattattatctccattttacaataatggaaccaagtctcagaaatgttaatttgggccaggtgcagtggctcacgcctgtaatcccagcatttttgaaggctgaggcaggtggatcacttgatgtcaggagtttgagaccagcctgcccagcatgatgaaaccccatctctacaagaagtacaaatattagccaggtgttgtggcatgcacctgtaattccagctacttgggaggctgaggcatgagaatcgcttgaacccgggagacagagtttgcagggagctaacattgcactactgccctccagcctgggcagcaaagtgagacactgacaaaaaaaaaaaaaaaaaagaaaaagaaaaaaagaatgttaattcatcccagagcacatagcttttaatacacagaatttggaattgagtaagatctagtcatactataagattcatgtccttttccttacactaaattttctaccaaggtttatataattatggcattccatattccaatatcaaaagtctttttgtacctgagtccacataatttctttctatgaggagctctaatatgctccatgttgagttagattaaatactggctccttcttcagctagcttctctttctagcagtggtcaagctcagcctggaaagctaatgtctagaatgatgaacagagtagatgggaaagtgaaacttaacatcacgtccctctttcctggcattcccctgctccacaacacataccacacatagcccgttttcgccaaagtcctgttttctcagcaagctacacccagtaaaataatatatacttggaaggcacatggaatgggtaggttttccctcttgtctttagaaacagtggtccaaatgaattgagctttttctgggcaacccagttggcattgcaatagtaaaaatccttattgtgaatgaacttgatctatgttcacatgattggctgtgactagaatgctgagaagctgccacgagataaattctgtctttactgttgccaatgctgtgttactgccatcagtgctgtggacagaagctttatgtcaatgttgtttgcttcagggatgttctgctattgaggctgccaaaggctctgagtactattgatggtattgaatagtgtttggcctctctcagacttccgtcaatcctatccctctacagagcacctgtgtatgtggtggtttacagattttaggcttaagtcttcctctttgagatggcctgtgtctatcccactgtattattcagggctacatagagaaacagaaccaataaaatagatagatagatgatagatgatagatgatagatagatagatagatagatagatagatagatagatagacagactatatataatatatatttatctcactgtatatatgtgtgtgtatatatatgcatgtgtgtgtgtgtgtgtgtgtgtgtgtgtgtgtgtgtgtatgaagagagagagagagtgagtgatttatcacgaaggattggctcacacaattatggaggctaagaaatctcatgatgtgtcacctgcaacctggaaactcaaggaaaccagtgatataattccagtccaaatgtgaagatctgagaaccaggggagccaatggtataaatccagtccaagggcaggagaaacccaatgtctctgctcaagtaggcttgcaggaaacataaacgggcacatttctccttccccgaccatttgttttatttaggccctcaatggactgaacgattcccatccacattggagagggccatctactgagcacactgatttaaatgcttatctcccttgaacactctcacagacacactcagaaataatgcttaatctgggcagcccttggctcaatcatgttgatacatagaattaccatggcacccaccctcagaactaactggtaaattatcagtagcattaggtttgccatagattcagagatacttgccaatttacttcaactagacagcgtttaagtttcttaattttctcccttagtagatgatgctgcctgcatcttccaaaatacaaaacagctaatctctcttttgttggatgactagctttcctaatctctcatggatttctgggtttatttacaaatccccactacctcccccataccaagtctctgagctagctgagttgctaaatatgctatatacatggtaattttttaagccttacactttcaatttattaacttattaaggctcacagtagccctattattatccttcacttttgaagttgaagaaactgaggtggttaaataacttgcacacagtcacacagttggaacttaaacagccatcactaagcaaagctaagattccagctcaaggaaatccatattcagagttcatgctctcaaccactaccttattttgccctgaaaaaatgtgagatccaaggccaggcatggtggctcacgcctgtaatcccagcactttgggaggccgaggcaggcggatcacgaggtcaggagattgagaccatcctggctaatgtggtgaaacccgtttctactacaaatacaaaaaattagccgggcatggtggcaggcacctgtagtcccagctactcgggagtctgaggcaggagaatggcgtgaacccaggaagcagagcttgcagtgagccgagattgcgccactgcactccagcctgggtgacatagcgagactccatctcaaaaaaaaaaaaaaaaattgaaagatcaatttaagaacacaccaaaagtttcagaatagctaagctacctaaataaaattaatcaatttcaaacatctgactctatggtcttatgatgttcatatgagtatattttccatcttctgttgactaccaccatgagttattcttttctggttcacactataaaaattataacaagaggatatgttctcttttcttctaaatatttatactattttcattaggtaacaaacgaagaaacaaaaagcctgtaacataacacctgcaaaaggattgaataaaaataatagtgtgacaagtccaaattttgcttccaaagaaagcaaatttatttaatacaaagaatattttccaaactcaaaaaatacttaagaaataatgaaaacaggaaaaaaacaaacaaccaaaaaaacaacgggaacgaaatgaagtgaagattctaaacttcaattcattctatttaaaggcttctggttgctacgtggttataaagcccatggaggtgaaattcaaaattaccttgctctattcgaacaatagacttaatcttctagttaatttgagaatgttgtgattcaatggctaaaataacagatggccagtgagtaggcctggattttagttgtggttctgatgttattaactacttgggcaacctctgatagagttgaacctatcgtaattcacaggactaggtaggcttttaggtttggttccaatattttatgaatttctgagactagtagcacattacttaataaaccagatccaatgctaagtatttccaaagaaaacaacttgcagttaaagtgtgatgtttcctttaagtattcatgttatttcctggctacagctcttattgcttaataacaaatcgtatcctactgctctaaaatagctagcatgctttccaaccccagattaccactagacatacccaaaagaaaaacaagaaaaaaaatcttgtctttggagacagtagtaaaataagacatgttcatttactaacaaacacacacaacattttttatttaaagaaatacaaaatatctaagtatctcaaaaataaattcatccaaatgagaatataagccatctcccctacagatcttcacttactaggcaattgagaaccaccagtaacacagcaagttggttcaactcctggagaagattccaggagttgtggctcaggtgcaacattgaccagaggtctacaggaactggattcagggttctgagactgacactgacattggctagatgcacgttccagagtttcgaaatttttagacttagaagtcttgggtgggcaactgtttcccttgaggcttgcaggttggcagctctgggctacaaaacccatctgctgagtgctttctgattggcaaggctgagaaacacaagccagccctgctgaagaactttctgattggcacgctgtcctttcgcagggcctggaattggagtaagtagtttggacaactccggggaagcagttactttgcacacagctatcgtctgtgaataagtcctgttcacaattggtcatttggcagctggtggtttcattgcaggtttcttgaaagttgtccaggaaacaggttctgctatggaagctgctgggcaaacacaatctgtcttcaaaggttataggattagtgccatgtgtgatggcagagagtggtggggcattgtggaagctcctgagtgaatggcagtggctatgaggcatattgctaaaaatccttaaagatggtcataaggactcaacatgctgagtttgaaaattaaattctttggtgcggcgattatatactcagaaacctgggtgttggcttctcaagacttctttgcaactcattgcttaaactaatttgaaggataacatctcattaccactttggttatatatgcagatgatgtcttattaacaaagatgtaagtccattttgaatcttcaaaatggcttttatgttagctccaaagatgactcattcaaggtggggttggtcaaataagagtctaaacctgtccaaccaagctaacatttttttttttttttgccaccatgactctgcacattggtaagtggacaatgagaaatgcatgaggcagtggccaactgaatactgattaacatttagcactggttttgagagctgccaatgtagcagaatgtggtaatttgatgttcaagacatttaaagttagaattggatccaggttgagcccaatctcattccactcagatattgttctctccagtggaccagaatgtgagaggactttgtgatcacattccttctcagtgttcatgcaaagtactgagtgtggccattgcccaataaatacttgtcttttgcctaacatttcgtttccctaatctccttgaaagccaagtttaaatgcgtccttttcctgaagtcttccccaatcttcccatttaggagttatttcttccttttctgaattactaatggatttaattccttttttctatacttgacaaagtggtgtgtttacttgtgtttgtgcttctcaaaggttgattattttcctttataatgaaccttcttcagatatttttcatctttattctgtgctttttttattgactgcagacagatgatcagttcctatgtttatcgcattaggacaccgttcttagcatagtttcatactcatggcacagagccaaccagcacaatttctataacatattctataatatatttggctcagctaatgacaataaaatagaagtatagtcttagtgcactaactagactccctttctaaggtctgaagaagcccaagaacattcagcaattctcagtaattcttatgcaaacacttccttgaaagactgaggatattataaatttaaaagggcacatctgaatactttcagctttataggctgcacactcatcttgtatacaatacctttgtaacacacgcaagtcatttataattttgaataaccacacttgtatgtttaaagatctcagtgtgccctccacatgaaccctacagccacccatttaattcttacgcatatatgtatttattattgcacggaggcttcgttattgcacagaggcttcattatagcttgtgactttcttgcttaaagataccaaatggcttctcattgtccttacaataagatctttttcctttagacttccctacaacatcttataagacctggccatggcctttctttctttctttctttctttttctttttcttttctttttttttttttttttttttttgacagaatttcactcttgtcgcccaggctggagtgcaatggcatggtctcaggtcactgcaacctccgcctcccgagttcaagcaattctcctgcctcagcctcctgattagctgggattacatgcgcccaccaccacgtccagctaatttttgtatttttaatagagatgggggtttcatcatgttggccaggctggtctcgaactcctgacttcaggtgatcttcctgtcttggcctcccaaagtgctgggattagaggcgtgagcaaccatgcccggccctatttttctaaatctaactcttgtcatgtcactctgcccaacatgattcatcctcacaggcctcatgcagctccttggcacactaaacctctccttgcctccaaactttgcatacgcagctgcctgtctgtttcacccctccactgccttctcccattctatccatagttctcatcttttgtgtcttagcttaagagttacttcttagaatgtctctctatcatcctatatgagaaaattccattatcagggtctcatattttttcatttttaaaactcatcttaacttatgatgattttatttatttctcttttgtgcttttgccactaattgtgaattccatgaagaggagaagcatgtgtatcttcctcacttccataaccccaacactgagcatggtgtctcattgccatatcatcagattcccataaatgtatcttcaaaaattcatacatagaaggtgctaagtaaaaatttaattataactaaacatctgaagaaatatagttttgaaattttgacatttccaagatttctaagaattggcaagagtattgagctcaaagaaaaacaaatttaaaaactatgcctatctttcagctacccctttgtttaataagaacaaaatcattaagaaagctacttattaccatggcacaaacttattcaattatttcaaaatcatgtttatttgtaggttttttttttctttttttttttagacggagtcttgctttgtcactcaggctggagtacagtggtgtgatcttggctcactgcaacctctgtctcctaggttcaagccattctcctgcctcagcctcccaagtagctaggattacaggtgtgtaccaccacacctggctaatttttgtatttttagtagagacgggatttcaccatgttggccaggctcatctcgaactcctgacctcaggtgatcccccccgccatggactccaaaagtgctgggattacaggcgtgagccactgtgcctggccatgtaggtatgtttttaccatgaaaatgggagccagttctcaataccaacacagagtcctcttgccaaattgtataggtataggcaggacatcatataggctggaatttacagaactgtctccagccagcagccttcttattaatttcacaatgtgcagccaattactgagtacttgggcagtcccttcaaatttcatatggtgatgttaagtctgtcatttgtgaataaggtcactccatgagttattttctctttggaatgaggcatttgcacattttatttaagtgagagccaaattaataagtgtttcagtatataattttgattcagtgagtaaacacagattttggttgttgctggatttatagaggaagttacctggtttattactatggaatgacgtaggctaggacaactggtcaccttggaattgtttacatgcagcctactaaaaactaagtattagctttgtaagcatttgaaaaattatgactatgtagtttatctgctggtattcttgagaaatagatagaactggttacctaattgcatacagtaactggatactcttgctactaaaggggtgaacaattccctggtctctcctggacttgaaatcattctcctggaatgactgcagctgcagtggcacctcctaaccaccagagggtggaatatcaacatttggtatgaggatgcaattaaatataagaattctagagtgagaatgccaggattctaagccaatatttacaatctcaaactgtaactttgaacaggttccataagttttctatgtcatggctgtttcattaaaataaatgagatattgtatatggtaccagattgcctgccacatattgaatgataaataataacaattattactgatcaggttaggaatcttcatgcagactaagacgcttctcattataacatcaatctaggattgatataaaattataagcaaaaacaagcacagtttttttatgtttatgattatgttgttgatttataattatgtgttaattttcacattccattcctttaaaggttggattatacttattcccattaatgatggaacttgtctccatctctcaagagctcagcatttggtagttgtaacattgaataatttatatgtcttttatatttgatcatatggctatactaaacttcttaatcacttgtttagaaacattgaagtgaaatgaaataaaataaccatttttttttttttttagaggcagggtcttactctgtagcccaggttggagtgcagtggcgtgatcacaatttgcaacctcaaactcctggattcaagcaatcctcctaccttggttttctgaatagctaggactacaggctcacaccacaacacttgactattttaaattattttgtagagacaggggtttcactgtgctgcccaggctggttttgaacccctggcctcaagtgatcctcctgcctcgccctctcaaattgctgggattacaggcatgagccaccatgcttgggcctagtcactctcttcatcccagtggtcccacaatttatttacctcatccttgtcttagttttatctcatcaaccaaacttataccaaatgacataagttaattttaatccattcctcttctccattcaccaaatgccgtaagttaattttaatccattcctcatctccattcaagaagtttcatacagaaccattgcataacaatggaggaatactagaaaaagcatgaagagatgtggctttcagccttggatccatcaactcactgcataaatttggacaagtcactctacctctctggatatctttcaagataatgagtttagatgagaagctctctaaggtcctgtcacatcctataattttcggtcagaatcttaataacgtagaattaacattacatgacatctcgtcaaatctgtctattgaatgaaatcttcacttacatttaagaccatctgatctttattaagattacatataaaattttaacaggacagaccaaagactgaagtcagtacattattagttcccacagatgctagtcaatatccacaactgtaaaattagtaatcttatggtatttaatcttatagtattaatcttatattaattcttcttatagtattaatcttatagtatttgacagcaactcttgagaataaataaaagtatatctctgcagtcaagtacacgttagtctatcccaaaagaggcttttttgagggaaatgaataacttttgttaaacataacattctatgaaataagtcaagtaccatataacccttctcagacactgtaatgcatatagaaaaaaaaatttaagttgtagaatacttcaaaattcttatgtggaacacagaaatagtattttgccagctttctctgtttctaatgagaaatagatattttattatatgataaaataaatcacatgtgacatcatttgttctctgagactatctctaaataattttgcttctttggctagttcttggtcatttacaattcaattatacgacacattaattcaaatagccaaacaaaaaacaaaagaagtaaaacataaaagttggaggattacacagtgtctatgcggctcttaataataagtaattggagaaaagaatgaaccatggtgttttgaccatctgagcattatagtccacattttccgactctttgttccattatatcttggatatgaaagcattatagtttactgtagtaattatacacttgttttttgcttcttttcccagatgtagttgttcttgccttcctctgaggttatctttgagtgaagttatttttctatttctgggtgatccagaaatgtgaattggtttttgatttgtctcacttctgtaggcgctggagttgtgacagtgtgtcattgagatattgagattgtgctaaatcaattgtgatgatgatgatcagaggattgtgacaactagcttatctaaaaagagttccactagcaaaaatgaatgcgagtttgatgtgtcattgacatatcctgggactgtcacctggctcaattccacttatttatttaatatttatttatcttttattgagtacaggcataccacattttattgtgcttttctttgttgcactgtgcagatattgcatgttttacaaattaaagatttgtggcaacactgagtcaagcaaggctatcggcatcatttttccaatagtgtgtgctcatttcatgtctctgccacattttgataactcttgcggtatttcagattttttcattattattttatctgttatggtgatctgtgatcagtgatgtttaatgttattattgttaattgtttcggggcaccacgaaccacatccacataatgaaatgggaaaagttcttttattctcccttgcaaggcatgcaatggggttgtggctcgcttctttggtgagcccctgctcagacctctgggggaacaggcagatgggcaggctgtgggtctcccaccctacagcagtgtctagggttgaatgtttacacctgtagccccagtgggcatgagttacagggtgttctttcagtttagccgtccataggcagcttgtgttagctcaattacaccctctgccttatcacaaagacagggggctttctgtatcccagagtttcttgccttggtataccagaagaatcagggcacacatgggcttggagaatgagttgagtgcaagttttattgggtggaagtagctctcagcatatgggggagccagaagggagatggagtgggaaggtggttttaccctggagttgggcccgttcagtggctgggctctcctctaactgccccggccaaacttcgcatcattccgctggttgacggtctgcaggtctgccagtgtctgtcagtgtgctcttacacaagtgcattcctcttgacgtccagccacttgtgtcttctgccagtctgttcctcttgacgtccagctgcttgtgtgcatgcccactagggtctcgggtttttcataggtacaggatgggggcgtggcaggacaagtggtcttgggtaatgcaacatttcggcacaaaataagaaatggctgtcctcacctaggtccgtgggcacaggcccagggggtggagccatagccagggacccacctttctctacccagaacttccctgccccctcccatatcaataagacaacaaacttaataaatcaaatgttgtgtgtgttacaaccgttccatcgaatggtacacccctgtctctctccctttcttcaggcttccctcttccctgagacacaacaatattgcaattagtccaatcaataaccctaaaatggcctctgtgtgttcaagtgagaggaagagtcacatacccttattttaaatcaaaagctaaaaatgattaagcttagtgaggaagccaatgttgaaagctgagatagactgaaagctaggcctcttgcaccaaatagctaacttgtgaatgcaaaggaaaagtccttaaaggaaattaaaagtgctaacctatactaacgaaaaaaatgatactctatatgaacacacaaatgataagaaagcaaaacaagctccttgctgatatggagaaagttttagcagcctggatagaagatcaaaccagccacaacattcccttaagccaaaacctaatccagggggaggcgctaactctcttcaattgtatgaatactgagagaggtaaggaagctttagaagaaaagtcagaagctagcagaggctgattcatgaggtttaaggaaggaagccatctctataacataaaagtgcaaggtaaagcagtaagtgctgatggagaaactgctgcaagttatccagaagatctagccaagatcattgaagaaggtggctacacaaaacagcagaatttcaatgtagataaaagagcattctgttggaagataacatcatctaggactttcatagttagagagaagtcaatgcctggctccaaagtttcaaaggacaggctgactcttttttatgggctaatgcagctggtgacaagttgaagccaatgctcatttaccattctgaaaatcacaaggcccttaagtattattgtaaatctattccacttgtgctctgtaaaaggaacaacaaagcctggatgacagcacatctgtttacagcatggtttactgaatatttgaagcccatggttgagacctactactaaagaaagattcctttcaaaatattagtgctcgttgactatgcacctagtcacccaagagctttgaaaggggctggagggaaggcagaaatgggctgcaaatgggctttgcaattatattaaggggtcttcattgggaaggaggattgttgaaggttttaaatgagtgtctcatttaaaaacatgttatctacgagtaacagaaattgtaattcaaaatggcttaagcgataagaaattttattggcttacataaaccagtgtccagaagtgagatggtccaggttctgtcctcctgcatttctcttggttctggcctctttcatttgatggtttaattttcaggttagatcgggtatggtggctcacacctgtaatcccagcactttgggaggctgaggcaggcagaacacttgaggtcaggagttcgtcaacagcctggccaacatggcaaaaccccatctctacaaaaaatacaaaaactagctgggcgtggtggcatgcacctgtaatcccagctactcaggaggctgaggcaggagagaatcgttggaggcaggagagaatcacttggaaccaggaggaagaggttatagtgagctgagattgtgccactgcactccagcctgggcaacagagggagaccctgtctcaagaaaaaaaaaaaaaattcaggccatatgcaaaacggatgcagcattccacatataacaaagtccagaggtagagagaatcgttttaagaaatcccagagacactttgggaggccgaggtgggcagattgcgaggtcaggagatcgagaccatcctggctaacacggtgaaaccccgtctctactaaaaatacaaaaaatgagccaggcatggtggcaggcgcctgtagtcccagctactcgtgaggctgaggcaggagaatggcgtgaacccagaaggcggggcttgcagtgagccgagattgcgccactgcactctagtctgggtgacagagcaagactccatctcagaaaaaaaaaaaaaaaaagaaagaaaccccagagaaggaactttaccagaagcattgttccacatggctccttgtttctcattggcttacctcagatcacatgctcattcctgagccaatcactttcagtaggcattggggcgctctagagtagccaaattcaatccttaagcctaaggcataatcacgttcatttgcaggactatgtgtggacgaggagggatgcacaaacaaaatccaatttccatagaaagaagagcgagaaggaaaacagctgtgagagcagtgaacgatgagctacccacctccatttagatatttgaaaatgtatatgactgtgttccacttaatgtaagaatataatggactgtctagttttgcatccagatacaagcccaggatatcaagaggtaaagtcttatctctcagtccgtgtcacctatgcatgatactgccaggtttcagacagttttcaggtgacttctattataacaccggatggctttatagtgacctaatgaaaggaggagggagtgaaccatcaaattaaaaaaaaaaaaactcttagatattatattcttcttattatagtggaatgcatacatctttaatttcatgtatacctaaactatttgtttcattacacttgctactgaactcagttaaaatcctgacctcagaatttcattgtggcttatatatgtctgggaaggaagattacaggaaggattttgataatgttctcataaaaacagccaggctagtacttgctaaaacatcactgctgtctctggatattttcttcctagactagacccatgagtagcttaaccaaagtgaagtgtcctgattaggcctaaatggccatgaatagaaaaacagagataatctcctgtcctatctctgagtctacttggcag

SEQ ID NO: 303 - DNA, 38950 bp, Homo sapiens
aggaggtagaggttgcagtgagccgagatggtgccactgcactccagcctaggtgacagagcaagactctgtctcaaaaaaacaacaaaaactaaaagatgaaccaaacaaaaacaataactacaacaacttttcaagacacagacagtacaataagatataactagaaacaacaacaagttaaaaagcagagggacaaatttaaagtgtagagttttggtaagttttctttttgcttgtttgtttgttcctttatgcaagcagcgtaaagttatcagtttaaaacaatgggtgataagatagtactgcaagccttgtggtaacctcaaaaaaaaaaaaaaaatacgcaatgaatacacaaaaaaaccaaaagcaagaggttaaatcataccaccagagaaaatcaccttcaccaaaaggacgataggaaggaggaaagaagaaagagaaaaccacaaccaccagaaaacaaataacaaaatggcaagagtaagtccttactgatcaataatcaccttgaatgttaatggactaaactctccaatcaaaactgttatggaaagaactgttatggagcagttctccccgtccccacccacatcatttttcatcaactctagatgagctaagggcccccaaatgccttaggcttagcattccttggggcgaagtcccttcttgctcagagtctaaaagacaagtagtgacactgtttctgcctgataggccttcagtctccagagtggagaatctgcctttgtgtgaggtcttagtaagaaaagctaggagccagatcatatcctctctcaccctgctgcatccagggagtgtgcatgtgacttactcagccaacccaatgctgtttccttgcacgtggaaatttgagtgagaaaggtggggaaacgagatggttgtagcaccaccagaggtcatggggtggggaggctgaactgtttctgctaagagactgttattgtggttcttggggccttcctctttgtttcttgggtcctaactgttctcaagcctgatccatcagctcccttctattctgtcagttccctgacagtctttcaataagtcccttttacttaagttagccagattagttctcaagcttttaaccaagaatgcttcctggtggaacagagcctctctcacccctgtggtttggccaatagagaaaggaatctcttgggggagcaaccttgaacttcgctttgtttccaggcttgccccactgtggcaggctggtcttagggtactgcctcagccaccaggacccttctcagtaggatcattcaccatatattggtcttaagtgtgactttctctctgtctcatgtaggatagttgacactggcaaggaccagcttcccagaatcagacacagaggagatggcttctctaggactctccagtaacaagctagtgccagttcttgtggtgaagggttgacatagtttaggaacagagaggtaaatgaactcatggactgctggaaagttttagctgtgcatccccatcctcccctgcatcttttcccttttgcatacatttccattcctggtaaggatggacacgtcgggaaacccatctttgttaatataatgtcatcccaaaaaaatcactggaggggttgtggcctggagttctgcatccgggggcttagtgcagatttctcaggctggcctgaaggtggtgctgtttgcatgtggtcagtctggactgataaagatactatcagggtattggataagattcactagataaacttaactttgcatttctgtatctggattaaagaggttaattagtgaaaaccacgtgaatttcacttcattggagtgggcagaggattttctaacacaaaactcagatgttataaaaagacaagattaacaaatttgattgcataaaaacttccaatttctatagcagaaaacagcaaactgagaaatagtaacaactattgtgacaaagagataattttcttaatatacaaagagctcttacaaataaatccaattaaaaatgggaaaaggaccgggcacggtggctcatgcctcccagcagtctggaccaaagtaaatgtgagatgcaagtggggcagcaaggaatggtggacacagacattgcctgtgtctcctctgctcacacgcaggctcctttgtcccatcagaccttgcttactggccgggtgcggtaactcacacctgtaatcccagcactttgggaggctgaggtgagtgcatcacttgagatcaggagttggagaccagcctggccaacatggtgagaccccttctctactgaaaatacaaaaattagctgggtgtggtggcagatgcctgtaatcccagctattcaggagcctgaggcaggagaattgcttgaacccgggaggcagaggctgcagtgagccaagatcgtgccactgtactccagcctgggcaacaaaagcaaaaaaaactccgtctcaaaaaaaaaaaaaaaatagaatatggcaacagcagagcattgtacacctgccccacttctccccactctccattgctttttcctaggcaaccaccttcaaacttaacactgttagctttttcttgtatttattttcctatttccaaaaagcattgctagactctcatttattgattttccagtttagatattatctggaaggttgggatttagcacccttgcatcacttcctgtatgtgcatttgtcccctcacctttcatcccaattttgtgttaacatatttggattaagtccacattccacgttttcattattatggctgtaaatcttgatggctgaactaagtgttgtaataagatggcatttctgttttttgtttgttttttgagagtctcattctgttgccccagctggagtacagtggtgcagtctcagctcactgcagcctccgcctcctgggttcaagtgattctcatgcctcagcctcccaagtagctgggattacaggcacctgccgcccccactcagctaattttgtatttttagtagagacggggtttccatgttggccaggctggtctcgaactcctgacctcgagtgatttgccaccttggcctccaaaagtgctgggattataggcatgagctaccgtgccccatctagatggcatttctttttaagaacagttttttttgtgctttgttttccttgcttctccaggccttccagatcctttaatagttttataagatgtctcttaatccagttttcccaaaggtaatccctaccagataatccagcagttcccttctttcctggaccctcctcccaacttccctcggtcctctagtttagactagatgctttctaggcctgccccaaaatatttatggagggtcttcctgtttcttggatcccatgctactttttttatggggaggtacctttttttttttttaatttgttttggtggagcacatcctcaagtagctttctgagaaagagtgcatggaggtaaatggtttgcccatctcaaagtgtctttattctttgctcacatctgattgatattttgatttgatatcaacctctgagttgaaagtgactcttcttcagaatgttgaaggcatttttctgttgtcttctagcttccaacattgctctgaagaggtcccataccattctgatttgaatgtgaccttttacaaaatctggaagcttttaggactctctctctttctctctttttggtgattttaaattttacaatatatgccttggcctattttaatttgagggagcactcattggactgttttaatctagaaacttgtgcccttcggttcttgaactgttgttgtattatttatttgataactttcttacattttctctttttggaacccttaatattcacctattttctcactttcttatttttaaatgttttatatttttcatctttgttttcctttctccttccttccttccttctttcttctttctttcctttcctttcctttccttttcttttctttgtttcctttctttctttcttttgagacagggtcttgctttgttgcccaggctggagtgcagtgccacaatcatggctcactgcagctcgagctgccaggcacaagagatcctcctgcctcagcatcccaagtagctggggctacaggtgtgtgccaccacacccagctaattttttcaattttttgtagagatggggttttgccatgttgctcaggctgggcttgaactcctggactcctccctcatcctcccaaagttctgggattacgggcgtgagccagcatgcccagccatctctttctgtcttctaggaggtatctgattcatctttactttacaatcctattaaatttttgaattttttcatcgtacttttaatttcttaaactttctcattcactaaatacacattgagttcacatctgaaatacttgggaccagaagtgttttagattttggatttttttttttattttggagtatttgcattatacttagcagttcagaatccccagtctgaaagtccaaaatctgaagtgctccaaagagcatttcctctgagcatcatgttagtgctcaaaagttttggattttggagcatttggattttgggattggagatgctcaatctgtgcaccttttgatcctattcttgtttcatgggtacagtatgttctcttatctctgtgaggttattacttacatggatttgacttttttcttctgttccctgaaatgtttttctttcctttgggttattttaaaaatacatatttgtttcatgttaacagttttcttgtccaggtgcagtggctcatgcctgtaatcccagcacttagggaggccgaggcaggctagcccggccaacatggtgaaaccctatctctactaaacaaaaatacaaaaaaaattagccaagcacggttgctggtgcctgtaatcgcagctactcaggaggctgaggcaggagaatcgcttgaacccgggaggcagaggctgcagtgaaccgagattgcgccactgtactccagcctgggcaaaagagagaaactgtctcaaaaaaaagttttcttaaaatgcattggctgtatttcatatatagcaaggagatgcagagacactaattgggcagtttgtggacttgggcaggacttttccaagtctctgctgaaagactggttcagatggggctattttgggaagatcctctaatgtcagtcactgaggtcatttttctgagtgaaccagtttccccagagaacaatcctctcgacttttcctgggagagtgtatgtctggctgcagcatccaagtggggaaggggcttggcatgtttcttacccttcaatgtatagacttttgcttgtccccttttctctgtaggtccttctgccttgggccttcatgtatgtctaccattcctgggccagagcctcctggttcaccctccccagggagtgatccccggccctctgctgggtggcaggtggccatcacttggctactcagggttggggaggggatctagggtctgatcggttcttacagactttcagccctactgtcttcagccctcctggcactaaggccctgaggggtccctggaaactccattcctgagcctttccgggcttctccttctgggtggttcctccctgcaggcaattggctctcagcttttatcactctaccaagtcagctactacctggccatctgcttcccagcttccagaatcttgttgacatccttcattacccatcatcaccccttatggatttatgccttgtttatttcctccactgtcatcatagtggagttttggaagggagcagcaataaatctgtctgctcaacgtgccatgtttttctagaagtccactcactatggggcttaagcagggatgtgactaggtccattagcgatgtaagagcaaggatgctggcctccagtggaagagggagtactggggtggggggattggaagcagagaagagttttgtttggtggttagactggccatgcatggtggctcatgcctgtaatcccagcaccttgggagactgaggcaggcggatcccttgaggtcaggagttcgagaccagcctggccaacatggtgaaaccccgtctctactaaaaatacaaaaatcacctgggtgtggtggtgcatgcctataatcccagctactcgggaggctgaggcaggagaattgcttgaacctgggaggcagaggttgcagtgagccaagatcatgccactgcagttcagcttggacgacagagcaagactgtcttggggaaaaaaaagaacctagactgtggcccaggcttctacctgtgttggcagacaagttatattagctcttaagcctcaaaaaatggacatgatgatgggcctgccttgtgcatgtgatatgaggaataagtgagaaaacgcatgcagtgcttagcacagtgcctgccacacagtaagcatttcacgcacactcattactattccttccactgttaccaagtgatagataggatggacttgaaccagggaagtggcctgaaggtggggaggagggtgtgtctccttccccagagagaggcagagaatgagagaatggcttcagaaaatcagaatagtagctgcccccacagcacccccagggcttgttcccagctgccccgacccagggtgccgcccaacagcctggttctaggacagacagacagacaagtctgtcctcattcagctgctggaatgcttgagggacttggctcggggcctggggtgagggtgagaggacagggtgagagtcagagccagccggggcctcccagagccttggcaccagggagagccagacagaagcagagcaatacgtgcctccccaggggagcgggcccctccccaatggaggggcgtttgggaggaagaataaccccttcttcccaaggtccttttgcactttcacctttgcatcctgggagtcaggtagcagggccctcccaaggcccaggaggtggaaggaagagggtgtgcggaggtggggagggtggcagcagcctgtcttccagcctgcagcctttggtctccttgatgggggtgggacaggagagacaggatgggccccacccaagcaggttgggggacagaatgagtgagattcaccgaaagtgccaaacagtcaggcagtgtttctaggacttgggggcgtcgcagaggcactcacagaccaccctctcatcctagctggtcctgaagccctttggcttcctgcatatagatgcttatccagccaggtagacccacagggctgaatccaaactcgttcttgctgtgtccacagactccatgtccatcaggccctgtgtgtggggaccgtggtaaaggagacagacctccaggtgcctgtcctccaggccctcacaccatggggagatggacagatgacagttggggatgattggcactgaggcatgcagtcctcgtgggtctgtaggaatggggagaggggcaccaagccctcctgggttcaggaacagtgactcggagaaggagcctgccttctaaaggccagcttccacgccgaggaagaagggtgctgctgtaagtggagggcaggctgggcagaggccagggccatgcgagtatagggtggggcagaagaaccctcaggaggtggtgggggggcactggagggtagcttctggagcttgtccaagagggttgacctgaagaactctaagaacctttccggactgacaggtgctttaagggaccctggggagaggtcacagcatttcaccagtgtcaacttggacctgggtggggaggaggggaggccctggtccctgctttcctcaaagccagcatttctacagggagagaggcaggctgggtcacatgtggggtccttcacttcaccccgtggaccccccattcagtgacttcatgaccagatcccaggggtggccaggggagcgggcccccaggtctctcctgtcagtggcaggcagctctttgcagtctcaaagtgagagtgaggcttctgaccggagtcacctactgtctcctttgacctcttgtgggactgcccagccccgctataattagcttaaggaggggcgtggaggggaagggctgacgggtttggggatccgggtgtgtcggcagcgcagaggacctggcagtgagcctgccagaggaaggaagggctggctgccggccgcctgtgtgatttttcccaagaagacactgctatttatacccctgtagcttgggatcagcctcttgtagatgaggacgtgaaggcccaaggccacacagcatctatagccaggcaaagagtagaacttgggtttctgactcccaagacagcacctcggcctgattctcacagtggattctgtgagggtcgcctcatgctcccgacttctcccacacacccagggtgggctgagaggttgttgtggcttcagctgcccaacagcaggcccgcaggagccacatgtgcagcgagtcagcactggggcagccaggaagcagaagggctgggctgcagcccagggactgttggtgccgggatgaggtgcattggacccctcagcccctgggtcagaggaccccctggctgggatgggtgagcccccagtctacctcctcgagccacggaatgctagcgggaaggagggagcccagggccagctgaccccaccacccgctgctgacactctgccccgggtgcaggcccaggaaggctcaaggagccccaagccccaggagcacttggggacactcctttctccccgccaggcctcactgccatggttttgaacttgtatctggggtgaagtatttgaggccaggctcgcggttgaatgggaggagcctggcactgcaggcagcccagtgagtagacacagcctggtgcaggcagcctgggcatggctccagatcctggccatcacatctctcttgcgcgacccagggcaagtgacatatgggccctgagtgcatgaggggagatgatggtagagtctgcccaggatgttgtgaggagcaaatgagagggtatgcacccgggaccagcctggcacgtggtcatcttgggcactaggactgcatccagcagctgctcatctgccaacgcccatgttagaggatctgtttccagccagcatgggcagtctgagtgattccaggaggattccagggttctcagtagaagtctggtcaccttggctttcttctccgcagctctgggcagggccaggggcctgtcactggtcgggggacttaggagaccacgcaaacacccactccaccctgggtctccaagctgccaggccccctctgaaatctgggcttcgggattccatggtctgatccaccctcccagcccctctccacacctgccttcagtagtcttggccctgtttcctgaaccttttgtgttctcccagcctctctacatctcagagtgtctctttctctccctgctggactccagaatccatcacctttgcccttcttccctgtgcaacccccccacccccatcccaatcaggactgtatgctcatcctggccctctggcctggcgccacctgccctaaggccacccagactggagaactggagggttggtgcctccccatctcccctgcctggctagaggccccaggtcccacgggtcctgcctccctccattgcttctgcccaagtcgtggctgcctgggtcatccccagccctgcaagtctgcgtggctcaattctccccagccactgctgcccccagagggccccaaaccttcctccagttcctccaggacagcaatgagccgtgggtggggtggtcagcatgccagggcactcctactaagctgtagtggtacccacctaaggtccagcaggggcagcaggctggtcactggtcccagaagcaacagcatgcccgagggctgtaaagagtgaggcaggggcagaagcatgtgccagccgggcctgggccgccctccccagggcccccgcctccatgctcactgcctcgtggtgttggggctgggcagccttgtcttcgccacaccgcagcagcaggagtatgtggtggatacagatggcacctgctcatgtctgccagtttccccgccatcgctgccagggaatgccagctggaagaaggcaggagtagatagggtatgacagaggccggaggccagccctgttggggagtgggggaaacaggacaggcatgcctgccctgggctctctcccaggggaggggctgctttccagacctcgcctttccacagatgacctgaggtcttctgcctgggtggggccgtcggaggctctgttgtgtcaactgtgatgtgatgttctccagatccttgtcgggcctggcttccaggatctgggctcagacacggaggttgcagggtcggagagcagggccacatgacggcttggcggtccttccgagggaagggccctgacaacgtgtgcagaggcctggggttggggttggggttgtttagccagctggagtgcccaggaggtgagatgacagaggccgggagggcctgtgctgctggctgcgggtggaggatcggctgagccgagcagggaggctggagtttcctacagttgcagggctctgtgccccctcccgcctctcctcctctcccggccccaccaagccttctccgatgggtctcacaggctgcgccccctgcatcctcccatcccatctctagccatggatggggcctgtgcctggacgaccctcctgccaaggacatcatcgacttccccttggtgctgcctggcatcccctatgctgtgagccaccagtgccgcctccagtacggggcctactctgccttctgcgaggacatggatgtgagtggggccggtgtgggtgtgggggtgtggggacctggcaggagggctcagggggcagctctcaccagcccgtggatgccagcctgggagcaacctctcctggcctgggctgcgcccccgagtgacactgtgagacgtcaagtggcctgtgggagaggccagggataggtggccacagacccagctctgaattctgggtcaaccatggaccgactgtgacccttcggacaagtcccttcgcctctctggagctggctcataagagggaaaaggaacccctgtggagagggtctatttatcctggcgaagatcgcctgaagtgatcttctaacaggagtgtttccagaggaggcgctgggccgggagaggtgtggacagctggggaccgctctgagcagcgcagccccgggcgccccacaccaccacatggtccggggaggaaggtgggagcaggcacacaagaaggaacctctgggggtctgtgggcccctgccatgtggaggggtgcccaggggacccttggggacagggaggggggcagggtgggtggcagcactgggtagggtgtgagggtatggcccatgccctccttctcgcggaatgtctgccacacactctggtgctctgtggggaccacctgtcactccaagctggatgcagccatggacggcacccggttgggggtgtccccagtcccggcggtgggtgtgtgagagactagacctcctgctgtggccgggccctggggtcagcctcggctcacagtcttgcctgtgcttgtagcagagccccaagctctctgcagcccaagcccccgtctgcaaagtggaggcattggggccagggtttgattccatgattccccagggtgtcttcagctgagtcagcatgtgggctgttttactccccgctcagctcctccatgtggcctgggtcacaaatgattgtgatgattgtgaggaggcctctctcaccttccatccttcccctctgtgcctttcgcagccttcccacccaccttgttctcactagggtgaggatgactgataggcttgggggtggggtggctctacctccgtctgtctcggtagtggtgtctcaatggggagtgcgtacccgtgggcttccggcccgaggccgtggatggtggctggtccagctggagcgcctggtccatctgctcatggagctgtggcatgggcgtacagagcgccgagcggcagtgcacgcagcctacgtgagtgtggggcccagggtgcccttgggcagtgggacagagggacccaaacagtcagccgattgcaggagcttggctctgtcccagcccctggctcttagaagtgtcctcataatggtcagtccgagtgtccaggccaccttgagtcactttcaaggagtgttctgggggctgacagggtccccactgctgacccctttgcagagactgctgacccctttgcagagaggggacactgaggcccagagactggagagactcatcagaggccacatggcaaagcagttgctggctggaaggaggcaggagagggcagtggggaagagcatgggccctggaccttagatggctcaggatttgaatcccctcttcaccccttctctgggccttcgtttccccatctgtataatagcagtgcccatccagtaaagttgtagtcaggggcaaatgcggtttacgcaggccaggtcctcagccctgcagctcatctgtagtgggcactcagcgggaggggcttcttggcctcagggacacagcgagagtctgagatgagactgggggcagctgggaggatgggacagcactgaaggggtggcctgaggtgagtgacttcacttctctgggcctctgtttccccatctaaacgggggtgcgcagggggtgtgaagatctggtgagacgtacaggccagtggtactgtagaccgaggcactacccggctgatcttcacttcaggaggccacccggggcaggcatggggttcacagccagccccacccagggccctgcgcttacccaagactggcctgtgcccctccctgcctcctggcctccaggtctgagctgggtgggggccagcgaccctggcctagatgcagaggattttaggagctgtgctaggtcagacctttcagctggctggggcgctgggcgcttcctttagacccgggctgggggtactgccaccaggaggaaggctgaggactcaagggctcgttaggatgctggtatcatgggctgaagactcagagcagtccctccagccagtgccagtcatgcctgcagcttgtcccagcttctcaacagccctctgcagaagcagccccaaaccccactttatacatgaggaaactgaggcccagagggtggccgaagacttgcccacggtcacacagcaggttgggggcagagctcaggcttcctgctgccacctccccgcaggtccttacaaacagggagggtgtgtctgggccagagggtgggcaacccaagggaggggagcagcgtgcacaaagctgggtggcagggatctcacggtgtggatgcaggaggaagctgcttgctctgggctgtggccatgcagtagcactcactgggccctcactggggcccaccccggttctccccacaggcccaaatacaaaggcagatactgtgtgggtgagcggaagcgcttccgcctctgcaacctgcaggcctgctccgctggccgcccctccttccgccacgtccagtgcagccactttgacgctatgctctacaagggccagctgcacacatgggtgcccgtggtcaatgacggtgagtgctgcctcccatggagacactgaggctcagagggctggtgggggtgtgtgggtccaaggttaccctgtgatgcgagcaggaaggcccagtctccaccccaagcctgggccgctcccactgtcccctggggctgctgctcgcccctagctccccagtctgcagccttgcagatagctatcagcccagccggagcctccagcatgttggtgctacttgggagcctccagcctgccatggatgtgtgtcactcctggcactggggaccctcccagtcaggcctcgcccccctgcgtctccttggatgcctccaccagtaccgccccagccaggaaaccagagcccaggcagtggcttgacctcttgctggctggctgaccccaggcagtggtttgctccctgatagaagggattaaatgaggtggcacagatgacacagagggctctgagccgcgaagagtagccctcagtgtgtggtaacaatttctattcttatttttaataacaatgacggcctctcctctttgcccatgtccccagcgacctacttgtccctgcttcttgccctctaagcctctggggtatcaaggcctgggctccgaggaggaccaggagggaggtgccaatccccagtgcctttgacgttgaaattccctgcacgcgctgctcaggagcccgtggcgtgtcagatcccctgcctgcccgcagcctctgcagaactcttcccttctcttgtctcatgtgatgctcatgacatgcctttaagggaggggtgggtctcctcgtctcacatctgaggaaactgaggcttagggaagtagagaggttcacctgggtcagaggcacagctgaggtggggcagggccagagagaggcctcccgaccccaactcccagctttctcctcctgaccctggctggcccccggggctggggccacagagggctggccgccagcaccagggccctcccctcctcgtgtgttgcagaacgtgggctgtgacttcgagattgactccggtgctatggaggaccgctgtggtgtgtgccacggcaacggctccacctgccacaccgtgagcgggaccttcgaggaggccgagggcctgggtatggggtgggaccgctgtggggaggggtgtgctcttcatctggtggccccttccccatctcccctgggcccatgtccttggcccatgtccttggcctcgtggtccccacccagcctagagacggctaagcagggaagccttgctggggtggattcttgcaggagtcaggggacccctggcccacgtgcagagacctgcccccatggggagtcctcctgtcccagagacccagcttgtgtgtggcccctgggcctttccagtcatggtagtctcctcctgaagcttctgagaccccagctctgtgccctcacctccggtctattttgcacacgttgatcaagtactgactgtgtgctaggtgatggggatatgcaggtgaagcacttagtcctgcagggggacagaaccttctggtgtgaccattacagtggagggaggcccagagggctgtgggagcactgaggaagaaggtcctggcctggggaagtcagggaaggtttcctgtaggaggcggaagtcgagctgaatcataaaactcagaagagatggaaagggcattccaaatggaggaaagagcttgtgccagagcctggaggcaagaagggaaggcagggccagctatggggccttgagtgccaggctgagaagcttagatttcatcccagagatgcagtgcagtgtggtggataaagcactggccgtggaggctgctcataccgcagcaggatgttcatgtacgttactatccccttctgcctcactttgctcatctgtaaaatggggataacaatagtacctatgctatagggccattacccatgagcttacacatgtgaggtgctgagagtagtgcctggcacgtgatgggtgtgatggaagtgaatgaataaaagcaggccgcatggggatgaggagggtgtcccaggagaaaggcctgggcactttggcctttttagaaagaagatgccagccggcccttagagtaggggatggatccagccttgtgatgagaccagtttaggtccccaagagaggggtgatggggcatggccacggggtcaggattttgtggcacctctgcgaggttttggtgacccatgacagatccgagcaatttagggagctcagactttaaagctaatggcgaaatctttggcatcagcaggcggaggcaagtggggagagacatgaggggagcaggtagggataagcaaccttctcaccctgggcacaacctatgcacaacccttggctgacagggtatgtggacgtggggctgatcccagccggcgcacgcgagatccgcctccaggaggttgccgaagctgccaacttcctggcactgcggagcgaggacccggagaagtacttcctcaatgatggctggaccatccagtggaacgggggctaccaggtggcagggaccaccttcacatacgcacgcaggggcaactgggagaacctcacgtccccgggtcccaccaaggagcctgtctggatccaggtgcctgcctcccgtggcccaggctgggggagcagaggcggagtccctaggcccagcaccctccatggcaggtctcgtcctggaggagtgagccctggttcagtcacagagcttggctctgagcccagccctcctgctgcggcctctacctcggtttccccatctttaaaatggcccagtcgtgtagctgcagttcacagaggtggctggcatcggctcctttaggactgggtggatggagaagacacctcatgctagtgggcccccgcctgccaacccagctgctgttctaggaaagcaaccccggggtacactacgagcacaccatccacagggaggcaggtggccacagcgaggtcccgctgcccaagttctcctggcactgtgggccctggaccaagtgcacagtcacctgcggcagaggtgagaagtggggcaggcacagccccaccagcacgggctttgtctctagacagggacactggcttcagctcccagctcactgctgggctaccatgggtttggaagtttgcttctctgagcctcagttccccatctgtgagatgaggctagcgattgccctgtgtcccaggcccgctgggagggtacatggatgaggcaggtgggtgctggcttgcggtgcgtgctcagtgtgctccagctcttggtgttctccttccaggggacacagctccccctcgattttgtccttgctcagttctggcaggtcttgtacctgcatttctgcagcgtcccggagaccagcccaggcccctcaccacactgacttatttccctgaactgtttataaaaagtagggcaatttcattaactccgactcttccttcccgtatttcccgtctccccccatgctcctcagtctcccctctctctgtctctttgtctcctctccactgttcctcagtctctcctctgcccctccgtctacccccatgcctctcagtctcccccccgccccccagtacccccccgccccttggtcttcctcccccaactcagtctcccctgccgttccttggtctccccacatctcagtctccccctttgtctcttagtcttccccttttcccctcagtcttcccatggttgacactcagtgtcctcagggtctcagaatcgggaatctgagatacatttcagcattccttcaaatgctattatgatgacaaagtgaaactggagaactgggcagttaccttccaaagctaggaaacccattttatctaatacagctgtctttatttatttatttgattttatttgagatggagtcttgctctgttgcccaggctgcagtgcaatggcgtgatctcagctcactgcagcctccgcctcccaggttccagcagttctcctgcctcagcctcccgagtagctgggatttacaggcacacgccaccatgcctggcttattttttattattagtagagacagggtttcaccatgttggccgggctggtctcgaactcctgatgtcaggtgattcgccagccttggcctcccatagtgttgggattacaggcgtgagccactgcgcctggcctaatacgggtgtctttaaatggacaaacttgaaaaccaacaaatagacttgcagcactagacatttggggaattgtctttcagcaaattggctgcttcgcaggtggaccacttgggagcctctgcagaggcaagtgccctgtggtggctggaacagacaggggttctttgtctcaggcaggaagttccaggtgcacagtccaagctggcgggacctggaactgactggacctcagccacatcgtccttgccacagcagcctccccttcactcctgcttgccacagatggtgtcctcccttccagggctcttgcagtgttctgggcaggaagaaggagaggggaaagggctgaatcccagcaagggacttgtgcctttttctcccaagccaggactgtcccagacccccctagttgcaagggagcgtcagtggggtgtgttttcagcaggtcccattgctgccttgagcaaaattggaatctgttggtgaggaaagaggggaatgagtgtgggactggcagctcgggggagggacaacttactctcgggaccacggggcagggggtggagcagagaaggcagagccaccagcagagggggtcctgcagctgggcttcaacaggcagtatggaagtgagtgtccaaggtgaggagcgtggctgtgcaaagtccccagggtgggcggtggcagagggtgtgaaggacaggagcagtgccaaggctggtgtgggggtggggagcaggggctgtcccttcatgccccatttcttgtccagacgttctctgagccattgggaagggtgtggatggtgggacggccttgacgccacggctgggtttgcatgctagcagcagctggcatggatcgagctcttaggatgtgccgggcaagggccgagcctacacatgcaagaacacatgcagtcctccctccagggcttggaggaggcaggattgttgctcccacttcacagaggaggacactgaggttcagagaggccaaatgagctgcccatggtttcagctaggaagcagagggtctgggcacccaacccactaaaactccacactctgccacccctccaggcacagccagaggggaggctacataggagaaaagggggtgtatgagaaccaggaggacagcgaggaggtgacggtggaggtctgccttcatcctgacacaggcagtaaggtgctgttctggcagagagagtgtctttgggtcttgggcggtgggcacctgggtgccagtcccaggctgagccccatggcccctaggtgtgcagaggcagagtgtgtactgctcagagcggcaggcaggacctgtggacgaggagcactgtcatcccctgggccggcctgatgaccgccagaggaagtgcagcgagcagccctgccctgccaggtgagcccacccccatcgcctgccaactccccacccccaggtgtcctgggtctgccacaggcccctacatctgggtccctggagaccccgggggggagcagagggagctgggctttcattctcttcccaaggctgaagccctaaccccaggtcacccctcaccccaggtcacccctcaccccagcctaggccagcctgggccagcctggacacctgtggtcctcttctttggatccctggatgtggaaataggcctcaggtcatgctcagtttccctgaggggagggtggcaggagcagaggggctgtgctatgtcaccaggctttgaggtcaagaaacttacctgggcttggatctctggagaatcaaccactggcctcagtcccagctctacccaaaccctgaaggcctggaagcccattccctgctggtgagcctgctgaagagcctgctgatgccacccgtctgatgccatgctgatgccacccatgtgcccccgccaggtggtgggcaggtgagtggcagccgtgctccagctcctgcggggcctgggggcctctcctgccgggccatgctctgcatccgcagcatggggctggatgagcagagtgccttggggccacccgcctgtgaacacttccctggccccctactgaaaccccttgcaactgccatgtgccctgtctggctacctgggctgtggggaactggtttcagttgagcgtgggatgggagagggcccacctccagctccacccttggtcttcggctatcgggaggcagacagccttcctggagccctcgtgggtgggagggagtctgggcattccagggtccagcccctgactaaagcctcagggatcaggaagcccctggcaagcatggccatagtcatggccttgagctgggcagggccagagagggctggctggggtctctgccactcctaagccccctcaccctggcttcccctgcagtgctcagtgacatgtggggagggcactcagcgccgaaatgtcctctgcaccaatgacatcggtgtcccctgtgacgaggcccagcagccagctagcaaagtcacctgctctctgccactctgttaatggcccctgggcacactgggccctgaaggctcaggcagcggctcctccagccacgagctcttcaatgaggctgacttcatcccgcgccacctggccccacgcccttcacctgcctcatcacccaagccaggcaccatgggcaacgccattgaggaggaggctccagagctggacctgccggggcccatgttggtggacgacttctactatgactacaattgcatcaacttccacgaggatctgtcctatgggccctctgaggaacccgatctagacctggtggggacaggggaccggacacccccaccacacagccatcctgcaccctccacgggtagccccgtgcctgccacagagcctcctgcagccaaggaggagggggcaccgggaccttggtcccttagcccttggcccagccaggccggctgcttcccatccccgccctcagagcagacccctgggaaccctttgatcaatttcctgcctgaggaagatgcccccataggggccccagatcttgggctctccagcctgccctggcccagggtttctaccgatggcctgcagacacttgctgcccctgatagccaaaatgatttcccagttagcaaggacagccagagccagctgccccctccatggcggggcaggaccaatgaggttttcaaggatgatgaacccgagggccgtggagcaccccacctgcccccgagacccagccccacgctgccccctttgtcctgtcggcagcacccactcctctcctagtcccgacgcggcggagctgtggacaggagggatagtggcctgggagccagctctggagggtggtctggggcctgtggacagtgaactgtggcccactgttggggtggcttctctccttcctcctcccatagcccctctgccagagatgaaggtcagggacagttccctggagccggggactccctccttcccaaccccaggaccaggctcatgggacctgcagactgtggcagtgtgggggaccttcctccccacaaccctgactggcctcgggcacatgcctgagcctgccctgaacccaggacccaagggtcagcctgagtccctcagccctgaggtgcccctgagctctaggctgctgtccacaccagcttgggacagccccgccaacagccacagagcccctgagacccagccactgcctcccagcctggctgaagcggggccccccgcggacccgttggttgtcaggaacgccagctggcaagcgggaaactggagcgaggcaagtggtgtgggctgggcgggcagggagtttgcgggggaccttggtgactgtttcttcactgaaaatgagcagagtgggacacgggccgtctgtctcgcctccctcggggaaggggttcccaggatttaggggggtgaggggaccccggggcccattcctgggcagcacagcgggcctcagggaaggcaggggcaggcacactctggcagcacagcacgccccaggatggagctggctcagacagctgtgcagtggggagggtccccgcgtggccgccggccccgcagcttccctgaggttctgcctggctcctccaggctgggctcagcccactgccacctggctccgccctcctctagcagtgacctgcaggggtctgagctgcaagaaagaagctggctagtgcccctccctgggtccccagatggtcactgcaggagaagaagcttctgttcagatccctaatttggaggtgggatggggtaggctgaagctttactcagcgatttggctgctggcaccaggacccagccttccttccctggtgcctctgggaagccatgaggatggtcaggatagctggtcaggggtgcccacagggtcccctccccccacctctgcaccaatgacgctggaacacaggccctttgtcccatgtgagcagggatggttggttgctggggggatttgacttctcatcctcacagtcttcctgggaggtgggtggaggagcctattttgcaaataaggaaactgaggcccagaagagggcccctgtcctgctgaggtctcctgtcttgctgaggtctcgctagcctaggtgggtagtttcctggctgtggaggcctggtggggatgggatctgcctggctttcacgggtctgttccccgcagtgctctaccacctgcggcctgggtgtggtctggaggccggtgcgctgtagctctggccgggatgaggactgtacccccgctggccggccccagcctgcccgccactgccacctgcagccctgtgccacctggcactcaggcaactggagtaaggtgcgtgaggatggagccaggacaggcattcccagggcatggggtggagccctggttccccacggcctgtgttccgagagcggcagggaaggggagggctccaggctgcacgtctgtgtgcccgatctcactggattctgaatctcttgggagtcttctcatctttgtctggcttggcctgtctccttttctctgtatctttgaccccatctggacttgtctttcactagcttgcctttgttcttccctttctctgtctgtcccagcccatggcagtctctggccatgccaccttttgcctggggcctgccagccttggcctctcgctggggttcttcagatatttccccgggctggggcgtgggtctgatgcctttcccgccacatgcctcacagggtcacacccgtgggcctgcacgtgggtgtcttggtccccagtgctcgcgcagctgcggtggaggttcctcagtgcaggacgtgcagtgtgtggatacacgggacctctggacactgcagcccttccattgtcagcccgggcctgccaaaccgcctgcacaccggccctgcggggcccagccctgcctcagctgttacacatcttcctggagggaggtgaggcctgggggttcagatcgggggaggggatgccctcagaccctggctgtgccctgactccttccctgcccacccagtgctccgaggcctgtggcggtggtgagcagcagcatctggtgacttgcccggagccaggcctctgcgaggaggcgctgagacccaacaccacctggccctgcaacacccacccctgcacgcagtgggtggtggggccctggggccaggtgagccgggctgtggcggggagcagggagcaagtgcttggtagcacctggtcagtcctgggttgggtgaaggagctgtggagtgtgtgctgtgagccaggctctctgtggcccctgcacatgcagcagtgactggacagccctgccatgctggcgctcacacctgccagggaaaaacggacaaggaaagggcacatgtgttatgatgtcagggaaggccttctgaggaggggcctggggttgagacccgaggggaggagtcagtgatgccaaggacacggaatcgaggggacagcaggtgtgaagtctgaggcaggaatgtcgagcttggggcgatcagggagcccagcaaaggccagcggcagaagggggcgttaagaggggcctcggatgggcaggataccttctgctgggcctgtttggaactgaggggttcagaaatctcaggtttgggccctgagctgggtcctggagtcagctgggccagcgtttgagtctttgtcccactggctgctgagtgactgggcaggttgctttgctttgctgggtcactgttttctcatctgtaaaattggaacagcttaggagaggagggtcagaaggattaaatgaaggaacgtaatgaagcacagggctgggcacagcacgacactggcagagactcagcgcatgttcagggctgataacaacgaagcctggcgggctgggccccggctgtgaaactgtctcctgccctcctgcccatgggctgcggcaggtcctctgccctgtccctcgggcacagtggtgtctcgcccacatctctgcccactgctgcatcagggctccatcccggggcccctgcccaggcttctcaggcatgtcctgtgtgaggggctcactgccctgcagccccgagggctgtcccacggttctcatgccccttccctctgcaggagccaatcccacaagtgagagtggggttccggcaccaagtgggctctaggaatgggaccaggtcctccaggaagcactgagagggcggctgggagcaaggccaggccagtcaggcacagggcacagggacggcttcccagaggaggtgtccctgcccccactgctagggctggccctggagacagtcattcctcccctgctccccccagtgctcagccccctgtggcagtggcgtccagcggcgcctagtcaagtgtgtcaacacccagacagggctgcccgaggaagacagtgaccagtgtggccatgaggcctggcctgagagctcccggccgtgtggcaccgaggattgtgagcccatcgagtctccccgtgagtcccctgaccccaggctccctgctgaagtgaggtagggtggggagggtgatggggaaatggtgtcgtcaaaccattgtgcccacggcactggctggttccatctgtagtctgggctcaggagccacatggccactgaaaatcctgatgccacaggatgccttgccggaggctgggctgtgctgggagtcagtcaaggggtgtcccagccacacaacatcctgcaggcagctgtctggcctcaggggagaagagggagtggccctggcccctgagttgctgtgtgaacctgggtaagctctttctcctctaggtctcagtcttcccacagtgaagccagggatggccctgaggctgtgtgaaaacagcctgggtgagaccctgtccttaaccctgatcttaaccctgacctatctattccctggctagaggactgcctagagtgagcaatagaaccacatgaagggcctccctcccctgcccccaacatgcgcgcgcacacacacacacacacacacacacacacacacacttcctccagctgcagctgctcccagcagtgctgagggcaggaaacggggtggccctggagtgtcacctgggatcccctcaccagctgtgtggccttgggctcccatttccctctcagggccttcatgtgctgaataaaggggctgccaagccccatccttgcataaatgaggtctgggcatgaagggcacagcactgcgtgggcatccaggtggtgctcagggaaggcagctttctcccctcccccacagccactgtcatccccaattgcaaggtcagggagagggcctggggctgaccctgccagtccaaggaatccagaaactgtggcatgaacagctgcgtcccctgtgctattggctggctgctccctgaccctagaaaagagtcctcagccagggcactcacgctgacattcggggcctcctgcgatctccccggtctgccttctccgcttgtccaacgcagccttctttacctgcaccggctcctgggcagccctcattcgggctcagagtggcccctgccatgcctcgctgccctgcctctggcaggggtggccttcctgcctcaaaccccattacctcaaggtccagtggcagtgcccccaccctgtcctgcctgccctcagcacgcacccagccagcatctcagagcactcctatgtgctgcctgagctgggtgctggcaccacgtctctcacctttatggctagggctggccacagggagcggggtggttatgatcccagtgggggaggaccagatggggcagagaacagaaactgaggcccctgggggcctagaaccaaggacggatggcccaggaggctctgggcttgcaaggtctcccaggggcgggtgtgagtgggctgcagggagtgggctatgggggctggttaggtggctgaactagaagctgtcctaagtgagttttctgccatcagtgaacagtggaggggggctgggaaggtgtcctggactttgagatctggaattcccagatgttctgctggtctgtgggacagttggtgggacatgtggaaagctgggaaacgcgtgtgtgtgtgctcactgcagtgacacagcatggccatatccgtttgctgtggaggtggggttgacagaggagagaaccgaggcccaagaggtgaagcagcttgtctgaggtcaccccgggcgaccaggatgcaggcctgcagatgtgcactttggagctctgcctggagctggggtggaggagcctgcctgctgcctcgtgccctctgccgggcctgggggatgtcccaggcccagggctggctgctgtcctcctgctcctcttgctggagtaagcagggcctggggtttgttagcagcagcggcagcagcaggagcaaggctaggaggctggaaacaagccacatcccaaaatagctctgataaccatggggcaggagggcccagccaagcctcagccctgacaagcacagcctgcagctggcctccctccccactgggcctgggctcagtccctggtttccactgatggcctgtaaggcccactcactctaggctttgtggcccacctgagaagtgggaggctggcctgggagatgggaccctgtgactcagaacccgaggctgtgtacagcccccgtggctggaggtggtcacagaggcctggcaggataggtgcactggagcagggggaggtggcgggagtggacggcagaggttgctgcaggctggcaggaggcccctgggacctcagttctgtgccaggatctgtcggggaataccaggggtgagcaagtatggagatggggtggcagggtgtcaccctgggcaggctcttttatgggcatgtgagggggtcagggtggggtctcaagacctttcctccagaaacttcagcccagcagcgcccgttcttgaatcctggggttggccatgagcaggtgggacagaaatagcaacagctggagacgtgtgaccttgaaaccggggcactctgcttggtggggagctgctggagcctccttaaggtggttggggtggggagccaggttctgatgccccccccgcccccccaccccccccaatcccccgcccccccactccccccactcccccccactccccccccactccactcccccccactccccccccactcccccccactccccccactccccccactccccccactccaggctataagcgggaccacctgtccttcaggttctgcgagacgctgcacctagtgggctgctgccagctgcccactgtccgcacccactgctgccgctcgtgctctccgcccagccacggcgcccgctcccgaggccatcagcgggttgcctgccactgaccgtgccaggatgcacagaccgaccaacagacctcagtgcccaccatgggctgtggcggagctcctgccccctacgccctacgccctacgccctaatggtgctaaccccctctcactatccagcggcaggctggggacctcctcccccctcaaaaaaagtatttttttattctaacagtttgtgtaacatttattatgattttacataaatgagcatctaccattccaaagcacagcatgacttcatcttggatttggagaatcttaaaagtgagaaactcttccccccactcctctgcccaaaactccaccgccacagcacctcggcaggcgcggcttttcacctgctcctctggggcagatctgcagggtacagagcagcaaacaagtccgtgagagcatggcgtctggtgaggcacgggccttggaagctggggggctgctgcccagggagggctatctgcggagggtcgggttctgggggcaggaaggtcttccgggcaggggcacagcttggcccttacttgctgcctgcctctagctcggctcccagctttccctggggccccactctgtggtcctcagagacctgttccacagggattgggcccaccttgtcacttgcaggactgccccttggagtgatggggactggggcccccaggggcacctccctgggcctgttgtatctgttgactcttctgcaaaaagtagacagagaagagagcaggctggcccgctgtgctctactgtgtctgtcccaggactcggaaggtagggagggagcgtggccagggcggctgcctgcaggtgcgtgtcctgctgctccccaactcaacatgctcacctcatttcacaccaacaagccccatcctcagaggaggagcccaaggctctgagaggaagtaactggcccaagggcacatgccctggtgacacaggcccatcctaggccctgactgcccacctccaagttccaggccaccctgagcaggccccagtggcagctttgcacagagagggcagcctgccagagttcacacaggaaagcaagttgctgggcaagctagagtgagtcccagccccgctgtgctgcccgagggtagaggagcgtcaggcgtgcttcctgtctgtctgcagcagcccggctggcccaaagagactctagggacccaagctctgagtcatggcttcccaggccttagtcagaacggcccctggtggcactcccttccaaggggtggggagcagggcctgtcgacttgctcctgacccacacacggagccagtccctgtcccagctctgccccagctctgccgccgccgctctgctgcgtgactccaggaacccccagcctcgctgaatccatgtccgcagaagagaaaagcctgccaggccttggcctgccctgtctgggaatccttgctggagccaccccgaaacacccctatgggaacccctttggtctttatcattcttgggtgttttccactgatgactgcgggtgtgcccagtggcagctgggcctgagctgtcagcccaggcaggagacaaacaagcctgtgactcaggcagggcatggcacagctggcggaaggaggcatgcctgttctttgtggctgggcggggggttatccggacacagggagtctccagcttccggctttcccacctcggtgcccccagcccacacctgcagcttggccatggttcttggggcctcccaaggctgcccctgctggcaaaggcatcctgatgcacccgccccagggtgagccaagggcagagacacccagaaacgccaggctggaaggttggagagcccctcctcgccccccgcaacaccaataagccctgccccaccctccaagcccttggggtgagccccatcaccagtgactataactgaatttcaatgcagaatattatacaaattagtagtttatttcttcctttagtattacagttccaaaacgtaacttgaaggtcagcacaggagctgctgtgatataaaaggagagagtcacctggcgccccctgcagtcctccagttgcccagcagcagtgggacgttcagtggcacacagtgggtctctgtatggcctcccacctgcaaggacttccccgggcaggcccagctgcccagaagccccggaacacacaggaagacaacactataggatggcaggtggggatctgtgcaatacaaacatgtagctagaaaacccaaccgaggatctgtctagaatacttccgatatcaatataccgtagttgaaaccagaaccgtctccagctgtcagcagtcttggcggctactgtacagctgtcagcatgactacaggcagcgcccgaggctatctggggtaagaagtgggcctgcacatcacatcggtgagtcagtgagagtcagggccagagggaaaagcaactcggaggctgaggctggcacagatacacacaagggagtcacacacataacataataacttgttatataaaatagatatgtggaatctagaaacaccttgagaaaatagcctataaaaatataaactgtagtgagagtgtacaaaagtattaacagaggttcaacccataaaaaaccccatccatttaaaagttggcaattcctagcaggtgttgggagggagctcccctcggtcctggtgcgcacgtttggacaggcctttgggtttcccagctggcagggtcccccttgcaggggccacgggctgggtgttggggtgaaggttcagaggaggaacagcagcttggggcagcccctgtcagaagggccccctgccatggcagccagtggaggccagggaccttcagggcactggaggggacagagcagctctttcctcagtgacccgagggaggggaagtgttagcgcaaaagagtggggcccacagtcctggaaggaggagttggctccgtcccgttcccaaactttaaccaggcggagccgccctctcttgccttctggacacgcatcacttgattccaggcaggagaacctctgagaaagtgtccccagtccctttcctccaggaactctcctgctgtcgcacacacacactgcccggcagctgctgacaactgcctggaaacactaacataccaccgtgggttgcagccacgacgggcccctggtcaggtgcatctctcagggcaaactggacaacacgagcctgtccctaaaggcagctcttagccccaggacatggcagtgtgtgctggcatgttccaggggccattggctcggaaagtaaaacctcagggcccagccccattcctgctgcacctcctcagcagccgccccccaggctgacagctgtcgtttcacgatgggctgaggggtggggggggttccaacacttgattcgagcagactgcaacgcccagctcacaggacaactgaaggagtcagacctcaaactgctgctctcaaagacaaagacaatgacaaaacccatttttgatgcctgaaaagaggcaaaggcttctggctaaatatagaggccagctccgtctacccagtgaaacattagtggagttggttaaagacacgaagccggagctcactctagcatgtgctgaaacaccaactttgccgtggcattgccaaaaagttgacagcaaaaaataggaaaaatacttcttaaaactgcattgcttcaattcttagtctcagtgtgttcacaacaaaggatgatttccagtttttttcgggtaatatgaaacattccactgagatcatttatcttgtattttcataacactgtgccagaaaacatcctctcacatctacgcatcagggatggtctagagcgattaagcaaaaacaagctccttgctcaaagcctctccccagccttcagaaaggcagtcctctgagttcccagaaactgctgtgtcagaggcaacagtgcccctgcatcctggcagagaacaaggatgttccaggcagtggtggggtgggcacacatctgggagagctcacccaagcctgccccaagcaaaaaagtttcccagccccaggcactggcagccggcctcctgcacaacccaggcaggtggagacaccaggagcactggccatccccaaggaggccatggttttcagctgtccaagagcgttcacgctgcggctgcaccactgccctgcaaagcacccccgaaaacattcctccatcccctcaaccaaggccagcccaggcgtgggcctgctttgcaatatgacggtccactgtttacttggaatcccatcccatcgtacttggtgaatgatttccacaagtcaagaagggcattccacagaatctcacagagccatgcctggcacggggcaagctggggacagagcagcccagtgatctgcaaacacaggctggccatgagaagtgagggtgggtgtctgggcagccaggccctccccatgcaggctggaagacactgatggaagggttgcgtgtggaagagcaaaggctattctagaaatggggcatggctggcagcttaaagccactggtgggaggttcacaggctttcctacagtggccatttctgaacaagggatgtgcctgcttttctaaggcagccccttttcataccaaccttatgcctgaggcagcaaccctctggcctacaggtgcctaaagcacagctggcatcctttatagcactgccattcaaaaccacacaccactgcccactatgtacaggagagagaatatggggagatgcccagcaaagcaaggtttcagagggtcagagcaccgacaggctgacggaggctggaaacaggctcttgcaaatagccactggtaagcctgaggatccaccaaccaggcagaaagcgtgactgagatacgtgtaaccaaaagcatggcacggaaatggttgtaaacagattagacctcccacccctgccccccgcacagtgggaaatgaggaagggcagcctggcttgggacatctgcccagcagatccccagaggacacacacgttacattctggcttttaagtgcactttcaccctttgggcacactttggttgtgaaggaaggaagagcagcatcccgagcccactcaggtatcctcctcctcgtcactgaccagctcacccttgtcagggctggtgtcccgctcacgcaggaagtcctcacggatggcctccagctcggtcagctccagccggactttctccaagtggtaggcgcgtcggttccggatctggcgtagggggaaagggttcaggtccccaaaggagatactgatcagcttcctggcaggacgcaggggagagacaagagaatcagcggcgctccagagagtgctcacacacagccctcacaggcatagcaggtggcctggggcagggtgggaagagcgctggccaggcttggggcctgatgtaggggatgaggcccaccttctgtagagaggtgacaaagcacaatggcccagccaggggcaggctcagaatgacgacctggactccagctctgccacatgcttgctgtgtgactgaagtcaccccccttttctggcctctgatcttcatctgcacactggggtaagagtagtgccacctcctagggtgtgggattactcgtgttcccacacataagccctgagaagagctcccggcacttgcatggtgatggcaggtatgtcttcatccttgggcgggcatgaggcctggcaccgggcacgagtccgggacgtctgtgtcccaggactcattgactgggaatgaacacaggcccaggcagtcctggcgatgactgtcagacccagttggcaatgtgacaagtgtccagatgcagtctacagagaaatgtgcagcttgtgggtttcacatccccaggtcaaggctccaattttcaataaaaatgttaaggttatgatccacttgctcctaaccactggtcagtggcttaataaaaacaagaccaaaagctgtcctgaggcctggctatggatttgtagcactaatgggtcagccacactggtctctggggatcacaaaataggccagttcctagggccaccttcttcccctctctggattctgccaggccccaaatgctttgtatccaccaacatgggctcatgcgcttccctgtcaaccaaaggcccaacagactcaccagccccaggaaaagctgtgatgaaacagaaatgccccgaaggacttcctgcctgtccccatcagagcaggccatttgctcctgctgccgtcggctgcgtgggctccttttaacacaaggcacacacgagggtgcaaccttttatgtttcaaaacacccactactacctggacatgcttaactctcgtccagaggcttaaggtcagaaaggccagctttatttaaattctgaattccccagtgtgtgttctggaacacgggagcaccagagaacagagaacgcccaagcacaggggtccccgcgtgtggatttctcgggttccgcctcctgcctggctctgcagaccaggctgccagccccagcaggcgggaggaggctccgtgtgaatggggcacagggtccccaccaccagtcctttctccccaacagctgtcagctcacagcccccacaaaccccaaacctacggcgcccaaccctcctgtgctgcagaacacgagcccgaagtataattcttcatttgttcctcagtcaggagctgacagaggcccctcggcccaggctggcacccgggacgccagaccccacctctgcctcaggcctggaaggttcctctgggaaatgagaaggtgccccatggtcagctaaatttgggagacgatgctcagcgccttaaaaggctcctagaagtcctgctgcagaacatggttcaatcctgtgtaactcccgtctcctgaatgcagctgaccacacaactccctccctgtgtttctgaaggccgatcgctgtgctgcaggactggcctccttgcaaccactagtctggggagctcattaaaacactgaggctctagcccagaggcggattatgggcccttgcagtcttgataacagcggggagcctgccgccgccttggcactccttaaagcacctgttggtgtggcgaccctgctttctaaagcaagctgcaggggagaccgtaccgcgagccactcagaaggaggcgctgcaggaccatgcaaggcccagcagtgtgggaggggccaggttggcctgcggtgccagggaagggcgggcactcaccagagccacgcccactcacctccgctcctcctggcagcgcctgggacccagtacagaactgagggcagcggcgctcccaacacagccctagctgttggcatgggcgagctcactccctgtcactctcggcaatcctgacccaacacgagatgaacagaaaccctccaggctcaccgcaggactcagaatcaaactttccccagcaaatatgattcccatatccctcctcatttggcagaaatcagggcactgttgttggtgctattagtaagcctgaaactattacaaacccactccccaataaaagactctaaaaatagcgacgacctccaggaagcctggcatggcctcagccagcacctcagctcccattgtccaaatcggctctcagggtcagagcagccaacagctgcagtccaggggacatacagacgaggatggcccagaacaggcaatgactgtgtggtcagggagggttcccgaacacctggcctcccaggccagaaactcaggggtcctccaagtcaaattcctccctccctctcttcaatctaccccccttctccatctgtgggaccacctacctccaggccaccacctctccccctagagccctctaacagccaccagtcctgccccaatctgacctgtctgtctcttgcctaaccctgcaggacttcccagcactcaggatgaagcctcaagtcctgagagaagtctgcaatcaccctgacagcccagctctgctatggcccagccacactggcaccagccgggctgagctgcctccacacttccccaaacacacgtgccccacagctctgcgccaccactcctgaaggaccccctgtccccatactgtttccttgctgccccttgcccagcttatttggcctttctccggcctgggatccctctaccacagcatggatcaaacgatgcgcaacagtgtccccagcaaggtcttccaggacaggccttactctccatctgtcatcctcagtgcccagcacagaccctaccacaaagcaggtactcagtaaatgctttctagacaaatgaaactattgctgttcgttgttgggatttatgtttgtaggataaaggacagaatcctcatctcagttcctcctaggtaaggctacttggggctcacaccccttgctctcttttccctggaaagcaatgccctctccaacactgtacaccggggatggctctgagttggaagacagcaaggacaggctgctctcaaggaggcaggggtcaggcttcctgctctccttgacatctgagaactccccaggactcacctagcatcaaggatagtgcgagtgaagtagcggagatacttaaatatagacatcgaatcttgcaatttcaaaatctcctcttccttgtacttaaaaagtgccagagcaaaacggaaaataacctgtggaataaacagggaaatctgttagtggaaaaaccctgtgggtccaggcacaaggctggactccaggggggtgctggccctactggggacagggggacatggcttgcacggtccccgccctggggaaagactattgacctgaggggcaattttcactggctaggccaagactcctttattacaggaaaataaaccctgctggttttcaacaacacatcagcccaaaccaaaaatctccttataggagatctttgtggaatcctttcatactcagaaaacacttctagtcaataaagcataaagaacaaacataaggaatcattttaaaataaaaccaaaatcaaggttttctgattctgaaactcttagaaagtcccacctacagaggctgtttccatctcaactggtgcacttttgaagatagcgaaggagttttttttaaattttatttttatttttgagatacagtcttgctctgccacccaggctggaatgcagcagtgcaatcttggctcactgcaacctctgcctcccaggttcaagtgattctcctgcctcagcctcctgagtagctgggactacaggcgcccgccaccacacccagctatttgtgtattttgagtacagatggggtttcaccatgttagccacgatggtctccatctcctgacctcatgatccacccacctcggcctcccaaagtgctaggattacaagtgtcagccactgtgcctggcctttcttttttttttttttaatttgtgtttggggtacattagaggttagagggaatggactcctggtagtcttgcaagttcaagcagctttggaacaaactgctttccccatatctaagggcctgtactttctctaatttagtttgttttctgggtcttgctgtgttgcccaggctatattttaactcctcagctcaaatgatcctcctacctcagcctcccaagtagctgagacaattggcacatgccactgtgcccggctaaggtaaagaataaattgagaagagtaactagaagactagggaggggcctccactccattacaaacacctgtttatacaattagggtttaatatgtaaatatattccttattcaaaaactgatttttaaaaaacatacaacagagcgggtgggaggctcatgggcagtaaggctctgaagttggctcccccaagttagtccccctcattagcccccctaatcccctgcttattagatctctgggcctccatctcctcctccatatgatggggtaacaccaccagccatttgacagatggtgaggctcaggctcaaactgtaagccatagctcccagcgcctatcacagggcttgatgtgggttgaatgtttctgatacatgaacaaatgactgtggtttcctgataccctggacccagatctagtgcaggccgtgctgagatcccttgggcaccatggtaaccctcataagttccaggtgagccagccgctctaccgccaccaacgctgctgacggttgtcaagtgtgtatatctgaaaatagctgagctgagctaactcacctttggtccttcataaaggaaagagtcccatattttaaagaggatgtcactaacgacactatccacaaataccaccagaaaccagttgaaagtgatgagagtgtagtcgactttgtactgttcaaagtggccatgcaaccgaggcagcttctcactcataaggtctctgaacacccgctggtccacctggagagggaacaaaggggagaagtgtatcaggcctgccaggtcaccgggtaagcagacgagcagacgcgcaacctgagagcctgggggtggagcccaagtgacagcagcacaactgttccaaatgcaccgtggggcccatcacggagccagactactatgttccagcagcgctgacctcgtgcactgcaggtacacaccgagtgtccgctgaacagcatgctttccacagggcatgggagtaggggagtctgtaacctgaaaccaactcctgcactcaaaatgccctgggaaataggccactgcaagcagcaggtaggacagtcagccttgccaatccacaagtaaatacgtgagatgttgacacaaagggccacaaactagaatcctgggcagatggggattctgcttccaaaaaggaagcagcatcaccacatccattcaacaaacatttgctgggctgcatgtgcagtgggggtggcgaggactccggcgtcacatgaacctgagtctgaatctcagctctaccacttactagctgggtggcttttagcaaattatgctctaaacggctctgtgcctcatctggaaaatagttaattacctctctcttactggactactgtgaggattaaatgaggcttatataaactacctgcgcacgacagacgagcaatacctggttactgccactctgtgtcaggcacggggccagtgctgggcagagcgttgaat

SEQ ID NO: 304 - DNA, 20689 bp, Homo sapiens
gtcttgttgtttctactgatgttttcctgaaagatttgtgcctttgaatctgtgttctgaacttatactctggtttctcttcgtatggtgttagtctttccccttttactaaagagctttgaactgggtagtttaaaagacccagattctagtttagtttggcttctagctcactttgttaactttggttgtgaagtttgtatccacgaaacaaatgagtttgacaaaaatccatgattcacatactgattttactatggaccgggtaagttatttgaattctaatcttgtgtggatacaaaaattggagacaaaattctggtagggttggcaaaggttgaaggaaactttatttatttattgagtgcttactatgtgctagatgctgtttatttgccttattcactaacctgtgaagattttatctctgtgttttagttacagaaatatgagatacaaagaagctaggatacttattgagctagtaagggcaggatccagaacttcggccaaagtcaatttcattccaaagccagtgttctttttgttgcagtttgcaagccgttccagacttctctaacggagtagcctttaggacaaatgataggtgttgtatgtgtctcttgaagaaagtactctctgttgcatgtcatactactggtagaatacctgccctcaccccccaccctcttttttttgagacagagtcttgccccatcgccaaggctgttagagtacactggtgatcacagctcaccacaaccttgaactcctgggctcaagcagacctgctgcttcagcttcttgagtagctgcatctacaggcatgtgccaccatgcccaactaactttgtaatttttattttgtagagacagggtctcactatgttgcccaggctggtttcaaactcctggcctcaagcgatcctcctgccttggcgtcccaaagtgctgggattataggtgtaagccactgagccagaccaaaatgctcttaagatacaaaaactagagtggataaataaactatttctctggatctttgattaagactgcacaccccacggtagtgcagttatttccattgtgcctgtaagtgtgctttaccatcctgagtgaagagtgaagggaccatgattaaaattcccatgacattgtatggttttatgattgtggtttcaagtcttgctctctctcaactaatttttgtgaccttagactagaaaatagtttttttttttgttttttttttggagctgcagttccactgtgtgtaagatgggaaaaacagtacctattttatataccatattgctcgttgctggacacatatgtgtccagcaagcatttattttttgtctgtggttgtacctataattggggagaattttttttctttaagtgtagatcaattatggtataggacattggaaggtagaagaagaggtactatatacagcagttactgacctttccagtctgaattcctatttagaaataaactacttatgttatttgtgttactgttttaggagacatgaattggctaataagttgtttgcagtgttgtttctttgctaatttttgtaaatgtaattagatttcataacattttgtgttaggagaacatagacactttgagagaaaaatgcataataaaagctaatttgatggtttctaggggtagttctattttgaaattcctttcagcagacaatatgagacagcatattatgggctaggccctgaaagaaccaagggagagtaaagcacagtcctaggccacaaagagtatgtctctggaggataagatctctggattttttgtcctacttacaaaacagaaataatatattttatgctagttacaagtagtataagctcattgaagaaatatttaagcagaaggaatgtgcaccagccactaggaatgcaaagataattggggtatagtgagagatatggaaatttgttgtgtaacaatgttagagtaccaactttgtggtatacaggcttctaaggaacacagatgagggatgagggatgggacgggtgtgctgggtctttttttttttttttgggacggagtcttgctctgtcacccaggctggaatgcagtggtgcgatctgggctcactgcaacctccgcctcctgggttcaagagattctcctgtttcagcttcccgagtggctgagactacaggcatgcgctgccatgcctggctaatttttttaaaattttttttatttttagtagagacagggtttcaccatgttggccaggctgttcttcaactcctgacctcaggtgatctgtctgccttggcctcccaaagtgctgggattataggcatgagccatcgtgcccggcctgtgctgggtcttaaagcatgagtaggaatttgccaggcctgggttgaggagagaaagaatggaatgatggttctgctgtgatacactgtgtgcaaagaaacagacgtcaaagagcttggtgtgtttgaactcagtgagcagtgaggtgtagaattatttcgtgtggatagggtgtggtcaccgaattaggttagaaagtcaaaatggggtgggtggaagcgtcttttagtttgtcctcttgaagcaaaagggaggatagtctggttttgttttggatacctcattctgtgagcagtagaggatagtggcttggcagagggagaagggagcattgcctctcagacaagttagaggaggccattaccatagttttggacagattgtgagggcttgaatgcagtgaggttggaagggagccagcagatctaatggacattttgaaagttgaatggatgaaacttgttgagtagatggtgggaattaggaggtggtagttgtccagaataactgggaatttctagcacaggctgctgggtgaatgagagtgcactgaggggcatgattcattctggcatgggagaggagttggcttcctggaagtggtaatgtttacatttggcttagattacctcattcaaagtggttcttgattttgcccacaatctattttagagtccatttattcatctagaaagtaccaactgcttactgcatgccagtaattgatattttaagaatattaaaaaatgttaattgtggtaaacacacataccataaaatttaccatcttaaccatttaccgtcttaatcatttttaagtgcagaggcagtggcatttagctctttcacattgtcgtgcagtcatcaccactgtccatttccatgactcttttcatgttgcggaacggaaattttgtacccatgaaacaataactttctatttctctctcctccgtgtccctggcaaatacttttctacttcctgtttctatggatttgactattctgggtactatatgtaaatgataccacacagtctgcgttcttgtgactggcttacttcacttagcacaatgtcattagaattcatccatgtggtagcatgtgtcagaatgtatttcctttttaaggcagaataatattccattgtatgtatataccacattttgtttatccattcatccaccaatggacactagagttgtttccacatatgggttattgtgaataatgttgctttgaccatgggtgtacagacatctttcgaagtccctgctttcagttctttggcgtatgtacccagaggtggacttgctggatcatatggtaattctatttttaattttttgaggagctgccatactgttttccatagtggctgtaccattttacatttctaacagcagtgcacaagtgttccagtttctctgtaccctcaccaacacttgttattttctgtttttgtgacagtagtcatcttatagtgtgtgaagtgatatctcattgtggttttgatttgcatttttctagtagttagtgatgtgagcatctttttatgtggttattggctatttgtatatcttttttggagaaatatttgttcaaatcctttgcctgtttttcatttttattttattttaatttaattatttttttgagatggagtttcactcgtcgcctagcctggagtgcataggcacgatctctgctcactggaacctctgcctcccaggttcaagcgattctcctgcctcagcctcctgagtagctgggatgaaagagtgcaccaccacacccagctaattttttgtatttttagtggagacagggtttcatcatgttgtctaggctggtctcgaactcttgacctcaggtgatctgcctgcctcggcctcccaaagtgctgggattacaggtatgagccaccctatcaggtccattaccctttttttaaattggttgtaggaattatttatgtattctaaatattaatctcttattaaataagagttgctagaattttctcccattctgtgggttgccttttcactctgttgattatattctttgatgcagctagtagtagttttttttttttttttttgagacagagtctcgctttgtctgtcgcccaggctggagtgcagcggtgcgatctcggctcactgcaagctccgcctcctgggtacacgccattctcctgcgtcagcctcccgagtagctgggactgcaggcgcccaccaccacaccctgctaattttcttgtatttttagtagagacggggtttcaccgtgttagccaggatggtctctatatcctgacctcatgatccgtccgcctcggcctcccaaagtgctgggattacaggcgtgagacaccgcgcctggcctgatgcagctagtagttttttaatgaaccttaaattataagggaggttgttgcttttatagtaactttactgagctcaaatgaagaaattagtttcctccattttcctttagaggagtatgatataattttataatttgaaaaagggttggtattcactttttctggaattttcctttctaggtatgatttatgacctagtatcttttgagtaatgtctccttcctttctttttcatggccctcaggtgtggttattagaataagcatcatgaccatgacttccccgggctggtcgctcatcaccagctgtccagttagaagcaagtctggtcatacctgcttttgtgtaccatgtcttacagtagtagttgtcttggggctgtctccctactcatgcccttcttgtcgactttcacctgggtcatgagaatggcttcaaaataggtcttctgcttcagatttctcttaattttcctgtacactgtttggactggcctttccaaaacacctttcaggggctttgtgatgctttcaggatcaagttcagacactaagcttggcagtccaactccttctaccttgaccttaacccccctttgcagttattttcttccctggtcattagtatattggcagtgtcagtcaaggcattttatcttccttggactggggtaagatgcttgataggtgggccatttctcttctgcgactctcagatttaccatctgtcacctggacgtgcttgtgctgtgctctctgcttggaatgctgtcacctcttcaccttgcctggtttttcagggcctaactcaaatccctttcctccttgaatccttctctagctggtccagcccatagagatcattttccgttctcagaatgattatggcatttattttctgtgctgtttcattgggcaattgattgtaaatggctctgtattgtgttagctttttgtgtgtttttaagaaaatgttctgtcccctttagttccttgtagtagtaatcatgacttgtactctatacaggttctacacacgtaggtaattgatggatcttcattgatcctataacattggttctccaagtgtagtcagtagaccattgaacattcctgagactctttcagtgagtctgtgaggtcaacacatgaaaacattatttacctttttatagtgtgcagacatttgacctgatagtgcatagtgcaaaagcaacaatgggtgaagctgccgatgccttagaatcaatcacgacagtgaactaaactgagctccagtagtcacggtattcattacagtcatgtactgtgagtgagaaataatgccagttccacttaatgtctgtgatgaagtagtgaacattattacttttattaaatctcaacctttgagcacacatttaaaaatgtgggaagaaaagggaaatatgcgcaaaggagttctgcacgtggaagtattgtggttatcttgaggtaaagctctcgtgtgatggacattaaggtgaactaactgcttttttttttgagatggagtcttgctccgtcccccaggctggagtgtagtggcacgatctcggctcactgcaagctccgcttcccgggttcacgccattctcctgcctcagcctcctgagtagctgggactacaggcgcccaccaccacgcccggctaattttttgtatctttcgtagagacagggtttcaccgtgttacccagggtggtctcgatctcttgacctcgtgatccgcctgcctcggcctcctgaagtgctgggattacaggcgtgagccaccgcgcccggccaactaactgcttttttaaatgaaactccatttttatttgaagggaggactttgataagctgtggttatccagaaattggttatttggcagataccttcttgaaaataaagcaagcctttacttcaaggaagtagtggagtctttgttgccagtgataaaatttgagtttgcaagtgaaaatcagaagtttggaaaatatgtattcgccaccatgagcttgacagcttttcagtatttaaaagctttatgagtaaagtaatgatattaacaaatgtgatttttgatattgtataatgaaatgtatctacatttggaagatctgcataactcaaggaaccagtattttcacaaatgatcaatgtatgatgttacagcaaaaatcatgcttgggtaaacgattcattcaaagtgaaagaccagtcacttttaatgtaacagagtacaaaacggtcattgatacagtttcagatttcacattgtgactaactctttaagaagctaccacttgtcaagttttggtgtaacatggaaaaagaatattaacaactatcccaaaagactattaaaatactactcctttttcaaattgggtatctatttgaggcaaaattttaaaaatgtacttccccaaacagtgtaaccgtttgaatgcagaagcagataggagaatccagctgtcttctattaagccagacattaaagagatttgccaaaatgtaaaacagtgccacgttcttatttttgttttgttttggaaaacatagttatttttcataaaagtatgtttatttgtaatgagttcatggaattttaaaatgaagtaatattttataaatttttcagttttaatttctaatacaataaagtaccaataaatataacccacataacaaaagctctttgggattctcagtttttaagagtaaaaaggagggagctcaggcaaccaagaactttcaaaccactgattatagcttacaatggattgaaataagctgatcctcatgaaatactttagtttcttatttgaaaatctttatagaaacaacacagaggaaaataattagtatctgctttcataatgctgagttatatttattgggcacttaatatgtgcctgacactgcactgaacaccgtacctatattatctcctctaacctttatcttatcctgcaacgtatatattaccttagttttacaaatcagggggctaaggcactggcgggtcaagtaattggcccaagcttatttaagaggtaagtagtagagctaagttttagacttagtttaagttgaaattgaaagcctgcgcttttcatcaggatgttctgctgcctcacagaaaagtttgtaagtcggcactgtgtccgcactgctaattgatccttagggaaaagtgcagaatgctgttgtctgaagattgttgatgcaaggttgagcagtggctgaagatcctgcgcatgttttctttttatcccaggtcacgtagtcttgtactgttttgtggagctggatctttagaaggtggttctttcagaacttcagaacagaccgtaactggaagactgtgggcttagtttcttatggttactagtagttagtatgtgaatctagctcaaggttggagagatttttcaggatggctgtagttcagttgtcgttgcttatgctagttctttcatttcattcaggggtatagaaactttagattgtctgaaaatgttattttcaggagttttcccattgggagacaaggaagtggggatggagttgaagtcaggtgaaggtgaagagaatagcaccattgccctgacccctggcttttgggttattgtgctgcaagcatcaggtgactgaaaaagcaaacatgaaagtagagattcagagaggggaagtgactcaacccaggcaccctgcacaggaacatgtgtcatcacggtttcagctccggacggtgagatcgcagtgtgttctcaggcccttgttaggattcttagcacaatagttgtttctgcttggtgggtttgttgattgagagcgcctcagaagcatttatattcacagtatcccacgtgccctactaactcaactttatattacatagacagctactttaaaattgtcttggtacatgtattttgaaatttatatgaacagctttatttacattatccattatactcctctattaaagaatatatgtatattttaattatacttttttatactcattcaactttcattgttttctccaaccttttttaccacctcagtggaaatggaaatgagagtacctgttatagcctgaaaagcagaggaaaaaaggtgtaactctttttaaggtttttcgtcatgtttaacttatgtgttattcccagatttttctccgatgttcatactgtctcttgaaaccagtcttcctttttttcagcactattgtggcctgtgtataattggtacttgtctttcagatttgtattctgtaaacaggctttgacggggcaaatttaaactgttgtaaagattgcctattcatttctaatacatgttttgtggtagaattgaattgctgattgtgtgaagggtttttgaaaatgagggacaaacaaaatgagaacttatgaatagtagcacagtaaaaaaaaatccaagaggaataagaccaccgtgctttcttttttcacttctgaactagtcaatagctttgtattctggtgataattaacaaggtttctatacatacacaaaaatgaggggtagtgagatttagatgatgatatagagaatgaagatgggaaaaaatcctcttggtattaatacatatggtataggtacagagtgttcctttatgtgtataatttgaaaagggtgagggagctccaaaataagataaggaagttggtagactacatgttttgttaattcttatgttagagtgccttctcctggtgtggatgcatttctaagatgaatagttaatttgttcttgtttctttttcaaagtctctttgagcaaatgacaaattgagatgtcctagctttaaggagagaccattgacatttgcctaatgccttctcttgtcttaggctttgccttgtattaaagaagtatatgactggatgtgactaaaatggtctgggaggagggttagtattctgttttctaaaatggattctgggattgttatatgcaattggtgctttaggatgggagaaaatcacctaagtgtaacttcagaatgtgagaaagtgtgacctgtcaactgttttggttgggttttctatgttggagtggtttgtttcttaaattttgctctcaggtttggggtggtagtgaagttactctgaaaattcataatttttctataattagtaacagcatcccaggagtttcagagggaaatacctttaaaaaaaaatgagatgtgacagcacgctgccacgccgacgcagaccccgctctgcacgccagctcgcccgcacccctcatggccacagttcagcagctggaaggaagatggcgcctggtggacagcagaggctttgatgaatatgtgaaggagctaggagtgggaatagctttgcgaaaaatggacacaatagccaagccagattgtatcatcacttgtgatggcaaaaacctcaccataaaaaccgagagcactttgaaaacaacacagttttcttgtaccctgggagagaagtttgaagaaaccacagctgatggcagaaaaactcagactgtgtgcaactttacagatggtgcattggttcaacatcaggagtgggatgggaaggaaaacacaataagaagaaaattgaaagatgggaaattagtggtggactgtgtcatgaacagtgtcacctgtactcggatctatgaaaaagtagaataaaaattccatcatcactttggacaggagttaactaagagaatgaccaagctcagttcaatgagcaaatctccataccgtttctttttttttttttttcattactgtgttcaattatctttatcccaaacattttacatacagctatttcaaagtgtgttggattaattaggatcatccctttggttaataaataaatgtgtttgtgctaataaaaaaaatgagatgtgtatattgatgattatcttttaaaaaataatgggaggtttatgagagagctggtgcacttaaagcctggtggttcagtacgcataacccctagagctcagttttcatggatcaaggcagatttgtaaatagaagaataatgagtcagtatggtaaatgtcaatgggaagattcgaatgaagtgagatgggagcacagaaggatggagcaactatatttgctttgaggagtcaaggagggaaggacattctaaaattttgagagcattaaagaataggttactcttttataattgtagagtttattgtactatgtatttgcataaatggacacataatatttagttaaatacctctattcattgtgcagtttatgtttagcactgtgccaggttcttggggaaggagttaaaaaataaaagatgtcctgtttcagtactttcttgggagtggggctactatgtgaacagcttgagtaacattttgttcaagactcagttgtgggtagccaggtactgtggtggactggtgcttttgttaagtctggtttttttcctccctgctggtaagccactttagaaatgatcagtttcattaatgtaaagtcatattttatacctctacgcactaattcccgtggacatgactggtagctacgataatttttgggactccagtggtcaatgagtatgtctcaggtacttaatttcttccatggctaactagtttttagtgggcaaaaggaaatttgagagaagctgcataatttgctttaacttgcagggtgtgttaagtattgaatcacatctattatgattatggaattttggtgtgtgtttgaatgtcagagatagtgttaaggtcagaattctgctgaaaactgacccatctgaaaaccagtatgttcactccattccactcttcagcaaggccatagtttccctatcatggttcatttctccttttccctgcccattaaaggtagcaaattttggaggttcttacacatttggggttcttaaaattgttctgtaatgtgtaagctcggctgtccacaaatgattataggattgacatttgttatttggtggagtttgatatattagagtaatataaatgtgttatgcttcaaaatgaaatacgggatttttattcactagtttgtctttgtttcattcctttccaaaagaaaattaatgcttaacttgaacagctgattttttgcattgtttcccttaaaagcttgctagcataggaacaaaaggtaacttttttctttgccttttattgttttctgattgtttgatattaagttttggattgatattagaaatattaatagtttatcctaggcaggagccagctttctttaatatgtgccagatgagcttccagtagtttttagactttgagattttagaaacctcattttcagggatgggtgacttcactgctttttctttgtcttaatttaaaattggtatgtatgaccaaaggaatctttctgatactcactggtcctttttggtggaatcgaaatagcgtatgagcaatgggcgtttaagttagaaaatattcgtttatgtaaaaattaaccagaaattactggaatgtagtattggtcaaggttgtagagtcaagttaatcagtatgattaatgggtattaggaatggaaatgttgcaatgtaatgacaagtcatgaattgttaaaagaacaatctgttgttagcccattgataaactttgtgagatacttatttgagagcaaagtttgaaatctttcttttgccgattaaacatgactgtcattttgccattttctgctgtattccaaccattacgttctaagtgctcatttatcctcaccaggagccagtgaagaaggcgacattattctagttttacagatggagaaatgcagcttatgtattaagcagctgatcaggcagcacaaaaccaaggaagttattagtactggtaattgaacctagatttgtctggctccagtccagtactgtccagtagaagtataatatcagccactaggtaatttaaaatttcctagttgctacattaaaggagaagtttattttaatattttaattcaatatataaaagttcattttgacgtaattataaaattgagatattttacatttttacattctttttgtaccatcttcattatttattattattattattatcattattattattattattattattctgagatagggtctgtccctgttgcccaggctggagtgcagtggcaggatcataggtcactgcagtctcaatctcctgggctcaagggaccctcctgcctcagcctcccgagtagctgggactacaggcgtgcgccaccatgcctgtctaattattttatattttgttttgtatagacagggtctcactttgttgcccaggcaggtctctaactcctgggcttcagacgatcttcccatcttggcctcccaaagtgctgggattacaggggtgagccaccatgcctggccttttgtaccatcttcaaagtcagtgtgtgtattttagatgtatagcacatctcagttcaggctggccacatttcttcaagttgaaatgtggctaacccaaattgagatgtggctggtggctctataatgggattgtgtagccctgatacctgtgcagtggccagtactataagcggtaaagaaaccaagacttcggttttgcatgttgttgaattatttaagcttgtagcatataattatagccactagtttaataaaatcagtcatgacaaaaagtgataaagtagccttgtcataatgcaaatatttggttgtctttcccatatttacaatttttacttctctgaacaggagatgatgtaggttaaaataaaatatttaagtagcatttaaaaggcaaataattgcatttagtctagagataaggaatcaatcgcatagttatcattaataataaagaccacaagtggctaagaccactttaaccacaaaaaggagacagttgaaatattgtacatgggtttaagtatagataattaaattcagcagtctgcttatagtacctgctgtgtgctgggcattgtttagatgttcagatgttaaaataagaaatggattctgtgctcaaggatgccacccttaagggtttaattagagccattatttccagaaccattaattagaaccattatttccagaaaaatttggtggtgatgggaagagtctttgtatatttttgaacattccacagtggacactgtttgctttaagtataatctttgtatcatatcatcataggatttgtaaaattttcaaacttctttgcaagtactttgcaaacttctttgtatgcattaaaagaatgcgtggttctgagagatttaattatggcagcctcagggccactttataaaatgctctccttttgatactctgtgagttgccattatgttgccccatttctattcctggtaaagactcaccgatcatactgatgaacttgatctgcattttggactgagcttagtcatacaagtaacgtggccgctgatacattgtgtatcattctggaaaacaattgtatgtcactgttgacccggatatttttatgtataggattgcttagttgcaagatagatgaaaatatagttgcctaatcatttaagagtgaaagattcttggtattctagtttttgggttgaggagggagaataaaaaattttccaagtttagtgagtttttttgttgggggatggagagggaatgtagagagatggttaaccagtatttatgtctcatttcaaaataatgacagctttttttaaaaagcttgaaagatagtatatgccttttgtcagtaatcaacatatgtatgtaatctattctgttgataaatgtcaatatctaaggataagtagggcacagagaagggaaattgtgtacctcattttctctgtaaggctgtaaagagtgaagagggtgagagaaagaaggcacacctttcatattcatctgtcatttctagaaggcttaagtgtctgaatctgactcttgttttttttttttttttttttttttgagacggagtctcgctctgttgcccaggctggagtgcagtggcgggatctcagctcactgcaagctccgcctcccgggttcacaccattctcctgcctcagcctcccaagtagctgggactacaggcgcccgccactacgcccggctaattttttgtatttttagtagagacggggtttcaccgctttagccgggatggtctcgatctcctgacctcgtgatccgcccgcctcggcctcccaaagtgctgggattacaggcgtgagccaccgcgcccggcctttttttttttaatctgactcttttaacagtattctgatagagcagcgatggcttcaagacgtagactgttgtcacttcttttgtctgctgagctgcaaaacagcttcttgggatatctggcccatgactttggataggattgatggcttccctagcccagtctgttcattcatctttggagttgatttcttatctttcctgcttgaaaagaatggatgcagggtatggtatgattctgattatgtttttattcaatatgaagcaattagttgaccataccatgagacagaaaagacaaatactcattgaaagttgatacttaaaactcttaccctaattgggattaggaggaagagtactttatttcaccagagaataatgccagaaaattttgctaagggtaaaagtgtggggaccattttcgaaggaggtcaagagctagctattttatgtaagggaaattatctgaatgggatggaattataaggaaaggaagctgaaatattgaaagagaatttcccccaatattttcttaaatgtgggctattactttttcattggaaaaaatttaaaaggactacattaaaaatgagaatacttaacaggctgaagtaggaggattgcttaagtccaggagtttgaggccagactgggcaacatggcaagaccgtgtctctctaaaaaaaaaatcggaattctgcattttaaggagtgtggttcattcctagttatagattaggacagttgaattatgtgaaggtctgagaactatttccaatatatagacttttattaaacaaaggtatagatggatgatgacttagaaatgcaggcggtgattttgtttcatgcctagtttctcaagttttagaaaatggtgacagtctcagagaaaacaagcaactattttgtgaaatctccaggtgtcaaaacagtccaaggcacatataattagaataaattaagggagaatgttgctttagagttcttgtggtgcactagtcattcttaaagggtgagcaaggcaaaaactaaaaatagatggaagcttatctgcacatttgaacttgtggaacagctggagtgggtctcttactcccttactcttcctaactgaataattctccctctctggttatttgctgtattgagaaagtcttcactggctctcctggcgtttttgagaaggatattaaaggggcttgaattagagcacaggaagtggaataaatggcaggaaacatttgatcatttctgtcactgtcagaatgaaagcccaatatttgatttgagaggttgcaggacagtagcaaatgttttgatgggtttgtgtgtgcgcgtgtgcgcgcgcgcctgtgcacactctcaactttgtatctttttttttctttgcccttctctctaatattcactcttgtccagattttcataatataattggaagaagcaaaggcccttcctcctctgttaatgagttacaatctttcacaggtccaagaaaggcgacagaagggactttctactttgtagacttattattgtttttcattttctactaaaagtttattttcccatgtgctgtttttcggtgtgtatgcattgttaactgcatttccaccatgttgcataaggaacatttgcaatttggtttataatgtcaccattcgtgctccataagggaggtctatactctatctctcatatatccagtacctaaaactcactgcctggcacttaagtaggtgcttcagtatatgtcagcattccaaaggtctttgttactgtaaatagagcattgatgtgaatagtacagatgatggtgggctctatcatgatctctcttggcagggatttatccagagtcatttgaataattaccatgtaccaactagtatgtctggtcctgggtatgtacgtatttaggacctttagagagcttatatgttggtaggagaggacatactaggaaaccaacaattacagtatgggggtgctgttacgagatttgaggtgtgcattagagagcagagaggaaggctacctgacccagtttagagtgagttgagagaattaggggattgtttcatgaaggagatgatggttacatgatcatgttctgtaagatgaggaagagttagcagggaaaaggggaggaaaggcttggagccctgagaaaactttgtccttatgttggggaagtactctgttcagttttcaagttatgcaccattttgactaatctttaaggaagtaatgtaattggttagtttggacttttctcataatttgaacagaggttttttgttttgttttaataatggagcagtttaagaaagaacttaccttgtttaccctaccctaaccaaaccaaaccaaatgaggtgttgcatccttctctgtgcatacctgcatatgattttaaattaggaaagaaaaaccaatccaactctcttgtgaataggagttgctgttagtgtacagtttcttattttggcagcaaacccatctcagcaatgcagatgttctgcagtaaaataggtgacttattaatatgatattttctggttgtgaaaaacagttgcatggccagtatagaagtgacctatttgaatatagtacaatattaatctgcaggcatgcttcagagatattgtgggtttggtttcagactactggaataaagtgaacattgcgataaagcaagtcacacatgttttttgtttcccggtgcatatgttttgtttatactatgctgtagtctagtaagtgtgtgatagcattgcatctaaaactgtacatcccttaattgaaaaatattgctaaaaaatgctaacaatcatgtgaaccttcaacaagtcgtgatctttttgctggatggtcttgccttgatgtggatggctgctaactgatcaggtggtggttgctgaggattggagcagcttaggcaatttcttaaaataagacaacagtgaagtttgctgcattgattgactctccttgacaaaagatttctttgtaacatgtgatgctgttggatagcattttgcccacagtagaaactcatttcaaaattggagtcactcctctccaaccctgctgctagttgatcaactaactttatgtaatactgtaaatcctttgttgtcatttcaacaatgcacagcatctgcaccaagagtagattccatgtctagaagccactttctttgctcattccttaagaagcaacctgccatctgttcaagttttatcatgagattgcaggaattcagtcatatcttcaggctccacttccaattctaattctcttgctgtttccaccacatgtccagtgacttctcccattgaagtctggaacccctccaagtcatccatcagggctggaatcagcttcttccaaaactcctgttaatgttgatattttgatgttctcccctgaattgtgaatgttcttaatggcatctagaatggtgaatcctttgcagaaggttttcagttggctttgcccagattcatcagaggatggatggcaggtctaggattatgaaattagtttcttaaatcataagacttgaaagtcaaacttacttctgggtcagtgggctgaagaaagcaagtgtgttagcaggcatgaaaacaacattaacctccttgttcatctccatcatagctcttgggtgacccaggtgcattgtgagtgagcaggagtcttttttttctgggcagtaggtcacaacagtgaccttaaaatattaaaccatgctataaacagatgttctgtccaggctttgttctagttacggaaacacagagtagacttagcataattcttatgggctctagaatttttagaatggtaagtgagcattggcttcaacttaaagtcatcagctgcattagcccctaacaagagagtcagcttgtcctttgaggttttgaagccaggctttgactttccctctctagctatggaagtcctagatggtgtcttcttccagtataaggctgttttgtctacattgaaaatctgttgtttagtgtagctactttcatcatttgtctagattgtctggataacttcctgcagcttctgtgtcagcacttgcttgtttgtagtgcacttttatgttatggagatagcttcttgtccttaaacctcatgaaccaatgctctgctagcttgctagcttttcttctgcagcttcttcacctgtctcagccttcatagaactgaagagattatttagggccttactctggattggcctttggtttaagggaacgttgtggctggcttgatcttctatccagaccactcaagctttcatattgttaatttgttaatagtaataaggctattgtgctttcttattatttatgtgctcactggaataacacttgtaatttcccgcaagaactgttcctttgcattcacaacttggctgtttgttgcaagaggcctagctttctgcctgtctcagcttttgacatgccttccttgctaaccttaattatttctagcttttgagttaaagtgagagatgtgtgattcttcctttcacttgaacacttagaagccatcatggggttattcattggtctcatttcaatattactgtgtctcagggaatagggagactcaagaagagggagagagatggggtagcagcaagttggtggagcagttagaacatacacaacatttatttagtttgctgtcttctgtgggcacagttggtggtgccctaaaacaattacaatagtaaaataaaaaacataaaagatcaatgatcacagattaccataacagatataataatgaagatgttcgaaatattgtgagcattaccaaaacgtgacacagaggcatgaagtgagccacatgtgttttggaaaaatggtgctgatagacttgcttgatgtagggttgccacagaccttcaatttgttaaaaatctctatctttgaagtgtaataaagtgaaatgcattaaaatgagatatgcctgtattcaggtttattatttatttttattgagattacctttttgttatgtataaaaagcctggttttaaattacagttttctaggtgtgtttatataagataaagccttttggttcttggaaaacagttttgggaatgtcaaactaattttttcattttaagattcctctaagaacttatactagaggctggtcctggtggctcacacctgtaatcccagcactttgggaggccaaggtgggcagatcacttgaggtcaggagttcaagactagcctggccaacatggtgaaacctcttctctaccaaaaatataaaaaatcagccgatgtggtggcacgtgcctgtaatcccatctactcgggaggctgaggcaggagaatcacttgaacccaggaggtggacattgcagtgagttgagattgtgccactgcactccagcctgggcgacagagtgagactctgtctcaaaaaaaaaaaaaaaaaagaacttacctcagttaggacttaattatcctctttgcattactgtgggagttagggcaagacttttttgaaagtactgttgttaattgtggggtagataaatttccttgagcagatgaggtt

SEQ ID NO: 305 - DNA, 240748 bp, Homo sapiens
acaaggccatcagtatgtgatagaattacaggtcatttaaaaaaattctttatatgtcctatagagtcagaaaaatatagaaagatgattaataggtttctatcctcaaaaagagttaacatcccagcagaaaagatataatttacacatggcataataaaaaaatatacaaccgaatatgagaactagacttctgctgtctcatcctctgttcctcctttgggaaattacctctccctcaacgtgattgtgtctctagtaaggcaacctcatcaggtagacttgcaatttcttgggctcagtcacaagtggggtctacaatccaggccagctcacctggtatcgctctttgtcgggccacagaatgagtgagagtccacctgggtcccatttttacactttagaaaagagaagatctttgtatgaatttgaagcccaaacttctagcattgacaaggaagtaatgtacctgagaatgaagctaacctggagaagaactgagttgaacattgagaaagagagacattaggacaatatcctgaaaaaaagtaatttttgcccagtagaaccagccatgcttgaagacatatgtaaccctgaacttttctgttttgtgagccaataaatacctttttttattttcattttttcagacagtaaattccattttctcttaaatccatttgatctatgttactgtctttcaactcacatggtcattattgatataaacacatctttcaaagacatagcatgagttattgaatcaggggagaaacaggtcacttccagcctgatgactgggaaaggctactcagagaaggggcaatccgagctggaccttggaacaaaagagagagtaagcataaggaccaaagaaacctggaatttatagaggtataaatgtaaggtatttggtaagatgcttttactgaaggagagactttgtgttgggaagcaggaagtgatgggctggggacaacactgtaattatcaggctagtggttttagaaattatcctataagcaatgaaatatccattaaagaattttagtaagtgtgtgacctgttgaaaatcatccttccagaaaaataattagtgtgagagttatacctaatgaaagtataaaattggcaccctcttcatccttttcctcctgtaatctcttcccagggaaattcactagctaatctcctggtcttcagttttccatactgatttatcctccatacattgtctggtggactttttaaaaatatgtctaattgtggcacttaaaaagtcaggatgtttcttaatgtccatgctgcaacatggataaatctcaaaatgattatgttgagggaaagaaaccagaccaaaaaggaaaaatgcatagtatatgattccatttatataacattctagaaaaaaaaatgacagaaagcagagcagtggttgcctagcaatggggagaaggtgaggaggaggggtgagagtgtgataacagggggatgagaggactttaggaggcaatgagataatcactgtcttgtgtgctaatggcttcacgggtatatacacatgtcaaattttgcaccttacatacatgcagtttagcatttgtggaattgttacacagttatacctcaatataaataatacctcaataaagctagtttaaaaataaagtgacaatgacgatgtggtccagtctcaaagcagaaagcaaaacagtacaactaaagaccagtttttaaagtagttcaggctattttcatgtattttctgaactcgacagcatcaactctctaaagcgcccttattctttcttgatccagcttcttccaaattccttcgctgttcccacatccgtttattctaaattccttgaaaattttaccttctaccatcagccataagggaatagattctctattttttctaaatcatattaaatccagttccagactccaaatgttggcaagaagttctcaaatcaagtatttttggtattaaccactgcccttttattgtttaaggatctcagggtaccagaagaaaagaaataatagaagatgcctcatcttcattctgtggtcatccttatcactgttgatcgttctgctacacaaggctatttttttaccagttagcattcagtagttctttcattgtgccaggcattaagctaaatgcattttcttactactcataacaaccccataagaaaagacacatggtacccccttttcccactcacttgccgtcttagttcgggctagtcacttaccttctctgatcaccagttgtctcttgtaaagcgagatgtaaaactaggtggctcttcaaactctgacattggtttttttctttatttactatacataccaatgccaaataaggtgccgtaagaaaaaagaaaggtggattgcacactgaaattgggctcgttttcatagactgaacctacatggacatttactggcctaaagtaactttatctctttcttttcttttcttttctttttttttttttttttttttttttttttttgagatggagtcttgctctgtcaccaggctggagtgcagtggcacgatctcagctcactgcaacctccgcctcccgggttcaagcaattctcctgccttagcctcctgagtagctgggactacgggtgcatgccaccacgcccagctaatttttgtattttcagtagagaaggggtttcaccatgctggccaggatggtctatctcctgacctcgtgattggcctgcccaggcctgccaaagtgccgggattataggcgcaagccgccgcgcccagccagtaactttatttctttttcagcgtactcagaacagattaagactacaagaaatccctgaatacacagacacatttaaagttcttggagaccatctggtccctggaagaattcaagacttgatttctgagcacatagaagaagtctgaggctaggcaggttttttctgggatctggcagggacccagccaggacatggtgtaacacgggcagtggtattccaaggacagggtgatgggagcagtctacgctggtagaaaagatgattttatcactggctttaacaaaattatttttaagtggcaatcttcaaccatatgtgctgctacttccagcagtctcttccaggactgctgattcagcatggcaaacttccccaaagcatccaaggccacagtgccaagtggcaagcatccctgtgcccccaaagataccatacaacacaatatatacccagcttcaatatggcaagactgggctctgcttcacgggaagctcaaagcctcatcacaggaaactcatacattgctactgacagtataagattatacaacccctatggagggccatagaacaaaactgcctacattttcaccttttgactcagcaatttcacattagaaacttaccctgaagatacatgtcctagatatccatgcaatgaatatcatggatattaattatcagtaaaaaataatacactctacggtgcttaggggtgaggtgtcacaatgtcagtaacgaactctcaaatgaatcagaaaaaaaaatggatggatagttgaactgaatgaatatagatggatggatagagagcaaaggatgaatggacagaaatgaataatgacagagataaatgattgattgactgatagcacatgcaacgtgaaataaataaagcaaacatggtaaaattctgaaaactcatgaatccagatgatagaaagataagtattcacttccctattcttgcactttaggtttgaaattttaaaaaataaaatgctgaggaaaattaaaccaaattactttgttcttaaaagactgagggaccatgggccaaggacctcatgaaactataggataaacttacggcatttcccaaaattgaagtgaggctaaactggatattactgagcaggaagcaaaatagccatgaagttttaaaataaaactgcatcaaccagtcacttgaagccacttgaagcttgaaccctagagcttacatttattttccttaaatattagagagtatttagggaaaaatttgaagaagccatcttcatttccacaccttttaagctatctaactccttgcatgagatttcctctctttgaacctgatttctcctttgagagaaatggcattaacacttatcacacactactattgtgagaattaagtaaaattaagaggtatgtaaacatgagggatgcatggcaaatgcatcacgagtgtctcttctcttcaatttctttctaccaatagtgtacctaagagaccagctaaaggtcattggcaaacctaaaacgatgtcccattccccgagatattcattcgtgcattattcatttacttagcaaatatttagcaaggacctaattttatgccagactctacagtgatgaacaaaacaggcaaaaatccctgccctcctggatgttggaatttaatcccctgctctttcctccaccactccctgtctcttacttgactagttgagcaccgttttgggtgttcctgagaacaggcctctgtttctcctcttcccccatgagataaggcagcagctgagaccacagaagtaaatgattgctttgagtttgtgtgaaaacaaggccacactgccccacttgaatcctgcccatggcaggatcagggctagccaatagcaggctgtcagcacagctaaagcagtccttcctgaatgtctgctttgagacaatgagactcttttaagccaaggcaccagtagctaatttgagtgtttttcaaacaaactttgttgaaattataaagcagcacttcagaacagttgccctgggaaaaatgggagtgcagtttacacagtgttcatacacacagagccagggtgtgcctcaagttaaatgaacccatctggggagcagatcggccctgatcataatgagcaaatcagcccatgataaaaatagctgcactcacatgcacttataataaagtagatctcaaggatctcaaagcacattataaacagataggtaagtagtgagccaacagaagaatccctttatgttcagtccaacattctatatggttctgtagctaagaagaaaggttatgtttttctctgtgtgacacaatggatccagctggaatagctcctatggagaacatagaaaatcttgtactcattataaaatcacaattatcataataatattaacttggtaccaaagtaattgctgtttttgccattacttttaatggcattaacactattactaacctaataacagatttctgcattaaaaccatacttgtactttcattgtctcttttgagcctcacaacggccctttaagataagcagaataggtatcatatctaattgaacagagaaagaaactgaagttcagagagggtaagtgcctcatataaagatgcacagctttttagaaagaagtagcataaaagagacatgaacagtttttatgctaacactggcacttttttgctctctttgctatcttcaaaaacgatcttctttctctgttggttacagagtctgaatcctcagaacctcaaagtggcataggctggcatccaagcctgttgtagaattctttttaatgatttccatttttttaccataaagagcaatgctttggttttgagggtgttactatagaactgtccataaacttgatcttttggttgatttatgacattgtggagctggagaatgttcatttcttaatttaaaaggcgtgaaggatcctgaagaagagagattcaaagtgggacaactgtgattccaaaaatcaagcccttgtccgtgggagaaggaaagatcaacgtgcttcttcagtctgtgatgaatgctttgatgttctttctcccactgcttttattgaactaatacatgtttgtctctttttcttgcccattaactgactgtattcccacttcctttaggaacactgaattattcagttcagagttcagtgcctggcgattgcatgtgctcactgaacattgctgaggttgagtaatatgctgactcggagataaataaatgatatcagtagctaatatttacttcggggacatctaggtattatcttaagcacgatacatgaattaagatatttaatctctacaatggaaagtctattaggcattagtataattagcttcctctctattttagaaatgtgaaactgaggcacaggaagattaaggcacttgtcccagttcacagcactagaagaagcgatcctggattttgaatcctggaaatctagctctctacaaagaaaccacatgcttaggaatggagggagttgggcagtgtgttttctttatttgttttgtttcatttcagcagctcctcatacagagaaaagaaagttttgttcatctcacatctccagattatctagtgtagccatcagaaaataataagttcttgtgaaaacttcaataaattacatgaagacaagatggtttttggcagcaggaaaaacttatataatacctctgaccagtttcaggctgagaaatagggatactgggattttgaaggtcaaactgctttggccaagggatactgccttgagtatcttaagtaattgaatacacatatttgagtcacagtaatccctattctgctgccctgttgagagacgatgtgaaaatggcccagttgtcttaaagatggtgaaaagtcctagaggcacaatgctggcccatggaagccactccatatgggtttggtggatggattcataaatgaatgaatgaatcattcaccttcaaccagcaaaagatgcctgcttttcaaatagttcagtgtgggattcacacctcagaatcttatccttaaaagaactttggtttaaacacttctttttgtaattgttgtaatcttcagcattacatctgaggcaaggaatttaccaaattttccaccaggaagcattaaaatatgagggagccaggggaagggggtggggagtggttactgagaaggggtcagttctctgtgatgctaggacatttgtttctgactttgggaaaaaattgaacatagctaacatatccccatattccgactgcatccaatctgaaaaggaacattttaaagttgccaagcatacagagggcttttgctaggaaagctctcattacaaatactttctgagtcttccaaacagtttgcacgcaaatacctgagactgcgtaacttacaatgaacagaaatatattggctcgcagttctggaggctgaaaaatccaatatcacagtgccagcatctggtgagagacttcttcccatgtcattacagggcagaaggcaataggatgacagagagggcttgaggggactgaacttgcccttttataaagggaccaatcccacccatgagatggagccctcatagcctaatcacctcttaaaggtcccacctctaaatactgttactatggcaattaaatttcaacatgaatcttggagggggcaaacattcaaaccgtatcatcatgatatggcaaaatgacattctcttaaatttacttaaagtgccaggcaactcctctggacaagcccctgacctgccctcaccaaacttccaaccagattcttgccccaaaacctcacttataccggaactctggagctgtcaggaatttacgcctaggacctacaaatactcggtgtgcatatgttggatttataaaattcccattcagaaatcatagacagtgcaggggatttctgttaataccacagcacctaagttaatttaatgtaatgctgaaatttgtgctcattctttccttttgcagatgggaaactaaagcctaaataagaaatttgcctgatcttccacagataataatggggaagccaaaatatgatctgagcttcaaaatcagtttctttctttgattctctatttttattaaagaaactgccttttacattataaaagtaaaatactaatttgtagaaaactgagaaagtatcacaaaaaataaagaaaataatattgaataatgttttaatgcaaagagaaataatgccaatattttggcatatttccttccaatcatatactatctagtaaatacaatttattgactaatttttttcttttttatatggcaagcaggagtccatgccattaaaaacttcctgtttagtatctatataatattcagtaatacatactttgtactttattttaatatctatgtaatattgagtatatacagactttattacatagtaacacagtctttattgctaaatatttagatcattattctgatcttaacaattataaataatattgaaataaatctccttctacataaatcttgaactgaaagactgataattaagttagtacagattcccaaatgtgagaatatattttttctattttatgtagcctctttccttaaaactaagacccttcccccctccaccaccctgaaattatttctcctgctttgtttataaaccacagagctgttattacaaatgtctagatcaaggtatgggaaacagagtgaaagagctggagatttggaatcagaaaatctagatcaatgcaccagttcacttttcactcacaagatgatcctggaatgttacctgagaggctttctgtccgtgttttctcacctggaaaatggggcactaatagcacctccctcaaaagattgaactgaggcttaaatcagatcaaacatgtgacaacagctttgtaaaccatcatgtggtctcgcaaacatcagttgtgattacctttacgtgtgctgacagatttaaacagctttcaaagggaaatcacaagagagaaaaaccagtttatgttgatgtgcttttttggtaaaataaagcccaaacctttctttattttatttttttatttgtaatgtttttgggtacatagtaggtgtctatatttatggggtacatgagatgttttcatacaggcatgcaatatgaaataagcacgtcacggagaatagggtatctacccttgcaagcatttatcctttgagttacaatctagttatcctctttaagttattttaaaacgtacaattaagtcattattgactacagtcaccctgttgtgctatcaaatagtaggtcttaatcattgtttctatttttttgtacctattaaccatcccacctcactcccccaaacccccactacccttcccaccctctggtaaccagccttctataatctatgtccatgagttcaattgttttggttttcagatcccacaaataagtgagaacatgtgatgtttccctttctgttcctggcttatttaacttattgtaatccaaacctttcttttaaaaaagtttaaaagaattaaaaggtcctcgggataaataatagctgtccaaagaacatttcccaagtccaagttgtgtcatcctggagattttgaaagcttttgctcatatgttggattagtacatctaaaagtctctgatcacaggcaagtcagagacctaatgaacccaacacgccttgaggctgtgcaagagaatcaccaggaccacagcttagtccctcctctctcagggagggccacaacatgaggccagagtgtgattggcctaggctctttactaaggagcatttaatgatgaaggaggatgcttccacgagactagagaacagagagaggagaggtgaagagcgaaagaaggaaggaaggtggcctagccttcatcaaggcacaaaagattcaggacaggcaaagaagtgagaagctgggaaggtgctcactatgaggtttgtgaagagacaactaggctcagaagttttcagtgtaggtatcatactgcaatggaatgaaaagggagaaaggcagtcattttatggttcaatcagaggcgaggattagaaatttcaagcattaatccagaaatcctagggattcgatgacaatgaaatttgaagaaaagtgtggggacaatgggagcattgtaggaaggaatcagtcatacccgggtgagaagcatcagccaaaaggaaaacccatagcaaatggggaagctgaggtctatgcaaagcaggaggcaaatgggaaatgcagcacgcccaggaaaagcctcagcatgtacacctggctggagatccagaggcataatcacgaggccgaccagtgactggtcatcaattgcaaggtttacaatgtctccagctgggccgacaggcatccgggtgggcaccaggtcctcaaccactgtgctggggaagatgccatggtaagaaactccaagctttccccccaaccctctccgtctttcccccagctgctgggtggctgagatcttggctctcctcccaaaagcattccacaatcactcatctcctcacaaaccaatttttcaggattcctctctagcaaaattttagtagtaaattaagcctcaaggtctagctatgagctgcacctggtttgggatgagttcagatgctgccagtgaatactatgtttgcatattctgagttttgttttgttcttggtggtttgttttgcttcgttttgaagctgagtcactgtcttataagaagaaaatgataaatgtgtgagtaaaatctgggaaaaaaaagaacatctgaacctaaatagaaatttataagactcttacaaagttgacattcaaagatgtaaataacatgtctcacagccagcaagtaatggtgccaaattttgaaatcaggtcggtttgatcctaaagccttaaatatctggattgtaaaaaataaaataaaatttctacttaatatttgataaaaatgtgtctcaaaatcttaaatgccttaaggaatctcttttaaaatattccataaagaagtcagttttctctcaattgggacttttatttcccacattgtacagacgaagaaacagaattagaggaactaaacaactaactcaagatcagaaattaatatatgacagaatagaaatttaaatgcaggcttttaaaaagtatgtggctcctgttggttttacagtttagcatataacttctttaactggttttaaagatcggattgaaaacattattttgctaagtaccagtctatacatggtactgtactaataataacaaaattcacaaatacctgcaagatttcatcttttgatgccatctgcatctcttttcctcaattcttacttttcccccaatttctcatccctcttgtctgtctaggttcctgttcttcctatcttgtttctacagtcagatgaatacctttctgagtatgccctgctacagccccaccacttctctcagatatatttcttaaacaaagttcaaactttccttggaaaataagcataagcttgtacacagtgcccagaaatcagagagcagagggtagaagaagcaagaagagcatttgtgtaagaacaacaggagacaaaaaaaaaaacaagaagaaaatgtaaaacatactacagatgcctatctatcccatcccctcatttctacaactcagagaaaatacagatgaggctttgctaacacaagtcacagaattagctcagaggatgtgttcgcaaagatgtgagccttcaaccaccttaaaaataactgatagcctcactcagtttgaggcagcccagatagatgataaagttttaatttgctaatgatttttatctcctagaagtcaggaaaagaccctgagtttgtgtccaattatagccaacaaggaggaattgattaatataatagaaaccatcagaatcttgtgggaaaatacccatgccaccttaggatttacctatgtctaggaagaaaatcataaattggtcagtaacgtatcttagactttaggaaaatagataaaaaatgtccagaggaaagattctcctagagaaaatggcttaagaaggaacagggagtgctagaacaatccacagtactccatgactcagagtacagggagcctgagctttggaataggttatgtgaacctaggaatgttattgggatgttctgagcctcagcttccccaactgcaaaatgaggctgacattacccacctgagtgatttatggcaaatagaaccaacgcatgtaaagtgcttggcattagtgccagatacttagtaaaagttcattcagtcttatctattatcagtcttatcaccagcatctttatcctcagaaatataattattatttcttgtttgttcaccactagcttagaaatcctgtgtgattgggaacagagggctatataatgaagcatcatgctttccagtgaaggagggaagatcataaagtcaggaggcgtgagatcaaatgctcaccctatagcttaagagacgtttgcaggtcgagcctctgaggggcaagtgtgagccaaagtattctcactgtgtgtcagccccaggcccatggctgcacctgcccagagaaagcacccttttcttatatacatcgtaatcttctgtaggtctccatcatcctcataaaaggtgaatgatggtatctacgtaatctatcccaaagggtcattaattcatacattcatgcagtcagttattccaaaactcttgttagggttccagcctcatgggaatgaaacaggtctgctttgcatctgggctccacatttactaggaatgtcctgaggttcttgaagcctcagctcccttatctagaaaatgaggataataataccttcaccttagcattgccgtaaaagtcagcagagatcaaatgaagtgctcactgtggtgcttggtacaaattagatactcaaaacatagcagctcttgtattttattattacttcagtcttctgagatgggtttccattttctccaaggaactttactaagaaaaataaatctataaaacaaaattggtatataagttcctgttattgcacatatgatttatctggtattttcaaacaatatggtttaaaactaatgtcactatgctaataactagagttatggccacattctttttatctgtaagagctcacctaggaaaatccagaaacaacctgtaagtacaacaaggaggattcattctatagattataattacaatacaataagctattttgcaatcattaaaattaggattataaaacatatttttcttcttagagaagggtctcactctgctgcctagggtagagtgcagtggcatgatcatagcccactacagcctccaactcttgggctcaagcgatccttcagcctcagccttccaaatagctgagaccacaggtgtatgccatcgcagccagattttttaaattttttgtagagatagggtatcactatgttgcccaggctggtttcctaatacctggcctcaaaccatcctcctgcctcagcctcccaaagtgctgagattacaggtatgaaccactgcacctgacctacaaaacactttgatgacagtaaatatatatgaacaaatagctggccacaaattttgtataaaacaacagtatgttctgagctccacgagaaacataattgcaatcttatgatgcattcagagaggcagcataatcagaacaaagaaagcagttttattatcttgtgtgctgtttagcacactccttatttctggacacaacactctaatagagagactaagaaactgaagttctttctcatgagagtcagagtccaacatgatgggaaagaatgacaaaatcttataggaaatatggcaggatccatttcagctctttggaggactggtatgtggaagaagaagagttgtgtgcagcaccaaaagagggcattctgaatggtttcagatgagcagagccagcagaggcaaggctggggcaggggaaagggagggtgtatacagaaatggagtataaatatgattcatggcataagcaccccaccagaatgggcatctcagcctggacacttcctttacttagcacaatattggccgaaactacatgctaactaatggtagtggttatgacagaggaattcactggctaagagaaaaggagaagacagatagaagatgaagagagagaagagatagaggaagagaaaagagaaagcagagggagagaaaggatcttgtgtgctgagctaaggagtttgcattttatccttactgcattgctgcctctcttcctactatacatgagaatgtgtccctagcacagcatccctcccaccttcatcctcacaacacaatcacctggcatttctaagctgttggtaaaagaaaagtaataatcagtgataattacatctttcctgcgtcatcaaaacttttaaaattatctgattctcgtggaaatgatagttctagttgtaaaatagatggaggagaggagagagaaagaagttcaagtgctaagagatgaaaatgggccatgaggagacagtgcctttctggaagttgagtctggcagttaagtgaaggatgaaatccaaaagagcctctcaaaatgaaggaggaccagggtggagtccagggaacatgttgaaggcccaagcaaggtgttggctacaggaatggagaagaggagctgggtgggaaggatttttagaagacagaatttctaatatttgaagagtgacttgataaactagcaggattgaggagtctaagctgacttatagatatcgggcttgggcaactgagtggtgatatctattacaaggaagcccaggagaatgcacaggtttgaaaggaagtggaaggggaggggagagttgatttcatttgggctggagctcagctgaaagcattatagaaaaaaatctcaatataaggaagagttttcaagaaacaaaagtgttcaaacaatagtatgagttgcagtgggaatataaccctctgcttatccctatgggtgaagaggaatctggtgactttctgtgatcattcccactccaaagcagctgtctcccaggacaagggcaaagatgctttctccacacaaattggcctgttcagaactcactgtccatctgaaatttgtagagacttgctctagccattgccttagggcaggtgaaatctaagaaggaaacagaagaggaattacccaaaggtgtgggagcaggagtcttcatctgtggctagatatagaagagtctcgtgagctttttttttttttttgcagtgagtacaccaaggtctatattctagttatcttgttttatggataacttgttttatggataacaacactctctatggatggtttctaaatttacgtttgttccttagtaaacttcttttgggaaatttcaacccacctcaaatgaactaagtgataatcatatataatcatggccacttattgatgtctgactccaaaatctaagctcttaacctctaggctgggtcctccataggttttagaatgactgaataaatgaatgaaggaattaatgagctcatagagaggattaggtagtgttatctacatttaggagaaattaagtaatttctgtgtgtgaaacagcctactcctctgctaccctatactatgccttagtgtgaattaggaaaggcacactctctgggtgattgcagccctataggcacaaggtttggcaaatggagtgtccactggaagtcaggccacacttgccatcttggccgagtgcctttgtacaggtcacagcctgtatacaacatttaagttgtaaaaacagaattttatctcacaccctctgactttatatacttttctcttccactagggatcatactgcttttacaggaaagcacatgactccatctcccaccaaataacagcaaaaaaattagcagtttatccaaggtatttgtgaaagcaaagcagtaatcacatcttctccatgctgttactattttggaaataatcagttacgagatgagctacggtataaatttatgaataatttaaatagtaaagatgatgattgagaaggaagccaaaagactaacagatgaaaatgtgagatgctgaagtcacaaaaagatcagaaaatagagatgccgtggataggaagagacagcagcgcttaacacctgtatacttagagtgccacactttgattatcctaatactttgttatagaaatgctatatctgttcattcattcaccctttcccttatttgtcaggtgtctattgatcacatgctatactttaggcacagtgattgacattaggtatacattaaccaataatagtacatggtcccagtctttaaaaaactcacaaaccactaaaaaaaagggtgattacacagattcattatagtataagtatagtatagtatagtatagtatagtatagtatagtatagtatagtatagtatagtatagcatagcatagcatagcatagcatagcatagcatagcatagcatagcatagcatagcatagcatagtataaatttgaaaagctctaggaacaaagtgtcgtgtgaacccaggagcaatcatgaatcattttcctgagtgattgggggaagcagtatttaacctgggccttgaagggtgagaggagcttttaaagagagaaaatgaaggaggtagtcaaggccaagagagcagtaagtgtaaagcctcagaaatacagaaggccacggaatgcatactgaatggggaggctccagtagagaagatgaggcatgaagggtatagagaaggtgagtctagggaggcaggttggagacagaagcaaatgttttacatgactcaaccctatggtggggacacgccattaccatctgccaagcagatacatactgatttagcatcatccccaatctgtcatcactcctttcttgggaggactttaagaacacaatctatatgtgttaaggctggaatggacctttagggctttaaggctttagaattgcataaccttgaattcaaaccctggctctgctattgagtgtggcatttggggcaagatacatctcccctctgaaacttagtgtcttgatctgtacaatgaaagtgacagaacctcacagaactaaaatggtgactatgagttggcccatagaataccttgtacacaggacacacttcataaacactgacactaccccttctactcttcattttatcccctctccgtctttcagcagaaacacatttggcccaagaatgttggtaacaggacttgcattattgcagtcttttcacgaagagaatttcacaacttagtatctagattctgtttgaagattctttcaaatagaatattctacctaaactccttccttgtgctgccccaatgatgcaggaaagagttccacagagcaggccagtgtctactgttctgaaaatctctgcggcatccccgtatgtgttgttacagttttaacctacgaaccttcctggggatttgaagaaacaatgaacccagaagaatattattgtcagtacactgttccaggactctagatagctgctcagagtacagcgaaattgcaattgattacattctatactttgatcttgatccatcaggatgtcttccaacctaatctgctctgaaacaacaagcagcacatgatttttcagtacgggtcacaatgagatattttaatcaccctcttcatcactgaatcactcttcctggttaggggacctaaactttagtatcataaatgtgaaaaatttaaacacctttgaaattatttagtccagcatttcccaagggactcagggggcatgtagagaagcagaatggacactggtggcattttctgtacaaaagaagcaatggcacttcactgcctggactgattctaacagataaaggcccattttacgtcattgcatctggagacccataggtgaaatgagtctaaagagttgatattgtatccttctaattaaccttgttcattataaaaataccttcttacttctataagtaagcattattataatactacaataataagtaggctcatatgtaattcttggatatatctaaagttgatttactatttgaagatgtagcactcattatattcattaatataattcagagctcactccacgttaggcattgaggtaaagggaggaaatctctgaatattgaagagaaggtaggtagtgggttcttatcagtggaggtatacacatatgaaatatatctgatgtgtttaaaacatagtaaatgccacttggcattattattaatttacttaaccctcataataacttcatgaattgagcgggtattatcatcacccccatttaggaaaaataatatagaagcgtcacaggcaattcaagagacttgcctacaattacttagctagtaagtagcaatgctagaatttgcatgtaggaaagctggctccagcgtccactttcgtaatcagtataacgcaacaccaccactgcagagtaatttgtatggcttccatatatacagtttacaactttggtaatatttcttcatttttaattactcccttccccaaaccataatagcaacaagtctagcatctccctcttggaaaatctttcttctttccagaaacaatttaaatccctggaagagaagactctctttcttccaaacataaacaggatataggaaccatcactgcttctcatagccatacggaattgctacttaacatgcacctgaggtggaaaaatatagtttgtcacctctattctgtttctggctgtcaccaagtctctgcacaggccaccacagcatttttttaatagagagtgaggagcctccttcagtgacaagcttagccaaaggtgtactattttagaccacccagggctctagggctgtgctcttataatctctcatgcctttgccttaaggaatcatcaactttaacctgtccttctctagaattaactaattcaaggggccttattcccctgggctttggccaagaaaccagagagagccctcaatggaagatataatttgcatagccaaacttggttgccgcactgtctcagatagtgtgagcaactttcacattaagactgatgctggacttttataaagatttatcccaacccataaactcaattatttcttctggtgataaataaaatagtgatctcatcaatgctccaggatcccctgactgtgttggtcatacctagagaagcagtacacgtagtaggtgggtctccagcaggaaactttcacagagatggttttcagggataattttgatcaatcaactggaaacattaacttggagttacaagaaaatcctctgcaatgaggtctgtgctgattcccagactgagcacaggacaagataagaaaaggaacggatctgtggataagcatgtctcttcaaagcctctgacaggtatctctgatttacaggatgtcttcagggccatgcatccagagcttgacattgtgcagttgtacctgaagccactgctcattggagaacttgccccaggagagcccagccaggaaagacacaaaaatgtaagtgagatgtcaggatccaggggtgtagaaggatggagacgaggcatattttaaagccaattaactgttttctgtgaagggtgggaccacagtagagtcaatggatggagtccacgtatttcaaaacaatgcctttttctttagatcatgggaactcttaaatcttagtgaagaaaaagaataaaattcttatcccttcatcaaacagtaatttcatgtctctaagcacctacctcatgccagggaacttacggatataatttccttttcattgactgcttttaattatgttttatatctatgtctatgttcccagcccaaatatgttgcatgagaggcgagactatgtccacttttcttatccctgtgtcctgaagacctcctttcacaggatcaacatgtagtaggaactccaaaaacagctactgattgaaagatgtcaccgtatcctaactacagcctttttacatttggggaaattatcattcagggaaaacaaattactctctaaaagtctgacagctggtgtatcaaagagctgagactccaaatcacttctctctggctccaatcccttaggtattcccaaggaaaaatgccattctttctttaatattttggctacatgaatactgtcttctaaaggacagagtctccataggactaaaaattcactgggatggttttacataacgccgagaggaattttacttaatattgagtaatttcatttttcaaaatttattttttgtaacagcttacatttgcctgactcttgaaataatttttataacgtgtggatccatagacccctgtgaagcagagggagcaaggattttattctctcttaaaaaaatgaagaaacagactcacaaagggagcaggactaatctgaggacacagaactggttatgggcaaatctgagactaataggtaagctccatctttaggcccatgttcatcccacagcacagctctgttccaaagagtgggatggtaggatggacagcctgcactctcaccccaaccttgccattctcaaattgtgtgagtctaggccagttcccaaacctcttttggctcagtttctcccccataagatactgaaaacaatggtaccaaccttatgagagttattgggaaaacaattgaaagaagtaaagtcatcatttaaagtgcttagaacaatgcctggaacacagtaaatgctcaatacattttacttattatcataatcacgaactgatgatggtactagtaattttaaaactttcagatatgtccccatcatttgggtcaggtagctctaggttaaaaagtgaaggtgatgcaaaattttattgtttttcctaaatttttcctgtaagaaaaataaaatcccactaacgactgagacctatcagataatcattatctaaaagagtgttggtctctggagataaaggtctaccataaattttctttaatacatttatatggatattcaagttgctgtatatagaaaattagtatttgagcataaaattggatgtcaggtgtgggtttgagttcaccacctgtcactgacttgttgacaacttcaagccagtcactcttctgggttttgctgacctccctcaactctgcaataaatgttttgcaaaagatgaccaggctggaggcaccctagagatagcaaattaatattagataattattaaaataacctgtggccacaagaattctaagattgatggggtttgggagatgagcctatccagaacttttgccaggcaatgggtcctttaaaagttgtatctgtgaattttgaaatttttggcttctggaattattttcatagctctttcttttttttgtttctaacatttctcctttcttacatctgtacaaccctgttatagttctcataacctggtcactttcccagctgtcctagtttcaaacccataatagtcaataagccaagagatatttctttccaaccttgtgagctccccagtatgatgtggcaagcttgtaaaccaatgctaatgctgaacatgaacactcacacatgcacatacacacagggcccttaaacgagacctttccaactgagtacacacacgctaataagccctgccttgttttgggggatccactaagcagctctcagaaaattcatcctgagagctaatctaagtgaactatattgttctacaatctccatcttccatgaaataaccctttctacacattaagcaactgatggcctggaaagcactttgtaaactataccagtaactggtaacacagatccatatagatgaccaagttcccccaaacaaaaccagagctcactcaacacctgaaataattctggtggtttacaaggcaacagttaggcacatgtatctctccactgccctctcctctccttccccatcccctgaaaaaaatctaattctgaattccataacagctttaggacagtttacaagtcactattcatctttcacttctgcagaaaacaacaaaaaaatttcataaactttttaaaggttttatttgctggttcattgttttggggttttaattctggacaattaaatgtattaataaaattctattaataaaagagatgtatacaaaattaataaaataaattattaattatgttcatctgtattccctttcccctgaaagagctaatttactctttgaatatttatttcatagtcccagttggtaaaagatttccaagaattgtggagcatcgcagaggctatgaacatgttccatgccaacctggggttcttctttcttcactttgtgcagatcttaattttggaagtgctggcgtggctaatagtgtatcattttggcagtggctggcctgttactatgttcatttcctttcttctcacaatttctcaggcaagcaggtatactaagcccaggcagcgtcctcatagaaaggctcagaatttcttcttctctctttagattggtgtcagctgctgcctgacacttcttggcaaggtactcatcaatgtcaggcacttaccagcaagtgaccaagcttcattgggctttggttctctcctctctaaagtgaggataataatgaatgtggaattattctgagaaggactaatcaggcaaatgtgtaaaatataaagcacagtgtctggcctatggcaaatgtttaattagtgacaattgctgctgtttgccctgttttatgcccaccatctcagtgattgaagttctgtccttagccatgccacacacatatttatctttcattctttaatcaatcaacatttatcaatgcatcagaccatgaattcttcaagggcagatgtgatatcctatgtgagaatcagaacgtgtgagttcctccataaatgacaaatagcaactgacacttagcagggcatttgataaatctttgttgaatgaagtatgaatctctgaacatagccttctatgagcgtgataccatgttgtcgatacaaaggaaaagtcaacatgctccctgctcctgagaaagaagtcgtgtagtggaggaaatagtccttcacaaacagcttaacacactgcctggcacaaatcaatgatattaatcccaagaagaggaacaagcattactgtcggagcagaaaggagcatttaattctcattagaatcattggaaaaggttttgtagagaattaactgcaatgtgtttcgaggttccagaattctggatgctgattctttttcttaaatcctcttgtttaatttcttgaaaagtgacttttggaagcaagaaaggaaacaaatatttgtttagtgcttagcatacgctgggcactttacatataggtatgtagtacaataaccccgtgagttaggtattagtgtccccttctatcagatgaagaactgaaggtgagagctatcgagtaacttgcccagagtcgtgaagctcgttagtggtgaagaacagtttagaattcaaatctgtctgacaccaaagaccatggtctttgcactccatactggaaacctttgaaagtgacaaggagagcattccaggctgatacaacaaaggcataaatgttggaaagaacaggcaggatatgtatgggaaatagaaactaattttggctggaggtcgaacaagatcacccacttttcccaaataaggttgtgaatctactatgggacttgttgattgatttcttgttagggtcccaatttctctaacagtaacttcctctctcctaggctcagagctcatttttgcagcatgacgcggggcacctttccatatttaggaagtccaagtggaaccacgtggtgcataaatttgtgatgtgccatctcaaggtatgggacgtcagggagcatgagggggattcctgaacatgagtccctaaggagtggttcccatatttgtacattgatatcagtaaaaaatatttatgataccccacaaataaatataagtgtactaacaaggtagataatatgtactaatatataatacaacactataaaatatgtgctgaaatgagaattttaaattaaattttttgtgaggatttatttagttctatttaagaagctcttatattttgtattaccctggtagactctttggctaaatccctggcacccccctgccctaagggaccacctcacagaagaaagtgtgtgccttgaaaaatgaagatgtgcattgtgaaatcataagtgggaatattcttagaagggattttgggcaaggaggaggcagctatgaagaaataaaggaaaagatgcaaaacagatactagtgaacagaaagactagtcaggaaaagccagatggctctgttcaagagtgcaggattgcaaaatccagactgctggaaaaagcaggtagtgatatgacagctggtcttatcccctcttacttgggctccaggaagcaggtacactgtcctatgcaccactgcagtgcagcacctaggagagtgcttggtgcatggcggcgggggggagccttcaataagcttttgttgaaggaaggaatgaaagaaagaaagaaagaaagagtgaatgaatgaaccagttaacagtgcaggacttccaagcatggcttccaggcctggctctgacagtgctcattgtgagatctttagtaaatcacattctatccctggtcctcagtgttcccatcagtagtactaggagttaaactagatctctacttttctagaactttctagggtttggtgactatgtactctggcctagaagggaagcaaatgtctctgagccttccactaaaccaaatccttgcattcaaaccgggatcccttaggaaaaacctatgggcactgactcagagcctattagttcttccctaacacagtgattttatacatatatctcattctggttatctgcttccccagcccgtagtggcttggaagtagccaactaataaaagcatgaagacaatgctggagccaggcccacagagagtagtgagcagtaactacttacagcaaacaataaggaaacacagatggggactcacattgtgtgagcctgacaagtgccaggttcggaatttgccccgttaggctattttctcaagtaattctaatgatgtgaggatatagcactcctagttttcagttgaaattcatgttcagaggggttaagcatttaagccaatggacataaactggtcagtggagaattcatagcatagcactaaataatgcaggcactagagcagagctgctcaatgctggctatcatttgaagccacctaaagaagttattttttaaagtcctaatgcctaagtaccatctctagatattctaaattcatccccagtagagtctagacatcagtatttttggaaagttccccaggtgattctaacctacaaaaatgaacctgccttctgtgagaattcaggcactcatgagctgagtcactttgaacaaattacttaatgattttgaaccacagtttcttcaactgtaaaatgatgatagatgatggcttcaacctgataaggatgttgttaggattatacgcaatactcatgtgtcatgctcaacaaagtgtctggcatacaggaaatgcttaataattgttaattgttattaatactagaaacagtctttccataatcaaaatgaagactcagaatcaataagaaaaatatttaatcgttgaagtattaagaagatggaaataaatcacatcatcactaagttgcaaggtacctggaatcatctacttttatctaccctctctcccattgagcagtttgagccttaagtcaatcagataacacagagttggattttgattcatattggagatgtgtcccccaaaatagttagaatgaataataagttgttatttcatgtgataggtcacatttgaccagaaaattcctgtgggcattctattccaccctctcttcaccagtgtaagatagattagtctgtttctggattcactcagagatacttagcacagaataaaagcagaggcagtttcttctgctattgtgagtttcaggtaatagaccatcccatttttcctcctctgttctgaggagtcagaggaaaggtaagactcatctgccctggaggtagctggcagttgattcagtgccagtatgtgaaatatttcagatcagccccacccatgctggcactttaaaaaaaaaatcactgctttcccattgatcctgatttgtacacagctatttctatgtaagttgtgtctccagaaacaattttgcactagtcgaaatgaatataaccttgatgacttgtgaactgagtaagaacatgggcaatggctctaaaagcaaatcaagtgtactctgcctttttttgcagacaaaaacagtgactcatgagcaaaatgaacattggcttcaactatgtgcaggagagaaaactacctgtggaaagggaaggtgggcggggaggatgtgacaaagaaaattacaatataaacagcaacatccccgccttagacatgcatcacaattttaaagtttaaaatttaacttcatgtcaattacctccccccaccaccgcctggaaaagacaccaatatggagattctttagaattttcattcaccaactgtgcaaaaatgtatatgttctggtctttccagtgtttgtacaataaaagagcacttcccaaaataaaccatgaaatgtttgcatacattttggactactgtgcaatactaaaaacaaagtggactccttgtagcatatttttcatattcatcagtatgtgcatataaaaaaactaagagtcaagtctcattatagggatagtgggacagaacatttgaaattaagatcttcctagaaaatctggcctatactgattccatgatgacatcctaaaacattttattttggtaaggaaaaggaaagtgtcaagcatgttattttctgcaatcctctaagaagcctcatccattttacagatgaggaaattgctcaaggtcacatacctaaatagatggccaagcagggattaaattcaggttggtttcattccaaagcctgggttcattcttttttttttttaataccctaagttctagggtacatgtgcacaatgtgcatgtttgaaacatagatatacatgtgccatgatggtttgctgcaaccatcaactcatcatttacattaggtatttctcctaatgctattcctcccccagccccgcaccccccaacaggccccaatgtgtgatgttccccgccctttctctaccgcactgagaatagacctaatgtggaaatgaggaatgacagggttgttcctgcctagaatttggcgaaggggcagcctatttggcatgccgctgataatcctctcttgcctgtggagtactttctttcccttgtctctggatatagtggcttccagaaagaagggccaagggaagacatttatttggatcacacccataattactctgaccattattctaagctttacctgttaagatctgcttcccgtcatatcatggatccaaaccggactcccacattactactcaccacagataatcattggctaaaagagtacagtcagctggcggaagaatccaaacattggttctcaggtgacttaattgaaaaggagattctctccttatcatattgtccttgttcagttgtctactgctcccattagattatatgtttcctaagtgtggaaaccccattttatcatgtttatctttatgttccaaatgcctagctcagtaagtatctgacacctaggacataattcaaaataaataatgaatgtgtgaataaatacacaattgtaagattaagtaggtcatatgcaatttaaaaaatcttttatcattttattttatttttatttataatcgacacatagtaattgtatgtatttatgagctacactatgatgtttcaatacatatgtacgttgtgtaatgatcaagtcaaggttattaggatcttcatcactttaaacatttatcgtttctttgttgtaacattcaatatcctctcttctagctatcttgaaatatataatacctgattgttagctacagtcaccctactgcagtggtcctcaatctttctggcaccagggactggtttcatggaagacaattttcccatggaccagtgggtggggtgtggtttcaggagattcaagcacattacatttattgtgcactttatttctattattattacactgtaataatgaaataattatacaatttacaataatgtagaatcagtgggagctctgagcttgttttcctgcaactactgggtcccatctggggtgatgggagacagtgacagatcatcaggcattagattctcataaggagcatgtaacctagatccctcacatgtgcagtttacaataggatttgtgctcctatgagaatctaatgctgcagctgatctcacaggaggcagagctcaggctgtaatgagaatgatggggagtagctgtaaacatagatgaagcttcccttgctcgcctgccactcaccttctgctatgcagcccagttcctaacagaccacagactggcactgattcgtggcccgggggctggggacccttgccctatgtgtaatagaacaccaaactcatttttccggtctagctgtaactttgtacccatcatatgcaatttgatggaagaaacacagagcactgatggggcccttgaaggggggacagaaattgttaagtatagtttgtgacatgtagaggcttgagtatcatgaaatatccaaatacacacacacacacacacacacacacacacatacacatatatatatcacatatatatcacatatatatcatatatatcacatatatatcatatatatatgatatttcatgatactcaagctcaatgtgtcacaaactacacttaacaatttctgtccccccattctgggtggggggtagagagagagagagagatctaaatatatatatatttggaaagtccccattcaggcataagattcaggatagagagtcaggctggaggattgcaaggttagggagtgttaactggggatgcgatgggggttgctaagaaacaactgcaaagaagactatggaaagacaatgctaatgcttacaggttttcaaataaagagccatccccttctactatagatgtatgatatccagaccagcattctccaacagaaatataatgcaccatattaaaatgacatatgcattttaaatttttcaatagtcatatttaaaaggtaagtttattactccatatatattcaaaacagtattatttcaacatgtaatcaatgtaaaagttattgatgaaatattttacattccttttttcatactgaatcttcaaaatccagtaggtattttatacttacagcttgtctttattcggtcgcttttcaagtgctcaatagccacatgtgttaatggctattgcattggacagagcagactagaacatgtatagactgctcgctaagctatgtgaaatatgcaataaaaactactactgctgctcattcttctgtaaatgattaacataaaggaggaaaaactgaatatgccaacattttacatacgtcatctcataactccccagaccacccacggaggtaaatgtccttatgttatttaccggagatagaactgagcctcaaagaggttgggtgatttgccgaaacgatgcagcagtatttatacatccagcataggtaactaggttgatatgcctccaaattctttgctctattaaaatttcagactttctatgattaaaaaagaaaaaaaaacacaaaaacctaatcagaggtgactcaagattggcatgtgctaaaatctttttattctcatttatttttgtatgacagcattgaagccgggacatgcaaggatctgagccaagacccccagggagatcacttcagatccatgattctttgaaacactcattgaagtaagatacctggggccgcatctttttccccagaactaattaaagtctcggagctaagtcttctttatatgtaaaatagaaaaaatactctctgccccagctaccttcagatttattttaatgaagatcagataagacaaggatgggaaaacatttcttttcaaccagcttttacgattttccttaccaagacttttagcctaaagttgtgtttctggatcagagaattatttctttgtaagctatgagcgcctctgtccgatgagtcatgctgtggctcagcagtggaggcaagctagagaaactcaaatatcttattttgactttggggatgcatgcagaaaactctgacagtgaagggtatttcaggaaagaattatttcaaataacgagcccgctcttctcctcagggcctgtcagcagaccggtggaattactggcactttgaacaacacgtaaagccgaacatctaccccaaagacccagatattgacacggacccactttttctccttggagattcacaacctgtcaaggtacacttagaaatcttgagcaccgaggaaatgttcctggaagtggttcgtggaaaggcttacagccttgccttggaaagatcaagctggaaattctggcttcacacacaatctgagaacatctctccttcttttaggttcaaaatacagatttgaaataactgaatctggggctgtaagaatacaaggcgatttagagccgtaaccattaagtctatgaccttacagatcatccagtccaacctcccacggcaggaaatatggaaatccacattactctgagcaatcccagtgacagatgggtccctgcccagtgcctgtcatttcctctgaggcaatacaagccaatgttagatcgtggaaccagatgactgaagttgcaatgactgtctgaggtttaaacagggcatggagaaacattcactgagagaatataggtcaatatattcaataagcactaggtcacatacgttcacatagctagttatctcaactaattctagcccagttagaaaagactatgctgttatatttagttcatgttcattttggtgcatttacacatgaactacagcccaaatgccatggaagagatctacaggtctcacctctaatttgagcttcttaaacaacagaaaaaaggagggggaaaaccatcttcagaatttctcagttaattattactttttaaaactccaacttatttctgagggctctgttctgttccattgatctatatctctgttttggtaccagtaccatgctgttttggttactgtagccttgtagtatagtttgaagtcaggtagtgtgatgcctccagctttgttcttttggcttagaattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttatttctttgagcagtggtttgtagttctccttgaagaggtccttcacatcccttgtaagttggattcctaggtattttattatctttgaagcaattgtgaatgggagttcactcatgatttggctctctgtttgtctgttgttggtgtataagaatgcttgtgatttttgcacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctgtgcagaacttccaacactatgttgaataggagtggtgacagagggcatccctgtcttgtgccagttttcaaagggaatgcttccagtttttgcccattcagtatgatattggctgtgggtttgtcatagatagctcttatcattttgaaatacgtcccatcaatacctaatttattgagagtttttagcatgaagggttgttgaattttgtcaaaggctttttctgcatctattgagataatcatgagccctcagaaataacaccgcatacctacaactatctgatctttgacaaacctgagaaaaacaagcaatggggaaaggattccctatttaataaatggtgcagggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaaataaagagcttctgcacagcaaaagaaactaccatcagagtgaacaggcaacctacaaaatgggagaaaattttcgcaacctactcatctgacaaagggctaatatccagaatctgcaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagataccatctcacaccagttagaatggcaatcattaaaaagtcgggaaacaacaggtgctggagaggatgtggagaaataggaacacttttacactgttggtgggactgtaaactagttcaaccattgtggaagtcggtgtggcgattcctcagggatctagaactagaaataccatttgacccagccatcccattactgggtatatacccaaaggaatataaatcatgctgctataaagacacatgcacacgtacgtttattgcagcactattcacaacagcaaagacttggaaccaacccaaatgtccaacaatgatagactggattaagaaaatgtggcacatatacaccatggaatactatgcagccataaaaaatgatgagttcacgtcctttgtaggcacatggatgaaattggaaatcatcattctcagtaaactatcgcaagaacaaaaaaccaaacaccacatattctcactcacaggtgggaattgaacaatgagatcacatggacacaggaaggggaatatcacactctggggactgtggtggggtggggggagggatagcattgggagatatacctaatgctagatgacgagttagtgggtgcagcgcaccagcacggcacatgtatacatatgtaactaacctgcacaatgtgcacatgtaccctaaaacttaaagtataaaaaaaaaaataaaaaaaaaaactccaacttaaaaccatcatgtaaaggacaatgtcaattaccgagatttttaggagggagtatttcttaagcataggagatataaggataaccaaagaaaagtgcctcccctcaaatgaagtacctgagagtcaggtacttgggaagagtttgctatctcctagaaaaactaggagttttataaaaataaaacgatatagccttctcagttgttgcctgtctggtacattaaccaaaaattgtgcaactttttgaaagtagtttttttcatctttgggagactcacccttttccctagctgaaatagaaaacaaggtctcttgctttgaaaaaattcttggtgctgtgatcacaaatcagttgcttttgacaatgattccacaaacacattggacttccctgatgtttgtgggtttctatgatcatcattagaattctgaagtattgatttctccaattgtcccctcatatctccccttccccctagagagcaagggagtttgtctcagggaagttcatgaagcagcttgagttcagacatgccttctatagagctattttcagcacacatgctacctcttcacaaacaatagaggctacctctccaagttctgaagctgctcctgggacatccctaaaaccttagagttctatataacataatttcaaagccactgcagaagacattacttacaattatttatttaaactctaaaattcagtagtttcacatcaaaaacatttctaatcagccctgggcttttcctttcttccttctttactgtctgcctttctaatactttattcaaatgttaagtttcttcagcaagcatttatattcttctatgtcctgtgcttatatcctggaagaccgaatcctcctttaaggtgatactcaaaatctgtccattactgtttgtccactcccacgcatttccaactagtccctttaccatgtttcctgttcctaaaatatttaaaggtttaggaataactgcaaatagctattattactttatcactatgatttttttgtaatttttgacaataagagaaggaaggaccaactatacaatccaaatacaagaagaaatctatacataggaggaaagatatcaaaggaaaggagaaagcaagagtcaaacactgcccagagttgtaactgaagggcaaaaatacagagtgagtatgaattatcattcattcgttaattccttcaataaacatttattgagtgtctgccagatactagagatataatcattacttctatcctcctttcaaagcatttgctttgtgccctgaatatatgccagattaactaaggagactcctagaaaatgaatcacattttcagtagtgaatgtaatattataattatattattatactgtaattatataatgtataatagatattatatgtgctgtcatcatgtgctaaaataataaatgatagtgtgatttccatgatgagaacacaaagaagaaagatgagacagacaggagaggccacaactatatcttctatcatattaccatttagtatctttcggatgaatgaatttaaaagaaaattcttgactgtgatgaatgaatcatacatctgttggatgaatgaatgaatatggagcagaatcctaaatgccatagttgaagaagcacaagaaaaactctgaaatgtcccatttcagtgaccattccacctcacataaaaagaaaaaaattcaaaatgattcccataagaacaaaaaaatgatcacaattcctacagtcaaatggaatattccatttgtgccagaattacccacatataattgaagcaaaaagttgccacaatatttcctcccatcctggttctggttcttctagttcctcagacttgaaagccgatgaacagtgatcagatggctcttcccataaagattttagacatacacacatgcatgtgcacacacacacatacacacacacacatacacatgcatcctcgagtgtgatgaccagaagtatggtctcttattttagttttattatctctctattcagtacggcaagaagaaaatcaaatacatcaactatgaagagcagcacctgtacttctacaaaggtgagtctcccagagccacattccttgtatcccatttacttgaagcaagtacttgtcaagggagaaggccgattggaatgctctcacagagaccagcccatgtcctattgctactgagcaaagcagaatgtcttatttatactcactggggtggaaatcggcaaagggaaatggaaaagtaaacagcctttttaaagggcacctcatcattctaagagttggatggggaaggaaggagatacccaacgagggagggaaggcaggctgccagtcaaggggcctgcatctaggactgtcattctggaaagaccaaacatctatcaagagaaaagaataatggtgtttgtgtaggaaggaagtagacatggggaaataaatctgaagcatttgcagtgtgacaccggaaatggagaggccgggaaataaagggcatctgcagtgctcttgtgtggaagaaagctgtctgctcccatgacctgcatacagctgtgggaaggcatgagacatatatatctgagtgtgggcatgtgggtcaagtgtgaaggaaaataaaggtagctgagtaaatctgataccagtaaaagaacatcataagcaaagagcctttgctcttaaccaatatcaaactcatagcagctcacaaaaaaaagaaacccccaaatctgcccaactaaaacatacatctgggggttaaaccaaaatcagggaaggaaccaaacatttcctgtaatccagttgttctcaacccgagcaattttgcctcccagaggcagtctaaagacatttttttggttatcgcaacagaggaagagggaacgtattggcagtcagtggatagaagccagggatgctgctaaacattccgcgatgcaaaggacagccccttataaaaataatcatctcacccaaattgccagcagtgctggggttgagaaacaccgttgcagatgatctgatttgcccacgtgtaggccacacacctatcatgccagaggaggacagcagggggcaaattttttgaagtgtgagattgaccatcactgctggctcctccacagttggaattcagcctccccgatcctgcactctcacctgccccgcttctcttgcataacctgaaagaggaatgaggacattggtgccccatttttatttatttttatttatttattttttaattattattattatacttgaagttttagggtatatgtgcacaacgtgcaggtttgttacatatgtatacatgtgccatgtgctgcacccattaactcgtcatttagcattaggtatctctcctaatgttatccctcccccctaaccccaccccacaacagtccccggtgtgtgatgttcctcttcctgcgtccatgtgttctcattggcgccccatttttaaaaggtagccgattcccagcctaagtagatgtgtgtttgcataagaaaatgctgttggactttcttctgtgaactttcctgagaaacatgtgtttacctcccctgtctgtagtggggcaatatgcccttcccttatgagaaatgagggaatggtgtgaattcactgcaaaatgcccacctcacaaaccacactgccaccaccaagagctgttttattgtggcctttcccggcaaatgctagcttaacatctcgggtgcaaatgagtcatactcaaactgtcaaaaagaaacaaaaccagacatttgttaaaggcagcaagacaaattatattcaggcaattgcactaggggagagagacttcaccataaactgagcttaattctcctgacgcaaaagtgagagagaggcttttaaatgctggaacatactaaaggaaaagtactgaaagacactgggagatggggtagggggtggaggagttggttgataagatttgtccaggctgtctgtgtctgctaactggtacttatcaaagtttggctcctatcctcccaaatagactgacagataacagccccagccttcttgatggctagatttcaaagggattgttaccaggcccctgagaaatacatttctggagtatagaagctacatctcaaaggaagacacaaaggatttacaattgtcagtgtcctaaagtaaatgctctaagaaaaaggggtgtcaggtgcctatagtcagatactggccagaataaacagtaaattattttggcagcattgagctttctcaggtaaaaacatcaaggatgctgggattaccccagagagatggccttgagctttgagaaactatgctagtgtttgttcaagtttcttagtttggagagtggatgaaatcatttgtgctgagagtctgcaattctcgtaggccaaggttgaggcctagtcaagaagagggctcagaggatcctaactaaagttcgaccagggagacagcctttgtcaaaagccaggggatgtccttaaggatcctctgtgcctgggaagcctcaatgatgctgggagagaggcaggtaaataactctgaccaggaaatgagtataccttctttatcactgacacctcaacacactgtaatggggctaaatcccaaagatccagggagactgaaggactccaagtaccttgaaaaaacttgaaagctgatagcagaagctcttcagggatgctttcatcaaaaatgactcaaatctcccaagctttcctcgcttctttgaggcagcttgaacctggagctactaaccaaattcctagcccagccttttagacttgaaatgcccagtgcagtccaggatgaggctgtggatctccaccttgcatctttccttggggccagcattccaggaacgctgcattaaggagatagactcctgctgacttgcattggggtcacattttttaattaaatatatttactggatttattaaataaatgtattaagtacattataaaaatacaacacagtaattacaaaacagatgctggatcatcctaatgccaaaaactggcagagacacaacaaaaaaagaaaattttaggacaatatccctgatgaacatcagtgcgaaaatccgtagtaaaatactggcaaaccaaatccagcagcacatccaaaagcttatccaccaagatcaagtcgggactcaaggctggttcaacatatgcaaataaataaatgtaatccaccacataaacagaaccaatgacaaaaaccacgattgtctcaatagatgcagaaaaggcctttgataaaattcaacacccctttatgctaaaaactctcaataatctaggtattgatggaaagtatctcaaaataataagagctatttatgacaaacccacagccaatatcaatttgaatgggcaaaagctggaagtattcccgttgaaaattggcacaagacaacctctctcaccactcctattcaacatagtattgaaagtttctggccagggcaatcaagcgaaagaaggaattcaaattggaagagaggaagtcaaagtgtctctgtttgaacatcacatgattatatatttagaaaaccccatcatctcagcccaaaatctccttaagctgatcagcaacttcagcagagtctcaggatacaaaatcaacgtacaaaaaccacaagcattcctatacaccaataacagacaaacagaaagccaaatcatgagtgaacttccattcacaattgctacaaagataataaaatacctaggaatacaacttacaaggaacgtgaaggatcatttcaaggagaactacaaagcactgctcaaggaaataaaagaggacacaaacaagtgtaaaaatataccatgctcatgaataggaagaatcaatatcatgaaaatggccatactgcccaaagtaatttacagattcaacagtatcatcatcaagctaccattgactttcttcacagaattagaaaaaactactgtaaatttaaaaaaagcccatatagccaagacaatcctcagcaaaaagaacaaaactgaaggcatcacactacctgacttcaaactatactacaagtataccaaactatactatggtaaccaaaacagcatggtactggtatgaaaacagagatatagaccaatgggacagaaccgaggcctcagaaataatgccacacatctacaaccttctgatatttgacaaacctgacaaaaacaagcaatggggaaatgattccctatttaataaatggtgttgggaaaactggctagccatatgcagaaaactgaaactggaccccttccttacaccttatacaaacattaactcaagatggattaaagacttaaatgtaagacctaaaaccataaaaaccctagaagaaaacctaggcaataccattcaggacatacctaggcaataccattcaggacataggcatgggcaaggacttcatgtcgaaaacaccaaaagcaatggcaacaaaagccaaaattgacaaatgggatctaattaaactaaagggcttctgtacagcaaaagaaactatcatcagagtgaagaggcaacctacagaatgggagaaaaattttgtaatctatccatctgacaaggggctaatatccagaatctacaaggaacttaaacaaatttacaagaaaaaaacaaacaaccccaccaaaaattgggcaaatgatatgaacagacacttctcaaaagaagacatttatgtggccaacaaacatatgaaaaaaaaagttcaacatcactggtcattagagaaatgcaaatcaaaaccacaatatgataccatctcatgccggttagaatggcaatcattaaaaaagcaggaaacaacagatgctggagaggatgtggagaaatagaaatgcttttatactgtcgttgggagtgtaaattagttcaatcattgtggaagacagtgtggtgattccttaaggatctagaaccagaaataccatttgacccagcaatcccattactgggtatatacccaaaggattatatatcattctactgtaaagacacatgcacacatatgtttactgcaacactattcacaatagcaaagacttggaaccaacccaaaagcccattaatgttagactggataaagaaaatgtgtcacatatttactgtggaatactatgcagccataaaaaaggatgagttcatgtcctttgcagggacatgggtgaagctgaaaaccatcattctcagcaaactaacacaggaacagaaaaccaaatactgcatgttctcactcataagtgggagatgagcaatgagaacacatggacacaggaagaggaacatcacacaccaggggctgtttgtgggttgggggttaggggagggataacattaggagaacaacctaatgtagatgatgggttgatgggtgcagcaaacaaccatggcacgtgtatacctatgtaacaagccttcacgttctgtacatgtatcccagaacttaaagtataatttaaaaaaaagatgctggaaaatatttagagaaatgggaagatggtcatgatatgttttctttttaaagatagtgtaaaaaacagtactacaggtagcataataccaatttttagaacatatattaatatatctatattcaaaatatttatggtagtatctgggtagtaagattactggtgattttcctttttttttttttacttttattttagtttcaaggatacatgtgcaggtttgttatacagataaattgtgtgtctcgggaggcatcactactcacaatagctaagacatggaatcagcctaaatgcatatcagtggtagactgcttagataaaatgtggtacgtatataccatggaatactacacatccattcaaaagaataagataacgtcctttgaagcaacatggatggagatggaggccattatcctaggtgaactaacgcaggaacagaaaaccaaacactgcatgttctcacttctaagtgggagctaaacattaaatacacatgaacacattttgtttatttattcagcatcattttttgttctgtttcagtttggctcccactcttcatgccagtatatctcaaactgccatccatgcaagcgatgtacctccaaagatattgggtggtgagtaatgtggctcattctccgaaactagaccaagtagaagagggaaaatgaaaatgctgtgtcctctccagatacagcttccttgaataacagggcataagatttagccagaacatgaagggatcccaggccaatgaagaggaaatgaaatcatgttcagggtgtataactttcaagtgcttttctctgcaagacatcacctgggttagcagcttttacatctgatatttcatcacatttggcctttactatggaatcttcgggaccatgttgctcatatatttggtcaagtaagaatactattttattccagtaatccagaagatcctcatcctttccctatcagagctatttgtcattagctttaagagagattagattatgacatcatgccccatttcttgcagctggggtgtttttaagcaaatgtgaaaaaaaaaagttgaaatagttgaataagacgagctctttgcaaaaaaaatttgcccatctccattttttacccacttcctggattcctaattgaagcatttcagttgaaccctaagtccttaaaattgtaatctaggtagacatagtaatccctaccaaagaatgacagggaaggatttttttttaagttcttttatgactagaggttttcccaaagcaaaacgacttccaacgcatttttgcttgaatagtcctctccagttttccaatgtaatcttccctcattctgttgccacgttattctaagtcctaaataattataagaataattgtagctactatgcatcagacactttgttaaaggctttacgtgcattatcttatttgatttaatcctcacacaactctgcagtgtagatagtatcatggtcatttttctgctaaaggaactgaagtttaaggagattaaatcatatgcccaagggcatgtaagagcaagtaagagccaaggccaatgccaaaacagaacttgaatccacctcttatctgaggacaaagcctaggctgtcaaccagtttgcatatgcccttaaatttccctagtggttttgatctttgcactagagctacagaaaactttagaggctctgctcctatacatttggcagtcatgtggctgaatgcttagagtgtcatctcttgatataaagatctttcaaataagaaaaagaaagaccaccattttactggaaactttgagtctctttcatttcctccaatgatcaaccagctctactaggggttatgcaagtccagtgcttgctactgaaacaccccaaacagtcatcactccctccttttattcctccaaaaggtttcttgaaagtccttggattgtatatgttacccagatgagccacataacaatgagaatgagcacagaggagaaccgggactggctcaccactcaggtaatgatggagttcctgggggagaatctttcaaaccacactgacttagaaccaggtccctcccttgacatggggattatggggattataattcaagatgagatttgagtaggaacacaggcaaactgtatcaatggacaatttgatgggaagagggctaggaaatgggtgctagttgactggttggggaagaaattataggggtgtggaaaatgttcccagtccacctttgggtggggccacaggacccatcgagtcatgagtcatgcatgggtccaagtggggacagtctgaaaaacatctcaaaaaattaatcttaggttctataatagtgatattatctacaagcacaattgggaaagtcacaaatcctgtcacctctggccacatgactcctgagcagtaaagaattatagaaactatgcctccaattgtttgacacttgggctcatttataactaatataagctttttctttgcaggtcttggccacctgtaatactgaatagtcctttttcaatgactgattcactgggcacctgaacttccaaatcgagcaccagtgagtaacaagaatagtccttagtagagcaagtgcagtcacttataacacccccaaatataatccagatcaggccctaggctcaaggtctcagaggggaaaaaaagaaagagcattttctacaggctgctatctttctattagcaatgatggggaagaaaggaaggaaggagagagagagagaaagagaaagtaaaaaagaaaaagaaagaaagaaagagagagagagatagaaagaaagaaaaagaaagaaagaaagaaagaaagaaagaaagaaagaaagaaagaaagaaaggaagaaagaaaggaagaaagaaagaaagaaaaaagaaagaaagaaagagaaagaaagattgattgtgagtaactagagtgaaatcttggaaaagtgccactgattccattttcagatacctgcaggcttgagaagtgggtaaccaagttgtgttgaaatttaatttaaatgtctatctctttagatctgaagttacaaaataatcaatgataaaacccattccctgatgcaatattcaaatggtattggcaatactttaccaatgagtcagttaggtggccataaaataaagagaaaatgataacacttggagagtcaatctccagaatatttaagggagagactgtccacatcctctttacctaagccatgtttaggatagtcagagaaggaaagagttcttatacctgctcatataattttctcatcctttccttcaagttattccttaaaaacctcagccaaacaaaaaaagactattattcacattttatcaagaggaagttaaaacccaagaaagtcacctgggtgattagtggaaaaccttagataaaaacccgtatctcctcactccttattcctatcccaggactttttcctatatgccatgactagaacttattgaatattcatctcttcatgggataggaattagatggtgtttgggaacctccacctagtctctttgctaaaacataacgagagtcacctttattccagttcccaagaagttcctgatcttcatctgagaccacctcagcctggaccttattgtccatatcgttatcagcattttgggcaaagccattcaacaagtctctaggaagttccaaactttcccacattttcctgccttattctgagccatccaaactgttccaacctgtgcctgttacccagttccaaagtcgtttccacattttgaggtatcttttcagcaacatcccacttctggttccaatttactgtattagtctgttttcacactgctgataaagtcatacccgagactgggaagaaaatggggcttaattggacttacagttccaaatggctggggaggcctcagaatcatggcgagaggcaaaaggcacttcttacatggcagtggcaagagaaaatgaggaagaagcaaaagcagaaacccttgatcaacccatcatatctcgtgagacttattcactatcatgagaatagcatgggaaagactggcccccatgactcaattaccttcctttgggtccctcccacaacacgtgggaatctgggagatataattcaagttgagatttgggtgggggcacagccaaaccatatcagatggatagagagaaagagagacacaaagacagagacagagaaggaggacaggggtatcttcagctcccctaggtaattcaaagtgatagacaatccataccttcatctgaactggccaaatataaacatattcgatgaagataacatttattctgttagcatttcccaaacattcaccacccacctggcttgcagaggtgttaagagacaagcgtattttggaaggagtttttgaacttcccagaacagcagtattgtgcaaggtcaaggttgggtctgcattgctgatatagttttatttggtaacagaaggaagaaaactcaaagtttttctttaggtctaaattttatatctcttgtgtgtttctccagtctgttccccacaatgccacgccataattatcacaaagtggcgcctctggtgaggtcactgtgtgccaagcacggattgcactatgtgaataaacccatgttgagggcatttggagatattgtcaggtaataacataatttctctcagctcacagctctcatttgtatttactgccactccccagactattcagtggcttgtgaatcattcatataacaaccatttattaagggtcacctgtgtgctcagcatggatacatggcaccatagggaaccgtatcaacaacaacaaaataataataatactgaccttttacctataggtacagcttagcgaaaatgctttactgtcctactaaatttcaaatttcttaaagtcaaggctgtatattatttgcctttttatcccccacagagcttcctacaaatgttagaatttaagtagtgggagacactgtcagatcatctggtccagtgttgcaaatttagatgcctgcagggttcagtggggtataaatgtgcagctcaggctggggtgattaattaagagtagtgaggcatgcagaaactgaaaatccatactcatccttaggcattcatatacaatttcctaaagaatgttgtgctggttaaattaacaaccagtaacctgggtttaataaatttctctttagtttagggttgaaaaaaaacaatcttaaatgagaccaacaaggccaggcctgatctgatctgatctgatccctaaccagtgctccagctccagactctctaccacactcctcctctttctctatcctccagataatttcctccagaaattaatgcaattagcctaccttaagttgctgtgaaactcccttccctagttgtcttattcttttgccactttttcttctgcctggaatgttcctccaaacctccacctcccctgacatcatcttgtcaattgccattctttctccaaggctcaactcaaatgccttttcctcatgtctatctcctctgacccctaaaactaaattagtcacatgctcttgcagcacctgcttctcttcatttgtgaagtttatcacaattgtattcagataacatattgggtaataaattatttaatatgtgtctcccaagctagacctggaatttcatgtggacaggactcacatccaccctactcattgttgtcccaccagagcctagaaaaatgtcctccatattataaaatagggttgacaggtaaatataggatgggtggatttacagatatataggctcagaaaagaataaaatgaaagaaaatctcaatgttctccataaagaaaaggtgaattcacctgctaaaaacaatttagtcaacagaattgatcaacagaggatgacatttatcagatatagctggaaatgacattgttctgaaccaggcagaggagcaaattccatgtaggagctttcttaacattacagtctcacctcctgatgatcttgtttattcctttcacagagccttgaagaaatctgctgccctctgggcggatgcttactatgaaacatgatgccgaatgtcagccttgacacacatgtaattgcatctctgatgagggttggtgcatgtgcaggagctcttccctgcttaactgggaattagttatcaccactggtatacctgactgtgctgttctaggaatatgaatcccaagcacatgtgataaccccttctctgaaagtcttctctgcaaataagaacctaggaaacacaagatgacattgaccagggtgacaaaagggaaatggagcccaatatttttgttttttcattagtaccttaaactcagtcctcccaatagactttagtcagatcatctcagtcaagggccagaagtacaagaaccaggcaaaagttttatggatgaagtggacatagggagaagtcagccaaaagagagccatctaacagggtactttggaaattagtgcaattgctcttagaaaagaatcatatgtttaagaatttcctgttgaagcacaaacgctttttacttatttcttttcagatgtgtgaacttctttttctttaaaaaactgagtataattaacaataaaatttcttaaaatatttcaaaattgacttcagatcttcattattgtaactgcacatgtgtcattaatgcatatacacattttctttccaagtggaaaaaataaaaagtctatgaaatatcttaaaagaacttcctacatctagtcctaatagcaacagatcaagcaggttaatgttctgtatttaaagatgtgttgtgtttcactaaagaatagactgcgttttaagtataagattttgttgcctactccctacccaccatgcagaactactgtaccttgtaattgagttaccctgatgaaagaaagagttttgttttctctgatggaaaccccaggcattgacaaggcagttttcaagtttgacaccaaggtaagcatgtcttagaacaagagggctttctctctcacaagagagttttagtgctagaaggataagtggatactcttagtaacatactgatctctagtgtctatacttttattcaaggttaccttagctgcagaaagcacaatagtgcaagcttgcttccccagctccaagcaaatcggcgctactggattatctgttgcctgaaattctaccagtatatattcattcccttacttcaagctctgcaaaatactcttttagctttgtttgtttctcaattaaacccctactggaaaataacacattaaatcactcatagctcctggggacttagccacacatgtcaaagttaagaaaacaaaaactggttgtctgggaggaagtggcattattaaaatgataatggctaatatcaaataggaaagttggggaggagatgaaaagaataaaaagctattttgacttcaagactcttcataataggcaggcaagtgcccattttcctcctgctggtggattctagatgatttctcctgcctcaattcagggttacaagtgggagcgggctcaatggttcgctttttctgtctcccttggtccaaaccagagactttcaagcactgcttgttctcctgattacttagaaatagcaacccgactctccttaggcaaatttactatctcaaacgtgttccccactcagtgttataaatagcccaccttgtaaatctccaaacagacttggttactgtgtaatctgaagaaagttgggagatttagacagattatataaggaaacatgaaatcaattcaaaaaaggtgcttgggccaggctcacatctgtaatctcaacacttgggaggccaaggcaggaggatctcttgagcccaggagttcaataccagcctgggcaacatagagattttttgagcaactagagttttgttttttttagagattctgtctctaaaataaataaataaatacataaaattcataattcaaaaaagatgctagaccatccgattctgggctcttctttgctgggaggtttttgattactgcttcactctccttaatcattattgacctgttcagattttctttcttcatgattcagtcttggtaggttgtatgtttctagaaatttatccatatattctaggttactcaattcgcttgtgcatagttgttcacagtaggctcttatgatcctttgtatttctatggtttacaaaaatgtgcaaactaaacaatgtgctgtttaaggattcataaatatgtagtaacatgataaagagaagcaagagaatagtagacacaaaaatgaggatcatagtgggggaaaggtgctaggtaagaatgaaaatgtataagtgaggtaaattttaatttgcttagtaggctgttagttaatgaaaatgatcatttttctgaactcactatctcaagtgatgtctctctctcaccctgtggtgactggcatttgcatttggtgaggcattagccatatttttattgcttgttcaatatactttccagaggaggagaaccaaagcctactgctttcacagctttgaataccactgagcactgagttaaattcagatgactgatcctgcaggtcattttatttctaaccttcaggctatagggctctgctttatgggcatagaaatgaaagtggcttcatcaaccaggctcatgtctctttaaactagataactcctggcagttatgttatagccctatctgaaactcttcaatggattcccatgactcttggaataaagtccaaaccccaagactgccccatggccactacccaaccttgtaccactctggctcttgctatctctgtttcagcccactggatctcttcaagtcttcacactcttttctgccacaggctctttgctcctgatcccaatggctgagccattttgtcaactccctgccctcactccatctcacctggtcaatccgccactcactttcagatctcagcactattatcacatctcagcatagctttatccacaatcccagagtgcttcctcactaagtcaagccttcctgtgatacactctgtagcaattaccatgggtataattttacattaatttatgtggtgtgttaatttctttgtctccctctctagcctgcaatatccatgaagcaaggatttcttgacatgttagagacactcagtaaagatgtgcgaaatggaggaagaaatgaatggatggatggatgctaattctaagggactacagcaaaaaaagtcctccttggcctctctcatggaaatccatccttttgtttaacaactcaccaaaagaaacttctcctgctccttcattttttatgtctgtaccttaagcttaactatatacctagaaaatcatttaaagttctcttattgcaagaattttctgattccaaaaatatgtttatgtaatttcttccaactagataaattttattaaatatatgagaataattccatattctaattttgaattgttttaattttatcatggtaaaaacactttttatgagccgggcatggtggttcacgcctgcaatcccggtactttgggaggctgaggggggcggatcacgagatcaggagatcgagaccatcctggctaacatggtgaaacccgtctctactaaaaatacaaaaaaagaaaaaattagccaggtgtggtggtggacgcctgtagtcccagctactcggaaggctgaggcaggagaatggcctgaacctgggaggcggagcttgcagtgagccgaggtcgcaccactgcactctggcctgggagacagagccagactccgtctcaaaaaaaaaaaaaaaaaaaaaaaaacatttattatgacatctatcctattaacatttttaagtgtacaatacagtattgttttctataagcacaatattgtgaagtctatctctagaacttatttatcttgcataactgaaattttatacctgttgattggtacttcccattttccccttcctccagtccctggcaaccatcattctattttttgtttctatgccgaaggagtttgactattttagataactcatgtaaatagagtcctagagtatttgttcttctgtgactggcttatttcacttagcatcatgtctttaagtttaatttatgttgttgctattacaggatttcctctttcttaagactgaataatattccattgtatgtatacaccacatctttaattcatttacccattgatggacatttagattctttcctcattgtggctattgtgaatgatgttgcaatgaacatcagaatgctaatatatctttgagattctgatttcaatttttttgataaatatccagaagtaggattgctagataaaattatttaattataaggatctaccatcaataagtactgatatatgccctttatgggcattattgcatttaatcctcaaaacaggcccattgggcataggtgctataattaacctcattttttagatataaaacctgaggcttagggaggccaagcaatttgcctgatgttgcaggtagaaattggtggagtggagtttcagacccaggaatctctaactccacagtcaatgctctttaattcccatgccaggaaatccaaagtaaaaggaagtagcataaattccagccagggaaaattcatcttctttacagctatcttcaaatggctttccctgatccgattttctctaaagctttactcttcttggaagaattaggtaggaagaatttgtctgcatttttagttggacatcaagtaagagtgcctggattagaagtcagaaatctagactctaatttcattttattaacttagtatcctacagtgaacttggccatgtcacttccacgcttcatacctcaatccccacatttgtataggtgcgatgcataatatttcctggcctatgtgcatcataggatgattgtgacaattacatgaagtaagacaaatgcaatggttttataagctggcaacaccaattcacattctagttactgatattcttgtaatgagggttcttcccatcctagatccacaaaaagcatgaaaggccacagagtcaccgagacctacaggatggaaagacactgaatcattttaacaatgacagggtacctttccccagaggcttatgagaggcgtatgactcacaagtgaaaaaatgatttctcttgttgcaacaagtaacatcggtgagtcatcttccacctctgactgtaattaatcccctggtaccagcctgcagatatcagaggctgtggggcaggtagcaggaagccaagattctagttatccaaacttctgattaaccatgtgagtgcaaaattcttattgttggaaatcttaccaatggcatataatataatatttgttgcctagtcagtgtaaataaaggaaggttttatctgctttcttgctagtcagagacacttctggcacaatcctaaaagtgcagaatgcataggaaattaaacttgagctctattgaaggcagggatatactcagttatattttctttcccagaactgtttatgaaagtttgaaaatacagcaatgttgaaataattttatagtgaatatctatatggccatcacttgatttcaacattactatttcagtaaatttcctccatcccgtgtctattcatctacccatctctcaatatatccattaatccactttatttttatgcacttcaagtaaatttcctgagggtacttttaaaactaaacatcaaataatttagacaacaaagtatctttttcctcttcaataaagaattgatacaaattcagaacactaacaggaaaattctagacttaagcttgacacttgaccaactggacctcataaccatctacggaatattccacccagcaaccacagaatcacgcaatatatctttataacaaactgtacatgtaccccagaatctaaaatagaagttgaaaaacaaagtggcaaaaattgtgtagcagccgcatctctaagaaaacataatgtagttatcatttctgaaaaatcaattattaactccccacagaatagaccttctcatatatagagagctatcatatatagatatatgtagatatctatatatattctcatatatacttatctctcatatcagagacatatctagagagaaatatctatgtatctatctagagatatataaatagaaaaatagatgtctatatataaaaatatatatagatatatagatataacagagagatatatgagatatatatatataacttcatgatccttcatatatatctttattattctctttcatttgcaacattaattgagcacttaccatttatcaggcattgacctaggtgatgtgaatgaagagtcagaagccctacctctaggagtttatattctagtgcagaaggcagtcaataaacaagtaaatggaagaaaaaacaagatgattacatttaaagaaaataaataggatgaggtgagagagaatgataagcaggggactagattagttcagggggtcaggcagaagggaatctgagaatattgaaggagcctgccatgacatcctgagaagcagaatcatcaaaggcaagtgcaaaggccctgaggcaggagcaaatttctgttcggacagcagagtaggaggcctatgtgactgtagaactgtttgcaaggtggtttcctcactatcacttaaatttcattcctccataagtatggttggccttggctttttgacagcattcgaaataatttcctattacttatataagcatagttttctctggacactcatcccagatttaaattaccaggttaatattccctttataagcttttgtgccctgtgcacctcactgatacaaatgatctctgcctgtgccactcacaagactgaaaactccatgagagcagtgattctgtatgctgttattcaccatttcatccctagcaatgtatccctagcaatcaaatccttagcattttatcctaacaatggactggggtccactgtttggcatagagacatagagtggatgttcaataaatattttagtaatgattagtttgttagttaattagagcaatgatagataagcctagaaagttaaactgagctcgtattgggaaaaaaaatctaaaattctagctgaaaagtttgtgcttggtttagtagaccagatgggtccatagagaagaatgcaaagaaacctgacatgagatcctgatgggcaagatcatgagaggcaagtgcaaaggcctgtgagctaaggagtagtttaattggaattgagctctggaaaaacctaacttaaaaccacacaaaggaaagactggaagagtgaatagcgtggaggtggagagatcaatgaagttcctattgtgaaacctgggtgagagataatgagtttggctgataataaaaatatgcaatgtaagggaatacacagagacacattgtggatactggatccatagaatatggtaagtaattaaacattcaggggaacccaaagacaccccaaagtttggattgtaggtggcagcaaagtagaggatgaagaaaactagaatgtgaagcaaaagcgaagggctgcttttaagcaccttgagtttatggtatgaaaagaaaacctaaatgaagatgtctagcagataattggaaaaaatgtccttctggattttttttttttatactttaggttttagggtacatgtgcacaatgtgcaggttagttacatatgtatacatgtgccatgctggtgtgctgcacccattaactcttcatttagcattagatatatctcctaatgctatccctccccactccccccaccccacaacagtccccagagtgtgatgttccccttcctgtgtccatgtgttctcattgttcaattcccacctatgagtgagaacatgcggtgtttggttttttgtccttgcgatagtttactgagaacgatgatttccaatttcatccatgtccctataaaggacatgaactaatcattttttatggctgcatagtataccatggtgtatatgtgccacaatttcttaatccagtctatcattgttggacatttgggttggttccaagtctttgctattgtgaatagtgccacaataaacatacgtgtgcatgtgtctttatagcagcatgatttatagtcctttgagtatatacccagtaatgggatggctgggtcaaatggtatttctagttctagatccctgaggatcttaaaaggaaaataaggacaaaagataccaacttgagcatactccccgaagagttaactgaggaaaatagtagagaaagagacttgatttgacagagaatcttaaagctgttttcactgcagaagagagataagaaagcaggaccagtagtgataaaaaaggattaaccgagacctagcaggaaacataagacagtgtatgatgcagaaggtgggagaggagaaagtttagaggtatggctaataagcaaagacacatcctgagagaaggcattatagatgcaagcccatttaatttcatgtttgaccaactttgctcagtttgaaaaaattgagttgggtttataccaagcaggaactaaacatccagactgacgaatgtatagtggatatgttgctactatatcctaaaaggattattttgctaatgtttgaaagcttctcatcattttaaaaaacacagagagagatcttaatttgcacactgcaaaaaacaagttttatgaaatagcacaaacataaaattgtaaagtttatgtgaaacattaagggtaaatggaataggatccccttctccctgatgaccacctggaaacaatggctgtcccagacccctcttgactcaactgagagaggaggggatcaatatttcagtaaattagggtctcccaggatgcaggttggaaagttctggtctataccactgaaagggcacatgtccagattttcctgctaatcctacaagcacaagataatattcggccagttaacctgcatcagttgttaaaatactgagatactaccatgtcagccagtaaatagccactaccctaaatcctacaattcctgccaacctaatccttttgccaagaggccctgaccctcatcccagcctgcgaccaaatgggtgtgggtggtagttgaaaagcttatttacaaataaagaaatagcttatttacaaagtaagaagaaagcttattcacaaaagacaaatatgctgtccaaaacaaaattcaaactctaggcttcaaattagttgagtctgactacctcaacatggcctattttaaacctcccaattaagaaaaacaatcaaagccagaatatgtcacaacatagtgacaaaaacaatacatatgaggccctttaaatttgcccaaattattgcaaaaatctgaatgtccaaattattgcaaaaatatgaatgtaagataaataaatgcattgccttaaaaagcctcttatgactcaggctattttttctaccctatattcccatatttgttacattttatggcacttaaaaaaacacttatttctatcattagctaccctctttataccgcatctgactccttcttgcctaggaaaaagggaactcttgcaattattttctatttctatcttcgataaagataatctagaaataggtggacctaaaagcctagccagtgatcatttatttgcaaaaggcataccattcattttgttcaggtgaataactttatttttttttaattttattattattattattttttattatactttaagttttagggtacatgtgcacattgtgcaggttagttacatatgtatacatgtgccatgctggtgcgctgcacccactaactcgtcatctagcattaggtatatctcccaatgctatccctcccccctccccccacccaccaccgtccccagagtgtgatattccccttcctgtgtccatgtgatctcattgttcaattcccacctatgagtgagaatatgcggtgtttggttttttgttcttgtgatagtttactgagaatgatggtttccaatttcatccatgtccctacaaaggacatgaactcatcattttttatggctgcatagtattccatggtgtatatgtgccacattttcttaatccagtctatctaaaatcagagcagaattgaaggaaatagagacacaaaaaacccttcaaaaaatcaatgaatccaggagctggttttttgaaagaataactttaaactacagaaactcaatgggaattcaaagggaggtcatgaaagctttgagtcaagaaaagaaattgtttgcagaaaagctttagtacacaggttgtacatcgcatcctaatggtgtgaatgcaataaagaaaacaatttgtggtcatttttataacctaccacaccatggtagatttctactcagagtaaattgtttttcaactgacacccagatcaggatataattcattctaccatagctgtgtaaacgaaaaccacttaaatgaaatctctgttaagagaaggatgacttttccgctcattattgtattcccagtatctgttaattgtcaggaatttaataggtggtaattaaaatagctgtttaattagtgaacaaggtctgcacatggaaaattcgaatgttatctactaattacaaaacttactagctacatttcattacagcaaactgtttagcagtccatgttttataaagacttcctaggtccagtaattgtatccaaaacattacaacagaagctcaaatctccaaccaaaacttgaagtcaacgattagcaaagatggctaattttatttattttattttattttatttattgtattttattttttgagatggagccttgccctgtcacccaggcaggagcgcaatggcccgacctcggctcactgcaacctctgcctcacgggttcaagcgattcttcagcctcagcctcccaagtagctggaattacaggcatgcaccaccccatctgcctaatttttgtattttcagtagagacagggtttcaacatgttggccaggctggtcttgaactcctgacctcaggagatctgcccaccttgtcctcccaaaatactgggattacaggcaggagccaccacgcccagcctcagctaactttattttttttctattatactttaagttctagggtacatgtgcacaatgtgcaggtttgttacataagtacacatgtgccatgttggtgtcctgcacccattaactcgtcatttacattaggtatatgtcctaatgctttccctccctacttctcccactccatgacaggccccggtgtgtgatattccccttcctgtgtccaagtgttctcattgttcagttcccacctatgagtaagaacatgcggtgtttggttttttgttcttgcgatagtttgctgagaatgatggtttccagcttcatctatttccctacaaaggacatgaactcatcattttttatggctgcatggtattccatagtgtgtatgtgacacattttcttaatccagtctatcattgttggacatttgggttggttccaagtctttgctattgtgaatagtgtcacaataaacatacgtgtgcatgtgtctttatagcagcatgatttatagtcctttgggtatatacccagtaatgggatggctgagtcaaatggtatttctagttctagatccctgaggaatcgccacactgacttccacaatggttgaactaatttacagtcccaccaacagtgtaaaagtgttcctatttctccacagtctctccagcacctgttgtttcctgactttttaatgattgccattctaagtggtgtgagatggtatctcactgtggttttgacttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgcagattctggatattagccctttgtcagatgagtatgttgcaaaaattttctcccattctgtaggttgcgtgttcactctgatggtagtttcttttgctgtgcagaagctctttagtttaattagatcccatttgtcaattttggcttttgttgccattgctttttatgttttcgacatgaagtccttgcccatgcctatgtcctgaatagtgttgcctaggttttcttctagggtttttgtggttttaggtctaacatttaagtctttaatccatcttgaattaatttttgtataaggtgtaagggagggttccagtttcagctttctacatatggctagccagttttcccagcaccatttattaaatagggaatcctttccccattgcttgtttttctcaggtttgtcaaagatcacatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttcttcttttggctcaggattgacttggtgatgtgggctcttttttggttctatatgaaccttaaagtagttttttccaattctgtgaggaaagtcattggtagcttgatggggatggcattgaatctgtaaattaccttgggcagtatggacattttcacgatattgattcttcctacccatgagcatggaatgttcttccattggtttgtatcctcttttatttcattgagcagtggtttgtaggtctccttgaagaggtccttcacgtcccttgtaagttggattcctaggtattttattctctttgaagcaattgtgaatgggagttcactcatgatttggctctctgtttgtctgttgttggtgtataagaatgcttgtgatttttgtaccttgattttgtatcctgagactttgctgaagttgcttatcaacttaaggagattttgggctgagacagtggggttttctagatatacaatcatgtcgtctgcaaacagggacaatttgacttcctcttttcctaattgaataccctttatttccttcttctgcctaattgccctgtgcagaacttccaacactatgttgaataggagtggtgagagagggcatccctgtcttgtgccagttttcaaagggaatgcttccagtttttgcccattcagtatgatattggctgtgggtttgtcatagatagctcttattattttgagataggtcccatcaatacctaatttattgagagtttttagcatgaagggtggttgaattttgtcaaaggccttttctgcatcttttgagataatcatgtggcttttgtctttggttctgtttatatgttggattacatttattgatttgcgtatattgaaccagccttgcatcccagggatgaagcccacttggtcatggtggataagctttctgatgtactgctggattcggttttccagtattttattgaggatttttgcatcaatgatcatcaatgatattggtctaaaattctcttttttggttgtgtctctgcccggctttggtatcaggatgatgctggcctcataaaatgaattagggaggattccctctttttctattgattggaatcatttcacaagtaatggtaccagttccttcttgtacctctggtagaatttggctgtgaatccatctggtcctggactctttttggttggtaagctattgattattgccacaatttcagatcctgttattggtctattcagcgattcaacttcttcctggtttagtcttgggagagtgtatgtgtcaaggaatttatccatttcttctagattttctagtttatttgcatagaggtgtttgtagtattctctgatggtagtttgtatttctgtgggatcggtggtgatatcccctttatcattttttattgcatctatttgattcttctctctttttttctttattagtctttctagcagtctattttgttgatcctttcaaaaaaccagctcctggatttgttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctgctatgttgcatctttattctcattggtttcaaagaacatgtttatttctgccttgattttgttatgtacccagtagtcattcaggagcaggttgttcagttgccatgtagttgagcggttttgagtgagattcttttttttttattatactttaagttttagggtacacgtgcacattgtgcaggttagttacatatatatacatgtgccatgctggtgcgctgcacccactaactcgtcatccagcattaggtatatctcctgatgctatccctcccccctcccaccaccccacaacagtccccagagtgtgatatttcccttcctgtgtccatgtgatctcattgttcaattcccacctatgagtgagaatatgcggtgtttggttttttgttcttggcgatagtttactgagaatgatgatttccaatttcatccatgtccctacaaaggacatggactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacctggtaatgggatggctgtgtcaaatggtatttccagttctagatccctgaggagtcgccacactgacttccacaatccttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgataatgagcattttttcatgtgttttttggctgcataaatgtcttcttttgagaagtgtctgttcatgtcctttgcccactttttgatggggttgtttgtttttttcttgtaaatttgtttcagttcattgtagattctggatattagccctttgtcagatgagtagcttgcaaaaattttctcccattttgtaggttgcctgttcactctgatggtagtttctttggctgtgcagaagctctttagtttaattagatcccatttgtcaattttgtcttttgttgccattgcttttggtgttttagacatgaagtccttgcccatgttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtacattctgttgatttgcggtggagagttctgtagatgtctattaggtccgcttggtgcagagctgagttcaattcctggttatccttgttgactttctctctcgttgctctgtctaatgttgacagtggggtgttaaagtctcccattattaatgtgtgggagtctcactctctttgtaggtcactcaggacttactttatgaatctgggtgctcctgtattgggtgcatatatatttaggatacttagctcttcttgttgaattgatccctttaccattaagtaatggccttctttgtctcttttgatctttgttcatttaaagtctgttttatcagagactagatttgcaatccctgcctttttttgttttccatttgcttcgtagatcttcctccatccttttattttgagcctatctgtgtctttgcacgtgagatgggtttcctgaatacagcacactgatgggtcttgactctttatccaatttgccagtctgtgtcttttaattggagcatttagtccatttacatttgaagttaatattgttatgtgtgtatttgatcctatcattatgatgttattttgctgattagttgacgcagtttcttcctagtctcgatggtctttacaatttggcatgtttttgtagtggctggtactggttattcctttccatgtttagcgcttccttcaggagctcttttagggcagtcctggtggtgtcagaatctctcatcatttgcttgtctgtaaagtattttatttctccttcatttatgaagcttagtttatctggatacgaaattctgggttgaaaattcttttctttaggaatgttgaatattggcccccactctcttctggcttgtagagtttctgccaagagatctgctgttagtctgatgggcttccctttgtgggtaacccgacctttctctctggctgcccttaacattttttccttcatttcaactttggtgaatctgacaattatgtgtcttggtgttgctcttctcgaggtgtatctttgtggcgtgctctgtatttcctgaatctgaatgttggcctgccttgctagattggggaagttctcttggataatatcctgcagagtgttttccaacttggttccattctccccgtcagtttcaggtacaccaatcagacatagatttggtcttttcacatagtcccatatttcttggaggctttgctcatttctttttattctttttactctaaacttcccttctcgcttcatttcattcatttcatcttccatcgctggtaccctttcttccagttgatcgcatcagctcctgagacttctgcattcttcacgtagttctcgagccttggttttcagctccatcatctcctttaagcacttctctgtattggtttttctagttatatattcttctaaatttttttcaaagttttcaacttctttgcctttggtttgaatgtcctcccatagcttggagtaatttcatcgtctgaagccttcttctctcagctcgtcaaagtcattctccatccagctttgttcggttgctggtgaggaactgcgttcctttagaggaggagaggcgctctgctttttagagtttccagtttttctgttctgttttttccccatctttgtggttttatctacttttggtctttgatgatggtgatgtacagatgggtttttggtgtggatgtccttcctgtttgttagtttttcttctaacggacaggaccctcagctgcaggtctgttggagtacccggccatgtgaggtgtcagtctgccccggctggggggtgcctcccagttaggctgctcaggggtcaggggtcagggacccacttgaggaggcagtctgcccattctcaggtctccagctgcgtgctgggagaatcactgctctcttcaaagctgtcagacagggacatttaagtctgcagaggttactgctgtctttttgtttgtctgtgccctgccccagaggtggagcctacagaggcaggcaggcctccttgagctgtggtggtctccacacagttggagctttccggctgctttgtttacctaagcaagcctgggcaagggcaggcgcccctcccccggcctcactgccaccttgcagtttgatctcagactgctgtgctagcagtcagtgagactctgtgggcgtaggaccctccaaaccaggtgcgggatataatctcctggtgcaccatttttttaagcccatcggagaagtgcagtattcgggtgggagtgacctgattttccaggtgccgtctgtcaccactttctttgactaggaaagggaactccctgaccccttgcacttcccgagtgaggtgatgcctcgccctgctttggctcgcacatggtgcgctgcacccactgacctgcgcccctgtctggcactccctagtgagatgaacccggtacctcagatggaaatgcagaattcacccatcttctgcatcgctcatgctgggagctgtagcctggagctgttcctattcggtcatcttggctcctctctccttgagtgagtttcttaatcctgagttctagtttgattgcactgtggtctgagagacagtttgttataatttctgttcttttacatttgctgagcagtggtttacttccaactatgtggtcaattttggaataggtgtggtgtggtgctgagaaaaatgtatattctgttgacttggagaggagatttctgtagacatctattaggtccgcttggtgcagagctgatttcaattcctggatatccttgttaaatttttgtcttgttgatctgtctaatgttgacagtggggtgttaaagtctcccattattgttgtgtgggcatctaagtctctttgtaggtctctaaggacttgctatatgagtctgggtgctcctgtgttgtgtgcacatatttttaggatagttaactcttcttgttgaatggatccctttaccattacgtaatggccttctttgtatcttttgatctttgttggtttaaagtctgttttatcagagactaggattgcaacccctgcctctttttgttttccatttgcttggtagatcttcctccatccctttgttttgagcctatgtgtgtctctcacatgagatgggtctcctgaatacagcacactgatgggtcttgactctttatccaatttgccagtctgtgtcttataattagagcatttagcccatttacatttaaggttaatattgttatgtgtgaatttgatcctgtcattatgatgttagctggttattttgctcattagttgatgcagtttcttcctagtctcgatggtctctacaatttggcatgtttttgtagtggctggtactggttattcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggtcaaaaattcttttctttaagaatgttcaatattggtccccactttcttctggcttgtagagtttctgctgagaggtcagctgttagtctgatgggcttccctttgtgggtaacctgacctttctctctggctgcccttaacatttcttccttcacttcaactttggtgaatctgataattatgtgtcttgaagttgctcttcttgactatctttgtggcattctctgtatttcctgaatgtgaatgttggcttgccttgctagattggggaagttctcctggataatatcctgcagagtgttttccaacttggttccattctccttattactttcaggtacaccaatcagaagtagatttggtcttttcacatagtctcatatttcttggaggctgtgttcatttctttttattcttttttctctaaacttctcttcttgcttcatttcattcatttcatcttccatcactgataccctttcttccagttgatcgcattggctactgaggcttgtgcattcgtcatgtggttctcatgccatggttttcagctccatcagatcctttaaggacttctctgcattggttattctagttagccattcatctaatcttttttcaaggtttttaacttctttgtgatgtgttcaaacttcctcctttagctcagagaagtttgatcatctgaagccttcttctctcaactcgtcaaagtcattctccatccagctttgttcccttgctggtgaggagctgcagtcctttggagtggggagaggagctctgatttttagaattttcagtttttctgctctgctttatccccatctttgtggttttatctacctttggtctttgatgatggtgacatacagatggggttttggtgtggatgtcctttctgtttgttagttttccttctaacagtcaggaccctcacctgcaggtctgttggagtttgctggaggtccactccagaccctctttgcctgggtatcagcagcagaggctgcagaacagcgaatattgctgaacagcaaatgttgctgtctgatcgtccctctggagattttgtctcagaggggtacccggccgtgtgaggtgtcagtctgcccctactgggggatgcctcccagataggctactcgggggtcagggacccactggtggaggcagtctgtccattctcagatctcaaactccgtgctggggtaaccactactctcttcaaagctgtcagacagggacatttaagtctgcagaggtttctgctgtcttttgtttggctatgcctttcccccagaggtggggtctacagtggcaggcaggcctcctagaactgcggtgggttccacccagttcgagcttccttgacaccctgcttcagctcatgctccatgcactgcacccactgtcctgcacccactgtccaacaagccctggtgagatgaacccggtacctcatttggaaatgcagacatcacccatgttctgcgtcgctcacactgggagctgtagactggagctgctcctatcagccatcttggaacagcccacctagttagctcttcttgttgaattgatccctttaccattatgtaatggccttctttgtctcttttcatctttgttggtttaaagtctgttttggctacctttatttttaaaaaatattagtctagactctgatggaagaaatatggcatcatacagagagcatttttggacagaaataacatggggaagagaatacctacacaagctgaaagacaaagaatttatttattaacccatatgtgtattccatagttgtaataaaatatagttggttgtctacccactattcattttcctttatttcttcctgaaaggactattattttgtgtggaaggtaatgcagccatataaataaagtctttttgtccaagcttccattgtagctatggtggcacttgtcttagtttgcattcctgagatatggctgtgagtaaaggtcatgtactgggggagaaattgtagtgaagaatgaagcttacctaaagacaaatctgacctttgccctcagctactgggagacaatctctgaatcactggagtgtactgcctaataagaatgtctttctttgtttggaggctttagccactggacaatctaacaatgtgatttgtgatggggtctttaggatattctatgtcgatttatacctccagaggcactggagactgaggtattattctgaacttccaggagtatcttgaatcttagagagcagtcagtcatgtggtcagtaaataatcaagtcccaataaaaactccggacaccaaaagttcatgtgagcttcctgggttaacagtactccatgcatattgcgacagttaatggcaagaaagtaacacatctttgaggactattgtattacacgtcccacatgaggttacttaagggtatatatttgcctggttcctgaaccctgaaggctgggttgtgagctaaggccatggtgcccagtgaaggagcaggtgtccctgaaaatctaaacatcccagagactatctgagaacctaacaagaaaatcagtctcactgcattcacacagtatacaaaaggccaaaaaattaccttaaaagcagtttagagatgggaagaggcatggatctctagagctctcctgctgctgtccaagagtgtcctgtaagtcctaataaacacatctgtgagaaaacattttacatggtccattttcaagatatgataaatctaagtactggcagccagcctgcagatgtgagaaaccacacagctcatgcacctagaaattcacaataagcaaacagaatgtagaggatgggtcagcccataaaagggaagtttcattattggcaaatcaaaacttatgtggggaaggagaccagggcataaccttataagggggataatgaaacttaggcaacatccagtaagattataaccccatagtactcaaccagtgaggaactggggaagggactcgtgtgctaggagataaattacctgctgtaactgccccaggtgtgcctgcctgccagacacccaatcttgcaaggccaccattaaaagacttgcttctgctgttctttgtgtctccgagtccattctctgggtttcaacggatgaatgtgtttctcacaaacttgggggctcatctgggatctatgagcctgtgtggagtgggactccagttgagaagggagatgcctcccacctgatttaggtggccctctctgtccagatgtcccggctccccacagaggccatagacaaacctgagactgttattcagaaggcagcagagacgacacagggagaaaagcaggcacagcagcaaccaggcaacctcgttcatgagccaaggtaggaaaattggactctatgtactgtcttagtggttggaggtcaagtgtgtgtaactgagatgtatcttagatacaaagtgagtgcagagttttgttctcctacaagggaaatggccagagatggatgaagcgattctcagagtgtgcaaaaaatctccagtagggggggttgagtacacaaggaaaagttcagacacagagactgaccaaaaatgggaaacagaaattctaggcctaggggacaaaggaaagagggagtcaaagagaattcctctgacattttcctggatactcctttggggataatgctgcaggtttggagggacaaccctcaaaccagggacaaggaaaagcaaaagatgataaagtattcctgtcttatctggctcaaagtcctcattcataagccttcagtgttttggcccaaatttggctcagatgaggattgggtgtgccaagctttaatcctctatgtgaatgataaaaccccatcctcacaagaggagataggttatgctcttagctggatcaaggaattagtccccacattccctctcaaagaagaagaaaaaaaaactagtaaaaagcccttgcccagtgaaaagccctgggacccccctatcacacttgccccctccatatatcttacaatataggggacagaaagatcaaggggcagcaggtgggttagaggaggaaagacctggagaccatgggggagccaaaccaactcttcctttcaatcctaatccaaatttaagaaaataattagaacagtgtaagaggaatattgagaaattccctattcctttcacacaacaggcatctagcatgtttcctcttagggaagttctcatgggacagggagagaatggctttgtaaatgttcctcttacaagtactgaagttaagaatttcaagaaggaaatgaaaccactcctagaagatcccctcagtttagcagaccagctggaccaattcctaggacctggcttttacaccgagcatgaccagttaatagaggcaataccctcttgggaagaagttttgccagatgaacaaaaattttcaaatgtcgatcccaaatggtataataatgatcccagggaatggacccaaatgcaggacctcagggaactataattaaagggatcaaagagtccacttctagcacaccaaatgtctcaaaagcattcaagattcaacaagaaaaagaggtcactccctctgcatttctacagaggttcagagatcaaatgagaaaatactccagattagatccagaggacctagtaaggcaaagccttctgaaggttaactttgtaactaagagctggcctgacattacaaagaaattaccaaaaaaactgatgaatggaatgagaaaccaattgaggaatcactgagtgaagctgagaaggtctttgtaagaagagaagagaagcagaaacagaaagccaaaatcatagtttccattgtggaagaggtagtcagaaaaaggttagatcaagatccccctcaaagtagataaggtgttgacacagagaaagaagggaaactcagggaaaactcctaagactaactggatgttacaattgtgataagccagggcatcttaagagagaatgccctgaatggaagaaagaagaaaaggttatccctctcatgaccattgatgaagactagaagggtcagggattctttctgagtaggtctcaccaggaacccttaatacatttgaagatgggaccatgctcaacacgactacttatcagggaaatgcaagtcaaactacaatgagatatttcttcatgcttgttagtatggctattattaaaaacacaaaatataagtgttacagggatgtggagtaaaggaaacccttgtgtactgttggtgggaatgtaatttggtacagccagtatgggaaacagtatagaggttcttcaaaaagttagaattagaattaccatatcatcaagcaattctacttctggttattatccaaaggaatctaaatcaggatctccaggagatatcttcatgcccatatttttgcaatattattcacaatagctgcaatattaaaacaacctaaatgtccatcaatgaatgaataaagaaaaagtagtatacacacacacacacacacacacacacacacacagagaaatagtattcagtctttaaagaacaaagatgaaggtattacactatctgacttcaaactatattataaggctacaataatcaaaacagcatggtactgttttgacacaatcacagacccgtagatcaatggaacagaaaagaaaactcagaaataaagctgcccacttacaaccatcagttctttggcaaggccaacaaaaataagcaatgtggaaagaacttcctattcaataagtgatactgggataactggctagccaaatacagaagattgatttcaccatatacaaaaattactcaaaatggataaaatatttaaatgtaagacctcaaactatgaaaatcctatttaaaaaccctagcgcggtggctcacgcctgcaatcccagcactttgggaggccgaggcaggtggatcatgaggtcaggagatcgagaccatcctggctaacaaggtgaaaccccgtctctactaaaaaaaatacaaaaaattagccaggcgcggtggcgggcgcctgtagtcccagctactcgggaggctgaggcaggagaatggcgtgaacccaggaagcggagcttgcagtgagccgagattgcgccactgcagtccgcagtccggcctgggcgacagagcgagactccgtctcaaaaaaaaataaaaataaaaataaaaataaaaaccctagaaaataccctttctctacatcagacttggccaaaaaattttggcaaagtcttcaaaagcaactgaaataaaaacaaaaattgacgagtgagacctaattaaaaatcttcctcacagcaaaagtaactatcaatagagtaaacagacaacttacaggatgggagaaaatattcacaaacaatacatccaacaaaggtctaatatcaacaatctataaggaatttaaacaaatttataaacaaaaaataaacaaccccattaaaaagtgggcaaagaacatgaacagacacttctcaaaagaaaaaaatatgcagcccacaaacatgtgaataaaaatgttcagtatcactaatcatcagagaaatgtaaatcaaaaccacagtgagataccatctcacaccagttagaatggctactattaaaaagtcaaaagacaatagatcctggccaggctgtggagaaaagggaatgtttatagaatgttgggaatgtaaattagttcagccactgtggaaagcactctggagatttcaaacaacataaaacagagctaccatttgaccattacccattactggtatataccaaaaagacacatgcactcatatgttcatcaccatgctattcacaatagcaaagacattaaatccaccttgctgcccatcagtggtgaattggataaagaaaatgtggtacatatacaccatggaatactatgcagccattaaaaataatgaaattatgtcttttttagcaccatggatggagctggaggccataatcctaactgaattaatgctggaatggaaaaccaaatactgcatgttctcacttataagcgggagataaacactgagcacatatggatataaatgtggaaacaatagactctggagactactaggggacagaaagggaagagggtatgggttgaaagactacctattgggttctatgcttactacttgagtgcaatatagtcatgtaaaaaacctgcacatgtaccccctgtatttaaaataaaagttgaaattttaaaaaaattatatgtgtttgtgtgtatgcatgtgtatatgagtgtatgtatgaattagtccattttcacactgctatcaagaaagtacccaagactgggtaatttataaagtaaagaggtttgactcacagtttctcatggctgtgaggcctcacgaaacttactattatggcagaaaacaaaggggaagggaggcatgtcttacatggcagcaggcaagacagaagagtgcaggggaaaactgccaaacactttttcaaaaccatcagattgcaagagaactcactcactgtattagtccattttcatgctgctaataaagacataccctagacttggcaatttataaaagaaagaggtttaatggagctaaagttccacatggctggggaggcctcacaatcatggcagaaggcaaggaggagcaagtcacatcttacatggatggcagtaggcaaagacagagagcttgtccagggaaactcccatttttaaaaccatcagctctcataagacgtgtttagtatcaggagaacagcatgggaaagacctgcccccatgattcaattacctcccaccaggtccctcacccaacacatgggaattcaagatgatatttgggtggggacacagccaaaccatttcacccactatcacgagaacagcatgggggaagcacgcccataatcccatcacctcccacagggtccttcccttggcacaaggggattacaatttgagatgaaatttgagtgggtacacagagccaaaccacatcagtgtaaatacacacatttagtatgtatgtatgtgtgtgtgtgtgtctacataaaaatcaaacttttcttcacagcaaaagtaagcaaagtaaaaaaattaatattgagatataaataaactaaatatcaactcatataaaggagggtacttaactcaatatcaattttaaaacaaaatactttttcagatggcaacgtatataacagataattcacataaaataaaaaattaattattctgagaaatataaaaagatatccaacctggttcatatgagtaaagggcaaacaaaatatattatttttcacttataaaaataaattttaataaaagtttcctgtctattagaatttagagaaatagtcactagatttggtagaagtagtataaattggtacagcctctggagggtacctgagcaataagtatcaaaagttatcattattaaatcctttacacagtttcctctccaaaataccttttaatcctacagatatattcacaataatttacagtaacattgtttatattagtaaaatattgaaaacaatctaaatgtcaccaatgggtgggggaaagagtctgattaaacagagtatgaatgcaactgttcaataaaatataatacaaacaataaaaagagtgaggcttctgtcttcatactgatggagacaaatcacccccaaacatgtgaataatatgtatgaataagacatacattgtcttttgttgctgggggaataaagtatatgaacataatatgttttcgaatgcaaggcaagtcttgtaaatctggaagaataacatgaacttgtaacagtggtgatccccagggaaggaaactgaagatcagaaatcaagggaggggtggggacatggtttatactccatacactttcatatttctgaatttttaccataaaatgatttgttatttatccctcaaactcaaaataagagaagctgagggtaagaaataaaagcaggaagaaagaaaaaagagggaagaaagagaggaagaataaaagggaggaagaaggttaaaaataaattgtcagtagcagggcaattctcaaaaatgaaagcaaaaagtccctgctggcattaaaacaagaattttcttccccctggagagcttaactttgcttcagcagaaaataagtagcaaacattgtttttcccagttacatctgagcccctggaacttcaggttctccagggagcgggtattgatctcttatgccccagctatatactcactgatgaggaggaactgaaaagagagaccttgatcagcaatcagtgccagttgcctaaagagaatgtgtaggcaacctcaacgtaagtaaaacaaagcaaatagcattttgttcaaagtctgccatgtatcatgccagtgcatggtggaaattttggagcaaaaggttactcaaatccccagcatgtttcacctcaaaaccaggaggaattacttcatccctggtagtttgattcaggctgagtattacctgggaaagaatatgaacgaacaaatgattgaatgaatcagtcaatcgactgatcaattaagcaatcaacacaatatgcctttaatgtattatttggtattaaagtcattgctgggcatatcttccattcccagccccgtgttgggaatttacataaatttgctcacttaaacctcacatcactgcacaaaagaccttacttttttgccttcattttttaactttttattaggaaatatagattcacaggaagtttcaaagataatagggagaagtttcatatatccttcactcacttttccctcaatggttcaatcttacataattataatatgacatcaaaacaggattttgatgctgggacaattgtatgtatagctctatgtcatttcaaatgtgcgtagatttgtgtagctacgactacagtttagatacagacttgtttgatcatagatctcagattctacatgtctcctttgtgctaccccttctggtcttaccacaccccttcactaaccaccccaacctctagcaatcaccaatctgttctgtatttctataatgttgtaattttggtaatatttgtaactggaattatatagtatatgaccttttgatgttgaatttttacactcacaataatgccctagagattcatccaagtttctgcatatatcaacagtttatttctcttttattttgagtaatattccatagtatggatgtaccacaatatgttaaaccattcacttatcatagggcatttgatcatttacagtttttggctactaccaatataaatattataaaaaattttgtacagcattttgtgtgaatataagttttatgcaaatataattgcccgcaagtccaaggactgggttgtatagtaagtgtatgtctagctatctacacaactgccagactattttccagaatgaccaccattttcaccagcagtgtatgagagatctagttactgtgtctttgccagcatttgctattgtcattgctttttcattttagccattctgcagtgacatctcacttgtagtgtagtgataactcattttgtttttactttgcatttccctaatgactaatgatgttggacatcttttcatctgcttatttaccatccatatagcactttttggtaaaatgtctgttcatgtcattccttcgttttctaatgtgattttttatttttagtttgagagttctttatattctctaaatgtatgtcctttatcagatacggcattttaaaatattttattttagtctgtagtgtgctttttcgtcctctttaacagagcgaaagcttaattttaatgagattcaattactgaggttttttttggggggagggggattgttcttttggtgtcatgtctaagaacccttcacaagacctatcctaaaaattttgccctgaagattttgtcttagattgctctctaagagttttaaggttttatatttcacatttaaagctgtgattcattttgagttaatttttatataaggtatgaggtttaggttggggttcatttttttgcctatgaatatccaattgtctcagcactacttattgaaaaaaggcttcctccattgaattgtttctgaacctgctcaaaaatcaaatggctgcactcacatggatctatttgtcaattcactattttgttccatctttgtatcattccaccaataccacagtgttaattactgttgatatataaaaactctcaatgttagataaagtgattcatctcattttttcttcttttttagaattgtatcagctattctaatttctttgctcttccctataaatttagattattcttttcacatactgaaaatactgtgctcagatattcattgcactggtgttaaacctgtacatcaatttggggagaacagacaccactgtattgagtcttataattcccaaaagcaacatatctttatttagatcttctttgatttcttccatcagcatattgtaattttcatcatcaagtactatactggtttgttagatttatacttgagtatttcatttttgaactattatcagtggtactgtgtttattccagttcccacacgtttactgctaatatggaaatactattgcttttttataactatcttgtattctgtaacttttctgaactcacttattacttcttgaagtttttggtatattcttggaatcttctacatataccatcatgtcatctacaaatgacagttttattccgcctttctgatctgtatgacttttaagcctattcttccttcactgactagaatttccccaactatgttgcatagcactggggagagtgagaattctctcccatctgttcccaattttaggggcaagcattcagttggtaactattaagtaggatgttagctataggtttttctgtagatattcttcatcaagttgaggaagttgccctattttcctagtgttctgagatttttaaaattatgagtagatgttgaatttcatcaaattccttatgtttatctatttatatgatcctgtgatttttctcctttagacctgtaatataccccacttggtcactgtgtataattttttacatatcactgaattctatttgctaatattttgttaaagatttttgcatctatattcattaaaaatattgggctatggtcttctttttttgtgtgtgccattttgcctgcttttgctaatagggtaatactgggttcatagaataagttaagaagtgttctttccacatctgttttctgaaagaaattgtatagaattgaagttcttttttaaacatttagtgaattatgctgtgatattgttaaaaggaagtttttacgtcataaattcaattttcatggctgtagggctattcaaattatcaatttcatatgggttagcttatacttttcaattaatttatttatgtcatttcagttgtcaaattaatatgtgtatagatgtttgtagtattctcttattctctttttgtgtctgcagagtctgtagtgatatccctgtttttctgggcttagtaatttgcatcttttctctcttatcttggacaaaccttctggaggtttgtcagttttattgtcttaaaaacgagcctctctctcacagttttctttccattgtttttctgtatccaattcattgaattctgatcttagccttattattctccttcttctgcttgctttggatttgttttcttcttgttttctactttacttttcttctttttcaacatttttgaagtaaaggcttagattattgattttagcctttttctttttttaacgtaagcatctagtactctatgatgcccactaaacattgatttaactgtaccccataaattttaagtaccgtatttttattaagttcaatttttgtatttcccttgtgactgcctctttgacccaaggattgtttataaatatgttattttgtttccaagtgcctggagagtttcctgctacattctgtgatttttgtctccttcaatttctttgtggtcaggaacacacagtgtgaattgcattcttctaaaattatatagattatgtacaatccgtcttgatatatattctgcaagtgctggaaaaaacatgtattctactcatgtgaggtggactgttctataactattaatggcatcctgttggttgatggtgagtgttgggttcctctatatccttgctgattttctgtctagttgttctataaattgctgagaaataaatattaaattcttcaactataattgtatatttgcctttacctcaattcagtttattattttttcctttatatatgttgtagcccactcgtttgttgcctacacatttaggattgctatttctttttttgtttgtttttttatactttaagttttagggtacatgtgcacattgtgcaggttagttacatatgtatacatgtgccatgctggtgcgctgcacccactaaatcatcacctagcattaggtatatctcccaatttcttttctttttttttttagagacggagcctctctctgtcacccaggctggagtgcagtggcgcgatctcggctcactgcaagctccgcctcctgggttcacgccattctcccacctcagcctcccgagtagctgggactagaggcgcccgacaccatggccggctaatgtttgcatttttttagtagagacgggatttcactatgttagccaggatgatctcgatctcatgacctcgtgatccgcccgcctcggcctcccaaagtgctgggattacaggcgtgagccaccgcgcccagcctaggattgctatttctttgtgatggattaacatttttattaagtaatgtccgtctttgtccttggaaatttttttgctgtgaaatatactttgtctaatatttatatagccatactttcattcttttaattcttgtttgcatgatatatcctttccttctttttaattctaagctactatatctgaggtgagtttttctgtacacagaatacaattgtgtcatttttgtttccactctgccatattctttcttttatttgttattaaatgaaagagacatgaaacatcagaaggtaagaaaaattaaagagtaaatacaacaaacttttcttttgagttttaaaaattatgtttgagaattgaagcaaaaattataacactacctaatgtggtactcagtgtatgtgaaagaattgtttaagacaattataagtgagagaaggtaaagaagttaaaaaggaagtaaggtttccccacttcactcaaactgataaaatggacagttatgattttacaggcatacctcagagatattatgggttcagttccagaccacctcatttaggtgactatcacaataaagcaagtcacacaatttttttgctttcccagtgcatataaaagtttacactatactgtagtctattaaatgtgcaatagcattatgtctttaaaaagtatatggcttaattaaaaaatactttattgctaaaaatgctgacacaacaacactaaatgggcacatgctgctagaaaatggtgctaatagacctgcttaatgtaggattgccacagacctttaatctatttaaaaaatacaatatatgtaaagcaaaataaaacaaggtatgcccatataatgcaacacctagagaagccactaaaaatgctataaaaagatatctaataaaaacactatacaaaaaaaaagactatagatgcaccaaaatgggattataagaaaaagttcaagtgacccacagaaatgcaggaaaaagaaaagagagaaacaagaaagaaaaagaacagttcattttaaaaatggcatacaactgtagcatatcaatgaccacataaaatgtacattgttttcttcatttttagaacaataatggccataaattcccattgtaaaagtgaaagtagaagttcagaagtttataagtttggaaaataatgttctttttcacctaatcccacatccatgaataactgtacttgaatttgctgtgcacactttctggcaattatccatgagtaaataatgacagtggaagcaagagacagtaggagtgagagagagtttggtttttcagagaatccacaagctacttattttttggtggtgggcttggggggattctttattttcctttgaacttttattttaagttcaggggtacatgttcacaatgtgcaggtttgtcagacagttacatgtgtgccatggtggtttcctacgcaaatcatcccatcaccttggtattaagcccaacacccattagctagtcttcctgatgttctccttacacccacacccaataacaggccccaatctgtgttgttccctgacatgtgttcatgtgttctcattactcagctcccacttataagtgagaacatgtggtgtctggttttctgttcctgtgttagtttgctgaggataatggcttcccacttcatccaggtttctgcaaaggacaaaatctcattccttgtccactggtatgtcatggtgtgtattaccaaattttctttatcgagtctatcattgatgggcatttgggttgatccatgtctttgctattgtgactagtgctgcaatgaacttatgtgtgcatgtatctttataatagaatgatttatattcctttgggtatatacccagtaatgggattgttgggtcaaatggtatttctgcctctaggtctttgagtgatcatcacactaacttccacaatagttgaactaatttacactcccaccaacagtataaaagcattcctttttctctgcaacctcaccaacatctgttgttttttgactttttaataattgccattctgattggcataaaatgctatctcaatgtggttttgatttgcattttgttagtgatcagtgatactgagctgtttttcatatttattggccacatgtatgtctttttttttgagtagtgtctgttcacatcctttgcccactttttaatggggttgtttgttttttgcttgtaaatttaagttccttgtagactggatattagatctttgtcagatggatagactgcaaaaattttctccagttctttcgattatctgttcacgctgatgagtttcttttgctgtgcaaaagctctttagtttaataggattccatttatcaatttttgcttttgttgaaattgcttttggtgtcttcttcatgaaatatttgcccatgcttatctcctgaatggtactgcctagattttcttctagagtttttgaagtttggggttttacatttaaggctttaatccatcttgagtttatttttgtgtagggtgtgaggaaggggtccagtttgaattttctgcatatggctagccagtcctcccaccaccatttattaaataaggaattctttccccattgcttgtttttgtcaggtttgtcaaagatcagatggctgtaggtgtgcagtcttatttctgagttccctattatgttccattggtctatgtgcctttttttttttttttttaccaataccatgatgtttgggttgctagagccttgtagtatagattaaggtcaggtagagtgatgcctccagctttgttctgtttgcttagcattatcttggctattctggctcttttttggttccacatgaattttaaaatagtttcttctaattctgtgaagaatttcaatggtagtgtaatgataatagcattgaatatataaattgggcagtacgaccactttcatgacattgattcttcctacccatgagcatagaatattcttccatttgtttgtgttttctctgatttccttgagcagtggtttctagttctccttgaagagttccttcacttcctttattacctgtgttcctaggtattttgttatgtttgtagcaattgtgcataggacttcatacatgatttggctctctgcttgcctgttgttggtgtataggaatgcttgtgacttttgcatattgattttgtatcctgagactttgctgaagttgcttatcagtgtaagaagcttttgggctgagacgatggggttttttagatatagaatcatgtcatctgccatgattgtatatctagaaaaccccatcgtctcagcccaaaatctccttaagttgataagcaacttcagcaaagtctcacgatacaaaatcaatgtacaaaaatcacaagcattcttatacaccaacaacagacaaacagagagccaaatcatgagtgaactcccagtcacaattgcttcaatgagaataaaatacctaggaatccaccttacaagggacgtgaaggacctcttcaaggagaactacaaaccactgctcaaggaaataaaagaggatacaaacaaatggaagaacattccatgctcattggtaggaagaatcaatatcgtgaaaatggccatactgcccaaggtaatttatagattcaatgccatccccatcaagctaccaatgactttcctcacagaattggaaaaaactactttaaagttcatatggaaccaaaaaagagcccacattgccaagtcaatcttaagccaaaagaacaaagctggaggcatcatgctacctgacttcaaactatactacaaggctacagtaaccaaaacagcatggtactggtaccaaaacagagatatagatcaatggaacagaacagagccctcagaaataacgctgcatatctacaactatctgatctttgacaaacctgagaaaaacaagaaagggggaaaggattccctatttaataaatggtgcagggaaaactggctagccatatgtagaaagctgaaactggatcccttccttacaccttatacaaaaatcaattcaagatggattaaagtcttacatgttagacctaaaaccataaaaaccctagaagaaaacctaggcattaccattcaggacataggcatgggcaaggacttcatgtctaaaacaccaaaagcaatggcaacaaaagccaaacttgacaaatgggatctaattaaactaaagagcttctgcacagcaaaagaaactaccatcacagtgaacaggcaacccataaaatgggagaacattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgcttaccatcactggccatcagagaaatgcaagtcaaaaccacaatgagatatcatctcacaccagttagaatggcaatcattaaaaagtcaggaaacaacaggtgctggagaggatgtggagaaataggaacacttttacactgttggtgagactgtaaactagttcaaccattgtggaagtcagtgtggcaattcctcagggatctagaactagaaataccatttgacccagctatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtaaggacatggatgaaattggaaatcatcattctcagtaaactatcgcaagaacaaaaaaccaaacactgcatattctcactcataggtgggaattgaacaatgagatcacatggacacaggaaggggaacatcacactctggggactgtggtggggtggggggaggggggagggatagcattgggagatatacctaatgctagatgaagagttagtgggtgcagcgcaccagcatggcacatgtatacatatgtaactaacctgcacaatgtgcacgtgtatcctaaaacttaaagtataataaaaaaaaaatgaatctggatgctcctgtgttgggtgcatatatatttagggtagttagctctttttctttaattgaaccctttaccattatctaatgctgttctttgtcttttttttttctgggttggcttagtctgatttttcagaaactaggattgtgacccctgcttttttctgttttacatttgcttggtaaattttccttcatccctttattttgaccctatgtgtgtctttgcatatgagatgcgtctctggaagacagcatatcagtgggccttgactgtatccagctttccattctgtgtgttttaattggggcatttagcccatttacatttaaggttaatattgttatgtatgaatttgatcctgtcatcatgatgttaattgattattttccagatttgtctatgtggttacttcatagtgtcactgatcagtgtgcttcagtgtgttttcgtagtggctggtaacagtttttcctttccatatttagtgcttccttctggagctcttgcaaggcaggcctggtggtgatgaattccctcagcatttgcttgtctaagaaggatctttttaggcaaggcataatggctcacacctgtaatcccatcactttgggagaccaaggtgggcagatcacctgaggtcaggagtttgagaccagcctggccaaaatggagaaaccccatctctactaaaaatacaaaaattagctggacatggtggtatttgcctgcaatcccagctacccaggaggctgaggcagaataatagctggaacctgagaggcagaggctgcagtgagctgagattgcaccactgcactccagcctgggtgacagatcaagactctgtctcaaaaaaaaaaaaaaaaaaaaaaagaacactttttaacttttctgggccaaaaattatcttatttctccttcatttatgaagcttagttcagctggatttgaaattctgggttggaaatttttttctttaagaatattgaatattggccaccaatctcttctggcttgtagggtttctgctgagagatccactgttagttttattggctcccctttgtaggtgacctatcctttctctctggctgccttgaacattttttccctcatttcatcctaggagaatctgaaaattatgtgtcttggggttggtcttcttgtggagtaccttgctggcattctctgaatttcctgaatttgaatgttggcctgtcttgctaggttggggaagttctcctggatgatatcctggagtatgttttccaaattgattttgttctcctatctctttcaggtaccccaactggtcataggtttgatcttttcacataatcccatatttcttggatattttgtttgctccttttcattcttttttctctatttttgtctgcctgtcttattttagaaagatagtcttcatactctgagactctttcctccaattagtctattctgctattaatacttgttattgcattatgaagttctcaagctgtgcttttcagctccatcaggtcagttatgttcctctctaaactggctattccggttatcacctcctgtattgttttattgggttcttagtttctttgcattgggttacagcatgctcctttagctcaacaaagtttgctattactcatcttctgaagcctacttctgtcaattcaaccatctcagcctcagcccagttctgtgcccttgctggagaggtattgcaggcattggaaggagaagaggcactctgtttttttgaattttcagtgtttttgagttaattatttctcatctttgtgggcttatttactttcaatgtttgaggctgctgatctttcaatgggatttttttgtggggtcttttttgttgatgttgttgttttctgtttgttttacctttaacaaccaggccacttgtttgtaaggctgctgcagtttgctgggggtctgttccagaccccagttgcctctgtttttcccaaacctggaggtatcaccaataaggactgtgagagagcaaagatggtagcctgctccttcctctggaaggtccatcccaggggcgtactgagctgttgttggcccaagtgcttttgtagggggtgtctggagacccctgttgggaggtctcacccagtcagaagggacaggctaagggacccacttaaagaagcagtctgactgtttttttgctaaagcaggtgtgttgtgttggggggacccttccttgtctgaaccacctggactctctagagccagcagggtgggaagactgagtcgaacgaactacagagatggtggccagccctccacttgggggctctatcccagggagagatcagagttctgttcatgtaactctggctggagttgctgaaactcccacagggaggccccgcccagtgaggacagacagatcaaggttccactcaaagaagcagtctggccacaatctggcaacagctctgctatgttgtgggagacccctccttgaccagaccacatggactctccagagccggcaggctggaacagcagagctgaccaaactgcagagatggtggctacccttccctgcctcccaggaactccatcccatctcaggcagtctccagcctgtttcccttggcttgctggaattctaagccagtgagccttaacttgtgaggtgccacaaaatggcattgcttggctccctagattcagctgccttcctaagggaatgttcaaacatgtctttcatattgccagaattcctggggcctgagtatgtaaaagtcctgggtctctgcatgtgcctgagtggctggtctgctgtgatgactccacacagctttgtgtattgggcccaagaccatggtggcatgggctcatgaagggatctcctgatctgtgggatgcagagatccatgagagaagcgtggttttccaggtggggttgcaaaatcactcaccacttcccttagctggagatggggattctcttggctccatgctgctccagggtgggccatcaccccaccccgcattttttcacactccgtgggtcaggttgtttgcctagtcagccccagtatgagaacctggatatttcagttgagggtgctgaattcatttgccgctttccttccgctctgtgagtgctggagaccacagctccttctaattggcctttttttttccccaaaatctacatatttttctacaacttgcttttcttttctgactccatagagtatatatttatttcactgctttagactatgtattaataaataatacaaatctactaaaatttatacaattctatcttccaattttgctattagaaagttgttcttaattaatttaaaatacgttacataacattatattgtacatgatatgcatattacttatactataaacaatctaatgaacatcaattaacttctagataagttctgtgatccccattgtacagagaaagcaagtggggctacagggagttctatccttttttgtattaactggtgagacaataattcaaaaccagggctacctatttcctttctactgcaaaatgttccatctaaatgaagcctgagaaacccagcactacccacttgttaggcatgtttgaaatgcttgagtagttggccattttccttgtagcatttatttgatctgaaaacaccttcaacatagatgaaacaaaatattttatactaaaccaacctaccattggctcaacataaacccagatatgtacagattctgtatgagggggtaggtggcggggcttgtattagtttccttagtccttgaaaagaatccccataatttcatattattttatttcaatccagataattaaagtcaaaaatgatataataaatgtcattactctgtcaaaattctagcttaaatggacctctggcctattctagcaagtgtttatcacaatgaaagaatgactccttgaaagggctgcatttctttcatttttacagtaaatttaccctaggaaaaagcttataccaacttattatatctcagacctcactaaatgtttaattgaagagaattatttcttgtttcttgttcctccactacataatttctgtaataagcaatagaaaatgtaaggccatttctcagacatccattatataacagggttaatatacttgtaaagaatagcacctagatggaagttgcattttaagaatactagtacaaagacactttgaagccttcaaaaatatgtgaatatgaacatattttgggaaattgctctccaattaattctactaatttcaagaactagaaagagaaataaaataagtggctgtgaataattatgtttctaaaaaggtacagaattacattttaacgttatttagaataaatacaaatacctgtttaatatagtgaaaaaatgcttctctatgtttctaagaaccacgcacattagaagtcagtcttcttctaagaaaatcttcttcattttgaagataaatctgtttcatctttcatctagtaactctctctttacttgatgattataaattttttttaatttggaaataacactattgtgagtatttgtcatgaaaagtcaaattgaaaaaagtgacttaaaatatagagccattttattgcaaaaagtcacaaggatgttcctgcttttctgggtccttctcttggtcctttctagacttttggtagtcatgggtcgaggaaacagcactgaagtgactgaattccatcttctgggatttggtgtccaacacgaatttcagcatgtccttttcattgtacttcttcttatctatgtgacctccctgataggaaatattggaatgatcttactcatcaagaccgattccagacttcaaacacccatgtacttttttccacaacatttggcttttgttgatatctgttatacttctgctatcactcccaagatgctccaaagcttcacagaagaaaataatttgataacatttcggggctgtgtgatacaattcttagtttatgcaacatttgcaaccagtgactgttacctcctagctattatggcaatggattgttatgttgccatctgtaagccccttcgctatcccatgatcatgtcccaaacagtctacatccaactcgtagctggctcatatattataggctcaataaatgcctctgtacatacaggttttacattttcactgtccttctgcaagtctaataaaatcaatcactttttctgtgatggtctcccaattcttgccctttcatgctccaacattgacatcaacatcattctagatgttgtctttgtgggatttgacttgatgttcactgagttggtcatcatcttttcctacatctacattatggtcaccatcctgaagatgtcttctactgctgggaggaaaaaatccttctccacatgtgcctcccacctgacagcagtaaccattttctatgggacactctcttacatgtacttacagcctcagtctaataattctcaggagaatatgaaagtagcctctatattttatggcactgttattcccatgttgaatcctttaatctatagcttgagaaataaggaaggaaaataagctttaaaagtgataggaaaaaagttttgttaagttagacacagttgttaaaattcaacacaacaaagcatccagcacagctaatctgccaaaatttaaagtttctaaaatagggagcatgtaggaaaatctcaaattaaccatctaacatcacacctagagcaattagaaaaaagaaataactaaaatcagaacaaaactgaacaaaattgagacccaaaagtccatacaaagaatcaatgaaaccaaaacttgttttttattttgaaataatcaataagattggtaggcttctatctagattcacaaagaaaaaaaaaggaaagatccaaataagcacaagcagaaaggacaaaggtgacattataaacaatcccacagaaatacaaaagatcctcagagactattatgaacatcatttctatgcaaataaactagaaaatctagaggaaatagataaattcccaggaacacacaacctctcaagatttaatcaggaagaaattgaaaccttgaatgaaccaatatcaagttctgaagtggaagctaagtgccatccaaaaaggggcccagacaagacaaatttgcagtcaaattctactagatgtaaaaagaagagctaataccaatgctattgaaactatttcaaaatattgaagaggaggaactcttttgtaacccattctacaaagccacaattaccctgataccaaaacttagcaacgacaaaacaaaacaaaaaataaaactgcaggcaaatatccctgatgaacatagatgcaaagccaacagtgaaatactagcaaatcgaattgaacagcacatcaaaagttaattcaccatgatcaagtaggcttcattcttgggatgcaagtttggctcaaaatatgcaaattattaaatctgattcaccacatcaatagtatttaaaacaaaaaccatatgatcatctcaatagatgcaggaaaattcttcaataaactcctacatccctttataataaaaaccctcaaaaaactaggcatcaaagcaacgtatctcaaaataagtgccatctatgacaaattcacagccaacattataatgaatgagcaaaaattggaagcatttccccttgagaactagaacaagacagggatgctcactgtcaccattcctattaaatgtagtactggaagtcttaagtagagtaaccagacaagagaaagaaacaaaaggcatccaaatagaaaaagaatcaaactaactctctttgtggagaatatgattctatatctagaaaactccagactctgccaaaaggctcctgaaactgataaatgacgttagtaaagttttaagttacaaaatcaatatacaaaaattagtagcattttcatacaccaataaagttcaacctgaaagccaaatttaagaacacaatcccatttacaatagccaccaaaaaaataaaataaaatacctaggaatacaactaaccaaggagatgaaatatctctacaaagagaattacaaaatattgcccaaagaaatcagaatgacacaaacaaatgaaaaagcagtccatgctcatggataagaataatcaatatcattaaaatggccatactatctgaagcaatctacaaattcagtgctatttctatcaaactaccaataccatttttttttacagaattagaaaaactattctaaaatttatgtgaaaccacaaaagagccaaaatagccaaagcaatccttagcaaaaagaacaaaactggagacatcacattacccacttcaaaacatactataaggctacagtaaccaaaacagcgtggtattagtacaaaaacagaaatatagaccccgtggaacagaatagagaacatagaaacaaagccacccacatacaaccatctgatctgtgatgaagtcaacagaagtaagcaatggagaaaggacttcctatttaataaattgtgctgggataactggctagctagccatatgccaaaaaatgaaaccggaccctacctttcaccagacacaaaaactaattcaagataggttaaagatttaaatgtaaggcctcaaactatagaaatcctagaagaaaaccagggaaatgcctttctggacatcagccttgggaaagaatttatgactaagtcctcaaaagcaattgcaacaaaaacaaaatttgacaagtaggacctaattaaattaaagagcttctgcacagttaaaatatatatatatatatatatatatatatatatatatatatatatcaacagagtaagcaacctacaaaatagaagaaaatattcacaaactatgcatcttacaaaagtctaatatcaagaatttataaggaacttaactcaacaagcaaaaaaacaaataaccctattaaaaagtggacaaaggacatgaacaaacacttctcaaaagatatacaagcagccaacaaacatatgaaaacaatgcttaacatcactaatcaccagaaaaatgcaaatcaaaaccacaatgagacagccatcacacactggtcagaatggctattattaaaaaagtcaagaataaaaccaatagatgctagtgaggctgcaaagaaaagataatatttatgcactgttgttgggaatctaaattagttcagccactgtggaaagcaatatgtagatttctgaaagtacttaaagcaaaactgtcattcaaccaagtaatcccattactggatatatattgaaaagaaaataaatttttctaccaaaaagacacaggtgctggcatgttcatcacagcactattcacaatagcaacaatacaatcaacctaagtgccaatcagtggtggattgggtaaagaaaatgtggtacatatacaccatgaaataccatacagccataaaaatgaacaaattcatatcctttgcagccacatgaatatagctagagaccattatcctaagtgaattaatgcaggaacaggagagcaaatattgaatgtgcttacttataagtgggagctaaacattgagtacacaaggacacaaaaatgggaacaataaacactagggactactagcgtgcaaggaagcaagtggggcaaggatttaaaaaccaactgttgggtactatactcactgcctgggtgacaggattgttcttatcccaaacttcagcgtcatgcaatatacaaacttgtacatgaacttctgaatctaaaataaaagttgaaattataaaaaacaaaataaagaacatatctacatcataaaccaatgcacttctttccatagataagctcttacattttggaaaatataacagaaatatttcctggagctgaaaaatgcttcacaggaaatattgacaatacacagttttaaagtttctgacttcaccattacagcaaaaagaaattaaatgaaaacactctctctgtaaagatagtttagggagatgcctgattaaacaggaaatgttgtagtatctttcttgctatctgatggttaatttttttctttattggctctgaaagatggtgtgatccatcctgccacgaggaaagatgaacattcccaccaacacagaacataaaggtgagcaatccaacttgctcagcattggatccccaacatccagcatatttagcacactgtagttgatcaataaacatttgttggctggacatggtggctcacacctgtaatgccagcactttaggatgttgaggtgggtgaatcgcctgaggtcaggagtttgagatcagcctagccaatatgatgaaaacctgtctctactaaaaatacaaaaaattagccaggcatggtggtgtgtgcctgtagtcccagctactcaggagtctgatgcaggaggatcacttgagccagggaggcagaggttgcagtgagccaagattgtcactgcactccagcctggaccacagagcgagactctgtctaaaagagtaaattaattaaataaataaataaataaacaaacaaacaaacatatgttgaaggaataaatggacaaaagaaagcagaaaggaaagatcagaaatctagacagaggactctcagtagagttgagaggagtcagctgcagtccagtgcagctgtttctgggttgaaaagtgaagcagcaacaagagctttgccaagcttactgggtgaagcaactacttgtaacaacatcgaagaatgttgttgtaaataaacacacagaaaatacatgtctgtcattttatatgcagaagtgtagaataaaagagcaacaggatacaggtgaccaggtcgattctctcagttcctcagtgtcagcgttatcaatttttcaatccacagtttatggaataaaacatgtgaaaccagcttggtagcttgagcaagctatcagggatctccaagaattgctgggtttttattaataatgttttctttttatttgtatgtatgtgtcacagaagatacaaaggcagaatatctaatggtatacaggaattatagacaccaagaagaatgcgggcagagctatcacttaacccagagtagtagtgggcaattttgtcagtggatgcatgtgtcgtgtctccatcattccccaccaagaaaactacatattttatgaattaatccttaacatctggcatgattctttgcataaataacttattagcacagttaagaaagaagtcacactgctttcaaggatattggagctgtaatatcctactgccaaagatattgatgctcgatcttctatgaggcagaagataatggtcacctaccactacagtaaaagggaaagtgattttgaggaatagtaaacataatcgtaaatcagaattatgccaggtggtgtggaatggagttgaatagtgcaattctctaagacttaaatttttggataaattataaggttactttactcctgtctaacctgaaagggatgctttccacattacatttttaagcatgatatttgctgtagttttaattgatgatatttattgaggttaaatagattcctgtctattcttagtttgctaagagctttgcataataaatttatgttgacttttagtaaatctttttctgtatctgctggaacaatcatatggttttcatcccttgatatggtaacagttaaccatatgtcaatgtatgtaattggttttctggaattaaagcaatcttatgttcttagagtaaaaataaataaataaataaataaataaataaggtggtggtcctcatcatatcctcatttaactcaccagtccaggacctacaaaatccaaacagatactggcagaaaattgactaccacaaccttagccaaatggaagcaccaatctcagtcactgtaccagatgtgcaattgctactggaaaaaacagcttctagtactatgcactgacactaaattggaaatacattcttttccacaagtatcaggaaggaagttcagaagcaagatacattctcttagcatagatatcacgaaacattcccaatcattcccagggctatctgaactctcctgagccacagtgtggcctattggaccttgaccattaaaaaacttgtagaacaacactccgctccactttagtgatgatatgattggacctgagaaagaggaagtagcaagtaccctgtgctagtttgttacagaagcaatagaaacagaaaactagtgcaaacttcatgaaaaataattgtaccaagtaacatgtacaataaaatgtatagcaatattgtgtatagtagcaaaatctgggaactacccaaacatccactggtagaatgttttcgtctaaatcctctaagaagcagacaccaagatgggattacacatgcaaacattttgttagggggatgcctatgtaaaaggaaatagggaggacaatgggaaaagctaagagtgatgcaagtttgactccaagtcaagaagagagggagagaagattgggaagaagcatgtgagaatgtcatgaagcagaaagatgatttggcaaacttactgagaaatccttgagccaaaatgggctgacaaaggagtcctgtgtttctcagatatgggtctaccttagaatccatactgcacacagtcattttcacatccccttgaaaaactactacaagggaattcaaagtaagaagctgagatccttggtgatttatactagttgaaagaggtatacaaattcattaacacagctgctatactggtgaagggataaatttaattacattttaatcaaatgatggaatattatgcagcagggaaactatgacacgacagataaattttagtactgttgagtaaaaataaacatcacacaataaaatagaaggaaattttttattaacttcagtaacaggcaaactagaaagcatatggtttgcatgtctctgtgtgtgtgtgtgtgtgtgtgtgtgtgtttatgtaaagctataaatcaaaaaataaaagaacacaaagaaacattctgtgaatgttgccatttgcagataaggaagaggctaagcaggtgcacaatacagggaaggagtacattggtaggtatatcttatagataatttttgagtcattggactagattatctacttaataaattattatgtaattaatattaaataatgttgtgcatggaccaatggcaacagtgtgtcatgaaacagggtgatgactaatccaattctctgcacattgttatgatatgtttaattaaaataaaattccaaaatattcagaaagctgagtgctttctaagaaactgttctttctgtataaaacaggctgtgactttacattaaacatcctcagggagactgtgtactaacccaaccactgctatcacccccagaatcaggtcattcaggagtcaataatatgaaagggaacttctttaagagactagccctattccaaagcaaaagaaatgacagattgcccctttagttaattcaataaaattccattttcagtggtacagtgtggattagaaagattagctagaacagctaacacttataattaaattttatagctaaattccatcaatcttaatttctgaagtgctcagtaatcaaaaaaaaaaaacccctcaagttttgtatgtctttctccagaaaattttgggcctggggaagaggaagtggcaattaccctgtagtagtttgttacagaagcaataagaggaaactagtgcaatattcatgaaaaataattgtacctagtaacatgtacaataaaatttatagcaatattgtgtataatagaaaatagtgtctcattctttttaatgaggcaaaaagggcaattcaaaatatcaattttaaagtaaaacactttttcagagggcaacatatataacagataattcacatgaaatgaaaaattgattgtgctgagaaatatgaagatacccaatccagctcatatgagaaaaggccaaaccaaatatattatttttcacctatacaaatagcaaattttagccaggcacagtggctcatgcctgtaatctcacactttgggaggctgaggcaagtggatcacttgaggttaggagttcgggaccagcctggccaatatgttgaaacccagtccctactaaaaatacaaaaattagccagacatggaggcacatgcctgtagtcccagctatttgggaggctgagccaggagaatcccttgaacccgggaggcagaggctgctgtgagcagagatcacaccactgaactcaagcctgggctcagagctagactttgtctcaaaaaaaaaaaaaaagcaaaatttgataaagttttgtcacagtctggtagaatttagagaaacagtcactagatttggtagaagtggtataaattggaagagcctctggagggtagctgggcaataagtatcaaaagttatcattattataccatttactcagtattctctccaaaatacctattaatcctacagatgtattcacaataatatttacagtaacattgtttatattagtaaaagattgaaaacaacctaaatgtcaaccaatggatgggggaaagagtctgattaaacagaataatgaatgcaactgttcagcaaaatataatacaaccattaaaaagagtgaggcttctcttctcgtactgatggagacaaatcacccaaaaatattaggaaaaatgaaagctgagcaatgtgaataatacattatcttttgttgcaggggaaaacaaagaatatgaatttaatatgttttcaaatgcaatgcaagacttgtatatctggaagaataacaagagcttgtaacagtggtaatctaaagggaaagaaactgaagattagaaattaataggctgggtgcagtggctcatgcctgtaatctcagcactttgggaggctgaggcgggcagatcacctgaagtcgggagttcgagaccagcctgatcaacatggagaaaccccatctctactaaaattaaaaaattagccaggcatggtagcgcatgcctgtaatccgagctacttgggaggctgaagcaggagaatctcttgaacccggaaggcagaggttgaggtgagccaatatcatgccattgcactgcagcctgggcaacaagagtgaaactctgtctcaaaaaaaaaaaaaagggaaagaaaagaaaagaaattaatagatggatggggatggggacatggtttgtactctatacactttcatacttctgaattttttaccatatagatgttttgttattcatccctcacccttgaagaaaagagaaggtgagggtaagaagaaataaaagcaggaagaaatggaaaaaaaaaaaacacgggagaaaagaaggaagaataaaagggagagagggaagaaggttaaaagcaaagtgtcaatagcagggcagttctcaaaaatgaaagcaaaaagtccctgacggcattaaaacaagaattttcttccccctggagagcttaacttcgcttcagcagaaaataactagcaaacattgtttttcccattacgtctgagcccctggaacctcaggttctccaggaagtgggtattgatctcttataccccagctatatactcgctgatgaggaggaactgaaaagagagaccctggtcagcaatcagtgccagttgcagaaagagaacctgtaggcaacctcaaagtaagtaaaacaaagcaaatagcatttttttcaaaatctgacatgtatcatgccagtacatgcaggaaattttggaagaaaagattagccaaagtcccagcatgttttccctcaaaaccaggaggaattacttcatccctggtaatttactggaaataaagggatggatttggttcagcctgagtattacctgggaaagaacatgaatgaacaaatgattgaataaatcaatcgattgctcaattaaccaattaatataatatacctttaatgtattatttgcattgttattaaagtcatttgctgggcatactttccatgcccagccctgtgctgagaaatttacataaatttgctcacttaaatctcacatcactgcacaatagactttactttttcttcttcatttttttaactttttattttgaaatacttatagattcacaggaaattccaaagataataaggagaggtcccatatatccttcacctactttttcctcaagggcacagttttacacaattataacatgacatcgaaacaagattttaatactgggacagttgtgtatagctttatgtcatttcatatgtatgtatacttgtttagctaccactgcagtgaagatacagccttgcttgatcacagagctcagattctacatgtctgctatgtgctaccccttctggtcacaccacacccctccccttaccactacaacctctggcaatcaccaatctattctctatttctgcaattttatcatattgataatgttttgtaaatgaaatcatatagtgtatgatctttgatgttggcttttttacactcacaataatgcccttgagagtcatctaagttgttgcatgtatcaacagtttattcctctttattttgagtaatatgtcatagcatggatgtaccacaatattttaaaccattcatttattgtaaggcacttgattgtttacagttttgggcaactacaaatgaaaatgatatgaaaactgttgtacagctttttgtgtgaatatgttttacgcaaatataattgcctacaagtccaaagactgggttgtatggtacgtgtatgtctagcagctttttacacaactgctaaacttttttccagagtgactaccattttcatcagcaatgtatgagtgatccagttactctgcatctttccagcatttgttattgtcactgtttttcttttttttcattttagccattctgtagtgatatgtcatttgtagtgtagtgatatctcatcttgttcttattttggatttccccaattgttaatgatgttggacatcttttcgtgtgcttattcacaactcatatagccttttttaataaaatgtctattcgtttcttccacttgttttctaatttaatttttttttttagtttgaaagttcttatattttctaaatacatgttctttatcagatactgtatttgaaaatgttttcctccagtctgtagcatgctttttcatcctcttaactaggtctttaacagagcaaaagtttaattttaatgacatccaattgtggaaattttttctttttggatagtgcttttgatgtcatatctaagaactcttcacaaaacctatcctaaaaattttgccctgaagattttgtcttagattactctctaagagttttaaggttttctattttacatttaaagctatgattcattttgagttaattttcatataaggtatgaggtttaggtaggggttctttttttgcctatgaatatctaattgtttcagcattatttattaaaaaagcttttgactctgctcaaaaatcaaatggctgcacttgcgtgaatctgtgaattcactattttgctccatctttgtatctatcattccaccaataccacagtattaattactgtggatatataataaatcttgatgttaggtaaagtgattcatttcattatttttcttctttttccgaattgtattagctattctaactcctttgctctcccctataaatttagaatatttttgtccacatgccaaaaatattatgctgagattttgattgcagttgtgttaaacctatatatcaatttaggaaaaattgacaccactatattgagtcttctaactcctaaactcaatagatgtatttatttagatcttctttgatttctttcatcagcttattgtaattttcatcatcaagtcctatattggttttgttagatttatacctaagtatttcattttttgaacttttatcaatggtgttgtatttatcccagcttctacatgttcactgctaatacggtaatagtgttgatttttttagaactatcttgtattctgcaacttttctgaacttattacttttagaagtttttggtaggttcttggattcttctacataaactatcgtatcatctacaacgacagatttatttcttcctttctgatctgtatcactttttatgcctctacatcttttcctctgactagaacttcccaaacgatgttgaatagcactgaagagaatgagtatccttgcctgttcccaattttagaggcaagcattcagtctataactattaagtgggattttaactatagatttttctgtagatgctcttcagcaggttgaggaaattgccctcttttcctagttttcagggatttttttaaataagtagatgttaaattttgtcaaattccttttcttcattagtttatattatctggtgatttttctcttttagacctgtaatatactccacttggtcattgtgtataattttatatacatagctgaattatacttgccaatattttgttacagattttgcatttatatttattaaagatattgggctgtggttttttgtttgtttgtttgctattttgtccgcttttgctaataaggtaatattgaattcatagagtaagctgggaaatgttcttttacatctgttttctgaaagaaattgtacagagttgaagttaattcttttttatacatttagtgaattttccagtgatattgttgaaagaaagtttttacattataaattcagttcttcatggctgtagggctattcaaattatcatttttttcatataggttagtttatacatttcaattaattgattcatttcagttgtcaaattaatatgtgtagagatgtctgtagtgttgcaggacttttccttagttcagttaaagatggggttctttgtcccaccatcacaaaaattcaggctcgcagacaattgcaatggtgagtgagacatggttttattgggtgaaaaggaagaaaagggggaaacagggattctcgcgacgccagagtccctgctagagcacttcccacccaccgttcaaatcccagcttccacacaggaagaggaggagccaggctcctccctgctgcagacatcgtgaacttcctgagattctccctcagtgggcaggggggctggagtttctctgagggccgcctcccacctggctgtctcattgccccctctaaagaagtacatctaactgcccttagattaaggataaggacgaagaccaatcttaactgcttcctgctgacaggggcctctattttggggaaacagcaataagagcttccctatttaagggttcctggcagaaggggccatcgtctgagactccagttgcattactgtttggtgtttgatggcctgaaggcaagaacagacaaaccgggttattagaaaacatgtatcaaagtgaaacaaggggaggggtaaggacagctcaaaaattccgagaccttttaccagtttacacagggagagggaggccaaaagcccagctgcgagaaaacttttcacttttgctgacatgctgggcgtctgggttcccttcccctgagcccaatcctaaaacagccagtttaaggtttgggaaattaacttttcagtttggaggatgcatctgaggggagtgtcctatagtacagagacacaattacctattagtgaagagaaaaccaaggagaagaaaggaaaaagaaggcattttttaaaggagtcccaagggttcaggatgcatttgaaaggggtacagactaaagatgaatggctacccatctagaaagacgcgagcagggatccctggttcccttctctttctagcagccagagattgctggttcaattgcattgtggtcaggagcacaaactgtgtgaattcaattcttctaaaattacagagattatatacaatctgtcttgatacatgttctgcaagtgctggaaaaaatatgtattgtattcatgtgagttggacctttctataaatatcaatgatatcctgttggcttacggtgttgagttcttctatatctttgctgattttctgtctaatgcagtaaatttctgagaaaggaatattgaattccccagttataattatagattgacctttatggcaattcaattttttcagtttttcctttatatatattatagtttacttgtttggtgcctacacatttaggattgctatttcttcttgatagattaacatttttattattatgtaatattcttctttgtccttggtaattttctttgctgtgaaatatactttaatatttctatagacatactttctttcttttgattaatgtctgcatgatatatttcttgctcccctttatttcaaacctatatgtatcttgaagagagtttcttgtacacaatataattgcatcatttttctatgcactctgccatattctttcttttaattgttattaactgaaagaaacatgaaacatcagaaggttaagaaagtagaaagggtaaaatacaacagactttccttctctcttgagtttttaaaattatatttgagagttgaagcaaaaattataatactgcctaaggttgttctcagtgtacgtgaaggaaatagttacaacaattacattataagtgggagacagtaaagaaacaaaaaaggatgtaaggttgccacacttcactaaaactggtaaaatggacacaagttatgattatacaggcatatctcagagagattgtgagttcagttccagaccacctcaattaagtgactatcacaacaaagcaagtcacacaaatattttggtttcccaatgcatacaaaagttatgtttatactgtgctgtagtctattaaatgtgcaatatcattatgtctaaaaaagcatatgcctttatttaaaatactttattgctaaaaaatgtcaacacaaagaaattaaatgagcacatgctactggaaaatggtgctaataggcttgtttaatgcaggattaccacaaaccattaaattattttttaaaaatgcaatatctgtgaagcaaaataaaataaagtatgctcatataatgtaacacctagagaacccactaaaaaactatacaaagatatctaataataacgctatattacaaaatcactgtagatgcaccataatgggattatttttaaaaagttcaagtgacccacagaaacgctggaaaaagaaaagagataaacaaaaaagaaaatgaacacttaatttaaaaaaatggcagacaactttaacgtatcaatgaccacataaaacataaacaattttctcggtttttcaaacaataaaggtcatgaattcctcttataaaagtgaaagtttagaagtttagaaaataatgttctagttcacctaatgccacacccatgaataactatacttgaattgatgtgcacactttctggcatttatccagaaataaataaaaagaatgaaagcagccaggtgcagtggctcatgcctgtaatcccagcactttgggaggccaaggtgggcggatcacctaaggtcaggagttcgagaccagcctggccaacatggtgaagccccgtctctactaaagatacaaaaaattagctaggcatgcagcatgcacctgtaatcccagctcgggaggctggggcaggaaaattgcttgaacctgggaggcagaggttgcagtgtgctgagatggcaccactgcactccagcctgggcaacagggcaagattccatctccaaaaataaaaaagaatgaaagctagagacagtaggagtgacagagagtttagttttttcaaggagtccacaatttacatatttttctacaacatgcttttctcttttgactccataagagtatatatttatctcactgctttagactagatattaataaataatatgagtctactaaaatttatacaattctatttcctaattttgctattagaaggttttcattaacttattttcaatgcaagttacataatattatagataatatgcatattactgatactataaacaagcgaatgaatataaacttctagatgagttctgtgatccccattgtacagaggaagtaactagagccaaagggagttataggcttttttctactaatggatgagacaaaaattcaaaaccagggctgcttatttcctttccactgcacaatattgactatgaatgaagcctgagaaatccagcactattcatatattaagcatgtttaaaatgcttgggaaaactcccatgatgtgagtttacctatgtaacaaaccttcacacgtacccctgaacataaaataaaagtttaaaaaaatgtttgggcagttggccattttcttcgtagcactcatttgattagaaaacaccttcagcatagatgaaataaaatatttcatactgaatcaaccaaccgctaactcgatataaacatagaaatgtataaattctgcatgaaattgggggtggggcttgtactacttttgttagctcctgaaaagcatccccataatttcatattattttatttcaatccaaatgattgaagtcaaattgatatgatgaatgtcattactctatcaaaattctagcttaagtagacctctggcctattctaccttcttctaataaaggtttatcccaataaaaggaacactccttgaaagaactgtatttctttcattttacagtaaatttaccctaggaagaaacttatacgaacttactatacttcagtccttgttagatgttaaaatgaagagaattgtttcttgttcctcaactacagaattgaaaaaaaaaagtaatagaaaatgtaaggctatttctcaggcatccattacataatgaggttattttgcttgtaaagaatatcacatagatgagagatgcagtctagggatactaatacaaagacacgttgaagccttcaaacatatgtgaaccatgaacacatttcaaaaaaattctctctaattctattaatttccaaagctggaaccaaaattaaaatggtaagtggctgtgaacaattataagtttctaaaaaagtaaaaaattacattttagcattactttaaaaatatggatagctgtttaatacagaggaaaattgtcaatctatgtttctaagaactatacacattaggagttaggatacttctaagacaatctccttcgattttgaagatgaatccatttcatcttacatcaagtaaatcactctttacttgatgattataaatacatttcttaaatttgaaaatgaataacactattgtatttgtcataaaaatacaaatagaaaaaagtgacttgaaatatagagccatttcattgcaagaaatctcaaagatttcccttcttttctgggtccttctcttggtcatttctagacttttactagccatgacactaggaaacagcactgaagtcactgaattctatcttctgggatttggtgcccagcatgagttttggtgtatcctcttcattgtattccttctcatctatgtgacctccataatgggtaatagtggaataatcttactcatcaacacagattccagatttcaaacactcacgtacttttttctacaacatttggcttttgttgatatctgttacacttctgctatcactcccaagatgctccaaagcttcacagaagaaaagaatttgatgttatttcagggctgtgtgatacaattcttagtttatgcaacatttgcaaccagtgactgttatctcctggctatgatggcagtggatccttatgttgccatctgtaagccccttcactatactgtaatcatgtcccgaacagtctgcatccgtttggtagctggttcatacatcatgggctcaataaatgcctctgtacaaacaggttttacatgttcactgtccttctgcaagtccaatagcatcaatcactttttctgtgatgttccccctattcttgctctttcatgctccaatgttgacatcaacatcatgctacttgttgtctttgtgggatctaacttgatattcactgggttggtcgtcatcttttcctacatctacatcatggccaccatcctgaaaatgtcttctagtgcaggaaggaaaaaatccttctcaacatgtgcttcccacctgaccgcagtcaccattttctatgggacactctcttacatgtatttgcagtctcattctaataattcccaggaaaatatgaaagtggcctttatattttatggcacagttattcccatgttaaatcctttaatctatagcttgagaaataaggaagtaaaagaagctttaaaagtgatagggaaaaagttattttaaatcagccccagttgttaacattcaactcaacaaatcatccaacatagctgttctgctaaaatttaatttttccacaataaggaatatgtagaaagatgtcaaattaataatctaacatcacctctagaggaatttaaaatacaaaagccaacaaatcccaaacctagcagaagaaaaaaataactaaaatcagaacagaactgaacaaaattgagacccaaaatttatgcaaaaatttaatgaaaccaaaatttggtttcttggaagaataaataagattggtaggctgctagccagattcacaaagagaaaagagggaatatctaaataagcacaaccagaaagaacaaaggtgacattacaaccaatcccacagaaatacaaaaaaatactcagagactattatgaacacttccatgcaaataagctagaaaatatagagaaaaatggatgaattcctgggaacatacagcctctcaggattttatcagaaagacactgaaaccctgagccaatcaataccaagttttgaaattgaatctctactaaaaaaaacctaccaaccaaaaaaaaaaatcccagaccaaaagaatttgctgtcaaattctatcagatgtaaaaagaagagctggggccaattctagtgaaactatttggaaaaattgaggaacagggactcttctgtaactcattctatgaaactagtatcagcctgatacaaaaacctgacaaagacacaatgaaaaaagaaaactgcaagccagtattcctgataaacatagatgcaaaaccatcaatgaaatactagcaaaccaaattcaacagcacatcaaaagttaattcaccatgatcaagtaggcttcattcttggatgcaagattggttgaaaatgtgcaaatcacaaaatgttattcactacctaaacagcatttaaaacaaaaaccatatgatctcagtagatgcagaaaaagccttcaataaaatgttaccttcttttataataaaaattctcaacaaaatagggatcaaagcaacatacctcaaaataaatgccagctatgcaaaattcacagccaacatcatgaatgggcaaaaactgaaagcattcccctttgagaactggaacaagacaaggatgcccattctcaccactgctcttcaagatagttctaaaagtcgtaagcaaaccaacgaggtaagagaaagaaccaaaaggcacccaaataggaaaagaagaagtcaaactatctctttttgtggactatatgattctatatctagataactctaaaaactctgccaaaaggctcctggagctgataaatgaatttactaaatttttaggtaacaaaatcaaagtacaaaagttagtagcacttctaaaccccaataatattaagctgagagccaaatcacaaatgcaatccaatttacaatagctaccaaaaataataaaaatattaggaaaacatcagaccaataaaataaaatatctctacagagagaattataaaatactgtgcaaagaaatcagagaggacaaaaataaatgggaaaacagtccatactcatggattagaataatcaatatcattaaaatggcgaaactgcccccaagcaatctacaaattcaatgctgttcctatcaaccatcaatgccatttttcacagaattagaaaaactattctaaaattcatatgaaactggaaaagagcccaaatagtgaaagcaatccttagcaaaagaacaaagctggaggtttcacattacctgccgtcaaaacatactgtggggctaacagtggcaaaaagagtctggtactattacaaaaacgatgacatagactagtggaacagaatagagaacatagaaagaaagccacacatacacacacacacacacacacacagagagagagagagagagagatctgatctttaacaaagtcaacaaaattaagcaatgcagaaagaacttctattcaataaatggtgctgggataataggctaccaatatgccaaataaatgaaactagacgcctacgttttgctatgcacaaaaactaactcaagacggattaaagatttaaatgtgatacctcaaactaaaagaattctagaagaaaacttgggaaacatcattctgaacatcagccttgggaaataatttatgactaagtcttcaaaagcaattgtgacaaaaacaaaacttgacaagtgtaacctaattcaattaaacagcttctgcatagcaaaagaaactatcaaaagcatgtacgggaaacctacagaatgggagaaaatattcacaaactgtgtatccaacaaatctaatatccagaatgtataagtatcttaaacaacttaacaagcaaaaacaaataaccccattaaaaagtgagccaaggatatcaacaatcaacagacacgtctcaaaacaagacatacaagaagccaacaaacatatgaaaatatgctcagcactaatcatcagaaaaatgcaaatcaaaaccacaatgagaaagccatctcacaccagcaagaatgtctattattaacaagtcaaaaattaatagatgctggccaggctgtggagaaaagggaatgcttatacactgttggggatgtaaacccattcagccactgtggaaggcaatctggggatttctgaaagaacttaaaacagaactatcatttgacctagtaatcccataactggataatatttaaaagaaaataaagttttctaccaaaaagacataagtgctcatatgttcactacatcatcattcataacaacaacaacatagaatcaacctaagtgcacatcaatggtggattggataaagaaaacatggtatgtatacaccatggaataccacacagtcataaaaatgaacaaattcaagtcttttgtagctacatggatacagctagatgccattatcctaagtgaattaacgtggaaacagaaaagcaaataccacatgttatcatgtataagtaggagctaaacactaaatacacagagacacaaagacaagaacaatagacactggggactactagggggaaggagcaattggggtaagggttagaaacactagctgttgggtactattgtgtattagtacattttcatgctgctgataaagagatacccaagactgggcaatttacaaaagaaagaggtttactggacttacagtttcacatggctggggaagcctcacaattatggcagaaggttaaaggtgcatatcacatggtggtagacaatggaagagagcttgtgcagggagacctccatttttaaaaacatgaggtctcatgagactcattcactatcacaagaactgcataggaaagacttgcccctgtaattcaaccacctcccaccgggtttcatacatgatacatgggaatagtgggagttacaattcaaaatgagatgtgggtgaggacacagccaaatcatatcattccaaccctggcccctcccaaactttatttcctcacatttcaaaaccaattatgccttcccaacagttctccaaagtcttaactcatttcagcattaactcaaaaagtccacagtccaacatctcatctgaaacaaggcaagtcccttctgactatgagcctgtaaaatcaaaagcaaattagctacttcctaggtaaaatggggatacaggtgttgggtaaatttacagccattccaagtgggagaaaatggccaaaataaaggggttacaggccccatgcaagtctgaaatcccacagggcagtcaaatcttaaagctccaaaatgatctcctttgactccatgtctcacatccaggtcatggtgatgcaagagatgggttcccatcgtcttgggcagctctgtcactgtggctttgcagggtatatccccactcctggctgctttcacaaactgaccttgagtgtctgtgggttttccaggtgcacagctcaagctgtcagtggatctacctttctggggtctggaggatggtggccctcttcccacagctccactaggtggtgctccagtagaaactctgtgtggggactctgaccacacattactcttctgcaatgccctagcagaagttctctatgagggccccactgctgcagcaaacttctgcctgggcatccatgcacttccatacattctctgaaatctaggtggaggttctcaaccctcagttcttgacttttgcgcactctcaggctcaacagcttggaagttaaagcttccaagacttggggcttccacccaaaagtctctgacatgccctggagatatattccccattgtctgggtgaataacacttgatcccttattacttattcaaatttctgcagccaaatttaatttctcctcaaaaaattggattttcttttttatcacattgtcaggctacatattttccaaactttcatgctttgtttcccttttaaaattgaatttctttaacaccatgcaagtcacatcttgaatgctttgctgcttagaaatttcttgcattagatattctaaatcatctctcttgagttcaaagttccacagatctctagggcaggagcaaaatgtcaccagtctctttgctaaaacataacaagaatcacctttgctccagttcccaaagagttcctcatctccaactgagaccaactcagcctgaattctattgtccatatcattatcaacatttggggctaagccattcaataagtctctagagagttccaaactttcccacatttttctgtcttcttctggaccctccaaactgtttcaacctctgcctgttacccagttccaaagtcacttccacattttcaggttatcttttcagcagcaccccactcctggtacaaatttactgtattaatctgttctcatgctgctgataaaaacatacctgagtctgggcaatttacaaaagaaagaattttattgaacttacagttccacatggcatggggaggccccacaatcatggtgggaggtgaaaggcacatctcagatggtgacagaaaagagaagagagctcccatttttaaaaccatcagatctcataagactcatttgctgtcatgagaacagcacaggaaaagctcacccctataattcagtcacctcccaccgggttcctctcatgacaagtgggaatagtgggagttacaattcaagatgagatttgggtggggacacaaccaaaccatatcatattaaaatgagagacttccctgatcctcctcacaggaagtgtgacaggggtgtggcttgcctgtttggctgccaccaagcaagccaccactgctcaaacccctgacaggagggtgagcatggagatgagcagttgcaggagccagaatgtgtgctttggtctccagccccatggtagtgtccaggggtgggtgcctgcagccccagtgttacaatgctcttttagccttgccatctgcagagggcttaagtgttaaccagctcagtgaatcctctgcctacccacaagggcaaacggccagtgtgacagctttctgcatcccgagctcttgtccagcatcccagaagaatcaggtcacacatgagcttgaagggtgaatgtgtagttattgaagtggttctcagtgggatggatggagaactggaagggggaaagagtaagaggatgaccttcccctggagttttggccatacattggccaaactcctcttcgattgcccccagctgaactcctcttgctgttcagtcattccttttcttctctctctctctctgccacaccattctgccatttgtcttgtttgtctccttgtctcgtctcatctgcttctgaagcctggtgtttggggtttatatgggttgaggataagggggggcatggtgggccaaaaggcaatattttgggtgcaaaaacagaaatgcctgttcctacttagggccatgggtctccaggcttgagagttaggcctttgccagggtactgccctcttctacccagtatttccctgtctcctgtccatatcatttccccctctgagtaggcacatctaactgctgctagaatatgggcgatgaccaatcttagctacttcttgttgacagtgggcatagttttggggaaaatggcagtcagattcttcctagaggtctatctaagagtccctggcaaaggggaaccatcgtctgagggtcagattgcctgactgtttggagtttgatggcctctatgtgagagagaaaaaaaaaaacaagttttgtaaggttaagtgtgcatgcgttaaatgtgtattatacaaggaaagaatctagtgccaaagattacagaaataagaagtgtacagaataagaatggtaattattctaaaaacactattgtgccccatggtatagaacagaacaaaggtaagaacagcaagcataggcaacactataaggaggatatccatggaagttaaattcataacacttatcttttgtgatttttagcttgaggtccatgatctcttcacattggtactttgggtgctcttctgggtcaacggcggtgactccatcaccttcccaggcctttactcaggtataatgaattcaagagtctatttctgtgaccttcactgccctaagagtagaaagaagaaaagtgtaaggtccctctcaacctaggcctatagaggaagaaaaggaaggaaatgcctttactagcactagggaccctaagttaataatagaggtcgccctggttcatgggattgggcctctgacaattgttgcagtttctgttggaaatgggccaacgaggttatgtatttaattaaatcagaggtttcttggtctagaaagaaataattggtgagaaaaggctgtccatacatcatttcaaagagactcaaacccagctttgaaggagtgtttctaatatgtagcaaggatatggggagaagggtagtccagcagagatgagtttcctgagagtttctcaaagagactcaaacccagctttgaaggagtgtttctaatacatagcagggataaggggagaagggtagtccagcagagacgagtttcctgagagtttcctgaggtaccttttgataatatcatttgtcttttctacctttcctaaggactgtggtctccaggcacaaaaaagatggtactgtatacctagtgcttttgagaccccctaggtgacagtcaccttgaacaaagagccattatcactcgggaggcacttagggagtccaaagtgaggaattatctcattgattagtacttttatcacctcagaggttttctctgtccaacatggaaattcttctacccagttaatgaaagcatctatccatactaggagattctggatgcctcttgcttttggcatatgagtgaaatccatttgccaaaaggtagcctttgtcctctgggttcctgagggaagaagccatcaattaagaggattgtttttaaagcaggtctcacaagcattatcgacctgtttaattgtttgtataaggtttttgcctgagaacaatctctgagagagttgataagctttattcttacctaggtagaaggactggtgaaggcttttaagagtttaccattggttggcagctggtatatgaagcttgccattgtctgattgtagctatcctggggactgaaggatgtttccccaagaggtggcccattatatttccacaggagaatattgaggttttatttctcttatgggtccctcccagatcagtggggcttcaagtgggtcagagacctgggccccccttactgatggatttagctccttggtctgccagcctatttctcttggctatttcatccatccctctttggtggcctctacaatttattactgccactttccatgggaggaaagctgaggatgatagtctgtaaatttcctaatggtatttaatgggagacccattagctgtaaggaagttcgtctctttccagatagtggtatgggcatggaggacaaggaaagcatacctagaatctgtataaatgttaactgtttttcctttgcttaattcaagcaccctcatgagaacaattttttcagccagttctgcacttttgccagagaagagatgtgcactctcaacaaaatcactcagggtaactattgcataccctactttatgggtttcttattctacaaaagaactcctatctgtaaagagaatccagtctgagatctctaagggggtttccttgaggttctctctggctgcataggtttgtgctatttgttcacagtcatgttcaggttcctcagcttcctctgggaggaaggtggctggatttagggagcgacaggtttttaattggactgcagatccttctaataacagagcttgatacccaaggaggcagttgtctgatagccagagactccccttaaaagatagtagtcctgccacattatgtgaggtatagacagttaaattattctccatggttaacttagtagcctctggtaccagcaaggccactgctgtgattgcccagagacaggctggccatcctttggctaccaaatcaaactccttactcaggtagcctacaggcttctgggctgaccaaaggcctgtgttagaactcccactgtcatttcctttctctccgacacaaagattaatcatttttcctatggggagactaagggctcgtgccttaagcaagacttgttttactcagtcaaaggcctttctagcctctgattcccatattagacagtgaggtttaactgcctgagtctcctttcttaggtgttataagggacaagctatttcaccatacccaggtatccaggtctgcagaatcctgcaatgcctaagaatcccctcagttgcttgagggttgcgggaagggaaaatggaaaatgggtttaattttctcttcacccaacactcttgtgccctctgagaacaccaggcttagatacttcactgaagcgtgacagagacgagctttagattttgaaaccttatatcctcagttagccagaaaattaagaaaagccttactgccctcctgagagatttcctcagttggagcacagagaagaaggccattgacatattgtaaaactttaaactaaggataaaggacagaggattattgaggtctctcaataatccctgcccaaacaggtgggggctgtctcagaagttctgaggtaacaccgtccagggtggtttggttagagggatcctcaaatgcaaacaaatactgagagtcagagggtaatggtatgcagaagaaggcatcccttaggtccagcactgtgaaccatttagttccctcagatgtttgagctagcagggtatacaaattgggaaccactgggtgtattggaaccacagcctcattaatgatatggaggtcctgaactagtccccattcccctttgggtttttgtaccccccaatattggggtattgcaagggccatttcagggtttgaggagggcttgcctcttcaagttatcaatgatggcttctagtcctttcctgacttctggtttcaggggatattgtttctggttaggaaaggaggtaagatccttaagatggacctggaccagtatggtggttgtggctctgccaattttccctcgagttgcccaaacttttggtttaaaatggtctccactaggggcagacaaaaagtttgcacaggggccatcaggatggggtccccatatgaaccagaatatccccacccaacagaggatttgggctttccagcataattagaaaagcatgggtgaaccaaaggtctccccagctacaactaagtggttgggaaaaagatcaggttaaaggcctttcctgatatgttcctcatggtcttactaagagaggagagagggtccataatggggaggagaactgagagactagccccagtgtcctaaagatggtctacttttttccccttcaatttccagaattatctggggctctcggatgataataatggtctggaacaccagactcaagaagaagagccccaggacctgtcaatcctactgctggtgtccccaatgacaatctaccctccaggtttccccacgacagattggacaggtcaaagtggcttccttatgctgcctgggcaatccttcttcaaacgccctggcttggcccatctgtagcagttaacaagtgcaccctgggaattctgggtttgtgggcttgcctggcatccattaaagcctctgtctcttttctgtatttcctctctctctctctcctgggcacccctatctctattgtataagactgacatggctacttgcaggaggttctgtaaagtattatctggtcccagggcctgtttttgcagcttcctcctgatattaggggctacatgagtaataaatttatgctttagggttagttttccatttgactgaatcagaagatagagaggtgtgctttatcaaggcctctcttagctttctcaggaagacagtgggattttcatcaaatccctggtcaatcatggataacttagtataattgagaggcttagtcttagtcctatgtaatccctccattatgcacacctgaaagtgtctcctcttccagcctcccgtcttgtcattgggatctcatttaggtcatccattggtactgcttctcttccagttagaggatttcacccccttccctgatgctatatgtgataaaaagttcatccccaaatctctctgctgcttgtagagtggcctgcttcccagtctttatcagggtctaattcaaaagtaacataacatctctccaggagagttcaaattattcagtgaaattctggaaagcctctatatattgatcagggccatctgaaaacttgtcgagatcccccttaatttgccttaactcttaaaaggagaaggagacttggacctgactgaggcaaaattaaccaggcatctgttggaggggcaagagtgagactaggacttgtctatggtgaggatttctaagcgggggcaagtgtaaggctgaagttggatagggaggtcagggccgacctggaggaacagggctggaaggagctggctcctctgctaggggtgtctctggaatttgtatttttagtttccttggcttgccccttgcagcctttcctgagatggttaacatgagggctggattaatcctacactgtcagcgaaggcctgggttgttctgcaagttacagaaagcctgcaaatatggggcctcagatcatctgtctgcacatctacagaaaagataacactgcaggatggtattgaaataaattgttccttcctaaggcagatccagtccttcataatttcaccaaacctctgtgcagagggctatgaggcatttttcttccagattctaagggtcatagcagtcccagtggttcaggatagactccaaaggaatataagcaaagggtgatgaaaagagctggttgcccattcagaaagacaaggaaatagaggtgactctcatttcccttccttctttcagtgaaaactcagagtgtgaagagagagaaaacaagtgtcccctttttctcttccatcttttgtccctgagtcctggagaccttggcagctcccacccatgggtgccaatgcgacatgtacccatgatgcagggaaggcctagagaataggaattatttgccctcacctatgcctccatcctccctactgctggcaacctttgagatccctgggctcatttatgttatggagcatggcctccttccatgtggtgggggtttagtcagcaggaattggtcctgcccattcacattgtgcctgttgcctggctttgactccctcagatctggttttcctttctaaggattcagcctgaagcttggaatcgaatttgagacaaaaaaagaaaaaaaaaaggtatttcaggggctgtctgtatctgtctagatggtctcaaattagccctgttgaatttgcagttatcagccagcaggggtcgctcctctattatttttcctatcataagcagcgtgctgtggataggagccctctcatttagaaaagaaaaaaatagtttaagaggcaaaagtgagaggtcctgggggaaaaacaccttgctcagtgcaaacaggttcctttatcattgtatccttcacctggttcagaccagggtgaccttcttggtcaggggaggaaaagttccatcggcatggcaggtgggaagtgctggacagctagccacatgaggccccggcagcagttgtgattttctcccacccctcgtggccattgggcatggcttatgcatgctgtcgacatgcccaggcacccaagccaggaagggagtgggcgaggagaagaggtgtcatgcgctgcgcgtctgtgactgtcaggttcaggatggggatggtacctctaagaataaacagaaaccacattgttctgaatttcacctttgatggctgcgccaaatgctcattatatttagtatcattgtcgcggtttgtagcaaaacccttaacattatcagggaagagataagaggcatttcaaaccttgagagaagtaaagacaccaggcaaagtctgggagtcttggccaacggagttgagtcttggggccttccagaaaaaaaaaaaaaaaaaaaaaaaaaagcccttcggttgccctagagctttactccagttctgtggtggatagacttctctgaagagaaatatagtcaatgttctttttgtctgtaggaaagagagaggtggcagggtcttggaaaagacacagatcctcattttaactcacccttctttgtatcccagatggggccccaaatgaaatgggagagttccctgattccctttgcaggatatgcaataagggtgtggctcacaggtttggtcaccaccactggtcaaacccctgataggagggagacggggagcacgcagatggtcaggtgcaggagctggggtgagtgctttgagctccggccccacaggagtgtctaggggtgggtgcctgctgccgcagtgtaaaaatgctcttttagccttgccatctgcagatggcttaagtgttaaccagttcaatggaccgtttgcctttttgcaagggcagagggccagtgtggcagctttctgtatcccaagctcttgcccagcatcccagaagaattgggtcacacacaagcttgaaaaatgaatgcagggctttactgagtagtggaggtgattctcagcaagatggatggggagccggaaaggcgatggagtgggaagatgatcttcccctggagttttggccatccagcagccaaactccccccaactgcccccaggcgaattcctctcggcattcagatgttctttctcttctctctctctctgctgtgcctttcttccatttgtcttctgtcgtctcctcatttctttgtctgcctctggagtctggggttcagaacttatatgggtataggataggggggcatagcaggccaaaaggccacttttggagtacaaaaacagaaatccctcttttcacttatttctggcgggtctccagccttaaaggtggggcctttgccagtgcactgccctcttctacccagtatctctctgtctcctgtccatatcactatactcactacctgggttaaggaatcattcacatcccaaacctcaacatcttgcaacatacccatataacaaacctgtgcatgaaacctcgaatctagaataaaaattgaaattattaaaaagtaaaataaaataggaaacatattcacattataaaccaatgctgctttttttaaatagataagctctttaagattggaaaatataatagatatatctcctaaggctaaaaattgcttcccaagagatactgacactatattagttttaaagtttctgaccaccattcaagcagaaaggaattaaatgaaaacactctctctgtaaagatagttagggagatgccaaatcacaaagaaaatgttgtaacatttttctagaagttatctagtgttatctagatgttatggatggttaattagtttctttattggctctgaataatggtgtgactcatcctgccaccaggaaagatgaatgtcctcactaatatggaacataaaggtgaggaaaatacttgctcaacgttggattcccaacatccaccatattctcagcacattgtagtatctgaataaacatctgtggaagaaataaatggacaaaggaaagtggaaaggaaagaccagaaatctagacagagcattctcacagggattgagagaagtcagctgcagtccagcacagctgtctctgggttgaaaagtgaggcagcaacaagagctttgcccaagcttactgggtgaagcaactgcctataacaacattgaacagtgttattgtaaataaacacacagaaagtacatgtctgtcattttatatgcagaaaggtagaataaaagagcaacaggataaatgtgagcaggttaattccctcagctcctcaatgtcttaacgttataagtttttcaatacacagtttatggaataaaatatgtgaaaccagcttggtagcttgagcaagctatcaggaacctccaaggattgttgggtttttattactaatgtttctttttgaattttgaggtcaagtttgtggatgtgtatgcgtgtatgtatgtgccacagaagacataggggcagaagggtctaatgcaatacaggaagtatagacaccaagaagaacatgggcagagctgtcacttagcctagaggagtagtgggtaatcttggcagtggatgcatgtgtgaggcctccatcattcctcaccagaaaaattacacatttcatggattaatcctcaacacctgacacatgattctttgcatagataacttaacagtacagttaagaaagaagtcaggctgatgccaaggatattgatcctactgccaatatcgtactgccaaggatattggtgctcaatcttctatgaggcagaagataatggttatctatcactacagtgaatggggaagtgatttggggggatagtaaacataacagtacatcagaattattccaggtggagtggaatggagtggaatagtgccactctataagacttagattaggtagtggtcctcattatattgttacaggatccttggggtgttgcttttctggcctgaaacctctggctagtggcacctttgcctgagttttgcttgggcccactgggctcattccaccaactcggtctggcaggctgcactcagcttacactaccagcctggatcccactcctgccaagggcaagtcaggcatggagtggtgaggggtgtgtgagcaagcgtagggtccagcaactgcacagtcagatatgctggctgccacagcaaagcaggaagctctaggtgctggcacaggaactggctctctgtgaggctgtgtctggaccaggcacactacaggcagctttcctggctggcaccagggaacatagtggcacctggaagcttggagatgccaggcaccacaggaccccataaaggaaggcacagccttggctcaggaagctcctaagtctgtgctcccaaagaggctgaacctcttctttccttctcttcacccacaacatggcaagtaaggggcatgtttcagctccatttgtgttatagcttctttagctccaccattcagtgggtcctgagttcttgtcctgtgaccaggaagaatctggtacacagagaaatggagggtgagcaagatacagaggagctttattgagcaatagaacagttcacagcagacttgcatggggtagtacctttctgcagtcagggtgtcctgatgagtgttcagatcctagcacagaggagaccctggagtgggaagcttctctctgcaggcaagttatcctgttgtcttcccggctctcagcagacagcaggcccttgagtgggtaacttctctctcctggtggtcatcctgatgtctcctgctatcagcagagagggtagctgctctatgcacctagtcgtcccatcatctgccaagctctctctgagcacggggcttttatgggcctcagatgggagaaagcgcatggtgattggtccatgagcagccatgggtaggcccagaaaatacgccacaagatctccctctggtcagtgggaatcgcagccaagcccaagtcttctggccctccctggcctgaacatggggtgcacccttctgcccaggaatctggctacatcctgctgccattcatagcccctggacttggtactgactttgctctgagatcagagtgggcacccacagcagggaaaagccaggcagtgagagcaggcatttccaagcctgtggggtcagtggggccttcctgggacctcaagagtggagggatgcctgagtctgcagctgtggtttgggtggttgcagctgcacagggttggggggagaagccagggatcctgccctctctgtggagcaagaggccctttgcagccatggtttgagcagcagcaatgacacccagggagctctcaccctaattcgaaaggggcagggctcccacttgtccccagcttctgctgggcccacggagcatgcagccccagccacacctccctgctgcagctggtgtgatggaagcaactggccaccaggagcagccgcggccatcaatatccccaattaatccaccaatccaggaactatgaaacccacactgattatggcagaaaatagactattacaatcttagcctaatggaagcaccaatctagctgccatcccagatgtgcaattgttactggaacaaacagcctctagaagtattcactggcactaatttggaaatgtgttcttttccacacttatcaggaagcaagttcagaagcaacgtacattctcctagcatagccatccccaaacattcccccaaattcccagggctagctgaactctcctcagccacagcgtagcctgtgggaccttgatcatcgggaaaactctagaacattgctctggtccactatattgatgacatcattggacctgaggaagaggaagtagcaagtatcctgtagaagcaagtactctgtagtagtttgttacagaagcaacaggaacaggaaactactgcaatactcatgaaaaataattgtaccaagtaacatgtacaacaaagtatatagtgatattgtgtatagtagaaaaatctggaaactactccaacatccattggcagaatgtcctaagaagcagacaccaagatgggattacacatgcaaacattttgttagggggatacctatgtaaaaggaaatagggaagacaatgagaaaagctaagaaagatgcaagtcagaccccaagtcaagaagagaggaagacaagattgagcagaagcatgttagactgtccaaagttattgagaaatccttgaaccaaaatggactgacaaaggagccctgtgtctcccaggtatgggtctaccttagaatccattttgcacacagactttagcaaggagcagcccacaggaagttgggtgtcagaaaaactactacaaaggatttcaaagtgagaagctgagatcctgggtcatttccactcatgagggagatctacaaattcattcacatggctgctacacagatgaaggaataaattaattagattttaatcacataatggaatatcgtgcagcagtgaaaatgaatgaaccactgctacaacaacacaacaaataagatttagtactgttgattttttttaaaaaatcacagaataaaatagaagaaaatgtttcattaacttcagtaacaggcaaactagaaaatatatgtttcaggggtgtgtgtgtgtgtgtgtgtgtgtgtctgtgtgtatgtctgtgtgtgtgtgtgtaaagctatacatcaaaaaataaaagaatcaaagaaacattcataatgttgctatttgcaggtaaggatgagggtaagcagatgcaaagtacagggaaagagaacattggtaagtatatattgtagataatttttgagactttggactggattattcatttaataaattattatgtaattaatattaagtggggctgtgcatggaccaatggcaacagtgtgtcatgaagcagggtgatgactaatccaattctctgcacattgttatgatgtttaattaaaataaaatttcagaaagttcagaaaattgagtgctttctaagaaacttcttattacacaaaacaggctatgactttacattgaacatcctcagggagactgtgtactcacctaaccactgctgtcacccccacaatcaggtcattcaggagtcagtatatgaaaggaaaattctttgagagactagccctaatccagagcaatgcaaatgatagattgtccctttagttaattcaatcaaattccattttcagtggtagaggggggattagagagactagatctaacagctaacacttatatttaaattttatacctaaatgccatcagtcttaatctctgaagtgctcaataagaaaaaaaaaaacttgagttttgtatgcccttctttggaaaattttaggcctgagtaagaggaagcggcaattgctctgtagtagtttgttacaggagcaataggaacaggaaactagtgcaatatacatgaaaaataattgtaccaagtaacacatacaataaagtttatagcaatgttgtgtatagtacaaaatattgcctcattctttttcatgaggcaaaaacggggcaattaaagatatcaatttaaaaacaaaatactttctcggagggcaacatatataacttaattcacataaaataaaaaaaatcattcttcatagaaatatgaaaagatatccaacctggctcatatgagaaaaggacaaacaaattaaattatttttcacctataaaaacaaccaattttatataagttttgtaataatctgttagaatttggagaaatagtcactagatttggtagaagtataaactggtagagcctcttgaggtatcttgataagtatcaaaagttatcattatcataccctttactcagtttcctctccaaaataccttttattcctacagatatattcacgataatatttacagtaacattgtttatattagtaaaagattgaaaacaatctaaatgtcaaacaatggggaaaactgtatgattaaacagattaataaatgcaactgttcaataaaatataatacaaacatttaaaagagtgaggcttctcttttcatactgatggagacaaatcacccaaaagtattaagcgaaatgaaggctgagcaatgtgaataatacgttgtcttttgttgcaggagtgaataaagaatatgaatataatatgttttcaaatgcagtgcagggcttgtatatctggaagaataacaggagcttgtaacagtggtgatctccagggaaggaaactgaagattagaaatcaagggatgaagggggacatggtttttactctatacacttttatacttctgaatttaccatttggtttgttattcatcacccatccaaaaaaagagaaggtaggggtaagaagaaataaaagcaggaagaaaggaaatacagaggagagaaatggtggaagaataaaagagagggagggaagaaggttaatagcaagttgcccatagcagggcaaaaactccctgatggcattaaaacaagaattttgttccccctggagagctcaactttgcttcagcagaaaataactagcaaacattgtttttgccaattacatctgagaccctggaacctcaggttctcaagggagtgggtattgatctcttatgccccagcaatatacttgctgatgaggaggaactgaaaagagagaccttggtcagcaatcagtgccagttgcaggaagagaacgtgtaggcaacctccaagtaagtaaaacaaagcaaatagcttttttttcaaaacctgccatgtaccatgccagtgcatggtggaaattttggagcaaaagattagccaaaaccccagaaggtttcacctcaaaaccaggaggaattatttcatccttggtgatttactgaaaataaagggatgggcttgattcagtctgagtatcacctgggagaaaagataaatgaacaaatgattgaatgaataaactgatggctcaattaaccaatcaatataatatgcctttaatgtattatttgcattgttattaaagtcatttgctggtcatatcttccatgcccagccctgtgctgagaaatgtacataaattcacataaatttgcttacttaaacctcacatcactgcacaatagactttatttttctccttcattttttaactttttattatgaaatacttctagattcacaggcagttccaaagataatagggaaagttctcaaatatccttcacatactttttcctcaagggttcgatcttacataattataatatgacatcaaaacaggattttggtactgggacagttgtgtatatagctctatgtcatttcatacttgtgtagatttatagcactaccactgcagtgaagatacagacttgatcacacatctcagattctacatgtctcctttgtaccccttctgatcacaccatgctcctccccttaccaccccaatgtctggcaatcaccaacctgttctctgtttctataattccgtcattttgataatgctttgtaaatggaatcatatagtatatgtccttttgatgttggcttttttacactcagaataatgcccttgagagttatctgagctgctgcatgtatcaatagtttatttctctttatttttggtaatattccatagtatggatataataaaattgctaaactactcatttactgtagggcatttgattgtttacagattttggctactacaaatgaaaatgttatcaaaaaattttgtacaggttttcgtgtgaatataagttttatgcaaatataattgcccacaagtccaaggactgtgttgtgtggtaagtgtatgtctagcagctttttacaaaactgccaaactattttccagagtgactaccattttcaccagcaatgtatgagtgatccagttactctgagtcttttccagcatttgctattgtcacagtttttttattttagccattctgcagtgacatctcacttgtagtgtagtgatatcacattttgttcttactttgcatttccctaatggctaatgaagttggacaccttttcatgtgtttatttaccatccatatagccctttttggtaaaaagtctgttcatgttgttcaggcattttccaatttgattttttttttcagtttgggagttcttttttattattattattatactttaagttttggggtacatgtgcacaatgtgcaggttagttacgtatgtatacatgtgccatgctggtgtgctgcacccattaactcatcatttagcattaggtatatctcctaatgctatccctccccactcccctgaccccacaacaggccccggtgtgtgatgttccccttcctgtgtccatgtgttctcattgttcaattcccacctatgagtgagaacatgcggtgtttggttttttgtccttgcgatagtttactgagaatgatgatttccaatttcatccatgtccctacaaaggacatgaactcatcatttttcatggctgcatagtattccatggtatatgtgtgccacattttcttaatctagtctatcattgttggacatttgggttggttccaaatctttgctattgtgaatagtgccgcaataaacatacgtgtgcatgtgtctttacagcagcatgatttatagtcctttgggtatatacccagtaatgggatggctgggtcaaatagtatttctagttccagatccctgaggaatcgccacactgacttccacaatggttgaactagtttacagtcccaccaacagtgtaaaagtgttcctatttctccacattctctccagcacctgttgtttcctgactttttaatgattgccattctaactggtgtgagatggtatctcattgtggttttgatttgcatttctctgatagccagtgatggtgagtattttttcatgtgtttttatattctctaaacacacgtcctttatcacatacattgttcgaaaatattttcttccagtgtagcttgctttttcatcctcttcactgggtctttaacagagcaaaagttttaattttaatgagatccaattattgaatttttgaggaggggattgtgcttttgatgtcgtgtctaagaactcctcacaacacctatcctaaagttttaccctaaatattttgtcttagattactctctaaaggtttaatggttttatattttacatttaaagctaagattcatgctgacttaatttttatataatgtatgaggtttaggtttgggttcatttttttgcctatgaatatccaattgtctcagcactattttctaaaaagccttcctccattgaattgaacctgctcaaaaatcaaatcactgcacttgtgtgaatctgcttgtggattcactattttgctccatctttctatctatctttccaccaattccacagtgttaattatcgtagatatataaaaaatcctggtgttaggtaaagtgattcatctcatttttttctttgtttttggaattgtatcagctattctaacttctttgctcttccctatacatttagaatattgttgtttacatgctaaaaatactatgctgagattttgattgcattcgtgttaaacctgtacatcaatctggggagaactgacaccactgtgtggagtcttgcatctcctaaacacaatatacctatttatgtagatcttctttgatttcttttatcagcatattataatttgcatcatcaagtcctgtaatagttttgttatatttctacctaagtatttcattttttgaactattatgaatggtgttgtgtttattccagcttccacaagttcattgttatgaaaatagtatggactttttagaactatctcgtattctgcatcttttctgaactcacttattacctctagaagtttttggtagattcttggaatctgctacgtaaaccattatgtcatctacaaattgcagttttacttcttcttttctgatctgtatcacttttatgcctatatatcctttcgtttgactagaacttcccaaactatgttgaatagcactgaagagaatgagtatcctcagctgttcccaattttaggggcaagcatttagtctgtaactattaagtaggatgttagctataggtttttatgtagatgttcttcatcagttgtggaaattgccctcttttcctagttttcagagatttttaagatattaagtagatattgaattttgtcaaattctttttgttcatcaatttatatgatcctgtgatttttctcttttagacctgaatatacccaacttggccattgtgtatgattttatacacatagctgaattctatttgctaaatttttaaaagatttttgcatctatattcattaaagatacagaactatggttttcttttttgtgtgctattttgtctgcttttgctagcagggtaatatgggattcataaaataagttggaaaatgttcttttcacatctgttttctgaaagaaattgtatagaattaagttaattctttttcatacatttagtgagttttccagtgatattttaaaaggaagtttttaaattataaattcaattctcttcatggctgtagggctattcaaataatcagtttcatatgggatagtttatactcctcaattaatggcttcatttgtcaaattaatatgtgtagagatgtttgtagtattctcttattatcatttttttctgtctgcagagtctgtagtgatacccctgtttttcctgacttagtaatttgtatcttctctcttttatctttgccagaccttctggaggtttgtcagttttttttttgtttgtttgtttgtttgtttgtctgtctttttttaatttattattattatactttaagttttagggtacatgtgcacaatgtgcaggttagttttattgattttcttcaaaacccgctttttgtttcatagtatttttaattgtttttctttgtccaattcattgaattttgtttttagatttattattctacatattttaaacttattttgttcttcattttcaatatttttcaagtagaagattatattaatgatttgaggctttttctctttttaatgtaagcatttagtgctatgggatgcccactaaacactgctttagctgcaccccataaattttaagtgtcgtattttcattcagttcaatgttttgtattacccttgtgactacctctttgacccaaggattgtttataaatgcattgttttgtttccaactgtctggagagtttcctgttacgtgtctgttgtttatatctcgttcaatttcattgtggtcaggaacacacactgtgtgaattccattcttctaaaattatatagattatgtataatctatcttgatatatgttctacaagtgctggaacaaatatgtattctagtcctgtgagatggactgttctataactatcactgatatcctgtttgctgatggtgttgagttcttctatacccttgctgattttccatatagtcctacaaattgttgagaaaggaatattaaaatcccaattttaattatagattggcctttacctcaattcaatttgttttcagtttttcctttatatatgttgtagtttacttgtctggtgcctacacatttaagattgctatttcttcttgatagattagcacttttattattatgtgatgttattctttgtccttggtaatattctttgctgtaaaatatactttatctaatatttacatagccatactttcattcttttgactaatgtttgcatgatatatgttttcttccttttatttcaaacctacatgtatcattatatctgaagtgagtttcttgtacacagaatatgattgtgtcatttttctgtccactcttccatattctttcttttagttgttattaaatgaaagaaacatgaaatatcagaaggttaagaaaatggaaagaggccgggcgtggtggctcatgtctgtaatctctgcactttgggaggccgaggcgggtggatcacttgagatcaggagttcgagatcagcctgacttacgtggtgaaaccccatctctagtaaaaatagaaaaagtagccaggcatggtggtgggcacctgtaataccagctacttgggaggctgaggcaggagaatcacttgaacctgggaggcggaagttgcagtgagccgagatcacaccactgcatccagcctgggcgacagagtgagactctatctcaaaaaaataaaaggaaagaaaagtaagtagaaagagcaaaatacaatagacttttcttctattttgagtttttaaaatgatgattgagggttgaagcaaaaattataacactgcctaaggcggttctcagtgcatgtggaggaaatggttaagacaattataagtgggagacagtaaagaaatgaaaaaggaagtaagctttccacacttcactaaaactggtaaaatgaacacaagttatgattatactaacatgtctcagagaaattgtgggtttagttccagaccacctcaattaaatgactctcacaataaagtaagtcacacaaatattttggtttcccagtgcatacaaaagttatgtttatactgcactacagtccattaaatgtgtaatagcattatgtctaaaaaagtatatgcctttatataaaaatactttattgccaaaaatgctgacacaaggatattaaatgaccacgtgctgctggaagatagtgctaatcgacttgcttaatgcaggattgccacaaacctttaattttattttttaaaaatgcaacatctgtgaagcacaataaaacaagccatgcccacataatgcaacacctacagcagccactaaaaaacatatacaaagatacctaataaaaacactatacaaaaataatcacttatagctgcaccaaaatgggattataagaaaaagttcaagaaaaagcccacagaaatgcgggaaaaagaaaagagaggaacaaaaaagaacagttaaaataatgaaatggcagacaactttagggcatcaatgaccacataaaacatagttttcttcatttttaaaacaataaagggcatgaattcccattataaaagtgaaagttcagaagtttataagtttagaaaataatgttctttttcacctaatgccacacccatgaataactatacttgaatttggtgtgccattttctggcatttatccacaaataaagagaatgaaagtaagagacagtaagagtgacagaaagtttagtttttcaaatggtccaaatttacatatttttctacaacattcttttctcttttgactccataagagtacatatttatctctctgccttaggctaggtattaatgaataatataaatctactgaaatgtatacaattctatttcctgattttactattaaaaggttttgttaacttattttcaatgcaagttacataatattatattttatataatatgcatgttattgatactataaacaagtgaatgaacataattaacttccagatgagttctgtgatccccattgtgcaggggaagtaactagggccaaagggaattatatgtctttttctattaactggtgagacaaaaattcaaaaccacggttacctatttcctttccactgcacaaggttgactataaatgaagcctaaaaaacccagcactacccatatattaagcatgtttaaaatgctagggtaaacccccgtggcatgagtttacctatgtaacaaaccttcacatgtaccaccaaacattaatgttaaaaaaaatgcttagatagttggccattttctttgtagtatccatttgattagaaaacaccttcaacatagatgaaacaaaatatttcatattgaaccagccaacgattagctcaatattaaacatagaaatgtacagattctgtgtgagattggaggggggggttacactagtttccttagctcctgagaagcatcctcatattttcatattattttatttaaatccagattactaaagtcaagttgatatgataaatgtcattactctattgaaattctagcttaactagacctctggcctattcaagcttcctctagtaagtgtttatccaaatgaaagaaacactttttgaaaggactgcatttctttcattttacagtaaatttaccctatgaagaaacttatgctaacttaatatacctcagtattcactaaatgttaaattgaagagaattgtttctgctttcttgttcctccactacagaacagaaaaaaaaaagcaatagaaaatgtaaggctatttctcagacatcaattatataacaggtttattttgcttgtaaagaatatcacctagatgggagttgcattctaaagatataaatacaaagatactttgaagccttcaaacatatgtaaagcatgaatatatttagggaaatttatctctagtttattgtactaatttcaagagctttatccaaaattaaaatggtaggtggctgtgaacaattgtaggttactaaaggggtacaaaattatgttttaatattactttaggtatggatgcctgtttaatatagtgaaaaattgctcatctatatttctaagaactacacacattagaagtcagtcttcttctaagacaacctttttccttttgaagatgaattcatttcctctttcatcaagtagatcactctttacttgatgattataaatacatttttttaatttgaaaatgagtaacactattgggagtatttgtcatgaaaatccaaatagaaaaaagtgacgtgaaatacagagccatttcattgcaagaagtcacaaggatttcccttcttttctgggtccttctcttggtcatttctagagttttggtagccatggcatgaggaaacagcactgaagtgactgaattctgtcttctgggatttggtgcctagcaagagttttggtgtatcctcttcattatattccttctcatctatgtgacctccataatgggtaatagtggaataatcttactcatcaacacagattccagatttcaaacacccatgtacttttttctacaacatttggcttttgttgatatctgttacacttctgctatcactcccaagatgctccaaagcttcacggaagaaaagaatttgatatcattttggggctgcatgatacaattattggtttatgcaacatttgcaaccagtgactgttatctcctggctatgatagcagtggaccattatgttgcaatctgtaagccccttcactataccgtaatcacgtcccaaacagtctgcatccatttggtagctggttcatacatcatgggctcaataaatgcctctgtacatacaggttttgcattttcactgtctttctgcaagtccaataacatcaaccactttttctgtgatggtcccccaattcttgccctttcatgctccaatattgacatcaacatcatgctacttgttgtctttgtgggatttaacttgatgttcactgggttggtagtcatcttttcctacatctacatcatggccaccatcctgaaaatgtcttctagtgcaggaaggaaaaaatccttctcaacatgtgcctcccacctgaccacagttgccattttctatgggacactctcttacatgcacttaccagtctcattctaataattcccaggagaatatgaaagtggcctctatattttatggcactgttattcccatgttgaatcctttaatctatagcttgagaaataaggaagtaaaagaagctttaaaattgatagggaaaaagttcttttaaatcagccccagttgttaacattcagctcaacaaatcatccaacatagctgttctgccaaaatttaatttttctacaataaggaatatgtagaaagatgtcaaattaataatctaacatcacctctagaggaatttaaaatacaagagccaaccaatcccaaagctagcagaagaaaaagtaactaaaatcagaaccgaactgaacaaaattaagacacaaatatttatgcaaaaacttaatgaaaccaaaatttggtttcttggaagaataaataagattggtaggctgctagccagattcacaacgagaaaagagggaacatctaaataagcacagccagaaagaacaaaggtggcattacaaccaatcccacagaaatacaaaagatactcagagaatattatgaacacttttatgcaaatagactagaaaatatagaggaaatggataaaatcctaggaacccacaaactcccaagatttaataaggaagaaattgaaaccctgagcagaccagtatcaagttctgaagtgaaaacagtaccaaaaatctaccaaccaaaaacaaagtacagaccagatgaatttgcagtcaaattctaccagatgtaaaaagaagagctggtgccaattctactgaaactatttcaaaaaatcgagcaggagggactcctttgcaactcattctatgaaaccagcatcaggtctctgatactaaaacctgacaaagacacaatgaaaaaagaaaactgcaggccaatattcctgatgaacatagatgcaaaaccatcaatgaaatactagcaaaccaaattcagcagcacatccaaagttatttcaccatgatcaagtaggcttcattctttggatgcaaggttggttcaatatatgcaaatcatgaaatgtcattcaccacataaacagcatttaaagcaaaaaccatatgatctcaatagatgcaaaaaaagccttcaataaaatgcaacatcccttcgttgtaaaaattctctacaaattaagcatcaaagcaatgtaccttaaaataagtgcaatctatgacaaatttacagccaatgtcataatgaatgggcaaaatctgaaggcattcccccttgaaaactgcaacaagacaagggtgcccactctcaccatagttcaacatagttctagaagtcctaagcagagtaattaggcaagagaaagaaacaaaagacacccaaataggaaaagaagaagtcaaactatctctctttgtggactatatgattctatatctagataaccctaaagactctgtcaaaaggctcttggagctgacaaatgaattcactaaatttttaggttacaaaatcaatgtacaaaaatcagtagcacttctaaacatcaataatgttaaactgagagccaaatcaagaatgcgagtcaattaataatagctaccaaaaaaataaaatatctaagaatacatctaaccaagtaaatgaagtatctctactagcagagaattacaaaacactactcaaagaaatcagagaggacacaaacaaatggaaaaagagtacatgctcatggattagcataatcgatatcattaaaatggccatactaccccaagcaatccacagattcaatgctattcctatcaagccacaacgccatttttcacagaattagaaaagctattctaaaattcatatgaaaatggaaaagaacccaaatagccaaagtaatccttagcaaaaagatctaagctggaggcaccatattatccagtttcaaaacatactatagggctacagtagccaaaacagcataatactagtacaaaaactgtaacatagaccagtgcaacagactagagaacctagaaagaaagccacacacgcaaacacggctgtctgatctttaacgagtcaacaaaaataagcaatggagaaaagacttcttattcaataaatggtgctgggataataggctagcaatataccaaaaaaataaaactggacacataccttttaacatatacaaaaattaactcaagatatattaaagagataaatgagacctcaaactataagactcctagaagaaaacctgggaaacatcattctgaacatcagccttgggaaataatttatgactaagtcctcaaaagctgtagcaacaaaaaatttgacaactgggacctaattaaattaaagaccttctgcatatcaaaagagactatcaacagagtatacaggcaaccgacagaatgggagaaaattctcagaaactatgtatccaataaatctaatttccataatgtatacagaacttaaaccactcaacaagcaaaaaacaaataaccccattaaaaagtgggcaaagaatatgaccagatacttctcaaaagaagacatacaagaagacaacagccatatgaaaaaatgcctaacaagactaatcatcagaaaaatgcaaatcaaaatcacaatgagctaaccatctcatatcagtcagaatgtctattattaacaagtcaaaaagcaatagatgctggccacaccatggagaaaggggaatgcttatacctgctgggaatgtaaattagttcagccactgtggaaagcagtctggagatttctgaaagaacttaaaacgaactatcatttgactgtgtaatcccattactggataatatctaaaagaaaataaatttttctacaaaaaagacacatgtgcttgtatgttcatcacagcaccattcacaatagtaacaacatagaatcagcctaagtgcccatcatcagtggattggataaagaaaatacggtacacatacataagggaataccacacagccataaaaatgtacaaactcaggtcctttgcagccacatggctaaagctagaggccactatcctaagcgaattaacaccggaacagaaaagcaaataccacatgttctcatgtataagtgcgaactaaatattgagtacacacagacacaaagatgggaaaaacagacactgggaaatactaggcgggaagagaacaagtggggcaagggtttaaaaaactaactgttgggtgctattgaaacagaagagatctctaatccccctgagcaacaggggtgtggctcaccttttctgtcaccattgctgctcaaacccctgatggaagggggagcacacagacagtcaggtgcaggagctggggcagtgctttgagctctggccacatggtagtgtctaggggtgggtgcctgcagccccagtattacaatgcttttttagccctgccattcgcagacagcttaaatgttaaccagctcaatggaccctctgtctttttgcaagggcagagggccagtgtgacagcttcctgtatccagagctcctgcccagcatcccagaaaaattgagtcacacacaggcttgaaggatgaatggaggattttattgaatggtggaggtggttctcagtgggatgcatggggagctgaaagggggatggagtgggaagatgatcttcccctggagttttgcccaatccagcagcaaaacctccctctgactgccccagcctaactcctcttggcattcagacgttccttctcttctctttatctgccacaccattccgctgttcatctgctcatctcctgtctcatctcctcatctgtttctggagcctgaggttcggggtttacatgggcacaggataggggggcggagtgggccaaaaggcaactttttggatgcacgaacagaaatgcctgttcccacttagggctgtgggtctccaggcttgagggtggggcctttgcaggggaaccatccccttctacccagtattttcctgtctcctttccgtatcactgtattcactacctaggtaatgggatcattcacatcccaaacctcagcatcatgcaatatacccgtataacctgtgcatgaacctccacatctagaataaaagttgaaagtatcaaaaaacaaaatagggaacttattcacatcataaaccgatgctacttttttcaatagataagcactttaattttggaaaatataatagaaacatctcctggggctaaaaaatgcttcccaggagatactgacaatacactagttttaaagtttctgacttcaccattcaaacaaatacagattaaaggaaaacactctctctgggaagatagctagggagataccaaattacagaggaaatgctgtagcatctttctatccatttgatgattaatttcctgctttattggctctgactgatcatgtgattcattctgccaccagaaaagatgaatgtgcccaccaataaggaacataaagttgaggaaaatacttgctcaacattggattcccaacatccagcatattcttaccacattgtagttgctcaataaacatttgttcaataaatgaatggacaaatgaaagcagaaaggaaagaccagaaatctagacagagcactctcagtggagttgagaggagtcagctgcagtccagtgcagctgtttctggattctgaagcagcaaacagagctttgccaagcttactgggtgaaccaactgcctataacaacactgaacagtgttgttgtaaataaacacacagaaagtacctgtctgtcatgttatatgcagaagtgtagaataaaagagcaacaggataaacatgagcaagttgattccttcagctcctcagtgtcttaatgttatgtttttcaatacacagtttatggaataaaatatgtgaaaccagtttggtagtttgagcaagctatcaggaatctccaagaattgtttggttgttattactgatgttttcttttgattttagaggtcaagtttgtgtgtgtgtgtgtgtgtgtgtgtgtatacatatatatataatgcgtgtgtgtatgcatgtgttacagaagacaaaagggaagaaggatctaatggcatgcaggaattatagacacagaggacagcatggacagaactatcacttaatccagaggagtagtgagcaattttggcagtggatgcatgtgtggtgtctccatcattccccaccagaaaaattacacatttcaggaattaatcctcaacacctgaaatgatcctttgcatagataacttactactacagttaaaaaagaatcaaactactgccaaggatattgttgctatgatatcctactgccaaagatatcggtgatcgatcttctgtaaggcagaagataatggtcatctaccactatagtgaaaggggaagtgattttggggatagtaaacataacagtacatcagagttattccaggtggagtggaatagtgccattctctaagacttagatgaggtggtggtccccattacaaccccatttaattcaccagtccaggacctataaaacccaaacagattgtggcagaaaattgactaccacagtcttagccaaatggaagcaccaatctcagccactgtctcagatgtgcaattgttactggagcaaacagcctttagtactatgcactggcactaatttggaaacgcattattttccacacgtatcaggaagcatgttcagaaggaagttaccttctcttagcatgcatatcatgaaacattcctagtcgtttccagggctatctgaactctcctcagccactgtagcctaggggaccttgagcatctggaaacctatagaacaccattctggtccactatagtaatgacatcactggacctgaggaagaggaagtagaagtactctgtggtagtttgttacagaagcaataagaacaggaaactagcgcaatactcatgaaaaataatgccaagtaacatgtaacacaaagtgtatagcaatattgtgtatagtagaaaaatctggaaactactacaacacccattggcagaatctgttggtataaatcctctaagaagcagacaccaagataggatcacacatgcaaacatttttagggggattccaatgtaaaatgaaataggacaatggaaaaaactaggaaaaatgcaagtctgaccccaagtcaagaagagaggaagagaagattgggcagaatcatgtgagactgtcataaagtagaaggatgatttggcaaagttattgagaaatccttgaaccaaaatgggctgacaaatgagtcctgtgtctcccaggtatgagtctgccttagaatccattctgcacacagtcattggcagagagcagcccatgggaagtggggtctcagaaaaactactgcaaaggatttcaaagtgagaagctcagatcctgggtcatttacactccttgaaggaggcctacaaattcattcgcatgactgctacacaggtgaagggataaattaattagattttaatcacataatggaatattatgcagcagtgaaaatgaatgaactgctgctatgacacaacagaaaagttttaacacaagtaaaaataaacatccatgaataaaatagaaaaacatttttcattaagttcagtaacaggcatactagaaaacatatggttcaggggtgcttgtgtgtgtgtgtgtgtgtgtgtgtgtgtctgtgtgtctgtgtgtctgtgtgtctgtctgttaaagctataaatcgaaaaataaaaagatacaaagaaacattcataatgttgctgtttccagataaggatgaggctaatttatatattatataaataaatatatatataatatataaatatatatatttatataatatatattatatatataatatatattatataatatataatatataataaaatatattatatattatataaatatataatatataataaaatatatatttatataaatatataataaaatatattatatatttatataaatatatatttatataaatattatacattatacataataaaatatataatatattttatataaatatatatttatatatgtatatacatatatacgtgtgtgtgtgtatatatatatatatatattctggctgccatcctgaggttgccttctgatagaaagaaaaaggccttctcacgagtgtcttctacctgaaagttgtcaccattttctctcagctctctctgacacgtacttacattctgtttctagaaagtcccaaggacagaagaaaatcatctctggattttgtagcactgtgagacccgggttaaatcctcttattgatcacaagtcatagagtattttcacgtacattttctatttccattctccttatggcctgcagaatctagaattagccccatttatcgtgagaaaactaggtttcctgcatcaaacccaggtttttgattccacaactaattattcagaaaaggatacaaactaaacccatagacagaacaacacaggatgaacaatccttacattttagtcacttacaacattttttaaatgatctcttctgaaaagattagctcttaatctgacagtgatgtgccaatcaatgttgtatgtttttagctcatttcagtcctcagacactgagatctttacaagtcctatccccacaggcctcagaaataaaatgccccatttgaagcaatcagaaaaccttatgctaggaagcaaccagccttgcaccagatgtgaaaaagaaagttctaagatgaatctaataaaaagcctatgttttcataattagttatgcatttttgaatatctggagaaagcagatgaataataaagagcattatacagaaactttgccccatgtctgggaagcacattgtatgtctggaaacacactaattccaaaaaaattaattctggaaaacttcgttagtaactggattttcaaagctttaatttttagattttgcactgtataataaacagtattatagttccaaattttaacaaaagacaagaaatccacataaatatatgccatccaggcttacatatttgctaagtaatacatactgaactccatcatagcctcaaaaatcacagaaattgaaaaacttacccagaaaacaggcccaggagtttgaatgggtcatagatcacaaaaagcataaattccaagggtctctgctattctgttccaagatcaatattagggatagtgcttaagaacacagacattaggttcaaaaagtctaaagcactgtggtacatattaaaataagtatgtgtcggctacatacataaacaatgctgaaatggcttagaagtagaaaaacatgaaaacacatgatcaagtcaaaataagcaattacagggtattaattacacaatttactatgtgatttttcttctagctggacaataataataacaaaatggaagggtaaattcaaatgggacatgttcatcaaaatgtcaaactatatgagcaatgtaaagacctagagtaaagcaacagctaaatgggagattctttcgagatatgtttataaaaaaataaagaaaaaaaactgcaaagtccccacaaataaggaacattaactaacataccaggaaaaatggctacaaactttaagagatgagaccatggaaagttgaagagtgatgatatcaacttcaaattagtgaaaggcattttttaaaatgagtttagacacattactttatgccaccactctcgggtattttaataatacactgttccatttcaaagaaaaatttaacagagtaagaacacaatgaaatatcactaaataactatataatggatacaattttatttaattgtgaaaacactaaatactattgaggacacagaaaaactagatcgctcatgtattagttgatgggattgtaaaataatacagccactcaggaaaacagtttggcagtttcttaaaaactcagcaggcaactaccatatggcccagcacacccagccatttattccagtgaaatgaaggctcccgtttatataaaaacctgtacatgaatgttcacagctgctttatttgtaagagacagtcactagaatcagcccagatatccttcaacatgttaatggttaaataatctgtggtacatacatatcataacaacttggattaatcacttgggaatcatgccaagaaaaaagccaaccccgaaaggttatacctggtatgtatccatttatatagaatactttaaatgacaaagttttagaaatggaggagagattagctgttgcctggaattagggatggaatgagaaaggcatgtggatgggatggggtggctgaagttataaaacagcagcacaaggaatcttggtggtttgggaaatatgtggtgtcgactgtggtggtgaatacaggaaaccaaacaggtgataaagtttcatagaacttaatacaaacacactcacacaagtaaagactgggaaaatttgaacaagatcagtgtcgtgtcaacatcaatgtcctccttgtgatgttacactgtacgctcacgatatgtcaccaatagggtgtatctgttttctattgctgctataacaaatcacaacaaaaataaatggcttaaaacaacacaaatttaacatattatggttctggaaatcagatgtccaaaataggtctcaaatcaagttaccagcagagctgtgttcctttctggaggctctaggaaatgatccattttcttcccctgtttcggtttgtagaagtcagtggcattccttggctgtagcccctttcctatcttcaaagccagcatcacagcatcttcaagaccctcactccacacttctgcctctttcttctgtttataagggcccctgtggttatactggccctaactggataatccagaataacctcccctttcaaggtgtgccaattagcaatcttaatttcatctgcaaccttagttcttctttaccacataacctaatacattcacagattccagggattaggatgcagacatctttggggaatcattagtcttcctatcacagaaggaaactaggcaaagtgtgcaagggaggccaagtggctcacgcctgtaatcccagcactttgggaggcccaggcaggcggatcacctgaggtcgtgagttcaagaccagcctgaccaatatggagaaaccccgtctctactaaagatacaaaattagccaggcacggttgcatgtggctataattccagctacttgggaggctgaggcaggagaatcacttgaacctgggaggcggaggttgcggtgagccaagattgctccattgcactccagtctgggcaataaaagtgaaactccatctcattaaaaaaaaaaacaaaaagtgtgcaagggagctctctgtattgtttcttacaatacatgcaaatctacaatgatgtcaataaaaattcaattaaaaatacatgtagtaaaaatagttgctaatctatgctggagtttacttgaatgtcactatgctgatcgtcaccttcaagtacacacatatcttccatcatcctgagcttgccctctgctatgtgtctttttccgcagttgtcttccacctgacagctgtcaccattttctttggagctctctcttacatggacttacaacctgaatctactgtgtttcaagagcaagaaaatccagcatccatattttgtggcattatgactctcgtgttaaacttccttatctactgcctgtgaaattaggaagtaaaagaagctctacagttaacaaggaaaaagtattaatacatgtagactgagggtaaattattaacactgagtgtcagaagtatcctgtggtgagcgccctgccatatttgctgatagcatattggtcaaagcaagttgcaaggccaacccaaacctggattcaaggtgttggagtaacaggctctcctgtctgatggaaagatctgcaccactgcatcacgatgatgtgaatgtaacaaaaacttggggaccatttttataacctaccacaacatgttcttactagaataaattgtttcttagctgacaccctaatcagaatatgaatcatcctgccacagatgttgatatgagaaacaaactgaatctctataaaggcacaataatttatatttgctcattattttatccccagtgtctaccaattgtcaggaatatataaagtgctcactaagtagttgttgaattaatgaacaaagaattcaacaaatgaattaatgaacaaagtcaagcctctttgtttgccaggaggctttggtcactggaaagtccaacaatgtggtttatgttggggcctttgggacatgccatatcagttctgatttccagagaacgggggacaaaagtcattatgctgatcctccagaaaggctgggaactaacatcaattacaggagcagtatgcaatcgagccctgataaaaaccctgagcaccacaggatcaggtgaacttcctgggttgacctgaagccaatatgtatgacaactccatgcatcaattgccatgcattgatatggcaaaagcatgatggaaactttatgtttgcacccctctgagacctggccttatgtttctctttgtttgttggcttaatttgtattctttggctataataaatctataattgtatgtatagtcttaaacaatttcctaatgtcttaattcacattctatactaaacaaccacagactaagtgacttataattaaaggaggccaggaacagtcgctcacacctataatcccagcactttgggaggccgaggtgggtggatcatgaggtcaggaaatcgagaccatcctggctaacatggtgaaacccgatctctactaaaaatacaaaaaattagcccagcgtggtggcacatgcctgtagtcccagctactcaggaggctgaggcaagggaatggcgtgaacccaggaggcggagcttgcagtgagcagagatcacgtgactgcactccagcctgggcgacagagcgagactctgtctcaaaaaataataataataataataataataataagtaaaagaaatttatttctcacagttctggagaccagaacaattccacccctaacccccaaaattagtgtcctgctgacatgcaaaatacattcattcctctccaacagcccccaaagccttaattcattctaaagactaaaatgtcaactaaatattatctaaattagacatgaatgagactcaaaatgcaatttatcctgaggcaaattctttcttcagttgtgaacctgtaaagccaaacaaattacatgcttccaaagtgcaatcgtggcatagacatttcctttccaaaagcaaacccactggagcacaggacacccttccagacccactgaggtggcaaaactacccccacagcttggggaggcactgcccatgctttggcactcttccatggcccctaatgcttcagttctattgggttggggattgcaccaccaccagggtttggcaagataccccaacccaactttctaagtattggtcccattctttggcaatcccacctcctgggctcatgcattctaggaatggtgaccctgatgatttcttaattgccttccaggttcttttttccttgtcttgaaaaatactacatgtatacacccagatacttctatagttcagtacagcagggtctaaaaagtcttataggctgttttcattttgtcctatcttctctgtttcctttagtcctatctggcagtactcccactggcataatcccatctctattcttgtcttttgttgagatgactgattaagcctgtcattcacattcatactaatcttatcaaatggacacttggccacagccttcgtgttctcttccaaatacactttctcacttttgcaatacggataggctaagaatttgattttctaaatctttaagttctggttcattttttgcttaaagaaccatcttgaaaccatttctctctttttgcattttattataagcagtcaggagaaactaagctgttccttcaatactttgtttagcaatcttctgctctcaacctctaccttccacaaaacccagaacataaacacaagtcagccaagttcttttctaccttataacaaggatctccttttctccattttccaataacatattcctcattttcatctgagacctcatcagaagggcctttaccttccatgtttctaccaacattctgttcatggttacctacatattctctaagaatacagaaactttctgtatagttaccttttcttactgcgccctcaccaaaatgcctttaaaagtctgttcacataaatctaggcttcttctaagatgcacctaaaaactcttctaggatctacctatttcccagttccaaagcagatttctacaatattaggaatttctaatgggcggcaccaccccttataccaacttctatcctaatcagttcaggctgctataggaaattagcatagattgggtggttttataaataaaagaaatttatttccaattctggaagtaggaaatccaagatcagggtgccagcatggtcaagttctgatgaggggcctcttcgggtttgcaggatactcaaagaaggcaagagagctctctgggttctctttcataaggaaacacatctcagtcagaagagctctaccctcatgactttatcttccaaaatccttacctcctgaatcaccaattgaggcttcagagtcaacagatgaattctgagggaatacaaaaattcagtccataacagctgaatttttgagtcactctagtgaagtatcaaacctgagggtgagtgtgtagtgagaattgctccctcagaagacaggtttctaagctcctcgagggaagtttccaaggccgcagagaccgggagcaagaatagcgaaatacaaaaggagaaaatccagcaatggaggaattactttgctggtatacactccggaaaactggaacttgatcctacaggggattctgataaaatatgtggaatgtccttcagaattattcttctaaaagacaggaacttaagacattttttcaactcccctcacccagtggtttgggattgcccaaggattttaacatcctcacgcacctgtggtggccctgatgagtgatctttaatgttttcagagatatttctgaggcagagaagcagagagatgttatagaagatggactgctggtagcacagacaaaactgtctaccacagatgcactgaaatcaagtactaaggaagggcggtacaagacacaaagatatctgctaatctatgtaacacagttctagcaaataagatgtacgtaaaagtctgctggggagtttgcagaaggcattatatatgtatatcatatatatctgtcaagggtatatatgtggtgtcaccctgctgtctttgtccctgtttttctttctttgaaagagaatgtgacatctagagctgagataaatttacattaaatttagattctttcagaaaaccaggcttattgctgattgtggtgacagggatgattaactagacctaaaaataatttcttagatatataaaaacatgctcatcctcattcttaacaagaaaaaaaagcagctgttctctaacaagacagctctttaaaaaaagaagaagtccctaatgacagtaacattgggaaaaaaataggccctctagaaagtttaaatttttgtcagcatgaaatatgtagtgaacattgtttttccaaattgcatctcagccaccgaaacctcgaatctcaagaaagtgaatatcgatctcttaggcccaactataaacacctgatagtgaataaccaaacagagataggccatggtgggttatcaggctgcacagtggcagaaagagactctggaagcaatctggggggaaataaaacaaagcaaagcgcatcttcggcatcagccatgtatcaatgttatcattgcagtgtgtgcaggtaatggtagagcaagaatcagagcctaagtgctagcatgtttcaccccaaaaacaggaggagtcacttcatccctggtggtgtgatgaaaatggagtgagggaactaaatcgggctgtgttgcctggaaattacatgaattaacaaatgattgacttattgaattaatgagtgaatataatatgcccttaatgcattatttgcatgtattattatgactaattttgagcatccattcaatactttccttgtgctgggacgttcacgtgaatcagctgcttgtcattataatcaggattctaggttaagtggaccctgactttttctagcttcctctgacgagtgcttttacccactggatggaaggaagcccccttgaaagacctgcatttcatatattttatagcaaatttacctgaggaggcaacttatacaagcttattggccctcagccctaagtgtagacttgaaaagaattgtttctttttcctagagttaacccactctgcttatttcttaagatagtggaaagggccagagaagcccatatcaacacccagcttagcttgctagataccccatcaataaaggcacattcttacctgaaacaaatcacttcatctttgcagctacagctctacctggcattactgacatcagaataaaggattccagtactgatatattggggatgtgatttttttcttctatgaccaatttctactattatacaatatttaagatgtacaaatatatattttaaattggccaggcgcggtggctcacgcctataatcccagcactttgggaggccgaggcaggtggatcacccaaggtcaggagttcaagaccggcctggccaacatggtgaaacccatctctagtaaaaatacaaaacttagtcacgtgtggtggtgggtgcctgtaatcccagctactaggaaggctgaggcaggagaattgcttgaacccaggaggcagaggttgcagtgagccaagattgtttttattttaattttttttaatttttgtgggtacatattttttggcatttatatgtgtttagaataaatttacctgaataaatttccaacatgagtaaatttccagtcagtatccagtctgttctctttaataatattgatatttttattttaatatggcagaattttcgatgttttattgcactccagcctgggcaacaagagcgagactccctcccaaatatatatatatacacacacacacacacacacacacatatatatacacacacatatatttataatcatttaacaacaactcatgtagcttgccatctaacttcggcaacttgctttttattacttagcattccatttgaaagatgtatccatgcagatgctgtagcaccatttaactagcttatttaatagctcgtatttttttctatgactatgctataaacattcttgcgggtatatctatgtatacacatgttcatagatatttgtatatccttctatatgtggtcatgaatttttcaagaatatgtacctacactggaaattctggaccacagaaaggcatacatttaattttactgatatttccaaatttgtttccaacatgactgtactaattctccttcccagcagaaatatgtgaatccctgtggctccacattactcatcaaaaattggcatttcagattgttgagcataagactgtatttcaatgaagtattaatatgaaattacctgattactagtgagttgttcatcttttcacatttctgttggtcatttgggttttcttttctataattatctggtttatgtcctttgtgaatttttcaagtttatttatagaaattatttatatgtactagacactaaatttttattttttttaagttttgtggctacatattttttggcatttatatgtgtttaaaataaatttacctgagtaaatttccaacgtgagtaaatttccagtcactatccagtcttttctctttcataatattgatatttttattttaatatggttgaattttcaatgttttacgatttgtgcttttatgtcttcttacattttatctgtatatctaagtcataggtattcaacatagttgattctagtgtttttgtgggttaattttaaaatagaaaatcaaatcatttaatattttgaaatttaaatatttggtacacacacacacacaccaactactaaataatgtctttcctgttagctttctttaaaaaaaaaaatattgagaaaccacaaaaatatcaggttatatgtatggtataaagtattatgattcagcaagcatcaggtagcagcaacacactataagaaggaaaataagttttatcattgcatttgtatccacagggaaaatgaactagagaaaggaatgaacttcattccttttttttttcaagagaacaaatcataaaacaaaaaatgatcaattatcatttcaagtttaataatttctggtccatgaaaagcatattatagacaaagttaatagataatacaatgtttggaaatttttgtcaagtcaactgataagttaaaaagaacatttataaatcaactcaatagaaatatttgtaaaaaaaataggaacaggcaaattacagaacaatagaattccaaaattctaagaaggatattacatttgcagttagaggaaaaaattaaaatggtatgctactttacacctgttttgtggcccaagaaaagaaaaaagtaaaaataccagtgttcacaaggaagtgtggatatcggaattcccacacgcaattagtaagactgtttactggtgcctccattgtggaaagtgatctgcaatgcttgtcaagttaaatgtgggcatatcctcagattcaacaattttgtctctaggagtacatcactgagaaattttcacactgagttacttgtatcggagacaaattgtaagcaatttggtatctatccataactggataacagattgggaattatttttaaaataagatcatttggcacagatacttggataaatacttccgtgaagagttctacatagccatgagtcatgatggccatggtggagttagtaagaaggggaaaagggtaaaatgaaaatatggagataagttgaaacaaggtcatatagaaccctaagaagaagtcaagatttttagatataaaattactatttaggtaaattgagatattttaattaaaatataaagaacataaaagaagtcataattaaataaaagaatatttcatagatttcttaaccgatatatttttgaattgccaatcagtttgtaccccgggaatatagcaactgctccattgcaatttgtacaaactgtagatgaaattctaagctggctgtcaagtttcagcctttaaaatagaagtcaatcatgtcacagaaagtacatgctgaccccactatgaaaccaaatattaagacatttccaaatctgaaataagttaaaagataacaatgattttagctttctctttctatttgcttctttctttgcatattttcagctgatatttaatctatgctagccatggaacaaaataatggcactgaagtgactgaattcattctcctgggatttgctggtcaacacaagtcttggcatatcctctccatagcatttctagcaatctatgtggttaccccagtaggtaatattggaatgatcctacttatcaaaattgatgcttctcttcatatccccatgtaaattttcctccaacacttggcatttgttgatctctgttacacctctgctatcactcccaagatgttgaaaaactttgtagaaacaaaaaaatctatctcatgtataggatgtatggtgcaattactagtttatggtactttgcaacaagtgactgctacatcctggctgctatggcagtagaccgttatgtggccttctgtaacccactccattatccaggggttatgtcccagagactctgcattaagctattagttagttcatatgtcatgggtttcctaaatgcctctataaacataagtttcactttctcattgaacttctgcaaatccaaaacaattaatcactttttctgtgatgaacctccaattattgccctaccatgctccaatattgacctcaacatcatgttattaacagtatttgtgggattaaatttgatgtgcactgtgatggtggtcatcatttcctgcatatatgtcctggttgccatcctgaggatatcttctgctgcagggaagaaaaaagtctctctacatgtgcctcccacctgacagcagtcaccattttctatggggttctctcttacatgtatctatgccatcgtattaatgagtctcaaaaacaagaaaaagtggcctctgtgttttatggcattattattcccatgttaaaccccttgatttacagccagagaaaccaagatgtgattgaagccataaaactaacagaaaaaaagtatttctaatttgaactttgatttctatctcaacatggctcaacaagccagccaacagtgctcttatttctcaatctcagaaaatatgacaaatgtctataagacagaaatgcattacttaattatatcaatagcatttgaaagatagagaaaaacatttggaatgattaaataaacaaacttctaatccatgtgttccttaaagaaaatgtgtctaaaacaatatctttgaaattgcatccatacattttaatgaggcttttttgagatatctgtcatcaaaaaaatagtaaagtaaatcaatgagaagtgcataatcaatgttgtgtaaggacttccattaaatagagtataaagactcagcagggggtagagggaatcttttcttttcttctcttgagaggtatttttctctacagccaatctatttgtaactgtaaagtaaaatttgaaagattatttctttggataatatatgcagaaaagaaggaaggaaaggaaagacagtggagtaaatcttcacggatattggggtattagggacaaatatccatcttttccctagtttccctgacaaattaggaaatcagtgcaggagtcagaaaaatatagagcatatcaattttgtcactggtaaatataacttcaatattcagctataccttcttgcaagtgtacatcttaggaaaacaacataccatgcagagtctggtgctaccgagcaggctcatttacccagaattcataccttatatccatcaattcccaacaatgagaattaatgcagaattataggcttaaatctagaacttaaatatgggatcagactttagtgttcccgttgtaaaaaagtaaaataaaatatgtgtattaaaacatacacagatgtgtatgtattatgtgaaatatatgcacatatatgtgtatatatatgatatacatatatatattatatacatgcaggagatatatgattacaggagataaaacccaaaactgagaaactcaagagcttatacagcattgatagtgacctgctcatcctcccctctattgaaagaaaccttattttcactctaaaatgtaagcaaatctccagataggaaaggacaagtctttatttacctcctggaccatctctggagagagaggcatctctaagttttattatcctgatatatctcctcatgcaaaccttcttaaatgtaatgactataaatgcctttgctcatagaaataggctgtgaagaaatgtgaattattctttgagaatctgtgtaccaaataatatagcttttatagtcacagaatttaaaaaagaagaagaaacagaaaataaatgggcaaaagatacacaatagtagtagcaaatgctacttcgtctcttccaattcatgacagaccaacttgagaaaaaaactttagaattaagttatagaagttatgttatataattaaaaagataaatcaaattcatatataggaactttgttttgttcaaatctactgaccaaacagggctgtagtccaaattttaggtttattttccttttgcagcacacactccacagagctgtaagtatctcagtaagagaaatatgaaaggggattttcatagagtatgggctttgctgcatgaatccaagaatgaaggaaggaatcagtggctctctgtagatttggatactctgaggagtagggaaaactcagaaattagatattttaatatgcattgctcaagaggtgggaagaacaaaacagaaatgatcatgctattgatgagaaagcagtagtcattcagaagtgaaaaactatagcataaaatgtggggtaggggagaagtaaaaatttagagtttaatatgcaattggaattaagttgttatgagtttaaattagaatattatgactctaagatgttttatgtaaggcccgtgataactacaaagtaaaagcctctagtagatacagaaatgactttttaaaaaggaatcaaagcataacaccacaaaaatttagcaaattacaaagacatacagtaagaattgaaaaaaggaataaacagactacaagtcagtgaacaagtaacaaaacagcagtagtaagcccttgcctgtcaataattactttaaatgtaagtggattaacttctccaatcaaaagacacaaaatggcataatagattaaaaaacaagatccaacaatacgctctctacaagagactgattttagacttaaggacacacatggactgaaagtgaaaggatagaaaaagatatttcatgcaaacagtaaataaaagagagcagtggtagctatatttacatgagataaaatagaattccagtcaaaatctgtcataagagacaaagaaagtgaatatttgatgataaaggggtcaattcactaagaggctataacaattgtaaatatatatgcactcaacattaaggtatctaaagatacaaagcaaatattaacatccctgaaggaagaaacagatagcaatggaataatagtggaggacttcatcacttcactttcaactatggataggtcatccagacagaaaatcaataaggaacagcaaatctgtggacttgatctatagtatgggccaaatcgacctaatagatatatataaaacattctatccatcagaaatggcatatacattctttgcaagcacatacagagcattctctgggatagatcatatgctaagccacaagatgagtcttaacaaacgtaagaagattgaaatcatctcaagtatcttttctgaccataatggtacaaaactaaaaatcaatagcaggagggattttggaaactttacgaatatgtggaaatttaaaaacacactcctaacaaccaatgagtcaaaaaaagagatcagaaggaaattttttttaaatcttgagacaaattaaaatagaataccacacaccaaaacttatgggatgcagcaaaagcagtgctaaaaggaagtgtatagtattaaggaccgacattaagaaaaaaaaaaaaagaaaccttaagccacctaactttacacgtcaaggaactagaaaactaagagcaactaaacccaaagtcagcagaaggaaagaaataatgtagattagggcagaaataaatgaaatagacatgagaaatgcaatagaaaatatcaacaaaactgagttggttttttgaaaagacaaatgctattaactagcttttaacaaaactgaccaagaaaaaatgagagaagattcaaataaaattacaaatgaaaaaggagacattacaactgttatcacagaaatacaaagaatcagagactactatgaataattatacatcaataaactggttaacttagaagaaatatacaaatttctagaacatatcacctgccaagactaaatcatgaagatatagaaagtccaaataggccagaaggagtaagaagattgaatcagcaatcaaaaatctcccaagaaagtaaagcccaggaccaggtggtttcttgagtatattctaccaagcatttaaagaaatgatgcccattcttctcaaactcttccagaaaaagcagagaagaaggaatatttccaaactgattttatgaggccagcattaccctaatacaaatgccagacacaaacactacatgaaaagaaagttaaaggccacatccttggtgaatatgcatgcaaaaatcatcaataaaatgttagcaaactgaattcaacagcacattaaattcatcaagtgggatttactcttaggatgcaaggatgtttcaacatatgcaaaacaataaataagatacactacattaacagaataaaggattaaattcatacggtcatctcaattgatacagaaaaagcatttgacaaaattcaatggtgttttatggtaaaagtctcaacaaagtaggtgtagaagcaatgtgtctcaaaataataaaagccatgtatgacaagcccacagtctacatcatacttaatggtaaaaagatgaaagattgtcctttaagataaggaaaaatacaaggatgcccattcttgccatttatattcaccacagtactggaagttatagctgttgcaattaggcaaaaaaaaaagaaatgaaattatccaaattgaaaaggaagaaatcaaagtgtctctgcaaatgacatgatcttatatagagaaaactctaaagactctacacacaaaaaaaaactgataaaagtaataaattcaggaaagttacagcataaaaaatagacacagaaaagtcattagtgtttctatacactaacaataaactattcaaaaaggaaactaacaacattattccatttacaatggcatcaaaaagaatacaatacttaaagaatacatttaacaaggaggtaaaagatctgtacattgaaaatatgagatattgatgaaaaaactgaagacaaaaaaaaagtggaaagatattctgtgttcatggaaaggaataattaatattactaagatgtccatattacccaaagtagtctacagatttaatgcagtctctgtcaaaattctgatgacattttttgcagaaatagaaaaaacaatcctaaaatttataagccacaaaagacctccaatagtcaaagaaatcttgagtaaaaagaataaacctagaggcatcacactcaataatttcaaattataacacaaagctacagtaatcaaaacagtatggtactgacatgaaaacagacagatagattaatgaaacagaatacagagcccagaaataaatctaggcatatgtggtaaactaatctttgaccaaagtgccagtacaaaattgggggggaaatccctttaataagtagtgttgcaaaaactggatagccacatgcaaaaaatgaaataggactcataccatatacaaaaattaactctaaatggattaaagacttaaatgtaaaatctgaaaccatataactcctggaagaaaacataggagaaaagcactttcacattgctgttggcattatttttttcgataagacataaaaagcccatgacaacaataacaaaaagaaacaagtggaattacttctttgaaactaaaaaacttctgtacagcaaatgaaacaatcaacaacatgaaaagacaatgtagagaatggaagaaaatatttgcaaactatatacctgataaggagtttatatccaaagtatataaggtactcacacaactcaatagcaaaataaatatgtaaacaacctgattttaaaatggtcaagttacccgaataggcatttctcaaaagaagacatacaaatggccaatgggtatatgaagaggtgctcaacctcactaattgccaaataaatgcaaatcaaaatcacaatgagatatcacatcacacttgttaaaatggctactaacaaaaagaaaaggatgtgttgaagttttgtgtgacaaaaatccttgtacacagctgatgggactataaactggtacaagcattgtaaaaatggtacagagcttcctcaaaaagttaaaaatagaactaccatatgattcagcattcccacttctgggtgtatatccaaaggaaatgaaatcagtatgtcgaatacatatctgcactctcatctgtaatgttcattgcagcactagtctcaatagtcaagatacgtaaacaaatgttggtcagcagatgaatggataaagaaaacatgatatatatagacactggaatattattcagccattaaaaataaggaaatcctgccatttgcaacagcatggaggaacctggagaacactgtgctaagtgaaatcagccagatgaagaaagaaatactgcatgatctcacttgcatgtggaatctcagacttatcctatggatacaccaactccactccttttgttccctctccacgaggaagtgttacgattgtatactttctctcaagccttaaaaccatgctgggtactgagaatctccaatttatttttcctagggcagtgacatgaagtgcttaaagtatcttctcccaacccagagcagtctagttggctgtctgtgtgtgtttttggtgtatgagctgcagaggctcttgcaggcacatctatggggagagggcaggcaaaataccagacacaaccatggtcttgttgtggcctccacaggtgatatgtcctggaaggtttgtgagcagcctcttggtggattctgcagagcagccagtggaaacaataacgctttatgtactgcacccatgttgctgtgagcccctgccccgaattgtcccaggactattgagtcattcattcagtattctgggtgaggtgagaaagaaaagaaccccttaggctggagaaggtctcactttcccctatgggagaaatcactggaggtgcaggtctctttgacattaagctgtgctgccttgagggaggccgatgctggtaaaatgaaactgcttttcttatcctctttaaagtgtctatgttcagattcttttcttcagcaggatgcttggacctctctgctggccttccgggctccacaaaggtgctctcatctgtgaatggttgtcagtcattgtttctgtgggggcatgagaactgaaagctcctgaacaccactgtgattgatggtggtcatcttttcccaggtatataccctggctgctatcccgaagatgtcttccactgcaggaaggacacaaggcttcttcatgtgagcttcccacctgacgagcagttgtcattttctatggcactccctcttacatgtatctacaccatgggaacaacgggtctccaaagcaggggaaagtgtcatctgtgttctatggcattgtgattgatctgcagcctgagagtccaagatgcgagagaagctctaaaagaaaaaggaaagaagcagttctagattgggcctcagtttctaattctctgcacttgtagacaaccagattgatagtgccaattttttttttattatactttaagtcctgggatacatgtgcagaacgtgcaggtttgttacataggtacacacaagccatggtggttggctgtgcccatcatctacattaggtatttctcctaatgctatccacaccctagccccccacccaacgacaggcctcggtgtgtgatgttcccctccctgtgtctatgtgttctcattgttcaactcccacttatgagtgaaaacatgcaatgtttggttttctgttcgagtgttagtttgctgagaatgatagtttccagcttcatccatgtccacgcaaaggacatgaactcgtcttttttatggctgcatagtattccatggtgtatatgtgtcacattttctttatccagtctagactgcaagacaatcctaagcaaaaagaacaaagctgaaggcatcacactacctgacttcaaacactacctgacttcaaactgacaatgctacaaggctacagtaaccaaaacagtatgctactggtaccaaaacacatatatagaccaatggaacagaacagagccctcggaaatactgtcacacatctacaaccatctgatctttgacaaacctgataaaaaaagcaatggggaaggcaattcctatttaataaatggtgttgggaaaactggctagccatatgcagaaaactgaaactggaccccttccttacaacttatacaaaaattaactcgagatggattaaagacttaaatgtaagacttaaaaccataaaaaccttgaaagaaaacctaggcaatacgattcaggatataggcatgggcaaagacttcatgactaaaacactgaaagcaatggcaacaaaagccaaaactgaccaatgggatctaattaaactaaaaagcttctatcatcagagtgaacaggcaacctacagaatgggagaaaaattttgcaatctatccatctgacaaagggctaagatccagaatctacaagtcacttaaatttacaagaaaaaaaacaaacaaccccatcaaaaagcgggggaaagatatgaacagacacttctcaaaagaagacatttatgcagccaacaaacatatgaaaaaagttcatcatcactggtcattacagaaacgcaaatcaaaatcacaatggataccatttcactccagttagaatggcgatcatcaaaaagtcaggaaacaacagatactggagaggtgtggagaaataggaatttcccattgttggtggtagtgtaaattagttcaaccattttggaagacagtgtgacaattcctcaaggatctagaatcagaaataccatttgacccagcaatctcattactaggtatatacccaaaggattatagatcattctactataaagacacatgcacacatagggttattgtggcactgttcacaaaagcaaagacttggaaccaacccaaatgcctatcaatgatagactggataaagaaaatgtggcacatatacaccatggaatactatgcagccataaaaaaggatgagtttgtgtcttttgcagggacatggatgaagttggaaaccatcattctcagcaaactaacacaagaacagaaaaccaaacaccacatgctctcactcataagtggaagttgaacatgaaaacacatagacacagggagggggacatcacacaccagggcctgttggggggtggggggctagggtagggatagcattaggagaaatacctaatgtatatgacagattaatgggtgcagcaaaccaccatggcaagtgtatgtaacaaacctgcacattctgcacatgtaatcccagaacttaaagtaaaatttaaagaaaaaaaatttttaagccttcaatcctgaatttcagccctaaaacttgatggaaataaaagtcccagtccctaaggccacatatttaaggatctttattatagcatcttttggaaagtcaagacctagaaagtgaacatccctcaacagggaaataaatctgtattgttgtaatcccaaaatctgtatcagttctatctattgctgcataataacatcctctgaaatgctataaccccactgtcaaccaagactgtgtccttatctgaaggatcagctgagggtagatctgcttccaagctcactcactttgttggcagaattcatgtccttgcaggtgtagaactggctgtctgtcagctgaaagctggctgtcagctgaaagctactttctgatcttagaggaagtccatagttctttgccacatggccctctccattgtcattctcagaacatggcagcttactcttcaaagtcaggaagtcatatactgttaatcagtacatacatcatgtgaaacaacacacctccacacacccaaatctcattattccttcaagagctagtctctccctgtagtgttcccaaaccagtgtttgtttcctgccaaccctctactcctggaagtaatttcttcttcaactgaatatccatagcccttcaactatgtaaataaatattacttatcactatctaaattatttatttacataccagagcttccctaccatctataaggaagttgacatacattttctttctataaccttttaacatctggtatggaggcttagacacagttgatagtccataaatattgaatgcatgaatgatgataaaaagtaataatatgggcagcttcctaactagaagttaagtgaatgtgtagcatacattagttgtctttaaataccaatctgtagacaacagcattcaaatgacctagcagttttttaaagtgtatataactacagcccagccctgcagatgttgattcagcaatattggatggaacccaatatctatacatatatatatatacagaatgttgttttaaacacatgtatcactgtatggtagtatagtgaacaggatttagaactctttgactctggttcacatcccaactctgccactcaccagcagtgtctctttacaagttaaatgagcttttatgcctggtttttctttatatatgtttcatggggtgctctaatttgtttatttgcttgtttgttaggaatagataagataatgtataggaatcatacagcctcataatgtaatatataaaataatacacagaaattataaaccctcaataaatgttaatagtaatgagtattagaaaagattattttaacatgggtgtgacagccattacaacaacacttcaatgcacacgctcccacacacacacacacacacacacacacacacacacacacacactgagtcaagaatcaataagagttgccaaaggtttgcaacatgaacacttttcccctctgggaaactcctctctccttcagtagaaatctaactaatgaaaacattcatttttttgtttgtttgtttgtttgttttgtgtgtgtggttttttttttttacctagagccacagatgctgaagggagcaggtcctgatcccaaaggcctccactataaattttctgtgagaatctgtggagaaatcttttagtggacaatctgcctgaaacagcatagaaaaaaatctaaaggcaaatctcctggaaaaaaattaaatttttcctattgaactgtgcattattttagcatatgtattagtttgttctcacactgctataaagaactacctgagactgggtaatttatgaagcaagcacgttttaccatgacagagcaggagagggagagagtaaagggggaagtgccacacactttcaaaaaaccaaatatcatgagaactcactcactatcacaagaatagcagaggaaagtccgccctcatgtttcagtcgtctcctgccaggccccttccctgacatgtggggactgcaattccagatgagatttgagtggggacgcagagccaaactctatcaacatatgaggaccaaagtaaaatctatagaattagagccagtatgtcatacgattaactccaaagttgggtagagtcatcttatctttggcaaagtaaaaatgtaagtgaagagaggaggctatcaacagtattgagaaattagaaaatggccctgaagatagcagctgatatattagccataaagttcccaattgaatataaacaatctttacaggatatgagcaaaaattagacaaggccactctatgactgaaatggaacaagacagagaaaaggccattctgtgactatgtttctgtgattatgtctgaaacataatcacaagacaagaactcttggcacccacaaaaatggctaaatactctgctcttctaactaatctgagtaaatactccttctttacctactttaatcttccttcctcttagatataaattaccaacatagctaatcaccagttcttttgctaacactcatctcagaatttaggaggcatccactccctaaatccttcttagaatcacccagcacaaaactaaatcctataatagggcttctcggttccctcttatccaacactctgctccctctggtgcatgctcactcttgctgcggcacacgaaataagcctacctttcttctgcatgtgagttcctgatgcttgttggctctcgggcattgacagtataaattgtgccaggcatatctcttacctctcttgaacattgcttctttttattattcatttttcttgagaaattaatttgtatgtgtctactactgtttaaatacatctgtttttaaagttgaaaatgtactattcaagttattttccccacttacttaaaattgcatatatgcttccagatggtgttttccttacatacacacacacacacatacacacacacactcaggatttttaaagttaaaatcagttcacaccccacatttttctgtaaagtattttattcacctaacactgtgttattaacttttttcataagaatacatatagatctatctcattatttttaggtgtttcatagaaatgcaaattatacattagttctgatttatcctctcacttccttatctattttcaatattttgctataaatagaaatactacatagaaacccctgtgttttaagtaaattctttcaatctcgttttatcaaagattagacagaggttaagggacattacatttttttttgcccaagatcatatgtctattaagtggtagttcccagatttaaacctagatctttctaactttaaagactatttacttttcatttcaggtagtataaaataaagcttcaaagggggtgaatatgctatagtttgggcaatttcaaaacacttatattcatccaattgaaaaccacttccagaacttctacttctggccaagataaagtaatagaaacgggatttaccttctgacctaaaatacacaaagttggacaaaatatatgaaataaatagtttcataattcttaaggcactttcatcaagcaataaaggacaacgatcccagaaagtcaagaaaccaatgagctctaaaatttccccagcttatttccttaagaaagtttccaggccacagtacagagatagaatgtacatgaagagtttagtggacttcctaaaggagatggagctgaaagtctgaaaagaccaaggcaactagagtttacaggacaaaatactggagaaaatgagctgaacagagagagaacccctagagctgcagaaaataccccttaattatttagctgagtgctggtcagtacaaacatgtaagaaacacctagagacaagggaataaaacaccaaaatgattaaaggtaacagtgctcaatgctcatacaaggctggaaattgtgcctgttctcgccagacagactgagaaatctcaagattcatgatgttctgggtggagcagacagaaaggacttgcttcaggtcagaaataattagctctagactgagctgtgcttcagttcaaactaacaaatctacaaagcaagactcaaaagatcatatggctggtcacagtatctcacacctgtaactctagtactttgggaggccaaggtgggtggattgcttgaactcaggagtttgataccagcctgggcaacaaagtgagacccccatctccacgaaaaatacataaatcaggcaggcaggcatggtggcatgtgcctgtttgttgtcccagctacccaagaggctgaagtgggaggttggcttgagcccaggaggcagaagttgcagtgagccaggatcacaacaatgcactctagccctgagtgacagagccagactccatctcaaaaaaagaaaaaaaaaggattatacagtttccaagtatctttttctttttttttttttgagacggagacttgctctgtcacccaggctggagtgcagtggtgcgatcccagctcactgcaacttccacctcccagattcaagtgattctcctgcctcagcctcccgagtaactgggattacaggcacacaccacaacacccggctaatttttgtatttttagtagagacgaggtttcaccatgttggtcaggctgctctcaaactcctgacttcataatctgcccgcctcggcctcccaaagtgctgggattacaggcatgagccactacacccagccagtttccaagtatcttaactgtgctacagaacaaagctcaagaatatgtataaaaatacaaaacatctagcaccaagcatagtaatattcataatgtctggcattcaatcaaaaattctccaagcatgcaaaaagcaggaacatatgaccataataagaataatttgtaataaaaactgaccaagaactgccaaagatgttagaattagcaaacaagagcactaaaacaattataactgaactccatatgttcaaagaagataagaagcaatatgaaagattcaatgaagtctacagatgattaaaagaatggatgggggacaggcacagtggctcactcctgtaatcccagcactttgggaggccgaggcaggctgatcacctgagttcaggagtttgagaccagcctggccaacatggaaaaactttgtctctactaaaaatacaaaaaaaatatagctggatgtggtggtgtatgcctgtaatcccagctacttgggaggctgaggcaggagaatcccttgaacccaagaggcagaggttgcagtgagccaagaatgcaccactgcactccagcctaggtgacagagcaagactctgtctcaaaaaaaaagaaagggggattaactatagattagacgtaatgcaaaataaataattagtaaacattaagacagagagaaaaggtatgcaaaatgagaaaaaaatcaaaaagataaatgaacagggcatcagtcagctgtggaacaccttcatgcagctgtatatatgtgtaattggagtcactgaaggagaagagaaacagagttgatactgaagagcattttttaaataatgattaaaattttgttaattttatgaaaactattatataaacccaccaattcaggaatctcaagaagccccaagcacaagtaacatggaaaatccacaccaagatatatcataataaaattgctaaaaaacaagaatagagggaaaatcttaactgcatccaaagaaaaaaaggccattatgaatagcagagcaaaagtacaaataaaagtagattgcttgtcagaaacaatgcaagtgaaaagacagtggagaaatgtcttaaaatactgaaagaaaaaaaattattttatcatagactaaataattttatatctattattttcttaatacatacacacaccatgcacacacacttctgaccacaatgcacatggaaagtacccatatgtaatgttgaatcacttttcagccttttatttaatttgttccctgggtgacttaatttcagaatttttaaaggctaattaagatgattaacaatgttcgtgccattatctcaccatgattaaagcaggtttaggcattcttacataccttctttctttttctttctttctttttttttttttttaattagagacggggtttcaccacattggccaggctggtcttgaactcctgacctcaggcgatctgcctgcctcagcctcccaaagcgctaggattacaggcataagccaccatgcctggcccctgcataccttcttgctctgctccccactagatttaaaattacttgaaggaaaagatcaaatcttattaatttatattacaaactttcctcaaggaaacatcttgcataaaatttgacttgaagtgaaattgtcatttattcttctaaagggctacttggttgtgagtatctacatatcaaggaaagaaccagagatgtcaatacattataactcatagcctagtttgcattatgcctcacataccaaagtcatatcctgattttggcttaattagagaaaatcagctttattgaagttactgatgttaacaaagataggacatctaatgattcctcaagtggatatattattttcttatctacaggtgacttctttatttaagagtcagggtcccctctgttgcccaggctggagtacagtggtgcaatcatggctcactgcagcattgaactcctggcctcaagctgtctttccacctcagcctcctgagttactgggattacaggcttgagatatgacaatcggtttgcaagtgactttttaaactgcccaccgacaccctaaagctattggtcagagccagacaggtaagaggctacgagtgtgatcactttcagaagcttagcagtttctatactagcacatgaggatttaaaccatcatgaaaataataaagatttcttaacagcccaactttggactttgccagttcctagaactatcaaaaatgttgcttgtgtgatgtcattttcccttagaatttgctcattatttcctctcatttcttacctatcacaggtttaactttctttctcggtaaagactcttttttcttcggtaaaaatgagtaacatctgtacctacaactgcaggaatctacagtggcagtgtttttcaatatttctcctttctagtaggtggcacaagaatcaaaataactttaaaagcatattatgagaacatttaaaatcctctcttttagccattttaagaggattttaaatgttctcaccacaaagaaatgataaatatttggggcaatgaatatgctagttaccctgatttgatcattccacaatatacacatgtatcaaaacatcacactgtacaccataaatgtctacaattattatgtgtcaattaaaaataaaataaactttttaagaaatatattttggaacatattacttcatttatctagtccctgacttgttcccacaaaaagcctaaagcatattatcagctctctaaatacattttcaattttgagaaactttaacccactgtaatacaaagcagttttcatgagatgccagtctgtagaagttattttaatgtagaatgactcatttaataaatgaacatatgctttctatttgaggcaaattattctgcaaaactgcatcatagatgatcagaaattgagatagcttcagtctagactagcaccataatccagtgatttcatttaaaaagaaaaatgaatggtgaggaatgtgcctccctgatcctagtgagttttcagattctctagtatatagtaaacatacaagaaagcagagaaattcatagggaaaaaaatggggactttgccctaagaattgtcaaggggaagctggagagaatcaaacattagggaaaatctcctgcgaaatgatttgatagaagaatccctgactcatcacagcatcattccatggacaaagaccataggtgttcttctttcatgtaaggaagtttattataggcctggagaaataatcggggtattattagctaacattaggataggagttctaagtgccaacacatagaatatgtgttatttcattgaactttgacaaattatctctatttcagattatgaaaaatctgtgatccctatttgcagattatgaaactcagagcagttaaacaacctgctcaagccacataatcaagtggtaaaaccaggattttaatttaattccagagcttgcactcttggccaaacaatacacattatttttagttaaggtaaaaaaaaactagaatatttttctctcaacagcatatcactttttccccacactttctgtaaataataacaaatttctataaataataaataataatttctaggtataatttaatttacatagtgaaacaagccattcttaggtatattccttagttctgtcttcgaaagtctgcatcctgttagcagctggcgtagttggtgggatacttagcagaaggattgtatgtgtgtcctactgtttcactgtcctcctccaggtccaatgccatcaatcactttttctgtaataaatccctagggcttggtctttcatgctacaacatttatatcagcacagcagtccctgcctttgcagagtttgagtgctgcattcattgccatatttggtcatcatgttctcctggacatatatcctggttgctatcaagaggatgtcctcagtggggagaaaagaattgtctatttgtgtctcccacctgaaaactagcaccatttttcatacagccctcttttatgtgtacttacagcctgatttttttcttttttaatttttaaattctttattttgagaccgtgtccctctctattgcccaggctagagtgcagtatcactatcatagctcactgcagcctcaaacctccgggcttaagcaatcctcctccctcagcctcctgagtatctcccagataattttgttttcagagacaggatctcactatgttgcccaggctggtcttgaactactggcttcaagcagttctcccacctcagcctcccaaagtgctgagattacaagcattagccaccatgtccagactattttttaactgacacataaaaaatgtctatatttatgacatagacatatttataataatattttgaaataggtatatattgtagaatggctaaattgatctgattaacatacacagcgacaacatatctatcattctgtgtgtgtggtgaaaacacaacatctactcttttagcaattttcaagaagacattattatcagcaacagtcaccacgttgtgcaatagatctcttgaatttattccttctacctaatatgtgttattgcattgaactttgacaaatcatttctatttcagattatgaaaaagctgcagatccctatatgaaactttgccctttgtccaatatttactcaacccccatgccctgtccctggtaaccaccattctactttctgttgctatgagttcaattttttttagattctacatataagtgagatcacacgatatttgtctttctgtgcctggtttatttcactaagcataatctcaagcaggtcttacatcctgattctaacaagctccaggagactatgaaagtcacctccatggtttctagcttgtgtatccatgctgaatccttgatttatggcccataaaaaacaaagaagtggtagaagtactaacgatgtaagaaataagtgtttatgaatttcgactcaatctctgacactaggcacacagaagcatccaagcaaaagtttttcaaaagaagctatttcccagagcaatttttccaatagcttccaaaatgtgtggcacttcctaaatccctaaattataggcaaggttctcaaattatcacagaaattgaattgactggaaaggcagcatagttcttctgtctcgtgaaccaaattctcttgctaatgactgcttttttatgaaaagttcatatctgagcagaacttctaggggtagtcagcaacaagaaaccatccccagactctgtaagtaaaaagcgatcatattatcaaatcacccagtggtgcccaaatggcttccaccatgatctgaagccaccaacaaccctagagacagagaaaaatgcaggctggcaaatatgctagcacccattgccagaggtgagctgccatattgatgacttctccctggctctgccttgtaacatcaagtctagcagcatcctgtacagtcagtggcatggcctggccaaacagaaaaatttctgctgctccagcatcacaaaatctgacagctgtgtcacttcagagaagtatctacaaaatttgccttagcccagcattctcccaatgaactccagagaacttgttccacaagacactcaacatgaaaagaatttcaaggccaagtagtgctgaaagttctgagttaaccaatatcagattttttttactgccaggctttccagggatttcttattaatatacactagtatgaattatgtctctctaagagaaaatgagtgtagagcatttgccaaacttactgagtcacaggacccttttatatctatggactatttgttctattatctcagttctaaaatgtatatttatctcacattttaatatttctgatattggaattaccttaacatctatgtatatatttaagaggaaaatgaaaatggttatgaaattgatggtgactctttccctccttctatctacctatctctatctaatataatagaagataattcttataattttaagttgccttagcatccattttgaattaagtttaactttctcataccagaagtaaggctcagtcacccttgacacaacttctaggtctataccacacccagtgctcaagctggtgaccagagatgagaacttagaggcatctcttccacctatcagtctgggttccccactttccttaaagtgacccacaatcgtattcctttatacacaccactagttgcccaccccacctcttctctctgtctctctgccttactcttcatttctgccttgtgtgacccaattgtgggttggacaactagacattaggccacttgccaggtaaaagaagtatctcatgaaaggcacactgtaaacattcatgtctatctccccttcatttcctattagagtaagtttgctaattgatcgggtactggacacccagtttagctgagaggtctcaaaataataatataatgaagataaaacactattaaaagcttggaattagtgttccttactatacaatttgaaaaaaaatatgtatctgtttaaaacaaagagctggctaactactcttataaaaataactaaaatgagaagaagaggaaatagactacttattagaaaaccctgtgtatttgaagaaaatcttcatatgataaacagaataccacatttgtatatcgataatcaatattctattcagtcatcaacacaagtaccttaaaaacttatgccaggaggtgtgttatttgccctgttccagttattgtggatcaaaacatttttatttctttacaaagcatctgagagtgtggaataagatgatggaataggactctccagtgttcgttgccacacagaaatatcaatttgaaaaactacccatgcatgaaaatacctttacaagaactaagaaactcatgtgagaggtcacagtacctggctgtagcataataatgagaaaagatgcattgaagagaacaggaaagatagtttttttacccacatcacccctccaatcccaacagcacagcagaaagaaagatactatttgcctgggggaaagagaaagaagtaaaaataagactttgcttttatccctaatatcagacctacaatagtaaaaatgacagtaaagatgctgtcaacctaaaaaatctatattttgttataactgatgtttttttgcaagcctcgtgataactacaaaacaaaaacctataatagaaacacaaaacataaaaagcaaggaatcaaaacaaaccacggagaaaaattcccttaagcacaaaggaagacagtaaaggaggaaggaaattttaaaaatctacaaagcatttagaaaacaagtaataaaattgcagtagtaaacctttacctatcaaaaatcaccttaaatataaacgattcaatttttcaatcagagacacagagtggctgaatacagaaacaaaattcaactacacactgccttcaagagactcacttcacctataacacagagacttaaagtgaaggatggaaaaagacattccacacaaatagaagccaaaagagagcaagaggagatatacttatatcagataaaatagactttaagtcaaaccctctaaaagagacaaagaaagtcattatataatgataaagaagtcaattcagcaagaagcttcaatagttattaagtccatatgcacccaacattaaagaagctaaatatataaggcaaatgttaatagatatgaagggagagatagattgcaatacaataatagtagaggacttcaacacccactttattttttttatatactttaagttctagggtacatgtgcacaacgtgcaggtttgttacttatgtaaacatgtgccatgttggtatgctgcacccattaactcgtcatttacattaggtatatctcctaatgctatccctccccgctcccccaaccccacaacaggccccagtgtgtgatgtgccccactctgtatccaagtgttcttattgttcaattcccacctatgagtgagaacacgtggtgttcggttttctgtccttgcgatagtctgctaagaatgatggtttccagcttcatccatgtccctgcaaaggacatgaactcatccttttttatggctgcatagtattccatgtgtatatgtgccacattttcttaatccagtgtatcattgatggacatttgggttggttccaagtctttgctattgtgaatagtgctgcaataaacatacatgtcaacacccaatttaagaaatggacagatcacccagactgaaaatccacaagaaaatattagacttaactgcactctagaccaaatggaattaacagacatatacagaaaattccatccaacagctgcagcacaccctttttctcaactgcacatggaacattctccacaatagatcatatgttaggccccaaaacaagtcttaacaaattttaaaagattaaaatcatatcaagtatcttttctgaccacaatgatatcaaactagaattttttttcataccaacagtgaattacctgaaaaagaaatgaagaaaacaaccccacttacaatagataccaaaaaatatatactatgaatcaacttaaccaaggaggtcaaagatctgtatactgaaaacaataaaacactgatgaaatatattttaaaaaaacacaaataaatagaaagatatcctgtgtctatagactggaagaatttaatattgttaaaatgtctgtgctacctaaagcaatctagtttcaatataatccctatcaaaataaaagagacattcttcacagaaataggaaaaaaatgtaaaatttatatggaatagcaaaagatcccaaagagccaaaataaccttgagagagaaaaacacagttggaggcatcacactacctagaacaagtagaaaagaatagagggcccagaaataaatccatgcatttacagccaactgtgttttgatagaggtgccaagaacacacattggtgaaaggacattctcttccataaatgctgttggacaaaaaaagaaaatttcaggccaatatctttgatgaacatagacacaaaaatcctcaacaaaatactagaaaaccaagtccagcagcacatcaaaaagctaatccaccatgatcaagtaggttttatccctgggatgcaaagttggttcaacataggcaaatcaataaatgtgattcaccacataacaaagagaactaagaacaaatcacatgatcatttcaatagatgagaacaggcttccaataaaattcaacatccttcatgttaaaaaccctcaaaaaactagtcatcaaagaacatatttcaaaataacaggagccgtctatgaaaactcctcagccaacactgaataggcaaaagctggaagcatttcccttgaaaactgcagcaaggcaaagaggccctctttcaccacttctatccaacatggtactagaagtcctagccagagcaatcagacaagagaaacaaataaaaggcatccaaacaggaaaagagaaagtcaaactatccctgtttttagactatatgattgtatatctagaaaacttcatagtctctgcccaaaagctccttgttctgataaacaacttcagcaaagtttcacgatgcaaaattaatgtacaaaaattagtagcatttctatacaccaacaagatccaagctgagagccaaatcaagaatgcaatcccattcaaaatgccacaaaaagaataagatacctatagatacagctaaccaaggagatgaaagacttctacgatgagaattacaaaacactgctgaaagaaatcagagatgacacaaaaaaatgaaaaaacatttcatgctcatggatagaattaatactgttaaaatggccatactgcccaaagcaatttacagattcaatgatattcccaccaaactacaaaatggcattcttcacagaataagaaaaactattttaaaatttatatgggtccagtaaagagtccaaatagccaaagcaatcctaagcaaaaagaacaaagctggaggcatcacactaacctgacttcaaactatactacaaggctgcagcaatcaaagcagcacggtactggtacaaaaacagacacatagaccaatggaacagaatagagagcacagaaacaatgccacacacctgtaaccatctgatctttgacaaagctgacaaaaacaaagcaatggggaaaggactccttctttaataaatggtgctgggataactagctagccatatgcagaagataaaaactagaccctttcctttcaccatatacaaaaataaactcaagatggattaaagatttaaatgtaaaactgaaaactataaaaatcttggaagataacctaggaaatagcagtctagacataagacatggcaaagatttcatgatgaagatgctaaaagcaattgcaataaaaacaaaaattgacagatgggacatgcttaaatgaaagagcttctgcacagcaaaagaaactatcaataaatagacaacctatagaatgggagaaaatatttttaaactatgtatctgacaaaggtctaatacccagaatttataaggaacttcaacaaatttatgggggggcggctccaagatggcccaataggaacagctccagtctacagctcccagcgtgagcaacgcagaagacaagtgatttctgcatttccaactgaggtaccaggttcatctcactggggcttgtaggacagtgggagcaggacagtgggtgcagcccaccaagcaagagccgaagcagggcgaggcatcacctcacccaggaaatgcaaggagtcagggaattccctttcctagccaagggaagtggtgatggatggcacctggaaaatcaggtcactcccaccctaatactgcgcttttccaatggtcttagcaaacggcacaccaggagattatatcccgtgcctggctcagagggccccatgcccatggagcctcgctcactgctagcacagcagtctgagatcgatctgcaaggtggcagcgaagctgggggaggggcacccaccagtgctgaggcctgactaggtaaacaaagcagccaggaagctccaactgggtggagcccaccgcagctcaaggaggcctgcttgcctctgtagactccacctctgggggcagggcatagccaaacaaaaggcagcagaaacctctgcagacttaaatgtcccagtctgacagctttgaagtgagtagtggttctcccagcactgagtttgagatctaagaatggacagactgcctcctcaagtgggtccttgacccctgagtagccccaactgggaggcaaactccagtaggagcagactgacacctcacacagccaggtaaccctctgagacaaaaatttccagaggaacaatcaggcatcaacatttgctgttcagcaatattcactgttctgcagcctccgctgctcatacccaggcaaacagggtctggagtggacctccagctaactccaacagacctgcagctgagggtcctgattgttagaaggaaaactaacaaacagaaaggacatccacaccaaaaccccatctgtacgtcaccaccatcaaagaccaaaggtagataaaaccacaaagatggggaaaaacagagcagaaaagctgaaaattctaaaaatcagagcgcctctccccctccaaaggaatgcagctactcaccagcaacggaacaaagctggatggagaatgactttgacgagttgagagaagaaggctacagacgatcaaacttctccgagctaaaggaggaagttcaaacccaatgcaaagaagctaaaaatcttgaaaaaagattagacgaatggctaactagaataaccaatgtagagaagtccttaaaggaactggtcgagctgaaaaccatggtacgagaactacatgatgaaggcacaagcttcagtagccaatgcgatcaactggaagaaagtgtgtcagtgatggaagatcaaatgaatgaaatgaagcaagaagagaagtttagagaaaaaagagtaaaaagaaatgaacaaatcctccaagaaataagggactatgtgaaaagaccaaatctacgtctgattggtatatctgaaagtgacggggagaatggaaccaagttggaaaacactctgcaggatattatccaggagaacgtccccaatctagtaaggcaggccaacattcatattcaggaaatacagagaatgccacaaagatactcctcgagaagagcaactccaagacacataattgtcagattcaccaaagttgaaatgaaggaaaaaatgttaagggcagccagagagaaaggtcgggttacacacaagggaagccttgtgtaacaagagagatcaaagtaacagctgatctcttggcagaaactctacaagccagaagagagtgggggccaatattcaacattcttaaagaaaagaattttcaatccagaatttcatatccagccaaactaagcttcctaagtgaaggagaaataatcctttatagacaagcaaatgctgagagattttgtcaccaccaggcctgctctacaacagctcctgaaggaagcactaaacatggaaagaaacaaccagtaccagccactgcaaaaacatgccaaattgtaaagaccaacggtgctaggaagaaactacagcaactaatgagcaaaataaccagctaacatcataatggtaggatcaaattcacacataacaatattaaccttaaatgtcaatgggctaaatgctccaattaaaagacacagactgccaaactggatagagtcaagacccatcagtgtgctgaattcaggagacccatctcatgtgcagagacacacataggctcaaaataaagggatggaggaagatctaccaagcaaatggaaaacaaaaaaaggcaggggttgcaatcctattctctgataaaacagactttaaaccaacaaatatcaaaagagacaaaaaaggccgttacataatggaaaagcgatcaattcaacaagaagagctaactatcctaaaaatatatgcacccaatacaggaacacccagattcataaagcaagtccttagagacctacaaagagacttagactcccacacaataataatgggagactttaacaccccactgtcaacattagacagatcaacgagacagaaagttaacaacgatatccaagaattgaactcagctctgcaccaagtggacctaatagacatctacagaactctccaccacaaatcaacagaatatacattcttctcagcaccacagcacacttattccaaaattgaccacatagttggaagtaaagcactcctcagcaaatgtaaaagaaaagaaattataacaaactgtctctcagaccacagtgcaatcaaactagaactcaggattaagaaactcactcaaaaccgttcaactacatggaaactgaacaacctgctcctgaatgactactgggtacattacaaaatgaaggcagaaataaagatgttctttgaaaccaatgagaacaaagacacaacataccagaatctctggtacacatttaaagcagtgtgtagagggaaatttatagcactaaatgcccacaagagaaagcaggaaagatctaaaattgaaaccctaacgtcacaattaaaagaactagagaagcaagagcaaacacattcaaaagctagcagaaggcaagaaataactaagatcagagtggaagtgaaggatatagagacaaaaaaaacccttcaaaaaatcaatgaatccaggagctggttttttgaaatgatcaacaaaattgacagaccactagcaagactaataaagaagaaaacagagaagaatcaaatagacacaataaaaaatgataaaggggatatcaccactgatcccacagaaatacaaactaccatcagagaatactataaacacctgtatgcaaataaactagaaaatctagaagaaatggataaattcctcgacacatacaccctcccaagactaaaccaggaagaagttgaatctctgaatggacgaataacaggctctgaaattgaggcaataattaatagcctaccaaccaaaagaagtccagtaccagatggattcacagccaaattctaccagaggtacaaggaggaactggtaccattccttctgaaactattccaatcaatagaaaaagagggaatcctccctaactcattttatgaggccagcatcatcctgataccaaagcctgagagagacacaacaaaaaaagagaattttagaccaacatccctgatgaacattgatgcaaatatcctcaataaaatactgacaaaccaaatccagcagcacatcaaaaaaaaaagcttatccaccatgatcaagtgggcttcatccctgggatgcaaggctggttcaacatatgcaaatcaataaacgtaatccagcatataaacagaacgaaagacaaaaaccacatgattatctccatagatgcagaaaaggcctttgacaaaattgaacaatccttcatgctaaaaactctccataaattgggtattgattggatgtatctaaaaataataagagctatttatgacaaatccacacccaatatcatactgaatggacaaaaactggaaacattccctttgaaaactggcacaagacagggatgccctctctcaccactcctattcaacatagtattggaagttctggccagagcaatcaagcaggagaaagacataaaaggtgttcacttaggaaaagaggaagtcaaattgcccctgtttgcagatgacatgattgtatatttagaaaaccccatcgtctcagcccaaaatctccttaagctgataagcaacttcagcaaagtctcaggatacaaaatcaacgtgcaaaaatcacaagcattcttatacacaaatagcagacaaacagagagccaaatcatgagtgaactcccattcacaattgcttcaaagagaataaaatacccaggaatccaacttataagggatgtgaaggacctcttcaaggagaactacaaaccactgctcaatgaaataaaataaaagaggacacaaaccaatggaagaacattccatgctcatgggtaggaagaatcaatatcgtgaaaatggccataccgcccaaggtaatttatagattcaatgccatccccatcaagctaccgatgactttcttcacagtattggaaaaaaatacattaaagttcatatggaaccaaaaaagggcctgcattgccaagacaatcctaagccaaaagaacaaagcttgaggcatcatgctacctgacttcaaactatactacaaggctatagtaaccaaaacagcatggtactggtaccaaaacagagatataggccaatggaacacaacagagccctcagaaataataccacacatctacaaccatctggtctttgacaaacctgacaaaaacaagaaatggggaaaggattccctatttaataaatggtgctgggaaaactggctagccatatgtagaaagctgaaactggatccctcccttacaccttatacaaaaattaattcaagatggattaaagacttaaatattagacctaaaaccacaaaaaccctagaagaaaacctaggcaacactattcaggacatagccatgggcaaggacttcatgtctaaaacaccaaaagcaatggcaacaaaagccaaaattgacaaatgggatctaattaaactaaagaacctctgcacagcaaaagaaactaccatcacagcgaacaggcaacctacagaatgggagaaaatttttgcagtcttctcatctgacaaagggctaatatccagaatctacaatgaactcaaacaaacttacaagaaaaaaacaatcccatcaaaaagtgggagaaggatatgaacagacacttctcaaaagcagacatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtagaagacagtgtggcgattcgtcaaggatctagaactagaaataccatttgacccagccatcttattactgggtatatacccaatggattataaatcatgctgctataaagacacatgcacatgtatgtttattgcagcactattcacaatagcaaagacttggaaccaacccaactgtccatcaatgatacactggattaagaaaatgtggcatatatacaccatggaatactatgaagccataaaaaaggataagctcatgtcctttgtagggacgtggatgaatctgcaaaccatcattctgagcaaactatcgcaaggacaaaaaaccaaacaccacatattctcactcataggtgggaattgaacaatgagaacacttggacacaggaaggggaacatcacacaccggggcctgtcatggggtggggggagtgaggagggatagcattaggagatataactaatgtaaatgatgaattaacgggtgcagcacaccaacatggtgcatgtatacatatgtaacaaacctgcacgttgtgcacctgtaccctagaacttaaagtataatttaaaaaaataaatttacaagaaaaaaaactttaacaagtgggcaaaggacataaacacttttcaaaagaagacatacatgtgaccagaaagcatatgaaaaatgctctacatcactaattatttgagaaatgcaaatcaaaaccatgagaaaccatatcacaccagtcagaatggctattactaaagtcaaaaaatagcagatgctggcaaggttgtggagaaaaggaacacttatacactgctggtgggaatgtaaattagttcagccactctagaaagcagtttagtgatttctcgaagaacttaaaacagaattaccatttgactcagcaatcccattattgggtatatacccaaaatatacaaattgttgtaccataaagacacatgcacacatatgttcatcatgatactattcacaataacaaatacatggaatcaacctaaatgctcatcaacaatatactggatttttaaaatgtagtacatatatacaatgtaatactgtgcagccataaaaaagaatgagatcgtgtcctttgcagcaacgtggatggggctatacaggttattatcctaagaaaactaacacaggaacagaaaaccaaatacatcatgttcccacttataagtgggaggtaaactttgagtaaatgtggacacaaagaaggaaacaacagacactagggcttacttcagtgtggagggttagaggagggtgacaatcaaaaaactaccaatcaggtactatgcttattacctgagtgatgaaataatttgtacaccaaaccaccatgatacacattttacccatgtaagaaacctgcacatgcacccctgaacctaaaataaaagtttaaaaagtaaataaataaatattaaaatgttttcattgttcctatagtaaccaggaaagcttttaaaatactgatgcctgtattcaaaatgctgatgccacagattacgatttaattgagctttgattgggctggagcattaagatatctttttgagcagctggacttgacaatcagtggtagccacaccaaaaatattaacttatttattacatacagctattttattgaattaaacttttgtctgaattttctgaccagtttagataaaatattttattcagtagcccatatacatacagactcacttgtctaatatgaggaaagtgttgcacaatatttcttcatgggtccctcatatttctgcacatcttgcaagcagaggcacagacttccctttgtttcagactgtctctctgaggatgttagtgtctcctctggaacaaagagtaagcatgcctactactctttttaagacatttgccttccctaacctcacgtattttctccagtaagaggagaaaacccactgcatgtgcacacatccatctgagtacccacttcactcccatgggacttgggagcaaggagaactgctatattcttgattatgctatttattggtccatgagtaataaaatcctttgtctctgaaaaaataaataaaataaatgctgttgggaaaactggatattgatgtgaaaaagaataaaattagaactttatctcacaccataatcaaaaatcaactcaaaatgatataaaaacttaaatgaaagacctgaaacagtataactaccagaacaaaacctcagaataaagctctaagacattggtgtgagcaatgattttttggatataatctcaaaaacataagcaatgacagaaaaaatagacaaatgggagtacatcgaaccaaaagtcttctgaagcccagcaaaagacacaatcagcaaagtgaagaaatgacctgccagatgggagaagatattttcaaactatacatctgaaaaagagttaatacccagaatatagaatatataaaaaactcaactcaatagcagaggaaacaaataacacaattaaaaatggggaaagaatctaaatagacatttatcaaaagaagacatacaaatggttaacagatatatgaaaaaaatgctccatattgctaagcaacaaatgcaaatcaaaatgcaaattacaagaataatgagatatcatcttgctcctgtcagaatggctattatcaaaaagataaacaaacaatagtaagtgttggcaaagatgtggagaaaagggaacacttgcatactgttcgtgggaatatagtttagtatagtcattatggaaaacactatggatgttcctcaaaaaattaaaaatagaactaccatgtgattcagcaacctcactactgggtatatatacaaaggaaataaaatcatatattaaagagataactccacttccatgtttattgcagccttattcacaatagccaagatatggaatcaaactaagggtccattaatgaatgaatggataaggaagatgtggtatatacacacaatggaatactattgagccatacaaaagaaggaaatccttttaactgagataaactggataaacctggaagacattgtgttaagcaaaataagccaggcccagaaaaacaaaccccacgtgatttcacttatatgtagaaactaaaaaaagttgatcttacagaaatagagagtagaaaggtggttaccagagactgaggcagttatagggaagattggttgaagaggtatgggtcaatggatacaaacttacagttaggaggaataatttcaagagatctattgtacagcactgtgattataattaatgataatatattgtattcttgaaaaaaagctaaaagagtggatagtaagtgttctcaccacaaatgataactatgtaaggcaatacatatgttaatcgctatatttaaccattctacaatgtttacatacttcaaaacatcatgttgtatgcaataaatacatacaattgtatctgttaagttacaaaataaataaatttgtaaaaaacagtatcaatgactcaggctggccattttacacaatctattttggtgaattcctagtccttgaaaacacttattattcctcttatttactaactttaatatgagtcaacattctcccttgctaagggaagtgagccttgcaaacactttctggaattcatgtttgtcctaaaagtggaagtgaaatccaaatttggaacttgtgttccaggaatgactgatcatttctacccatcacccctccctaaccactccagccctgtgaggataacacctatggcctgaacatagccaaaatgttgctatcttttatcagtttgttcaggctgccataacaaagtaccacacactgggtgcttaaacaagagaaatgtatcgtctcacagttctggaggctgaatgtctgaaagcaaggtgttggaggattggttctttctgagggctgtgaggaaagaacctggttcaggtctctctccttggcttatagacaaccatcttcatgtccacatggtgttttctctgtatgtgtgtcagtctccaagtttcttttttataaagacatcagtcacatggcatttagggctcaccttaaacaccttatcttaacttgattacctctgtaaagactttacctccaaacaaggtcatattctgaagtaccggggtttaggaccttaacataagaatttttccagggacataattcaactcataatactatctgaggtaaaggctgtcaactgttcagaacactaaagaatcttttagacatcttgacctaaggcaaacccagatcaatcctttattccctctctctcttaatgggtgagtctctgggtgatgatctgggcctgttgtggtatgtcagacttattggaatcacattttctcctggcaagaatgcctcttaaacccttcagaaagaagtatgctctggctaatgagtcatgactggagaaacagagagaactgagctccaacaaattctcaaggatatgactcaaatataaggaagattataagaaggccagaaactgttcttatgaaaacatcagtttcaagtttaactacagcttcccatggcaccaagcctgaaatctaaaatttcataatagtaaataatggtgatgactatagcaaacatttattaagcatttagtaaatgcctgaaataggtgctttacatacatgatattattaaatcctcacaggcactatatgaagttcatactttcaattaaatctgatatgtaagtaaagagcctagtacagactccaacacatagtaggtactcaatcgagagctaacatttatcctcattttacaggtaagaaaactgaatatcagagatacctaagattgtgctggtagtgagaggtaaagcctatatttgaatctaggcatcttagactctaaagcttgcgatcttatctactgactacacaactacaccgcatcccattcctatccatgtgccacagaagtccaagattatataaagctccagaaccatccatcttgtcctctgccctttctgagtcactggagccttttatgtctgccccattttgtctccagaccttgaaaattactttctcaggattcaagtaagatttcagaaataggactcaagaccttcctctttttccaggattccttctccccagatagttccagaaactctttataagccacaaggaatggtcccagctgtctttcatgaactcaggtgtcccttggccacctgtttcccaagagttaagtgttttctgaaaggagattatcccccagctcagagaaacccaactagctacctcagctgcatctattccacattttccagcaaccagcagtcctgaggggctgcagaccccaacccagtgattgctccacatgtccatttacctgagttcatgaatctacagccagcatgttcctgggttcctcagagctcatttgtttggggtttcttcaggctgagagccatctcagccaggcttcttcaatcaagaggtcaagagcatactgtggccttactccctcccaccattgcccccagcaatttcagtcatcaacagaagagacaatgtggccaccctaacaaaacatgtgaaacttttcaggtgcatgttctttaccttgacatcaactggtgaatgtgccacgtcaaacctcaagatgttccaacaaattagaatccagtgattaaggaagggtcctctacttggttagtttccaaatcaaaagacctccttcaactcacaataaaataactattttatttccttcatttctgcaccaaagatatatagagtgcccgaagtatgcaaagtgtttttacatgcattacctgacccttgtagcaattctatgaatctactgtgtatcattggccccttttaaagatgaggaaaatgattctcaagctagtcgaatggctttcccaagacctctgagccagagaatcataagccaaattaggcattcagggtgtttttttcatatcattctgttttctttccactaccctgcattgcatctctgattctcaatattctctttcaactctgtctgtatcataaattcttacctggcactccctacacaattttcaaaaattaatttcttcaacaaatgattttgggatggatgctctgtgccacattctaggctaggtatgggcacaaaattgagcaagacaaacataacttttttcttcatggggcttacagtccagcagattagctggaggtgccaaaagcagtgtaccaaagggagtactcaaaaatagagaataaaagaccttttatatgaaaagtaaaaggaagtcagagtttaattcttgtaagtatctattaggaagactcttaggtgcccaaaaaggtgattcaaaaggctaaagtgagccattttaaaagagttcaccaagcctgctttctgcagcaactgagtaactatgagatgattagctcatttggaggacatttttatcttcccttttaaatgtgaaattctcagactaagccagatatagctactgttagggtcaatgtttttataacaacttattcatagctacagtaaaggccagagccagtctgattaatgcagctaaaccactgtctacactgaggaggaggccccagacccaaatcagttgtctgggcctcttgtcaaccagtccagtcactaaatctcatagggccttcgtgtcctcatctataacacagaggctgtaataacctatcaaaaatgattgttaagaggattctttgggaaaatatactcaaaaatgctatgaaaattcttagtatagagtgaagagccatctaggttgtaagatgaaagccatagactgaggatggtaaaaccccaaggtagaaggattctcagcaacacagtggactctcaactacccatgcccagagatgggggtaaagttctatgtctttgaaccactgttagtgtggctttgttgtagtagctgagcctgtatctcaatccatggagatgttaactagactaaagaataaagtaaatcagctgtatctctagcagaaccatgttcacaaatatatttccttagagaatttctttctctaatcatttacctatagattattttactattgaaagatgtgtatgtgtgtaaatttttttgcaggaatgttctcacgaggaattggcagcctgaggggttctgttttcctttacctttttgtgaaagagatagactcagaaaaggaactggatttgacaaaacacaatctgctctcaattttcagcgtcccacctgtggtcattaaaattaataagcccaaaattaagaagtgcacaacttgagccactgtgattattttcttggagccatgggagtcaggaacaaccctggggtgtttggtaggagtttttttggaaggaatggaaaactctacttttaaatacctaaaaagagaaaggaaataaagctttccttagatagagtaagaaaaaaaattttgttttctctctgagaatcccaattggctgaggctagcaacacttggaatattcccagagatagatacaaactatttggttcaatagggaagcagactcagatctaagtaaggagcaacacatttagcagctgtgaggtctgatttagaccaatggagtcaaagagtagccattagcagttctacatgatgctctgaacttccattgtctctgtgatggttaattttctgggtcagcttgactgtgctaagggatgatgcccagacacctggcaaaatattatttctgggtgtgtccatgagagtgtttcccaaagaaatgtgcacttgaattggtacttagagcaaagaagatcaccctcagcaatgagagtggacatcatgcaatctactgagggcacaaatagaaaaaaataaggcagaggaagggtaaatttgctcactctgcttgagctgggccatctgtcttctgttgcccttagacatgggtgttcctggttctcagaccttcagacacaggctggcactcacaccatcggctcccctaattctcaggccttctagtttggactggaactacaccactggatttccgagcctccagcctctataatcacaggaaccaatacctcaaaataagtctctttctatatcccaatgtatatatatatgtgtgtgtgtgtgtgtgtgtatacacacatatatgtgggaatatagaaagaggttcattttgaggtattggatatatatgagatattatatatatatatatacatatatatacatatatatatatacacatatatatatatacacacacacacatatatatatatatatatatatatatatatatatatatatatatacccaatctgctccctcagttttgtggttgggtagaattggcctcatcttttatatatatatatatatatatatatatatatatatatatatatagtattatatacatatattatctatatatagattttatatatatctacatatatatatagagagagagatagatatagatatagggtcccctgataaccatgtgcccctcccactgtggtgcctcagctggccctaccttctccagattctggttcagcccctgacaccaaccagccattgactgcccaccatctcccagctaagtgataaaagttcctttatcatggggctgttatttgcattttgacagaagccttctataacttatgctcaaaccctgcatatatatctatatctatatatagagatatatagatatagatattagatatattatcttatatatatattagtagatatatgtatatgtatttttaggatatatatacctatatatctcctactggttctgatacagtctcttagcaaacagtcccaatctttcattccttcaacaaataattttataccaggccctgttctaggcacttggaaaacacaagtaaacaaacagacaaaaaattcctgtcctttggaagttataattaagaagatggaggcagtcattaaacattaaaggcaataaataaataaaatatataatatgttaaaggtgtatgtgttatattttaaaaaagaagaagaaaaaaaaggcagggtaaggtcaaagagaatcagaagtttgggtaaggagagtggggttgcaaaattaattagcctggccagggtaaacctccttgagaaggtgacatttgaacacatacttgaagaaagtgagagagttgaaggaggtacagctatctggaggaaaagacttccaggcaaaagaaatagtaagataaatgacccacagcaggagcatttcttatttgttttaaaaaacaccaagactccactgtgtggccagagtggaatgagcaggttgggtgggggaaaataactgcaggttagagcacagaaagccttgcaagtcattataaggatgctggttgttcttagagtcttacaagcagctgttgcagagttttgagccgataggtaccattttctggcttatgtgtttcatttgtttgtttgtttgtttgttttgttgagatagagtctcactctgtcacaggctggagtgcagtggtgtgatctcggctcattgcaacctccatcttctgggctcaagcaattctcctgcctctcagcctcctgagtagctgggattacaggcacacaccaccacgcccagctaatttttgtatttttagtagagactgggtttcaccatgttggtcaggctggtctggaactcctgaccttgtgatccaccggcctcggcttcccaaagtgctgggattacaggtgtcagccaccacgcccagtcgctggcttcggttttaacaggatcactctaggttattggctcaagtagccaaacactctaagggttgaaactggctttagttgttccagagactcaaatgataacatccaagcttagtttctttgcatgtctcagctcagcctcctttatgtgttattctcagcctcaggatggtccccttcctggtagcaaatgactgaaacagctctaagccttgcacaaccaaagccaggtaaacaagagaaagcctttctttctacaagtcccaggatatatctcaacagagattccgcttgggatgtgttcccctctctgaaacagtggcagagggtgaggtaatgaagcacatgcccctgaatctgaagatgaggccaattctacccaatcacaaaactgagggagcagagtgggtttcctaggggaaatttagggtgctgctaccagaaggagggagactgtgcattgaatcacaaacgataaatgctcagttatttaggggaaaaaagattcatatgcttatcactttaatgtgaggtaggtcagcagtggctacgaagaggtgtggaaccaagggcttatggcagaaagaggctagaactgaaaggaaggatcttggaaggtcacgtagacttgtgcactattcttgattctgctgctagcacaatggggctcgtcactcaattttattttgggggccctaaattccagcttcacctccatgcagtgagctatcatgccatatattaccatttcagttttccattgagattcctcactaaaaaataacgtggtgatcttaaactctcaggcttttccaactctaaccttgtaggattcttgctctggcctctggaatcctcctcctgctgtctttgggtcccctgataaccatgtacccctcacgctgtggtgcctcagctggccctaccttctctggattctggttcagcccctgacaccaagcagccattgagtgcccaccatctcccagctaagtgataaaagtacctttgccatagggtggttatttgcattttgacagaaggcttctagaacttatgctcaaaccctgcacattcacataaagtcctgggtgctgcatgactctaagcctcattctgtaccttgataagaactgggcctgattcatgcgtgcccaaatgataaaacactacagtaatgtccaatctcaacaggaaatactatatttcttcccttaacacctcagatgtattagaatgatggaaatcaagtaggcagtagggccgctccaaaaacatttcacggacttggctacttccacatacagtcagcgctacaataattagggaaaagcagacttgaagacgccaacttttcagacttaaatagtcctacaacacgtaaagcaacaaatctattgaaaattttttgtacaagtatttgaactttctccttgacgtaggagctctgagttagctctaaagccatttccctgaaacaagtgtggagacactgaactgcgtgcaattacaggttgtgcttccacaacgacacattgtctggtgtggctttgaaagctcatgaagaaatggtagaagggatgtggtgggaacactcatcctaggtcacttttacaatatctctttgactttcagcattgaccttcagcatggccttctcacagcatgctctggccttctccacctctgggcctcttttcacactgccccgcctctttaaatgtcctttcctcccatcccagctctgctttctctactattttctctttttttcaaagctattttaaacattgttgcctccaaggagtctttcctgatctctctgctggaaaaaatatgagccgcctcttagctcccacagcatgctacctctatctccactatgacaacaagaaattagcttcctttaaaaaaaaaaagcctctgctcaaaccctgcacattcacataaaggcttgggtgctgcctcattctggaccttgctatgaactgggcctggttaatgcctgcccaaatgataacacagtaatgtccaaactcaacagggaatattctatttctttctataactgtggtagcaacctctgagatgatctccagtgatacctgcctcctggtgtgcatgctctgtgttatccactccccttgatgccctgagtgtgggcaggacttagtgactcccttatagtaaatagaatactgaaaaagtaatgggatgccacttccaagagattagtaagattaaaatacaaaaagtctctggcttccattctgaatgaatgaatcaatcaatctctctctctctctctctgtcgctgtctctctctctctctttataacctgtctctctccctttttgtctcccactctctccccctcactacccttctgagggaagccagctaccatattgctagttgccctttgtaagttatcccatgaccatggggcaaggaactgatgcttacaaccaacagccctcaaggaatcctaccaagagccatgtaagtgaacttggaagaggatcctcctccagaagagtcttcagatgagaccacagccctggctaacacctagacagcagcctgtgagagaccctgagccagaagttctcagcaaagccacatctggattcttaacccatggaaaggcaataaatatttcctattttaagcaactaaattttgaggtaatttattacacagcaatagacaactaatatagtaaccaatcaaaaacgcctttcagattcctacattttttggaagctccttatccattccttcccagtatctgcccatcatgccatagaccacttattagcctttgttattcttcaacaacctactattttttaggcaatatgctagagaattaagctcagaatttgattattccaatgaatgcaactcttttccaagaagctcagaatttcattattccaatgaactcagctcttttccaagaaatagtatagatatccaaacttcagaaaactctcccattaaaatgtagtcccaatgaagttgtaacaagatatactttttatatttttatatatttagtacccccatgattctatttgctggtccattaattcagataaatgtatatttcatattaatcagattgaactatgggaagaggaacaaagtctattcaagtctgttcaaatgtcctaatttgaatgggaagtaaatcttgtcataaagccaaaaatctttcaggagaatcacttggtgggggtattagctgacaattgtaacatccttttcacctattcatcatgttcttccacaagccccagcatgagcatcaccaggaagtgacttcagttgctgaaaagcagggggcctagccctttaggaatggcccctgtggtgacatttatctcttaaaggtcacgactgcttctggaagaagagatgctattgtcattgacactgactctattaatatttcatccaagtcctgcaaggctttctcctgtgtctgaattcctcattggtttggtttgacattatgtcaattcattttggccttcagtttcctgaaaattaatttatggattttttttagtcaaatcaacactaaaagcacttattgtgtatacatatgctaggtacagtgggagttggaggaaaagacacaaagatgactaaaacatgagatgattcctacaaagtcagagtctgaatagccctgaataaaggtttagaaatagttctatgctcaaagacctcaactatcactagagcaggacactgaagacctagcatgctgattccaactctgtcactcaacactgcatatgcctgggtaacttatttttcttctcttagcctaagttgtctcatctgtgcaatagggaattttaaatttagaacaggatgctgctgcaggcagaatcctagaatgtcctcccaagattcctgccccctgatgtacacaccttgtgtaatctcctccctgtgagtgtggcttgggcctatgtatatgatgagattttgctcccattgttgagttctattatgtggcaaaagtgaagagatttttgcaaatgtgaagtcccaaattagctgattttgagataaaagggagattatgtgacttcatcagttaacagctcttaaaagaggaactgggcccctcctgagaagagagatactccttaggcctggaaggactaagctgccatgttatgagagggcctatgagacagtcgtgtgatgaggatctgtgagcagtggcctctagggctcagaatgacacccaactgacagcctgcaaaaaaacaagaacccttgtcctaaaactgcaaagaaattaattcttccaacaactacatgagcttgaaagaggactcaagctccagaaagaaacatggcccagccaacatcttgattgcagtcttgtgggaccttgagcagaggacccagttaagccatgcccagatgcccaatctatggaaacagtgagataatgaacatatgttgttataggccacaaaatttgtgataatttgttacatagaaataaaaaactgatatagattctagatacattccatcttgcccactaactctaatgattgatcatatctgcttggagcaatatattgaaaagaattctaagtctgcatctaagctcagttacaaaaagtgtcataattgattaataatatctatcatgaatatttttcagtgaggactcctctgaatgcaagcaacagaaaacatgacgcaaattgacttaagcagggaggagtgtttcgttctgccaagccagcagctggaatcgccccaaaagcagcagcaggggaatttccacaaaggagttccccaaattgtcctgagatggggctggttgggattccaaagaaagtagtactaaatgtcagggtgatcagtccaaagcaattattaggggaacttacagaatgctgcagcaacctttgagatggacagaaagagaaaagaggtgctctacctacgtatgtctgccatgagggtgtcagggtatggagtttatacaaaggtttaagaaatttggctcagggccagggccagtgtattagtctttttcatgctgctgataaagacatatccaagactgagtaatttataaggaaaaagaggtttaatgaactgacagttccagatggctggggaggcctcacaatcatggtggaaggcgaaaggcacatcttacatggcagcaggcaagacagaatgagagtcaagcaaaaagggaaaccccttataaaaccatcacatctcatgagacttattcactaccatgagaacagtatggggaaaccacccccatgattcaaatatctcccaccacatccctcccacaacacatgggaattatgggagctacaattcaagatgagatttgggtgggacacagccaaaccatattatttagtttctttcagcgttttggcaacaacctagacacctatgtcagcacctagaaattttcaaggccccagtttgggtttgagcctgctgagagaaatctgcagctggatgggtcacagaatgttcaagcactctgtgacttttcaggaaggacacagaaagaaagcagggggaactgggggaacctacaatggggaaggattgttagatctggcatttactcagcaaatatttactgaacctccactgtgtgctgaacattgttctaagcactgaagttagaacaacaatgaaatccctgccttcagagttcccatgtccatggcttatagaaatgaaaattccagggatagagttgatttcaggcaatggttgaatccaagggttcaatatactatttctgtgttatagctcctttaggcttcaagattgcaccctttctgctccacatcccgtggaaaaacgttattttttatatctgcttcctaaagcaataaagaaaactccctctttactgatcttgattggatagactcaggtcacacacccacccctaaaccagtcactatgtcctggacaaaggaatgacttaatcagtcaagctggctcaattcttcagccccaaagagggaaatgaagttggctccacctaatgcacctggtttgggactgcagaagagatgattcttgagtaagctatcagggtcctgccaccagagaaacagaaaataatcaacatccaccacagaaaaggagtgaagagtggctaaaaattcaccacatgtttggtctttggatgcaagatgatccctaaagtcctttaaaattctaaaattgaatactacatattcttgtatttttattaaatgttattgatttctaatgtcaaatgaaatatacgttcaatgtaatagaaaaaaatcaagtgatgcagcaatctaaaaagcagaaggcaatgttccccaagaacctctatctaccctacacccaacatcgtaaaaatcatcctgaaaacatgcctgtccttcctgtggctataattctatgggccacgtttatttggcacatagggtttggcacatatttagggtacacatagacttctggaaggaagaggagtatagacattcaggctctgggaaagagactccaataccccaatggcaagatcatggaggaagtcacagataatgggagaacattcctgggactactacatcaaagccaaagagacccctacctttccaacaaatgcccatccatttcctcaatatttaaggaatcagagtggcaaggatctcagccccaaagtgccctctctggtgattacacagtatgattgaaagagcatggaacataaaatcagtcagacacaggtgcaaattttggccactccctaatttctctctgccactatctaattttggccctgctactacctaatcctgtgtaagaccacaggaagtttaccatattcctcaaagctccagtcttctcatctataaaaactggaataagatacccacctactagtccatgtgtgattgagtgaggtaacagcacagatggcaatacctaacaggcacctatgaatgaagagaattaatgcagaatgagcctgcattgtggcatggaaagcacactagactggaagtcgagagtcgtagtaggcacagtccattggttattcaagatcttctgtacagagcagttaagaccttggactctggagccagactgccttggttagaatcccagcttcatcatttcctgtgttaagtggctggaattttacaagttacatgaaattttaagttacttgaacattccatgtcttggtttctctctctgtaaaatgacaatgacaataatcgtccttaattcatagggttgttgcgaagattaaatgagtttagtaaatgtgaaacacttagaatagtgtgtaacacattgtttgcactcaataaagatttgctattattattatgcatgtatccaatacacatttattgaaaatatatgttccaagatctatgttagatgctagaattgcataaatgtatatatgtcagtatcttccatggaagagctcaacacaaacacataaatagatttttttattgcaaaatgagatcacaattacaacaatagaagaatgaacaaatgctatgggagcccagaagagggagcctaacattggaagaatagggaaggcttcacagaggggaatatttaaactgcaccttatgctgataagccatttaaacaagaagggcaaaggaaattgggtctgcgagtaaagcaatagaaaaattaaaagcagctatatattagaagcattccactgagtgaaaaaaaagtaatagatttataacactacacaatttctgaaacatacagccttgcacacaaaatgacaagctacattttacaaaaacacctataaaaaacacacagaatgacagtggagaatcatggttttttttttgtttgtttgtttgttttttaaatctttcaatattatttaatgaaaaagtctcacactgtcatgtacaggatatatcaacatttactactcatctgtcatgttaggaaaaacatcattattacacgcttggaaaatcctcaaacccatctctagtggatgtctgtcataatttaaagggtattttccccattcaaataaaacaatctcttgtaaagctacaatagttatataccaaagcaatatctagttacatgctttacacagtcccgtgaaaaaataacttaattgctcctaatccctgatgcaaggcacttcaaagcacccgcacaaaacgtccatgtaaacagcagtacagtacatcatttaaataacataaatgacttctacacagcttgacctaggaaaaaataaaatccatcatagccacagctaaaaagcatgttaagattcacaataagaatttgtttctcttattataaagagaagagcaatcatataacctcctgggggtgggggagacctcataaatattttatattgattgacaaaacagcatgctccctgggtacgtatgaaatcagaatattcaggagtaactgagaggatgcaaataacatttcttagtacccagctttaatatctaccagacctggtagtctggattatttgtagcaccatggaaaactcattagaaaatcacaaaggtatacacctcaacctttctatgaggttcatttaatttatagtaacaaacagcagtgatgcagataaagaatctttaaaattattggcttactggatttacctagcaagaaaaattctatattacttattttagtacatctcatgtacataaagcaccagtttaaatgagagtatcaaatatctccagcatctttttgcttagcctagaagttcatttcttatcactttccatggcacactcttaaagccaaggaagataaaactagaatggttataaatatgaatggagaaattcagttccttccctatcatatttacatgtctcaagtaaaacacagatgagtggcaaaaggtctactgcattctctggaacctgccaccccagagtagttaactggctactagaggattaacacacagggctgagcaggtcaaagccagggctctgtcaggtaagggccagtttttactactgagcaactcacaaacaccactggtaaagcaaagaggtgtgagtgtgcatatagctcagggaaccctgagtttacccttagttaccactaaaaactaacaaatgagactccactgaggcttaacttcatatacaaaaatcaacacctttgcctctttgacagtggtaattattagcatgcccttcttaggtataaaagggataatggtactagcttttgtatttgaattaattatcattccagctttttatatactatatttcatttatgaagaaattgattttcttttgggagtcacttttaatctgtaattttaaaatacatgtctgaatatttatagttgattcttaactgagaatcatgttttaaaagcataattaaaatgtaaagcgagagaaagaccatcactcccaatggtgataatgtaccatgatctgaaagaaagggagagcagaaagcaggagggagggagggaacaaagagaccaaacatagaatatgttagaatttgccagcaatgtattgcatctgaaattctgaaagggtcagatccctgctggtagaatgaggcatcaggttatttcatctaaattatcaaaagtaatgtcagaggcagtgtatatatgcatgcacacacacatacacacaaatacacatttacatatgaatggggcaaaaacctacttgagctaccaggaaggagtaagtcaggaaggggtaacttgcctacctgaccccattatgaattagaaataggcacctcttctccagaacaggcacagcttgtgacagggcacacagctcagccagcagactgcaagctggattttagcaccactcacacactgagaaagggacctttgtgcagaacacaatggcacaaccctaagagatggccctgcagtggttattctctttcatcagactccagaggaaaactgaacaggcttaaacaatacacaagatgagcaagcaaaggcacgggaggtgcagatggtgagagcatctcttatgagcaaaaccaagagccctgagcctcaaagcagaaatgttgtcaagctcagcttcccacatcagagcatcccctgggcttgggaaagatcatcactcgcaaaagaacataacatcccatcatctttaaattaaatgtttacagtgctgctctgggaatgttcagagtcagcacatgactctttaaactcaaattctttaaactcaaattcttttccctctggccaaggcaacttgacccaaacactgtctctcttgctataagatcttcatagagacgttataccacacgttctcgaggttgaggaatgactggatgttagcatgcagcaaaggaagaagagggcaatgaagaaaggaatacgaagacattaacaacaacaagcaacttgaaatgctaaagaacaaatcttaatcaaaatggcttacagacatgaaaggaagaattaaaactttaaaaaaagaaactttacatctgacaaccgtgttacagcctacaaggctagtgcttttacaaccacaaaatcatgggatcttcacaacgatcctgtaaaattggtattaaaatcataaaacatgccggaggagaaggaagggaaggggcatcacagggcaaaggctgggagggttcaagtctcaagatagagaggccacggccagctgctcacccaaagagaaagcacttttaactctagaggtacccaacaggcaatataagatggatattaaggtcgtagactctagagacaattggaactgaagtctaaacagctagcaggaacttagacaagtcaattaatcattctaagcttgcttccttgtctgcagaatggaatagtaatagcctcatcatagtgttactgtgaaaggtaaatgtttataacatgcttactaaaatgcctgtttttatagtaagtgctcaataactagaagctattactcattcatgtattcaatacatattactgagtgcttatctcgagccagtcactggtccaagctcaggaatacaatgttcagcaaaaaacagacattgtattagttctcatgaagcatatactttagtggggtacagtggcaataatgatataattgctaaagtaaatattatttgtgaattcatttctaagaactacaaaatttcacagtgccaaatgtttgaaaagctaacctagtttagaaagatttagtgcaggaaggatcaagaaacaattacctgtgaaagcaaaatttgagttgagatctgaaaaatgaatagaggctaagaaataaaaagcactctaaggagaaggactggcatatttaaatgcagtgtgataggagggggcacgacacagtctaggagatggacaatgagtgtggctgaagcatcaagatagcaaggaagagtagctcaaaatgaagataggataaagaggagtgaataggcaggagcagccccttgtgggccacagtgggaatcgatgagaagctgccaaatgattttcattctattggaattgactaacccaaaaggtgaggaagagagggatagcatgttcacatgaagtttaaaatatggttctggccatttgtgtggagaatggatgagaagtaaaagatagaacagatactgagagaattgttttgccattgttacagtggtctgggctagagacaatgatggcttaatacggcaatagaagaaatggcacaaagtaaaggaatctgagatctgtttagtaagtagagttgacagggctttaggatggattgggtatgaaggttaagaaagatgggagaatcaagactgtctcacaggtttctggaaataccagtcacttgaagatgtctcaatttaggggaaagataatatatgaattcatttgtggctaagttgaggttaagatgcctttgagatgtctagatagaaggttcatgcagacatgtagtctagagctcaaagagagatctaaggtatggatatgtatttaagagtctttgacatatagatagcatgagttagatcaaatagggtaagaatatagaataaacttttttaaaaagaaagttttaaggacttacaacaaaggcttaaggaatttcaacataatgattaagcagtgaaggatacatgtgcacatgtaccctaaaacttaaagtataataataatttagaaaaagaaaaaaaagggagaaaaggaatgttctaagataggaataaaacacaaaaaatgtagagtaacaaaagtcaagggaatagaaagtttggagtcaacattattaaatgctgctgagaattatgtaaattgagtgttataaatcacagatctatttgctattcaacggctcagaattgcacacttttcatcaagaaaaaaatgttaaggcttaaaattttcagtcattttcctgagtttatgcaacaaggaggtggtgggtagggtttcaaacccaaacctagcaccaaagccttttctgtggaagttcctggggcctctctactatcttttttagtggttagaaggcatttcctcacaatggcactgttacctgaaaactggaggactctgacactgaaaatttggcaacaatatctttcttctctcttctcagtagctgcacacctcaacagaataaaaccatttgtctctagatcagtaattggtggagggaatgccaaaggagacatgacaaaaaggacaaggatgttgtggcatatgccaggacttaattgtagccataatttcatgttgagcctaggctggcagaaggtgcacctgtgaagttggtagaacatctgattgcagtctctttgcagaagggctgcagagaatgctagagagagatatttaaaaggtaagaaggagcctgttctgaagaactcaactaagaaaaaagtcttatccattagcatgaagtcacatttctaagtttagcatagtagttattactcaaatccatccccaccccaaccttctaggtgacaagaagagacaagactggatatcaagtttgaaaaaacattttatcatttttttcctccttttgacactcatagcttctctctcaattcctgccttagaaccagtaagagcatcttattacccctgtttatgtccatcaccccatgaagcccaagactcccagctcatctccattcacgaattcactagctctggtgtctgtatggctccatcccattttatgaactcttcttccacttttctccctctcctgaaatcatttcactgtaactctggagcttaaggtctctcagtacatttccctgtgtcctcaagctcttccagtaacatttccttcaccttcttgaactagctgaaaaccctggctcttcctcgaggacgctatagccctctaaagtggttctatgttctctttcactcctccttccactggacctggacgtggggtagagaccttccttactactttaataatgctgtaagaccatccttcctccttcctcaccaacaaaaaaatcaaagctttgaatatcacatcatgaaactctgtctcctactacgcttgtttgtttcattcccttacccacgcctccaaagtcaagttcctgcccccaattctcaaagatgctcctagattagtgccattattgttttgaaacacaactcctgtcctgtcataggtctcaaaggtccatcccagggtgagtaccgacctgttgtcagcctggatgctcctgtagaaggtgtttggagacccctgtttgaagttctcaccccatcaggaaggacaagatcagggacacgcttaaagaggcagtctggctgcttttctgtacagcaggtgtaccgtgttgggggtagcgtttccttgtccagactgcctggactctccagagccagcagtctgggaaggctgagtcgacagaaccacagagacatcagctgccccgccccactgggtctccatcccagggagagatcagagttttgttcacgtaaccctggctggtgttgctgaaattcccgcagggaggccccacccagtgaggaggaatggactggggtcccacttaagaaagcagtttggccacgatctggcacagcaatgacctctacatagataattccaatggtcagtgctcagtcctgatcttacttcagttttcattatcatgtaacacagatggtgactcttttcctctaaacattggcattgtttggcctccaggactccatattcacttggttttcctctgacctctgtggctgctctttctaatcttgctttgctggttcctccatatgaccctgacctctaaatgaaggagagtcctgagagttagtcgtttgacctctattttacccatctacattgctggctttaataccatttagatgtccatgacttccaaatttatataatttatataactagccttgaccacttccctttccttccctttagtctagatttttttttctaattgagacagagtttcgctcgttgcccaggcttgagtgcaatggcaccatctcggctcaccacaacctctgcctcccgggttcaagtgatgattctcccgcctcagcctcccgagtagctgggattacaggcatgcgccaccatgcctggctaattttgtatttttaatggagatggggtttctccttgttggtcaggatggtctcaaactcccgacctcaggtgatctgcccgcctctgcctcccaaagtgctgggattacaggcgtgagccactgcacccggctagtctacatcttaatacccaacggcctactctacatctctgcttgtctaatagacatctcaaacaacatatctactaaaaatctcctaatacccccctaaaacattctcctccctcggcattttccatctcatttaatggtgaattcatccctccatttgttcaggtgaaacaccctagagtcatccttacgtcctggctttctccaatctaatctgtcagcaaattccttcaaatatatcctcttcttttgcctatatcttcaagatataaatacaattctattgcttttcactattgttatgtcctttatctgagccaaactaccatcacttctcccctgtattactgaaacagcctcctaactggtctccctgcttctgtacttgtcctcctacaagctattccccacacaaaagtcaaaggatcatgttaaaacaaaagtaaggtcttgtctcccactacttaaaactctccaatgagtcctaggccaaggtcctcaccttctgcttcaggatgctgcacagtaagaccatcacttctctgacccagcactttccctctccctcactcttccagcaatgttgactttattcaaatgttgacttctcaaggaggcttttcccagatgttctatctaaaattcaccctcctgcacatacttttcctattcgctttcctcagaggaaaattgttatcacttgctgtatattttagttgtattaaacatggagcttcatgaagacaggaattttttctgtttcctttatcaccatctctctggatcatagaacagtgtctagtacacaataagagcttaatacgtgcattaagtgaacggatgaattaggaaattgagtctccaagagatttagtaatttcccccaattgcaaatttggtagctaataagtgtcagagccagaactcaaccctctttttagtgcccccatgcttccaagatggcaactcagaaaactcttcatccttgtttggagaggcttctcaaggttcccattcttcctgacttcttgtaaaatatttataatcctacattaaataagatttcccagtgccactgctgtgacttccccctcatctttaatttagccaatctaaacaaacaggacaaaaaaatgtgctgctgatctattaatagagaagcaaataaacagctccctaaatttcaagttgcaattagcaattccacagagcaaagggattttagataaattaagatagctcattttgggctctgctgcaagttttaaggacactaagaagaccatgccttatttaagctcacagggccattgggaaataaaagctcattcatgaacactgaacttaatataaccctcctcttcaaggcacaattacctagaagttcagtgttctgattggcctggaaattgtgtattcaaatgaatagaacttacacatttgctcagcactaaactgtgtgcaagttactctcttctgttgagagatggatgtgaagctaaaaataacatcattttttcagcaaatagtactgttgggtttgaattaagggtcttagaaacaatatatcatttcattcttacagtagctctgcaaaaaggtacaatttccacattatgactaagaatgctagcttagttgatcttcccaaagccctagaactaacaaatctcacagggaaaattccaaaccagatccctctgacttgaagtctcaaccaatgtgtcagaccgccttcatttaagaagatgactcagacttatctcttgccttcaggaattcagattctcaccagaaaaatggaataacacctaattctggctttaaaaaatactggaatcatagatactaattaggaaaaatcatttctaaaaggagttagctaataatcttctatgtatgaggtatctgaatcaagtttgaattataggtaaggtttaagaggttgatatggaccaaaaggaattccaggtggaagagattttacttgacaaaagacaaaatcttgaatgaactaaagcagcaaccttaataagtataagactctgaagctacagtaacatcctcactctccagaagagatcaataactgtaccccaaaagggaaactcaactactaaactcttacatatgttatctgcttggaattgttaaaggcattttaggcaaagtgcccaaccctaaggctcccctccacttgtcctgaagtcctccaatcttcttatcttcatacagagcttctgtctggctgataatcaatgggttaacaacctgcttttaaaagctaaaagccccaggaaaattacaacctataaatcacaactcacttcgtattgatctattcacttggcttcttcctaacccaactgagagctagcatctgatgcacaagagtattgatgtggagggaggaggggggaagaaagaggaagaagtaattctagaacctggggtagaccccaaggggcaggtctgagtggagtcctgagtgctcagacacaggaaagaatgaggcaaaaggtaaaagaaggaaacaattacaagggaccgaaactacactcaaaccgacttaaacaaattaaggaagtgattggatgatgtctctgagctaaacttaggcatgtttgtacagcggctaaacttgcaggactggtcatcaaattgcctgagttcagatccatcttcaaatttttactcattgtgggaccttgagcaagttacttaacttctcttacttaacttctctgagccttacttccctcatctgggtgaaggtacaagaataataattgtactgaacctactttatagttttgttgtgggaatttagtgaggtaatgcatgtgttatgggttgaattgagtaccccaaaaatatgtattaaaatcctaacttccagttcctcagaacgtgaccttatttggaaataggttctttgtaaatataattacttaagatgggatcatactagagtagaatgggcctttaatccaacatgactgatacccttttaagaagtgaagagtcacagagacagactcaaggggaaaatgccatgtgataataaggcaagagactgaagtgctgtcattgcaagacaatgaatgcctgtgtctaccagaagctgaaagaggccaggaaggattctggcctacagatttcagaggaagtgtattagtctgggctaccatttaaaaaaaaaataccataaaccgggcagcttaatcaacataaatttattttctcacacttccggaggctagaagtcccagatgaagatttggcagagtcagtttctgtttagagctctctgtctggcttgcagataggatggtcaccttcttgctgtgtccttatatggtggggtggtggaggagagatgggtttctggtgtcttgtctctaaaaacactaatcctgtgagatccagaccccttctcttttttcttttttttttttcttttaaagacggagtctcactctgttgccagactggagctcagtggcgctatctaggctcactgcaacctccgccccccaggttcaagcgattctcttgcctcagcctcctgactagctgggactacaggcacgtgccaccacgcccagctaattcttgtattttttagtagagatggggttccacatgttggccaggatggtctcaatctcctgacctcatgatccgcctgccttggcctcccaaagtgctgggattacatgcgtgagccaccgcgcccggcccagaccccatctttatggcttcatttaaccttaattacttccttatgggtcctatgtccaaattcagtcacattgggagttaggacttcaacatataatggcaagggggtggggggcacaaaattcagttcataaggggaagcatgaacctgccaatagtttgaatttggacttctggaatccagaatcatgaaaaaataaatttctgttgttttaagccacccagtttgtggtacttttgctatggcggcccaggaaactaatacaatataagaaatgcttgcatcaatgcctggtacatagtatgtatttaatatatgttagctgttactattacaactcaggcacattccaatccagttcctcaagcaatgtcattagaaatttctttctcttcctctctcagcttgttttcctctgacactgctgaattctcaggtcgaccctccctcatggtggtccctgggaactccagccaaccaacttagcagctacagcaaaaggacacatttatttccctgtagatcccgcaacagtcctgggactgactctcattggcctggatgaagtcacatgcccatccctgaaccaatcatggtagccagagggcttcaaagctttgtccagacatgcctaccctgtaggcatgactggagtcaactccacttgaaccacaaggactaagaatagagataagtggtttggaaaaataaaatcaggctgctagtatcagaagggacatcaggcatcagaagactgaagaggcctaaaaaacagattactacatgggattttagcaaactgaagtttataaacaggatctgtagatcctgcagtttccactgtgttcaaaatactatactagtaaaacttattggttgcaattgcaaacaacagaaaccaggattaattaaattaaacagaaaattatttttagggggtttctggtagcttgcaatgctgaaaggaaggctggaaatcaggcttaagcaggaatgagcaatgctaacgctaacactggccatgatttttgctgtgttccaccagccagaggacagagaagatggatccctttgtgtctcatcttgcatctgtggcaagaggagagaacattctatatacttatttagggtcccccccaccaaaacaagtagagtgtttggatattaatttgacaaagagaaagatatacagtagttttctacttaatgacaagcaggaaatagttatgaatagaacaagaccttatagtctccagaagctgcaatcaaggtacgaatgccttatttagaactaaccaacactcaaggcagagcactcatacgaggcccatagaatgtcatcgatgagggaatggggaatgctgcacgagacaaatgtcagcaagagaatggggatgattttgacaatagcagaggagcaagagttaggatagaaagagaattctagaagtgacagcatgaacaaaagcatgcagaaaaataaaatccagcacataaaataaggaagacttttttgtattcaagaaatttgtttttacagcagcatctcagtgcctcaaagattatctttaaaaacagctgttacccaacaactacttaaagcttgaaataaaggaaaacattcccacgccaactctgcactctaaatagaagctgaaaagatagatacaaaaataccaaggccactatggcagcctgatttgaagctttttataaaacaaaaagttctgtggtctcctgaaaggctcactcctcttgtttgcacaattgttcagtctctcctgagcccccactgtcgggatagcagggagggaactgaggaaaagcagccgtcttgaaccagagccagcctccaatccctctgcacccatgcaagtgtgccttctcagggacaaggactatgataaaataagaacattatcactatcatgcattgggtgtttaacatggctagaactatccaaagcatcacacaggttatgtcatttccaaccaccccaacaagtgactggtactgtaatctccatttcacagatgaagaaattgagccagagagaagttaagtcataaaatgcccaaggtcacttaggattcctcattaattctcagaatagtaactgaaacctctgcagcattttagagtttatgaaggctggtggagggacagggaaggagcttattaaataattacaacgggtcaaatttttgtgcaaagcactctacagatcctagaaatataaaaacaaacaaaatctattaggtaaatgcccaatatgaatataatgaatgctaatgaactgtaatttaaaaatggttaaaatgataaatgttatgctatatatattataccacaataaaaagaaatctatcaggtggtactgtgtggcatgtgaatgctctaaatgcattagctcatttaaatcctctcaacagccttgtgaagcagatggcagtgctatctccaggtgacaaatgaagaaatggaagctccagaggttaagtaattcacttggttagaatcacccatctagtacatgccttcaattagtactattagttacaatattattactgttgttagtgttaactagtattattaataattgatagtattattattgcaaataatataataatactaatattgttagtactattaggatagatttcagaggcagttagtgggcttttgaatcccaactgtaccatccactagctgtgttatcatgggcaggttagttgatctctctctgcctgtttgcttatttattaaagaggataatcatagtgcctctctcatagggttgtcaagaggattgaaatgagttagtaaggtgtgagtgcttggagcagtgcctggaaaattgtaggtgttaaataaaatactattggtactattaagctttttcaagagcggaattaagctaagacattatgcaacttgcccaaggtcacatgactaaaggaaaaggtggaagagaggctcacacctttattggccaaggcggaagaaggtggacatttaccgaggtcagtagccacacttcccacagccaccagaggcccattacagaggcaggtctaaagagatcttagatcagtgaagacttactgggtaaggacctctttgataaatctggaggcggttaaagttaagacatcctcaccacaaaaagatgcacacatgtgaaatgatataaacttataaaaaaaaagtccaaggtttttggatccctgagcattgccctccccatccagggagtcctctggtaagaaattctaccctggagaaccctgcccaaacctcactcccacactgtattgatttagaaggaaaactcccaaaaggtcagggcagtagttctcccttctgcttctgattcattaaacctggtgcaggatgcagggatataaatttttaataaggctttccgagagattctgatgcaaggagccactatactctgaaaatcacagcttaatggaacttgctcaaagttacccaggtaaaagagaccaagacaggattggccttaagaaatgactctgcctgcagagtccaaactccagtgagttctccttccactttgtgcacaacctaaaaatattttcaaataaattaaatttttaaaacttttcaaaattgctacatatagaaagaaatttcacatagagaaaactagaagagaatatgccaggatattagtaatagagtctcttggaaaacagaattgtaaccatcttttcacttttatctgcttttttatattttctgattttcatgcaataaatatatattctatgtaagacatctttgaaggtaaaccttatgcttaatatttatttttatattttagtttcgtggacattgtatttagaacattaacccacttaatttctgtttttcctggctccttacttttaaaaaaggagataagtgggggaaattaaataaatttacttggaagtgaaccaaagtaaagataggaaggaaaaatgtgcttgattagccactctgtaaagaattatagagatagacctagaatttctaaactactctatcacccttgaagagaaaaagaaatgaagaacacagccttggatgacgtactaaagcatatgttttcaaatcgttggttcttttataaaaatgccattaggaagaagaaggtcaggaagacagaaaacgcctgcatcctgggagtgtgataacaaaagaatgatgatcaagccttacatctgtctagcacttaccatttttccaagcccatttataataattagcaattggaaagaacccaaatgggcaacaataggggaatggctaaacaaacagtggtcgattaattcagatggaatacttcataaagagagacaatggtgagcttgcagactgagctgatactggaaatgtctgtatgacctcatgttaactaagaaaaaaatgaaacacaaaatagcgccttggggacttcaataaggcattttaaaaggtccatcacattagcttcttagacaagatggagaaatgagaacttcattgtttattagagagaagagctgacatcaacatctggctcttccagaaactagctaaatagcattagagaggttaggggcaattccctttttatatgcgtaatgcatttctgacttcaaaatttttttacaaagcctgagttaggaaattacatgtcacaggatttttcaaagacaaaaaaaaaaaaaaaatgtaagacctctaatacatcttgccttcttgagacaatctttttggatttgcttctagcaatgtatataatttttaatttggcccttttctttccagttgaaaccaaagtataaaggctttaagtccaaaaagaattcaccacttttggtattcccaataagttttattttagtctcagtttgcattgagtattattaaaatgttaagttcattatcaccaatattagagcttatatttttttcagctcccacacaaatctagtaaaccacgagtcgggcattgtgttcagaacttttgcaacagcagtcctggccttgttctatgtcacagatccagtaaataataaagttaaatgtatgcaaaagctctgaacacaatgcctgaaacataatttgtcctcagtcggggtttactaaattctattttggatgctagcatgtagattaacaacaacaaataatggtgcacacagaatactgctttacaagttgaacagtgtttacctagcaggacacttctgctaacaagcatcaaagatcctggctttgcttgccgtaagaattttagccctgcctcaggagagttagaccatgaaatttgtgagtggcaaaaagccaagaaggggagcaaatattttagaacataaaataaaaatctaggataatttggtcaagtcctgagttatggtttaaacataccaggatgaaagtgaatgcaaggagctgggtgtggtggcacacgcttctcccagctattcaggaggctgaagcaggaggatcccttgagcccctgagttcatggccagacttggcaatataattagacctcatctcttaaaaaagaagaagaagaagaagaagaagaagaagaggaagaggaagaggaagaggaggaggaagaagaagaagaagaagaagaagaagaagaagaagaagaagaagaagaagaagaagaagaagaagaagaagaagaagaaaggtattgcagggaaatagggaaatgtaagaccttccatttagatcccaaagactgatctcccaaaaatgagttggagaatatataacttactctagcatgtatggaagggattcagggaatttgattagcagaaagtctactatgagtctatataataatttgaatctgcaaaatgctaataagacccaggcatttagaattagaggcaaggacatattgagagtttgagtttagtttttttaaggacttaggtagaataggttatgtgtttggaagacaggggccaggatgattactgagaggactctcaacctcatcatctacagaatttttgaaggatccagtcaaaaaaagtcactggggtatatgatcacctatttcaaatgcttctaacaatggacgaagaagtaacatttattgtgtaagccatcaggtagattcaaagggtagaaggtgatgcaagatgacaatatagagagaatttctaatcatcagaacttcccagagataaatcacatttggtagatagaaagttcaccttcaatggaggtgttccagcataaactgtagaatcccctgacagaaagtagtaggaagttcataagcacacggtgatgggaaggcagatgccccttgagatcccttttagtctctttctctatcctattctagtgtttatgccactttcaattcaagtatgtgaaaatacgtgtgtgcaagactaaacctgggaacaaatatggaaagatatgaacagttgacaggtaaatgcacattaggttccttcttcatttattcatactccctcatacctcacaccacatatgtctgtgttaataataatctagatcaaagaaaatgtaaatcagaaaatgtcatttctgagagcaaagattaaggcactatattcaaaggcaggtcaccaaggttctgtgcagttcctaagtgaatgacagatttggcactgagcttcctggttgccaaagtgaaaagagaaactgcaatcagtcacaagattctcaaaggtcaagagaagaaaacatttcagttcttcagaggagcaaaactcctggcacttagccctgaaaggaattgctcttgtggagacgctgatcactgttaaagacagcgtccataacaagaatccctggagtaaatacaatagtgtgggccttaaagctgtttcttgatggtgcctctggaagaaacctgaggctgtgaccctggagcacaatgtggtaaaaacacttctctcaaagtggaaaaaataacatttgaattctttataatctaggtagacctaaaaattaatacctaaaatatatattttttaattaagtggatgacataagtttcacacaatcctttatgaatgttatttctctaaaccagagagtttgagcttatactctgtgatagggacttatcctccttaagctgataagtattttcctttttatttcactcttttcctttaactttcctttttatttagatcatttccttttcctccatattatacagggcccctctctgcctccagggctgttcccctcctccaggctgtcacctactgtctctgtgtacagctctcttttcccttcgtggtgcgaggcagtttgtgtgacatgtatcctcccactgggaactaaattaagacatcatagtcttgtcacatcaggcacctaataatcactagttgtttgctagcactgttcatttgggatgaattcaaaattctgatcctgaaagaaagctgccagtttccattaacagcaattgccaattcaaaggtcttgaccgggagctaaagaataaaaagctaatagaacaaatgactaatgggacttgaatataccttccgtgataggagagctagtcgagcatgggactgcctggagactgggtggccatgtggctgagttcttgatggtggaatgtgagtggaagttatgcatgtcttctgtgcccttaagacaagagatgtccctcctgagcaccacagccagcctctaagatgccagacagcctctaaggtgttctccagctggcctgaacaaccgcagggagcagagttcaacaactcaccctgaagagaaaatgagccattgcattttggggtccccttgtcatagcagtttaacttccccaccctccgcataattccaactggataattccaagctggctagggacccatgccatctcagaagggcttgattggtgaccaacttcatcacatataatcacttactttatttgagaaacctatactttcagaaactcttcatactaaaagtgtgctcttaacctttaatcttaagagttttctctaagtatgtacatgtgtgttttccacagataaaatttagtttgcacttttgatgaatcaagggttgaatgcttgccttctttattaatcacaaaaagtacaatagtaatattcctatgaatcacaatcatttctacatgttctgtcacaatttagagtgttccagcaccttatgcttccaaaagtgtggtatcaggaatggtagatgagatgtttttggcaggacacaactttttttaattaaatagctaaatggcattttaatgtgtatttaatgtgccttctatttatggcaagtgactctacctctcaatgaggtagtatattttttcttaaaataaatttatgaaaataaaaagtaagactgtttagagaaaaacatgagtagtagaggaaacgagaaaagttgttaaggtggtaacgcaaatgactgaaactgggaaactcaacaataattgcaagacagattgaggagacattatgatattcactctatagtgatgaaattaatactctaaaaatgacgttggccaactgcatcaatagactaactcagtgagataaataatactaacaactaaaaattataggcacttttatcatttacaaaatactttttcatattatctcttttaatttcataattgaatgtgttgacatgtaatattaaagctaatggaaaataacacaagagttctatctttaaaaagactgagcatgtatatgatgtttgtgttacagcattagtaaaggagagctctcatgggcctaatcacctaagacctaggttcggaattcaggtcagttgctcatgtggaacccagaacaggctacttgttcaatagtcaacagacactgaacacctatcatgtgagaggcacagatccaggtacttgggataaatcagtacacagaatagcaaaggtacttgacctcagggaatttaccttctaatgaaagagactactatggtctgaatgttgtgtctcccaaaattcatacattgaaacctagtcctcattgtaatagtattagaaggtgggacctttgagaaataattaggtcattagggctccaccttcatgaatgggaatggtgcccttataaaagagactgcagaaagctaactagcctttccaccatgtgaagatgcagtaagaaaataccttttatgaatcagaagacagccctcaccagacactgagtctatcagcacgttgatcttgaacttcccagcctccagaattgtaagaaatacatttctttggtttataagttacccagtctatggtaatttatgtagcaacttaaatggactcagacagagtcataaacctcgaaagtaaattatagaatgtattagaagtcaagaaatgctctgtaaaaagggaggaaagggggaagaggatagtatgaaatagcagtcagactgggcttcgtgaaggaggtgacatttgactttaaaaaggcaagggcatgagccaaaaaggtgtctggggaaaggagagtccagcaagaaggacttacttagggtttcctaaggccagcatgtacctgatgcactcaggaaactgcaaggagacctgtatgattggaacagactgggcaacggggaaagtagcaggaagtgggttcagagaggtggaggtaggaggtgcaaatcacgtagggccttgtaggccattgtttagtaacttcagcttttaccctaagtgaaatggaaagccattgcaggattttgagcatatgggtgacatgaactcacttatactttaaaggatgactctgactgccctgttaaaaatagaatatgaggctgggtgccatggctcatgcctgtaatcccagcactttgggaggacaaggcaggcagatcatgaggtcaggaattcaaaagcagcctggccaacatggtgaaaccccgtctctactaaaaatacaaaattagccaggtgttgtggcgggcgcctgtaatcccagctactcgggaggctgaggcaggagaatcgcttgaacccgggaggcagaggttgcagtgagccgagatcgccccactgcactgcagcctgggtgacacagcaagactccatctcggaaaaaaaaaaaaaaatagaatatgggggatacagggacaccttttaggagactattgcaataatccaggttaaagattatggtaactaggaatacaaccatagcagtagatgtgagaagtagctggactctggatataggctaagggtggagccatggaagttcctaatggactaaatataaagtgtgagagagagggggcagttaattggacttaacaattggaagaatagaatgacaataactgagctgggaaaggctataaatagagtaggtttggggattaagatcaggctttaattttttatttatatacatatttaccatttctggtgttctaaacttctttgtgtagattcatactttttacttgtattatattttttctgcctgaaggaattcaggcattaaaggaattccttttaattttcctgtatgacaagaaaggactgctggtgattaactctttcagcttgtttgtcttggaaatttgttatattttgctttactttttgaaagatatgttcactgggtataggattctaattcagcagtttttttctttcagtattttaaaggaatcattctgtgtcttctggcttccattgtttccagtgagaaatcagctgtaattctctgcattcaatgtctcttttaaaaaatctatggtggcttttaagaattagtctttatcactggctttgagctacttgatgatatgacctcatggtcattttcttagtcttccttttccttagagtttgtggagcttcttaagtctgcaggcttatagtttgtatcaaattaaaaaatgttttccatcattatttcttctaattattttttggttccctttctctctcctttcttttgaggactcaaactacacatatattaacctggttcaaattgtcccaaagttcactgatgctctgtcatttgttttcaatcatttttctctgtgtgtttcattttggatggtttctattgctatgtcttcaagtttaaaaatttcttctttactagccaggtgcagtggctcacgcctgtaatcccagcatattgggaggctgaggtgggtggatcatttgaggccaggagttcaagaacagcctggccaacatggcaaaacactgtctttactgaaaatacaaaaattagctgggcatggtggcacacacctgtaatgccagctacacgagtaactgaggcacaagaattgcttgaaccagggaagcagatgttgcagtaagctgagattgcaccactgcactccatcctgggcaacagagtgagactctgtctcaatcaatcaatcaataaaatttaaaaaataaaaatttcttctttagtgcctaatcatctcttaatcacatctaatgtattttttatctcagacattgtatttttcacctgtaaaggttagatttgggttgaatgaaaaggactgtgtctttccttagcatatactgcttcctctattttcttgaatttatgatatttagtcctaataactgttacatagtctttgcctaataattatgttatctattcatttctgggcctatttctattgatattttttccttgttatgggtcctatttcctgctttttatttatgtatttatgttatttatgtatttatttatttattggcatgcctggtaattttgattggatgccagactttgtgaattttagcttttcaagtgctggatatttttatactcttttaaatatttttgagttttgtttgaggatgcagttaaattactcagaatgtgtttaatcctgttgaggcttgcttttaagttttgttcagtgggactaatgtagcctttacactgaagttaattttaacttattactgaggcaatacccttctgaatatttttcccattaccccatttattacaaagttttcccactctggctggtggaaacatgaactattcctggtcttagctgggcttctaagattgttctgcctactgctttctaaaggttctttccaaggcctcaggtagtttctttacatgcatgtgttcatcaatactcagctgaaaacacaggagaatctacagatttccaaaggtctctccctctgcgtgcatgtgtgtgtgcgtgtatgtgcacatgtatgcaacttctctctgtgcagctctctcttctccagtactctgttctgttcattctagccaccctgggatccctaaattcttaactctgtcctcaactcaggaaaatcacagttctgtttgaattctccattcctggtgccatgctctggaaactctctccaggcattaatttgagacaatcagaagggtcacctcactcatttcccttctcttagggatctttgtcctatgctgtctagtgtccaatatctgaaaaccattgtttcttatgttgagttatttgcttcagttgtccaaagtgagagggtcaatccagttgctcttactccaaagttcagtttttaacatgttgagtgtgaaatgtctgttagacatcaaagtggaggtaggaggcctactaaaacacatctaactaggccctaacttcagaatttctggttcagtagctctggcgcaaggcctaaaactttgtatttctaacaagttcccaggtaatgctattactgcttgtcagggaccatactttgagaacaccggcatactgcaattttgccccacgatgtggctaatgttttttttttaatataaaacaaaaatcagagagttacttctctgttaataatcttggacagatccagagatctgtaatcttcaggattgggctgaccctggtcagtctttccagcatcctttcccctccttcctgaactccctgtgctgggctattcacacagtaccctggctgtgccaggttttcctggcttcccctgatgtctttgtgccaggttctcctggcgtcccctgatgtctttgcacatgctgtgacctccttctggaaggtcctccttctaccatgttcagcagagtccaagttatcatttatcagctttggtatcactccctttatgggacctttcctggcgctaggcagaattgggtctccctcttctatctcccaatagtgtgttagcacttagcggagtttcctaataactgttttcttgtcaatcttcctcattatatttggacctcctttaggagagggctttttaaattattcttaatttatttcctttactttgctcctaactgaatggtaaagatctctagagactttttttttacttgcaggaacactgttagttgtcccaatagttggtgggagactactagtatttagggagcagagattactaaagccacagcatggtatctcacaggcaagaatagtcaacatcaaccatgattttcaaatatcccatcggatatcatgtaagtggaaaccttgtttatgattaactgaacatagaacctaactctgtgttacaaaaaaacaaagtatttttgcacaatttgaacatacaatgggttacctgaattgcaactaccacataaatggaggaaaggtcagactttgttttgctgggaaatttaaccagaaacttttaccatttggagaaatcacataaccaaaagcaacactctcattgtagttgagtctttaacacatggaaatcatcatgtcaatctgcatttgtagctgatacattcgtgataacatgcagatgcaaacatctaactacaacagcagctgcacttagcatttaaatgttacttattttttaagttattttccttttacttttacttttctttagagttagaatgatatattatctcttaaaagtacatttgcaggtatgttatgctatctgtaaattttatttcaagacagtagttaattataaattgttatggagggagtcggtatacaaagctgtcactatcattccataaaataaaatccagattccctgacatggcatttgaaatcttttacaattttgttctagagcatttttccaatctccattccaaccttctcccaccttcccttctccagccacacagagtttccaccttctcttgtgcacaccatgttctcactctttgcacatctggacttcctcaatctggagttttcttgtccccttctattgacttcccactgggtttttttaaagccctgctcaacataattgctagtttgcctgccttcctctcacatcagtctatagtctcctcaaggatagtatgttggctgaaagctttggctttgatgtaagccaactgggttcaaatccacctctgaaacactctagttgggtgatcttgactttgggcaagctaactaaccttgctaaaactcagtattttcttttacagaataaaggcaataatacttacctctcaaggagtttgaaagaattaaatgaaatactgcctctacagcacctagcagagtacctatcccttagtaaatgctcaataagtagtaattattgccatagttattattcattccttacatttatcatattacataaaacatagtggatgggcaataaatgcttgatgaatacattcatttgattctaatatatactactcatctgaaaaaaaaccattggagacatacctaacctcagagaaagtcgttgagtgtgatattggagcagagtgttttcctgaagtctcttcagtaacatcatgtggacaattattccaaccaagctcaacctgtgcctcttgacaatttataattaatccggatgacccagatcccagatgaagggaaatagtcagaaaaatagagatagttgctcttttatgcaagcttatgttccagaatatagataatccctttaaacaggaatttttagactgtgtaggaagacatgcctcatactttgctccaatttaaaacaagcactgggattggagtggagccaaggactctgacattaatggaggaagaaatgagcaggctcatttccctgtagaaatagacagagggagaagtcgatgttctttacactgataacaacccaaaaggagaattgagaaaggagagtgcattcaatcacaaaaacagccagagagatgtccctatccccatgcccactagcaattaccagggcaagattggttctgtttctgtacccctatagttctgcaatagaactgaagtatgtatttggattacaagttttttcactcaattacctgtaactgccaactgaaatttggtgttatttaaataacttttgtgttattttgacctagaattacagaaacttaaaaaggtcaaattttatagttaaaagagtcgtgagggatcatttctttctgttactgtctttatgtttaaatgtcatctaagcaacattttctacagtaaccactacaagtttattaagaatggattttgggggaaacccatttggaaactgattaatttttcagatgtcctatctcagcacttcagttgattgacaacacatagtgcagttgtcaagctacgttagaccaaaagacctcatgcaggcagttttggttttctattaaaatgtaatttataataggtattatttagctgtgctttttatttgcaaggtataaagcattacagttgacccttgaacaatacaggtttgaattgccccagtccacttgtaagcagactttttccaataaaatttatacttaatgtgcctgcctctcctgcctccccttcccctttctccacctcttctgcctcctccgaaacagcaagatcaaccctttctcttcctcctcctcagcctactcaacatgaagacaatgaggatgaagaactctatgataatccacttccacaatgaatagtaaatatattttctctgccttatgattttcctaataatattttcttttctctggcttactttattgtaagaatacagtatataatacatataacatccaaaatatgtgttaatcaattgtttgttaccagtaagtcttcctgtcaacagttggctattagtagttacatttttaggggtttaaattcataagcatatttttgcctaaacaggggtcagcattcctaaccctcacattgttcaagagtcgactgtattttgtggccaggttctgtggttcacgcctgcaatcccagcactttgggaggccaagacgggtggatcacttgaggtcaggagttcaagaccatcctggccaacatggtgaaaccctgtctctattaaaaatacaaaagtcagccaggcatggtggtgcatgcctgtagtctcagctacttggaaggctgaggcaggagaatcgcttgaacctgtaaggcacaggttcagtgagccaaggttgtgccactacactccagcctgggtgacagagcaggactctgtttcaaaaaaaaataaattaatgttaaaaaaaaaaaggagtcaactatattttgcttaatgcaaacacctaaatgtcaagtggctctgcatctcaccagactcaactgggatccatgattaataaattaattatttgtttccttatttactcttagggaaaggctttccatctcacatgttggtgctttggatctgttcacattccacttgcttctccttgaatagctgaagaagtaaactcaaaccaagtttatatattgaagtcttaaaatataaagtcctaaactaaaaccaaccatagtacttcttggcttccaatcccttcataatctgatgcttcttcatctctccagcctcacttcccatccttttctagtgacatgatattcctttgagttgctcaaacatgccttgctttctcatttccagccttcatatatgctgttctctctgcctgggacactgttcttcccattactcctcattgctcaagtctagatttaaatctcacttctccctgaaggtcttctctaaactctaggcccggtaagatgttgctgcaatgtatcctcatagcaccctgtatttccccacttagggagttatctgctttctccactgaacaataagattcacaatatctatctcggccaccaggaacatgcatgatatatatactctgtaaacattagctgaatacatatattgatgaatgcatcagctgtttcaatcaccttcacgtgttaagacaatatctcctttcacatatgaattgaccaaattctaatgagcttaagagatttgtccaacaccgctatagcattttggcatcagaactgttactcaagtctcccatttttattattatattatttatggttacaaaccaaaatatcctctagggtcatcagtgaaatggaagggatgtaagaccataggtgatggagggggctgtgacaaactgaaggactcatgcctcatttgaggggagcatccgatattcagacctagccaattgttgccatagaacggggtccagtgttgccagatcttctttttttcaaaagaaaaataaacccataagtttatgtgaaatattctggattttaatactagcaaaataaaatgtatttgatgtaatatactgggcatcctaaacaaaatactcatatactaggcatggactctaaggccccagtgtgccatctccacactgcactgagctgcttctttctacacaacccagacctatggagagaccttcccttgttccaacaaccagcactcaggcaatcctgtaatccccctgtagttgagaattgaaaaattcaataaaacacaattgccttttaagagagacactcagctctccaattgctttagaatcgatcgaccccccactgcattaagttcagctcccacacaggctatggtaactcttatgatctcacataacagaaaacaaaactctgcaaaagtggaagaacaattttttttccaggagataacaaagtaccacttatacaaagaaagaagactggatcttatttctggagaaaaatggcaccaaagtttctactttcctccccactgttacaactaatcagtgtatgacaacagagagactcgcctagcattagactcagaggagtttggtttgcagtctggcccttgctcttgaagctccatgatctcaagtaagtagaacctgttgagagcctcagtgttctcatggataaaataagaagaaagtctacctcctcccagggctgcagtgaggaagggaccagggaagaggcaggtagaagggctttgccacctgtcatataccacaccagtgttaagagttgacaataagtggggctaactgaacttcgttattcctgtgaacctattctaggtaggaatgcctggccctgaattcctcttctggacttgaatgtggtccagtggaattgcaaagtcaggatgagaattaatttctcatcatagagaagagaaatcctatttttgtactctagagcctatttatctaatttttaccccctcactctcttctgatatggtttggctgtatccccacccaaatctcagcttgaattgtagttcccataatccgcacgtgtcatgggaggaacttggtggcaggcaattgaatcatgggggcagttacccccatgctgctgttctcatgatattgagtgagttttcatgagatctgatggttttataaggatcttttcccccttttttgctcattcttctccttcctgccaccacatgaagaaaggcgtgtttgcttcctcttccaccatgattgtaagtttcctgaggcctccccggccctgcagaactgtaagtcaattaagcctcttttctttataaattacccagtcttgggaagttctttatagcagcatgagaacagactaatacactttcttattcaaatatcaagaaagagtcataggttttccccattactgattcccatcaatttctctataacttctcgagagcaccacttgatgtctactaggctcttacaggtaccattctctgcacttacttgtatttattcatttgattcttacatctaaacaactggtctaaaacccactgctagaaagtaataaagtcgggatttgaattctgttcctctggcttcagaccctgagcatttagccacaataatacattatttccccctccatgcactggaatctgcttttgcatctaccatttgttcattcattcactcttttgacaattctagactgagtgtctacaatacgccataccctcgtgaagcttatattccaaaggaaagaaaaaatgaataaattaaataagttaaatatatatatacagtaggcaagctagtaatcaatgctaaggataaaaaaattaaacaggtaagagagctatgatagcatgggcaggagactagtccaacagttggaatgtgggatctacaggcagttataacagtcaggggctcagcaccaggcacagagtgcatacaaaccaagggaacatggcagacttgtaggaaagagacccaaccagtattaagccctgactttgtgccaaacacaacatgtacaacataagttgtctcatttgccttctatcttattcacctatggtatcattatatcaacttaacaagccagaatttttaataactttgttattaatactaacatgtaccaggccaagttcttagcactttgcatatatcttatttgagcctctgaggaaggtattgttatcctttctcatcaaaaatgaaatgaagataagggagtttactgagtttactcaaggttacccagccagcaagtggcagggacaggattcaaacacaagcagggtttcaaacccaaatgtcttgcttctaaactaaataacctgctgtatagaggtcagtaaacaaggatcccagctggaaagcagtgtcaagaacatggcagcaggtggcagcaaatgtattagtctgccggggctgctataacaaaccacagaatggatggcttaaaccacagaaatgtatttctcactgttctggaagtccaaaatgaaggtgtctgcgggtttgctttctttgagacctctctccttggcttacagacagctgccttctcacagggtcgtcacacagcctttcctcagcacatgcgcccccgggtgtcattctctcctcttataacagcataacagcactaatcatattgttctttgttgttgttatttttttttagactgagtcttgctctgctgcccaggctggagtgcagtggtgtgatctctgctcactgtaacctccacctcctcccaggttcaagcaattatcctgcctcaccctcccaagtagctgggtaattttttagcctcactaatttttgtatttttaatagagacaggtttcaccatgttggccaggctggtcttgatctcttgacctcaagcgatctgcccacctccacctcccaaagtgctgggagtacaggtgtgagccaccgcacccagccagcaccagtcatattggattagggccccatacttatgacctcctttaactttaattacccctttaaggcattgtctccaaataaagtcacactgggggttagggcttcatcatatgaattttagggggacagaattcagtctataacagcaggtaacagaactccagttccttcgggaagaggaatgagatgattgagaaaatggaagtcaagatgcaaccttattataactagagtaccagttctggccagtgggaaagtggagatgatggagtaggggtgtgagatgagagtgagcagcaggcttgccctgagtcacctactgtatgatcgagagcgccttcagtgtgctgaggctggaggttatgccctcggtgtcttaccctgcagtcctgcagtaggaggcaggggtgtgggcaccagagctactgggcagagaacgaagaaagtcatttcactgctgtaggagcagccagctcatggcttctctctaaaactggtgtacaatttacaaaaaacaaaaaaaaaaatcaaccccataaaaaagtgagcaaggacatgaacagacagttttcaaaagaagacatacagacatacatgtggccaacaatcatatgaaaaaacagctcaacatcaccgatcactagagaaatgcaaatgaaaccacaatgagataccatctcacaccagtcagaatggcaattatttaaaaagtcaaaaaataacagatgctggcgaggttgtggagaaaaaggaatgcttatacaatggtggtagaagtgcaaattagttcaaccattgtggtaaacagtgtggcaattcctcaaagacctaaagtcagaaatcccattcaactcagcaatctcattactggatttatatgcaaaggaatataaatcattctattataaagacgcatgcacacatatgttcattgtagcactattcacaatagcaaagacatactctcaacctaaatgcccatcaataatagactggatacagaaaatgtggtacatatataccatggaatactatgaagccataaaaaagaatgaggtcatgtcctttccagagacatggatggagctgggggccattatcctcaccaaactaacacaggaacagaaaaccaaataccacatgttctcacttacaaatggaagctaaatggtgagaacacacggacacatataagggaacaataaactctggggccttttggagggtagagggtggaagaaggaagaggatcaagaaaatcaactaatggttactaggcttaatacctgggtgatgaaataatctgtacaacaaacccccatgacacaagtttacctatgtaacaaacctgcacttgtacccctgaacttaaaagttaataaagaaataaataaactggtgtgcctattcccatcattaatgagctctacttattctctatacatcagcaccatcctctataacttgtgtgcatgagtgtatatgtatctatccatctgggagtggtaagcagaaagaaagaaagagagagaggtaaattatgttaaagaaagagaggaggagagagaataaaaatgagaatcacaaggggagggagggagagaagggggcatccagggaatgaagatctatggggttggaccccatgcagagacccttatccttgtatagtcgtcaggtgcctggcaactgaggaatccaggaggctctataagcaaggctgattttcttgtctgtgggcctgaggatatctaatttataaagagtctagaccagagtttcccaaccactctgcctaccttaaagcagccaggctggatctgagcagccaaagtcctgaagcatctaccaggatgccaaacaaatgttaattctattcatggaatagataggccatggaaaaggttagggagcactgctgcagaccagaacttcccaaatgtgtgaaaagagggctccacagtcactttagaaaatgctgtgtattgtataccactttgtgaatatactcacaaaatgcagcagcataataaaggctctgagaagctctcagtttagggaacaaggtaggagacctgttaactttgcttaggccttccagtatcagactatatagctggttaacttacatccttaaatccaataaagccaaggatgggaaaccctatatctcccagcccaaatgcacgttctttcttttcaggaagtgctaattctcctaccaggtgatgcttgctgaagcacaggcagtctctaagattagatggccatcttccaggccaagcaataggtggtaaagaagtcaatcaatgtgtccttaccggcctagtctcctgctggcaaaccagcacatgcctccaaccaatagttcagcggccagaaacaagcttgttgcaagttgtatgttaggggttggccaagcacagatttaattcttaaggtttggaaccatagctcaaggggctaaaaattcactattaaaattgtgaaaaatttgcgtgagtctagagagtatgcgtgattcgagacagaccgcagctcctttaacaggcctcaatttttccaacgtataaaaggagtgggttgggtgataacataggatgaattgtgtctcccaaaatgtatatggtaaagtcctaacctttagtacctaagaatgtgagtatatttggagctaggacctttaaaggggtaattaaaattaaatgagatcactagggtgagtccttactcaatatgactggtgtccttataagaagacaagattagaacacagacacaacacgaagggacaaccatgtgaggaagcagtgagaaggcagtcatttgaaaggagagaggcctcagaagaaaccaaacttgctgacaccttcctcttggacttccagcctccataattgtgagaaataagtttctgttgtttaagcctcccagcctacagcattttattatgacagcctggtaaacaaatacagatgaataaagtctccagagtgagcacttagttgcctatcaaacaccccttccctcctgcttccttactaatgtaaaccacctttattcaaaattcacagcatgaataatctaagcaactgtgtttcagtttatccctgttgccagtgagtggctgagaaacaggcatatgaccaaaatcaaaccagaagacattaaaagaagactcttggggccttctaggaagagttttctcaccccttttggaaaggcaaagtaggtatggcctcttgtttctctaaaaatgtttgtgtctcactgagacacctgaaacttctgcagctaatttgtaaccaacagggagcctggctgaaggcaaagacaatttcctaaggattgcaaagaggatagatgagtaatgacatctctgtctactatctcacgctaacctgcagcacctcccacctcaggactttcagggatggctgatttttaaaattcctttttatttaaaccagtcagttttctgtgatcacagctgaaagcatccaatcagaggcattccatcatcctttccagccccattacttcctagaagctatatttctaaggccactcgcaacagtaaacgtgttaaagagaaccttacaaacatgagctccccacatctctaagaagtagtaagatattgtgatataataagaaatacatatttggtcttcatttcttgtttctgacacagagctcctaaatcccttggaatttcctgggtgagaggaatatcttttgttctaatgagataattcttttttgtttgtttgtttttgtttttttttttttgacatggagtctcactctatcacccaggctggagtgcagtgcagtggcgtgatctcggctcactgcaaagtccacctccctggttcaagcaattctcctgcctcagcctcccaagtagctaggactacaggcatgtgccaccacacccagctaattttttgtatttttagtagagacggggtttcaccatgttaaccaggatggtctcgatctcctgacctcatga

SEQ ID NO: 306 - DNA, 43394 bp, Homo sapiens
tttggaggtagacaatttaccattttttgccaaaactatccagtgaataaacaatacccagaaggacttcaacaatgttgctgtgggaacacacaccatctttagcatttggctgtgcatcaggaaacattttgttctattattctctttctatttaaaatgttctgtgtccttagacaagtcattaaaatctttatatgccttttttaatatattcaatcattttatgctatgaaggtggctggttaaaatagtctgtatacattcattcagttcaaacaaaaaacaaaataaaaaaatcacaagaaaaatgtaagcatagatctataatttcctggatctcaaactctaccagctgagtttgattccaaaacttttcttcttttctctaaacaaggggtcagctaggaattccatccataaaatgtatttggtttttcatcaagttcttctgcttttgtcctgaacttggggtctttctctaagcattgtgctctcaaattctgttttcatgttgctcaaaattcctttttgggacttcaaatttgcatttcattttatctgatcctaggtatcagaatcctggtcttcactcttgcttatcaaactctataggcataaaatatgtcattctgccttgctgaactaaatactttctctgaaagcaatctcataaaatgtagagagctagcaagctaactctatttcatccaagtctaaggctttatccaaatcctaacaaataacaaactctttcctggagtaccagtaaggtaatttaagattgaaattcttatgacgtgtgtgtgtgtgtgtgcacgcacatgtgtttgttgtaaaaatttaggtaaaataattaagaacacgtctaatgtgacacggagtttgcctgggttgctttgatcttagaagcccaaactagaatttaaaatgaccttgataaattagagtagtcattcatcaaaaacagtatgaaatttaatagggacaagtgcaaggaggcacacaggggaaacaactaagtatgcatgcaataagcgcaggggtgactctaagcaattcttaaaaaaaaaatgtgaaaattataggggagaaaagctggaaattaatcagcatttaactgttgttaattttcaagaactgatatgacacttagatacacagtattatgatctatcatagaaaagcagaaaagtaatcttttggctcagtaaaatctgaggataatcctcttctacattttgccagtagtgagaactttattacagcagtatgtttattcgttccataactattttttgagacactacgtgtcctgtgtaaagtgttaaaaattgtcatttgctacatccttctaactatcatgggtaacaaaataacatttgtatcactataaatgtcccttgtattacattttctaattttattgtattctgtcttgggacatttgttacattttgtctgtgcagcatcttctcttttagaattttgtcctcccttctggcgagataatttaatgaaatatctatacttcactgtctgccactggccaatccaccaaagtgagtcattgaaggatgagcacataataaaaagtgaactgtttctaagtcattcaaggatcctgtcagagttataaagaaatagctcttttcttcactctggaacctgtaaacataagtatagggtaagccagaaatctgttgaccctctttgtttgtctgtgtggagagcttgattagtcctcaatgaatccaaaagaaattagagttcatatttggatgaaatgaaacacaattctaattatatcactgagtcattagaatcaaagtggactttttacacctcatttggactttaaagttaaatgaactaatagatttttttcttcttcttaagctaatttgatttggatttgtgacacttgcaaccaaagagtttagactaatatatacatatgtatttgtttatattaatagactgtactgtaaggtaatacttggagtaaggaggttctcttctccccaactcctatgccaagatgatgattttaatatcagtgttaccagaaagaggcaaatatatagcaaaataaacaaactgcattaggtagcacattgacatacttgagaggtaaatcttatttcctccaaattgtaatgtctgaaatttagagctagggtcatgaaaataccatggtagtgatgatgaaggctaatatgatgcatatcagatgaaaggggtgatgtttaattttgtgtgtcaatatgactgggccacagggtacccaatatttggttatatttctttgtaagtatgtttatgaatgaggttaacatttgaatcaatagactgtataacagatttcctactccaatgcatctgggcctcatccaacccactgaatgtttgaatagaatataaggctgagtaagaaagaatcctctctctctctgcctattttcaagttggggcatcagtcatctcctgcctttggacttggatgcagacaatgcattagttagcattctctagaaaaacagaaccaatagtaattttattctggaaattggctcatgtaaatatggaggctgagaagtcccgccatctttcatctgcaaagtagagaacaaagaacgctggtggtctaattcagtgagtctgaagacctgagaaccagtggtgatgtgggggaaggaggagtagaacctggtgtcagtcccagaattcaaaggcataagaaccaggggctctgatgtgtgagggcaagagaaaatgggtgtcccagcttagggagagggagagggaattttttctttctccacctttctccattattttattctactagagccctcaacaaattggaggatgccaactcacaccggtgagggtaaatcttctttacttagtctactgattcaaatggtaatcgcttccagaaacaccctcacagatacatccagaaatcatatcttatcagctatatggacatctgtaagcacagtctggttgacatataaaataaaccatcacagactaaagttatatcatcagttttcctgggtcttcagctctctgacagtaaatcttgggacttctcagcctccataaccctgtgaaccaactccttataattccttatcataaatatcattatgatatccttatgcagaagaatgaaaccagacacttatctctcaccatatacaaaagccaaatcaaaatgaattatagactcaaatctaagacctcaaattatgaaaccactacaagaaaacattggagaaaatctccagaacaggcggaggttgcagtgagccgagactgggtcactgcactccagcctgggtgacagagcgatactcagtctcaaaaaagaaaagaaaagaaaagagaaggaaaaagaaagaaagaaagaaagaaagaaagaaagaaagaaagaaagaaagaaagaaagaaagaaggaaggaaggaaggaaagaaagaaagaaagaaagaaagaaagaaagaaagaaagagaggaaaggaagaaagaaagagagacaagaaagaaagaaagagaaaagaaagaaggaaggaaggaaagaaagaaagaaagaaagaaagaaagaaagaaagaaagaaagaaaggaaaggaagaaagaaaggaaaggaagaaagaaagaaagaaagaaagagaaaagaaaagaaaagactctccagaacattgcattggtctgggcaataatttcttgagtaatatcccaaaagcacaggaaaccaaagcaaaaatggacaaatgagatcacatcaagttaaaaagcttctgcacagcaaaggaaacaatcaataaaataaaaaaaccacccacagattgggagggatttataaccagaaagtataaagagctcaaacaactctacatgaaaaagaaaatcataatctgataaaaaaaaaaaaaacccatgggcaaaatatttcaatacacatttctcaaaagaaaacatacagatggcaaacaggcatatgaaaaggtgctcaacatcattgattatcagggaaatgcaaatcaaaactacaatgaatatcaactcacaggaattaaaatagcttatgtccaaaaggcaggtaatcgcaaatgctggtgaggatggggagaaaagggaaccattctatgctgttgatggaaatgcaaatttgtgcaaacactatggagaacagtttggaggttcctcaacaaactaaaaatagaggtatcataagatcccacaatgtcactgctgggtatatacccaaaagaaaggaaatcagtatatttaagagatatctgcacttctttgtttgttacagcactgttcacaatcgccaaaatttcaaaattttggataaagaaatggataaaggaaaagtggtacatatatacaatggagtactattcagctgtgaaaaagaatgagatcctgttatttgcaacgacatggatggaactggagatcattacattaagtgaaataagccaagcatagaaagataaacatcacgttatcagttatttgtgggatataagatcataacaattgaactcatggtcgcagagagtggaagaatgtttaccagggactgggaattgtaataggggaattggagaaaggtggggatggttaacgggtgtaaaaaaaaaaatagggccgggcgcggtggctcacgcctgtaatcctagcactttgggaggccaaggcgggcggatcacgaggtcaggagatccagaccatcctggctaacacggtgaaaccacgtctctaataaaaatacaaaaaattagcctggcgctgtggcgggtgcctgtagtcccagctactcaggaggctgaggcaggagaatggcgggaacccgggaggcggagcttgcagtgagcccagatgacaccactgcactccagcttgggcgacagagtgagactccatctcaaaaaaacaaaaaaagttagaataaataagacctaccattagataacataatagggtcactctagtcactaataatttaattgtagattttaaaataagttattataaagtatagttggattgtttgtaacacaatggataaatgcttgaggggatggatacctcattctgcaagatgtgattattatgcattgcatgcctgtgtcaaaacatcttatgtactccataaatatatacacctactatgtactcacaaaaaataaaaattaaaaaacaatccaggcacaatggctcatgcatataaacccagcactttgggaggctgagacaggcagatctcttgagcctagtaattcgagatcagcctgggcaacacggcaaaatcctgtctctgcaaaaaacacaaaaataaaccagacatggtggcgtacgcttgtagtcccagctactcgggaggctgaggtgaaaagatcacctgagcccagggaggtcaaggctgcagtgagtcaagatccagccacactgcactccagcttgggtgacagagcaaggccctgtctcaatataataatgatacaaataaataaataaacatcattatggtatagatgccacatacacacacacacatatacagacttctgaatagctcagtttctctggagaactcagacaaaaacagattttgatatagtagacagtgctatccagtagaactttctgtgataatgaaaatgttcttatctgtgctgttcaatacagcagtcactagccacatgtggctattgggtgcttaaaatttaactagtatgacaaaagtgcataatttaaatttaattgcattttaattattttaaatcaaaatttaaatagccattcatgcttagtacctacctggtggacagcacagctctagagaaaaagccatattttttaagccatactattttgtaacttgtatgttaccttccagatccatttcctgctattctcttctgttcttttagtaattgttagtttgctacttcaagatgctttattgcttttattttttctttttattgtatcaaggtacaaatcagatgttccttagagatgtgtataaaattggctatttacaatagtgagattttaaggtagtttaatttagcttgggtttataaaaaatcagtaaaatcctaatgttcttcacaattcctttatttcagctatgtgaattaccaagatagctcctgttatttagtcaatctgggtcaagaaacagggtccttagttggtttcagtatttttagtctgcccttctcattccatagaagtactcgtaatattcctaacagaaattgtattaaatggtaatgcaaatacaaagaatcttctgctctaaggaaacacaaagattcacactaaaaaacagtcactgacacttaaaaaatgcacactttaataaatgactataggttttcttatttatttattccaaactgcttgtggctgaaaaagtcaggaacagttaagaaatggtgaacaatctgctgggcgcagtggctcatgcctataatcccagcactttgggaggccaaggcaggtggatcactagaggtcaaaatttcaatccatcctgggcaacatggtgaaaccttgtatctactaaaaatgcaaaactcagccaggcgtgctggcacacacctgtaatcccagctactagggaggctgaggcacgagagtcacttgaccccgggaggcagaggttgcggtgagccgagattgcgccattgactctggcctgggggacagagacagtgtccccaccccccacccccacccccaaaaaaaggtcaacaattattatgaatggggagtggaattttatttatttctccacagcttatatttgtaacagcccatatggacttcttttgtaaatgaaaatagaaataattttttaagtgcagaatcttttagttcgagccattccacttaagaatacttagaattacttacatagggaaatactgcccttaaaacagacacagaggaaagataaaggaatctatatttttacaggataaaccagacacccattcctttagcaaacacatattgagtgattactatgtttatttttagctgccaaaaatttgatcaacaagccaaagtccctgcattcttcttgccacttacattttagttggggagaaaaacaaacacacatgtaaataaatgatttaaattatataagttcaagtttacaaatgatacgaagaaaaataaaattagaagcatgaagagtgaccagaggaggtaggggtgaagaggaaaagggttatcagcaatgcctcactgagaatgtcacatttggacagactctttggtaatgtaaggaaatgacaaatatgatgatctccaataggagtgttgcagggaaaaaaaaactccacatgcaaaaaattatatgtcaggaataaaattggcttgaatagctatagagtcattgttgtgaaagttttttttgttgttgtttacttggttttttttaatgaagtcaattttcagtatgattatgttcaaaagtagacagtgatcttcaggttgtttccgtttatagatgattatttgcaaaacttccattttacgtattacctgctgttaaactcaaggatcatatgatcatctatgaattagggttaatatgtgcttgtcctgaggaaaatgtagagaaaggaattatccttcttgatgagtttaagaaagtacatgatggccacatatcttagatcatttacattcaatcattgtataaatagaatttacactacataagatcattaggtcatttgcactctatacgttgtgattgcatattttaaaacgagagaaggtgaagatgttgatcatattgctacttgatgtagctatataaaaaggaaggaagagatcattttgaggttatacatttctgaaaatttgtgaatttattttcattacttttatatactttcatcaacataacatgaaattctaataataagacatgtggagtggggtgaggtaaaataataggttatattttgaagagggacactgagtgttttataaacagtagcaaaattgtaagttaaaaaactatctaaagcagtaaatattgccataaatatatacaaaaaatacatataccaaccatacaaaccattttgtatatatatacaaaaatacatataccaaccatatacacacatcatatatattaatactacttatattgtggtgtatatactatatactatgcctataaattcttaacatttctgcaacacaggcagattatctcatacttaaaatgctagcaagcaaggagaatgacaatcaatgtttccagtactcaataagctaattttcttccacaatggtgtacattttcaccaggccatgaaatctgtttttctaggtcaatttactacaagggtcaatttgctatgagagtcaatttagcatgaatttttagattttcagttctgggaatgactgtatattttaaaaaaattagatatttcccctaaatttagcattttaaaagagaaatataaatgttctggtgaaccatgtgaaatcacaggaaatttatccatagtgataaaagtgacatttgttttcccattttcatttcaatatttttagcataattaaaaccgtagacagtttacttggctcccaaaagtgtaaaagagcataatcatcacagtcagaataaatttcaatactttcaactgtggtagaaacagtcataaaatataagctaactgtagtctcttctgtgataactaccttaaaaaaaaacctatctttggtactactgagagaggaggaggaggttgccatcttattctgtgatagtataaagaaagaggaccaatatgttcaaggcagaacaaaatataaactatcttttatataatacattaattactaatgaattacttgcttgtaaggcattaatttctcttcgttttatattggatttcaaaacacttaattaaatatttaaaaatatttttgccatgaagtgaaagagaatacggggcttaattataaagaaagtaaagaaaattttgcaaacaggtttaatatttcaaactattgcatatagggatgcgtggatagatgccatcttttggcaatttatgaaactaattaattgatgattcctatggggtcagttaatttatacatttactgccacattgatgatatatgtagacaatataaccttaaacctatgaaatgaagatactggaagatatttaattgtattcacagaacagctgtaagttttagaaatgtatttattcgtacaagtctatataacattttgacaatgtcacatttttctaaaatattcaaatatctcacaacattgagtactggcaatttttaaattaattgtgtaatagtatctaagaatagactacttgaaaaatagagtattatctgttctttgtacatgaatctgacattatttatccaaatgaccagagtttatgttttcagtatttttctcccataaatgcaatcagtgcacatttcacttctagtcccctgggtgtatgggctaaagagagcccttaatcacaagaaagttcatgactctcacttaatcaaactttcaacttaaaaaaaactaattaaattaatcattttgtttcatagtttaccaatggagttacttttgtcatgagtttctgaaagcagtaatttaccaaaaatcccctaggctttttaggctcttccgtttcagagattgcccactgaaattatccctgggggtgagtatgtggcaaaatagtgttaaagaccagtgcttctcaaactttgtgtgcgtacaaatcactacaaatcttggtataatgaagattctgactccgcaggtatggggcagggctgagattctgctgtcctgataaattcttaggtgttgctggtgctgctggtctgagaaccacatatttagtagtaacgctatagattatatgagggtacaaatccaaattgctgtcatggttatcaacaagactcagaagaagactctttttcagagtattggttacaaatgcctatatattcatgctcaaatggggtattttcttcaatataataatcttaaagtttttttttctattgctcaatgtagctttataagtaattaagtccagctccttcatattatagttgaggccactgagggtcaaggaagttgaatatatgcccaaggtcatacagctagaagcagcatgtgcattagaacccagaaactccgactaccatttcaataaacaaatcctaacttctttggcatttccatttgttatattctccctgacacaaaacctaagcgtgagtcaataatgattagaatttcaccttttgatcctcacaataggttaaatgatagcagtatctgtggactcactgactgactttcctaacagctaaaactcacagtaggcaactatctcctacaataacacaggtattcacacatctttcttcaagaatgtgcttgcagttttattatggacattttgttccttaattttgagaacctggggagaaaggtgggcagagaaatgaatgggtcattagttaaaaggcaagggttgaatttgcaaaaggttgtggcaaagtaagcaacaaatgggaaagagtgaagggcatcaatattgatcttgcctctcatctttccctctgtcttcttgcttgcaggtttctattgtgtagtctctcaaacaaagccgactttatttatggtgtgactgatttaacactactgaaccagtccatcatctgccaatttggtccaattaaaaactggtcatagggaaaacctgggaattaagctcatttagaaacacaacttctgattcatttatgtcttgctcatttatgtctcctcttctaaaggacacatttcagggtgttgatttatagaggtggctctttccagcttcctgagtttctgtgactccttttggttaggtccattaaaaaagtgcacttctgcctctctcccctcgtaaggctattgttaaaacattttaaagaggcttgcctaagatttcctgctatccagaattagaaaaatcccaataaacagctagagtcaccatttttaaagtatgtacgcattgcatggacttacgctaacatgattgctttctcacttaatccttacaactctttaagtactattatcctggttttgcagttgaggaggctttagacttaaacgttcaagtaaatcatcaaatattataaaacatgaagcgacagctatgctatttgaaccaaaggctgcctgatgccagtgccagcactgctactcaccaagctctactgagatttatacctagactaagtaaaacctctgaacaacaacaacaacaaaattatttcctccacttgtttttccttttttgcacaagttcttgtaggcaggtaggtgttccactccctatacttagcctctcccacgccctctgcaatctttcccttttgctgctggaatcgtcagagattgctactgcagctggtgagtgggcaggtgcagccaccatctgctctaggagtccaaatgcgcagaagaacctcgcacccaggacctggcccaggcaccacgaattccagaacatgctggggacacggctaaccccgccccctcgcggtggcgattggctgaacccttcctgagtgcaaagcgctgattaatgaaggcagttgtctcgcctgcaagttcgggcgagacatctctaaagaggtaagatccgccaggggtgctgaatgggggcttcagttcttcctgcccgaagggtccttgagaagcctgtttgtttttcccggcgcttgtctccacccatccccttctctcattggccagacctggtgggcgggggagtttccattggccggggggcggtgtctgtccctggccggggtgggggcggggcctccgccgctctgagcttgcccttgtgtctggtgcttcgtagagctgccgccgtcgccgctgccgctgccgccacagccgccgctgcagccggagcatccgggagccgccactgccgccgccgctgccgctgctaccgccactagcgctgcttccactgcttctacctcccctcccaggaccccgagacaccccgggcgcgagcggcagtgctgcttgcttgctcctcctctcccccagcccttcccctccgtgacctacccactccttgcagccctcgcccgcaccttctccaacaccccggcatccctgcaccacctgctcgggcagccccggcgggctctgggacttgctgtgcgcgccgagaggaaggcaagctccaaacccctgcctggaagacgggctgtcgcggctgcaccaccagcaggaggaggaggagaagaaactatttcgcgataccccattctgcgggtgctttgccgctgccgcttctgctgccgccgatccgagtccgcgggttcgaacaccgcagcggtggggacggtgggtccggcgggcgccgggaggaggacaccagcggagccctgcactctcgtgccccgctcaccagcatctacttgccccctcgttccttccccagccctttagagaagggaccatgatttggaaacgcagcgccgttctccgcttctacagtgtctgcgggctcctgctacaaggtaatccccgccccggcgcagggaacatcaacttctcgcccattccccatcttccccattccaccccatatttccactctcccctcccagtctccctgtccccagcgatttccaccccctccccctactctctggtgcggcagggggcagtggcagtttgcaccagcccctcgaatttctaacactggctcagccctgccttcccagcagtcagccccttacgcggcaccttttgccttctcattcacctgagcttccttcatctcactccattcccgccagcatccccctcccacgccttttggctggcaacttgtgcctctctgaacattccaccctcccgacaacccccaccagccacctcccacatcacgctcttgagcgaccctctccatctcttgtcatctctttaacctcccccttttcaggtcgccttttcttttccccctcttcccaccatcatcatatccgtgtgtctttaaaaagtgtgtgagagcctgggagcgagctaccaagacgggcgagaacagcagcagcgacagcaccgtgtgcattgcaataacatccccgggggggaaatgtgttctgagacgtgtcatttacctaggaagagagaggggactctgtctgggatttaaaaaaaaagaaaagaaaagaaaaagaaaggaaaaagaataagaaaaaagaaaaaatgagtgaatgaatgaataaataaaccaagaatttaagaaaggggagaaaaggcaaaaaaattaaaagacccaaacccactttatcaacacattgactttttattattcagtctgtgtcgtttctttttttttttaaccaaagaaatatatgctccctagcagttactttactgctaagatattttcacttagatttcctacctctccatcctctctctgccgcttctttccgtaattaatattatcctttcacgtgaaatgtaagaacctctgcgaccgcagcagtggagggaaaccgcacaaaacgctgttattatgcaaatcactgggtttggatgccggatggctaaggaatctgggttcacttttctccagaccctcttttttggaggagggagtgagggggctgtgtggaatgggaggacgatgctgattatgaaataaatggcaatgcatagtacaggagtgcatgaggacactttgggtggtggaggaggcaggggcggcgtgctagggctaggtgggcaggggctgtaaggcggaagattgttgctttgaagagaatagtatagggatgtggcttgagtgtgagatatagcaaggatggatgtgaaatgatgattgatagaatattttttaagctaggtgactagattttttttctttgcctgcctctaatccttctgtcattatttgggtatttgcaggaaaggtaagttgatcaaattaatttttccctgggtaaaagggatctgaaagtaagacacacgtagactcactggcgtgcaaaacccagtcggcctttggaggatttaaatgaggtcaatgaaccatctttcagcaagttcttggaatgcatcctctctcctgccctcctccgggatatagactggggaccgaattttatttatgcatatttatgaatgtgaaaaaagaggcggtgggcagaattttcctgaattaactaactgaccttgtagagatcttgtgtagaaaattttggtggtacttttgtgtattttacgttgggtgtaaatttcagatatgtcatgtgtgccagaatctccgtgaaggcagacagcacattctccctgcgtacaccgccgagtcccatttctcacctttcacacccccatcctcacacaagtaacccgggtgtctgacacgttacttaggtttttaatccgcgctgagacaatctcacagagaccctacttcacctctcagtaacttgcatttctcagctctgctgtgtgtgtgtgtatgtgtgtgtgtgtgcgcgcgcgcgcgccggcgtgtgccgtgttgggggagtgtgatgtgggggaatcagttaatttggtgattgcaatgaaaattcgacaccgctagatgtattttccctgccaatctgtgtgtgctggccccggccggtcaatgcacacactgctgggctgctgcgaaattatttattatagagcatgtgggccatggactgcacttggggtcgcctcctctcttccttcaacatttccctgtgaattgtctattcagtgcagtgcgaaataactgtttgctggtgcctctctctcagcctggaggaggatttactctttctctacccggagagattccatcagcagcattcaggcatgagtctcttttattgagtatgtaaaccaatgattaagacagtgctgcttttcacagcagactggggagcggggggtgcggggaaggggtgtgagtatagccgagaaaatgcaccactgcaaccagcagcaacaccagcattaggtccaataaataaataaataaataaataaaggttctatacagcaaccagggaaagagcacaagtccatccatgtctgtggacttaggagcatcttagatcaggccatatgaatacactaaaagagatacgaggatttaaaaaaaaaaaaaagaaagaaagaggagggggcacaaagcaccactggattgtcttctcatgtttatggctgcctcacatttattcatcaaacactgctccacagacacatcatagtttgttgatattgtcagtttttgctcaaattgctcatgccttccttgtcttaggcttggctgagaacattgtttcggggttcagatttatgtttcttcccctaccctactgttttattaggacttggttaggttgtaaaatgaaggctttattttctggacatagattaaatacttagcgggtctttctatgtgcggggagaaaagggtggcgggggaactagtgagcgactgattttggctagagggagtctgccctgcctgctagtagttatgactaggcaaatactatagtcagtcattagcttcttttttttagctttatcagcactatagtgatattcacttaagtaatactaatcagtttatttatcccatgtattactattctctttctttcagtatcattattaaagacaagaagactcatttgaacatatcttctccatgtttctgtgttttaactgactgtattttatattatcacctatattttttaccttttttctgggaagcaaaatcaattttctggcttgttaatatgtggagtgataagccagtggtgagaatctagtcaatgataaaatgagttttttttaaaaggcttacttaattctataacatctgccagtttgtcctcatcctcatcgtgtctttaggaaatgaataatagatagggaataaacatatgcttttggctaaacatttgtttggccaaagtataacttggaatgtaggctacttaaatagcaaaatttcatttggtgttcagttacaatgtgtcttttcttattttccctcatcatagaaagaggaaaatctggagtaagcgcaagggacacattacagaaatgaatttctttgcaaggaaagcttgccacctgtaactaagtcctctcttggctatacagtagatccagttcaattgctaacccttgctgaaaccttatgcctttccatgcctgagggggcactgcaaagatggagagaatgccctgggtagcacaggaaacaattctggaaagggcaaaaaagaaacaagggcaaaatataacaagaaataatcatgcatacatgcatacaagacctcattttgttgagaactgtgtttactttttggaattagtcgtataaaaaagcacctccaagacagatactggggctttaggtttttttgtttgtttgtttgtttgttttttgccgtggtatattctggtaaattatttgttacatttagtaaaaatataacacaagcacaatttaatttgaatatacattcaaattaaatctcattggacgtacataatacttgcctcagtatctgtcatgaacctcaccttacatttttagaaagcacattataatacatcttatatacacttaatgaaatacttacgcttcctaaaagcatatctttccaactattttacctttacatgtgttaactttagtcttggcaagctcatttcttatgccaaatgcagttcttgaaatacagttttctcactcccttttttgattaacataaactttggaaagtggagcctatatacttaaatgcaataactgtggcttaaatagtcaaacatcagacaattggtaattaagaaaatctttgcaaatataaggagtttctagactagttttatatcaagatgtggaagcttacttcattgtctttttcccatttctataactattagaactctgggaacataacatgacaaagctaagtatcaactgagatgatctgttcttgtgtccttcattagaagataagacatttgaaaactatttgtcacacaattaaatagtggtagaatgtcatttttcttaaagaaaaaaatacttaaatcacttaaagagcaaaatggaagtgcaaaaatgttggaagacatcctaagcatgcatttgaaagtggcctggaatcaacaccaaatgacatgaattttctccttaagtagtctgtggtatatcaatgattgagacaagtaagccttatttactatgaaggatttgggggtacattaataatcaaatatagacctaatgtcatatggatgttttatttgatcttgctgacaagtgctctatgatatttattgagaaataatcctcattttattagactgtattaaacccattggctaagtcacctattctgtagcagctagctgaatagattgaggaagtagagagaaggaaaatcacaaaccaaggaggccgactcaaaactgaagtcaaaagccctttgttgaattggcagatattggtctgatttactctcttaaaatagttctagtgcccaacaattattatacttaagcttcctgagggcaagctctgagcctcacatagctatgcaattttcttatcctcattttagtagatgcataaacagtcatgttggattgaataatatatatgtcctaattacttgtgatgggattaaatgatctcttcttttcataatatgaaagcactcatactttgtcaagtcacataagagttaattttgacattttgtaagctatattggtttatgaaagttatcctaaagtatcacataaatagttcttaatatacatctttaagtgaattcaatctgatcagtcatttttaacatttttcctaccatttttttcttttccttgattaaaaaccccagatactttacattagattagatcataaactaatttcataaaaaatgaaggacacaatttaaatttactgatttaacctaaaatatttaaaaggacacgttcattgccaacattttatttgaaaatgtcaagcatttttggagtgcaattctgttgtatcaagaaaggcatcttctgcaaattccttgtgtaaagaggtgggtgaggattaacctagagctgtggcagctgaagccccctgctgtgtgatgatgcaaatggcatctcaggcctaatgtgctctgcagaggccacaaactcacaggaaagcagtcatgtggcatgagagtgaaatgggaagtctttttcatagcttgtagtggacataaaacatcctttagctttttataaccagaaatgatccagagtatttgtaatcacatgaggttatgacaaagcaaaagagagaacatatattttgtttagagatgaataaaatcctactaaaactatcaacattttcatccaatgaatggtgaacatttaattttcttccaaactatcgggaacataggtcagtttaatgaagatgaatagcaaaattaaaataggatttccatgctattttttacgtgtgttggacttaataactgttgggctgggaagcattctgttatccagttcttccttcagtgagtaaggagttagtcctttaatctcattcttattagagcatttcctgtactatgaaaatatagcagtttctttacaaaataggagttaactgttcagtgtctcttcagtttatttagtgttgtcaagtataatttgtgttatgtcacatcaatagagaatgtttcctatctgcacaatattatttatcacataggcaaagtcatctgatatgttctctaaaaatgtaagagttataaacccactgttatagcattaaaccctatcagataaaaggaactaacgtagctttgtatattttgattccatttgccacagaacaaaaaactgaacatgttatacatactgatttttactaagtagtgagcccagttggtcctgttaatgtgttcagtggatttccttaagcatatacgaaaccgttttcatcttagaagcatgcagcctatttaaaaattagtgaagtaaatattctgcttaagtagggatcagttaaatattaatgtcaaaatcagagatgtaattattgagtatggaaatattccacagtcacttatttatatatatgcacatatatacacatttaagtatgtcattatttttaagactgaagaacatctttattaattttgtaattagagtttagggctttcagggatgtataatagaatgatggaaaagttaagagtttgttttgtttttactcattgtgttcttttactctttcaattaaggttaagaattttatttttttttaaagtaaattttctcaggctgcaacaacgattaacaagacttccacaaaaaaacacacacacaagtcttacaatttatgaaataacaatagggttgagtattctgcatctatctttgtgcttatgaaactgagtgataagaacttgttactacttgaatagatacagagctaagttagtaagatctgccatagagagagggggccattaactattcacattatattttagaggtctttgaagtaaatattaacacagtcattgttcaattttggaaacaactctttctgagtcagcaaatcattttcacttgaatatttaaattatctttcagccatttcattgttgaagaggaagtccctgtctagtcatagttaaggagtttttccaggggttaaatactgatgtcattaggcattgcttagaaaataaaaataagcatacttttgctttcagaaaaaaaaatctcaaagctaaatgtgatcaaatagtgcaaataatttcacattataagaaaacaaagtcctttaaaaagtcaaattgagtttctaaaaattttatatattttatgatggttaatttacagtaaggatacattgcttatctaaagttgtccttgagaacagaatgagaacatacctttcctgacaaagatatgctgccgactgctaagtgtatagctgttatattgatttgctataatttataaagccaattaatttattattgtaaggaaatatttttacctttaggctaaaattgtttgtattctaaaatgcaggtgccttccataatgcttatttaaacatcaaggcctaaaatttatagtgtgtaaaaaaagtcctaattttcttaataaattcatattttatattaacttctcctgtatcccccatgggggaaagtgtccatgacattcataacttccgttcattctgataccttttacatctcttgtttttcaatctggagttgtaggcttaagtttaaatgagaaataatgtattatgaattagaatatttatatgtaaaagcaaagaaaaatatatagtaagctttttatttaattgccatttctttactgctctctattttatgtgctgaagtccgaatagtaactcggcttcctttatactctccaggaatataatatccctcccattccctgcccatgctactgacttgaaagatccattaaaataaattaatggggaatgaagaataaagaagtgttttgctaaaggatatgtacagaatatgtacagattgggtgtttttcctttcaacccccaaggagcacaccccagcgttttagcaaggataaaacatgtgcaatgtgtattgacttgtttttgttattgttactattgcatttttttgaaagctccattccgtaatctcttaataaaaatggcaaaaagaaggggaaaggaatgtgagtcagccagccaaacacacagagaaaggcctggcaaagctgcctaaattagcatatgctaggctgagtatttccctctgttgttacataatccctttctaatacgaaatcagttctcatacttaaccctttcaggaggtttggaattctcccactgttatatttttattttgcttcatttattttctcatgaattgtgtaaatcatctattcaagggcttttatgtcaagttctttttttccctctccagcccttctgtatacaaatgttccattctgtgtccaacttcaggattcaagaatcaacttttctatagcttccactgagaggatctaattagcattttagtctccctttactcatgtgcagctttctttagaaaatgtattagttctacgaggttcccctaaggattcataatactctagtttgttacatgttctgtgatattcaatgtgccttaattatgcacgtgtcctcatttcaaagccttttcagggatcatgtgggatagaacaggggtctggctgtaagttcactgtcatgtattaatgtgtaggtggtattcagagaaggatgtttctgaaggcaattatatatctatgactccaatatagcaagcagttactcacattctgcacttactagttatcctgccaaggcagaattaaattcaccattgtgatacataatacagtatctgttatttctaaataacagatactgctctaggattgaaataaaataatgagtgaaaatgtgtatcccctaccctgaatagggattgttcctttcactttcccaaacaaaaagaagaatcagaaattgttcctaagtcaatactctattccttaactagcccattaacacatcttgctatggtgggatcttgaagttttgctggtttttatgtgaggctgtagatatttaagcagtattaattgcctgcaatctttatggactgccaaatatcagtgcattgccaaatttgagacattttattttcgggttttaatttggatgcaatttgaatactggtggaagtatagagagacgctgaactcaacagagagagacagacatctttttcttaaagagacttcaattgtggagagattgctataagaattggcttgttttgtatgtgttatcacttaacaagggggatactttcttatattacatgagtatgagagtgcatttgtcttaattgtaccctttgacttacatgtcttcctctgtgtcttatgtcataagaaaatggtggtttaatttgtaactgcaacttgtgtcttttattcttttatttatgcttatggcaataaaaagcgttttataagctgatataataaatatgttttgacaatttttgtttgattattttacacaatagcataatttttgaagctatagttttagttttagtagacaaaagaatgccatctgccctctattgattattttaagcatttatgtgttcttatttcatgagagaactgagcatttgattttgtctattctgtgatctatataaaacttcgtatattattattatagtattttgactaatcgaatgtctggtctatctttttttttaatgttttcattccactgattgattagttttcttctaaaagatttaatcttgacacaactctttaattggatctagataatatttaagtatttacattataactgccaaaatgccaatacagtactccaaatagaataaatatttgcagtgacttttcatttatatgtaatacacaggaagaagacagaaatgcaccccaagaaacaaaaataatactaaataatggtgtacttaacaaaaatatgaattaattgctttcagtcagggtagtcaattcaaatttgcactgtaaacatttatttgaatcttcccgatatctttgggtatttaaccccttatctttaatctactttctaaagattttatttctagcttcaaaaatattcctgatgatgactttggttaaacgtgaagccacattatcttcttgttctactttgagtagctggcatttccggataaatgtataaacaaagaggaattacaagctgaccttgatccaccagattatgtgtggactgacctgctttttttttttttttttttttttactgccaagctagagagtagaggttctctgattagtccctgaagtgaagattcagggtgcattcttctcagttaactggaagagattctgtcagtattatttaaaaggccctttaaaaattctaaatgttagtctatttgtgtttttaatgtttagttatttatacttatgcagttgatgacacatatatgctgtgattgaatttgattttttttttttgcatttgaaagatagaggtaggatggaaatattatctgccttttaaagaaaatataagtacagttactggaaactcgaaaccaagggagaaaagactctacaatttgtagtgactatattttcacataaagtgttttaagaatactttttctaaaaagtcccagtgaaatgcgacttttcttaaaagtcaagtttttcttcacattttaaaaatcaatttccctgatgtcttgtggatttttgactgtttcatgactcttagcatttgaaaagatattattaactagactagcttaagatttacctgaatgccaggtgcggaaatcactctgtcatcctcatagagaaatatatattctgtaaataaatgtcaaatgaagataaactagcaaaatttattaaggattcttgccgctttatacagttggtattaagaattatattctctcatagcttctattagcacctagtcttgctttatgttaaaccatgtctgtatgatgctacagttgcagaataaaccttctctaacatggcttctgtttggcccctgctcatcaacttttcagagactagtgaattaaagggaaggtagtttttgttgcaatttttgttggaggcaatttttgttgactatttcactgtttcagtgaaacattttaatatgttactgaatttattcattatattgaggatattcctgtaacctatggttaaatatgacatattttaatttttttgtgtgtagccacataatatctgaaattggaactgtgaggaaaagctataccttcatattttcaagacttttagtcgtaatgattcacttaaaattgaatttcagtttgttataagaaagaaacacctttacctgttactttacatgcaaaagcatttcagaccaacattcttgtccagaggcacaaaattaaaaacaatatccataatatttagcaaacaaatattacactaaaagtactgattttatagaaagactgttgcacaaaaagtattgattttacggaaagatttcatgataagtaacatgaaaaagaagttgtatgttcaataacatttacaaacatatttttaaaaatcaagtaaaatttatacaggatagtttcatgttcattggcttgcttttttatcaacatagaaatgctagggatgaggtaaaactaatggtgttaccatttagtaactccatttctccatatcatttcatttccatgaaatttacaatgctataataaaagtattctagagagataagaactgcatagtattatagaggtctggtggaagtcactaatttattttaaactttatctcgctttacccaattttattgactgtgcaagtatagactatcaacaaagcagaacatattatccctgaaagatacaacagcataagagtacatgttttaataaaacaaatatgcttgatgggtatggacagactggggagattaatatttcttatcatttaatgatggactaactataaggtaaaagtaaattcgatcaggcattagggatattttctcccaggaaattctcatcacctagccataccatgatggagtatagaggtggattggtaatagaggaatgaagtggaacacaagcagcagacatggtcaaattgtggttcgtgtggaagtggtagtgagattggtctggtgcaggtcttttattttgtagtgagggttctttatgctgtaaagggaggagctatcaatggactaattaaaactttgattttggaagtgccttacagcagtaagacatgatggtaggaagcaagagacctaagttctcaggcaagccgtgtcacggtctcactggccttgagcaagttacttctcttgtagcttagttttttcagctgtagactgagtggttggaaccacattcattctttggtgatgtattgtagaaggaacttatggatgattgcaaactgcagagatggcatttttctttttcctttccacctaaagatgttttataacatagtataacattaactgcatgctcttaaaatagcatttcctaaaatttaactttttatatccatctatgcattgtttagtgcttaaggattttacatatgtaaacagattttttattgtgatatatgtgcctctgtaaatttcagagcttttctttctctgtcaatgaagtttataaattaattttgtagccattggcctgagtttgagccatacatacttttctcacaaaatcacatccatagatcaattctataaattaggaaattgattcctttgtcatttttattattaggaagtggactggataaggtttttcaattttgagtttgatttcatatttctgtgcatttcatgtacattaaaaattttctgtggtcattttattcttcatagcctttggttttctgaagcataacttattcattcgttgattcatttatcaacaaatacctatttgaaggcagtgttgtaaaatgctggatgtataaatgaacaagatggaaagagtctctgcccttatggagtttacagtctagtgttggccacataataaacaaatcaaaatacataattcctttcttagtttctatctttctttctttcttttattactattattattttttgaatcagagtcttgctctgtcgcccaggctagagtgcagtggcatgatcctgcctcactgcaacttccgcctcccaggttcaagcaattccatgccttagcctcccatgtagctgagactacaggcacgtgccaccacgccggctaaattttctatttttagtagagacagcatttcttcatgttgatgatgctggtctcgaactcctggcctcaggtgatccgccaacctcggcctcccaaagtgctgggattacaggcatgagccactgtgcccagcctgtaatgcctttctgaatcaaaattagacattttatttttatagtaatatctttcaacagcaacagaatgcagatatatcaatgaggatgtgaaatcactgctttacaacaatgctgtaaacctcactgggcttttaacattttttttttaaatttaaggttaaagagctctcatttcctccagtcgtttatcctgaaaacgttctcagtatgatgccagtttctttatttttattattgttaatacaacttgaaagaacctgacaggtgaaaaagaaatattcaagaatgctctattctaactgatttgttcgagaggatgattcatttaatttcataaagactcagtggtccagaacagtgggtgaccaggtcagcagagggaatgtaggggagaagaggtctgtgagaaggaactatgtaacaagcaacaatatttagtttttttagacctagagttctgcttgagcaattctgatgttaccagcaacattcattcaaagagccgctgatgcctcagggaaaacatttttaaagtgtcctatctagaaacaatgctccttacactgtgtcatatatattaaaactcccgccttgcttatattacaatacatcatgcttggttaaaacctatactaacataatttggctttttgaaagtgtcagttaaatgttgttccttaaacttttattcaatatgtttgaaatattaaccacctggtcaacaaagctgaagaatacatggggataccatttaagaagtttaaaaataaaatgaatttttatacaattatttaaaacattggagagaaacacacatcatatgaacaggctacaaatattcttggcatcatattttacttcctttaatatttaactttgatgatcccaagatgggaatgataccacatttctaacagattgtatggtatttttgaatattactatttattggctagtgatatctctggaatggatgatatacatgttaaaatagacaagcgaactctgtaattatatgtatatatatatatatactttggaaatcataatgatggtggtctagcatttataatagttcagtttagggacttacttatttggattatacacagtaatataatccacagttagaaaaacctgtgcttacccattaactttaattttactttcttttggttttaaaagaaactttaattcaagtaaatgcagtcttgcaggtgataaatggctagagtatagttttatattaaatgatttattttgaaatatattaagttttcctaagtcagagatgcatacatgtttggaaacttttataaagggaactaggtggtgctgttctgtcatctttgtgtcttagtgacttctttggtcctgttctgttcattaaatactctcatacaagaagtgcattaagtaaggcatagctttggtttcctagtggtattatgttttactaaccaactaagtttatattgattttgtatcattgttttcagcagtatttttgtacagtagataaaaaccttcctaagaagcaagatatatcacactttattacttacctcatttctgtaacatttaagataatatattacattctgatatcttcaaattttttattatgttttttaaaacctcatagttggctttttatttaccaaatctttgattattattagagtcagaagttaaaatgataacatttttgtacagtttgggttgatttagtgtaaaatgctgcaaatatgtgatctcaagaaaaagcatttatttctaaccattatttgaaatattactaattgcattaagtttttaaacaaaagaaaagagaaagctttctcttgaaaggaaattttgtttgcctaatttacctccctttcaagaaaagtgacctcaattaggctgtctgttaatcttttcaagtttcaagatgttattaagataattgtgccttcccataatcttggtgctacctgatagtcaaaaataaaacagttatttaaaacaaaataagtaaacaacaaacaaacaaagttatttcactctccatctatatttagtacactggtatctctgtggtatattttattggtaataattatagcttctttcagatacctttacattttggaaaggcaaataagagaaaacttataagggattgcattttttttcatcaaaaatcatccggtgtactgtataagcaattgtaagttacgtttcttaaggattttgtaatgccatctctgaagcatatattatatattttctaatgaaaacccggatataaagtaatgaagttactctaagagttttaaccaaatacctccttgtagaattgtaattttgcatacctatcattttgagtggggaaaggtaatttatatcctttatttctcacataataaatcccccttgctgctacttagatcataaaaactttaagttttaccctaataggaaactcaacattatagagaaaactctttgtgttttctgttattttgcaagtcttttatctgtggaagacagaatcaatacagaatttcaaaatgcttccacaggatgtcatcttacaatgtagagagataatctctgagatgaacatcttctaaactaataagcataagtgaatgcactgctagacctctgtgctcttgtctggcctccccaaacaaaatgaaaatcaaaagtattataagagtttagaatgggggctctgcttaaaagaactgggattgtttattcacaaggatgccttcattttctattgaatgaaagttttcctaaggagaattgggtaattcccattttataccaccataaccttaaattatgaagaaacctaatggtaaatagataaaatatttaagattatataaaaagtatgtcttggggagtaattatttgtattataatactttctagcttttagttactgtgttatgggaataaagtgtgaaccagataaagaaattatgaaaggtatttgtgaatttgtcatatctacatgttcagaaaccattccgtgtttgattcactttttgaaagttgacattttggtagagataccaacaagaaagtagaaagtatttaaatttaaaatatttgatactatatttatattatagaaagttaaataagactatcagaccaatacctatttttcaaatatgtcatactttaaataaattaaataaagcatagtatttagtgaaaaatccatcataaaccaatatatttcaaaagtatttttccttcaaaaatatagaaatatagaaatctattggttattttattaagtatcagaaatacaataaaaaccacttatatttggtgataatctggtgattacttgtcttagaagtaaagttagacactaaacacatctcttccagtatgtttctccttggattgaggctctacagttcataccgaaatgctctatacatttttataatatcctttggtcattatttctttgataatttttatccaaataagaagaggctttcttaataattatctttgatgaaaattaatcctaggcaatgtagcatagccactgactattagtaatcaatggctgcaaacagattactctggcatatcatcttatcttttcaaatgcacccttggaaacttctgtagaagacttttttcatcttgccacattttatcaatcatcatagatttatatctcacagatctaaaggtgttttttactgtaaaagatagactaaataacaacaaattcaccatgagcaaagacaacagtaagtaagggatttctggatttcttttgaaatcagagtcagatagcagaataggtgaaaatgccagaaaagagactatgctggtcaagagaataaaagcaataggataataaaaatgatggatatagatctttagcgcctttaagtatatatttctttattatactgaaagaaatcagaatctccaatgaagaattgatacagatttatagctgatatcagcaaatcaaggtttgatggacccagtgggtactgacatcattgcacatggtgaaagagatttacatataactagataagaacttaggatgatatttggtgcagcatgtccagcacctgatttcttggaagagcactgataatgaagaagcctaacacaattaggaggtaggtctaaatgataagcacatatgaccagaaataaaacgataatctttggggaatctatcttaccacaaacttaatatattctcacatacaacttaaactgagaagtttctagttgactttgtgaaaagatacatttttttcttaaaattaatacttgagtctgtctatgttggcattaatatgagtggaggtgatgggatgcaataattaggacatgcttttgttttgtaggtgaatctcagatactcctcttattatagctttgcagtttacaaattttcagattttcaaaagtattttattattggctacatatgttcagatataaaactggaagaataccacaacagaatagttcttaaaaacagagagcaatggtttcatcgttgatttgttttcatgcaatattgacgtcaacggaaaacaacacttaacaaaagcagtgtctacgtttaattcctaaggtgtcaatcagcaggtgtttcaaagggaacattgcttgctttaaactaagatctttaaatttggggaaaacctgacattctgggggaaccgtattccttatgcaaaagtttaaaaataaagacttttgaaggagaataaaggcatttgcaaaaagtttgtcttctcctttcacataaacatacaaaatacatagagtaaattagagatggcaaatttttagaaatgataaaggtgtatttgctcatctaaacattaagaaattaatataaatgtgctaataatctaaagtacttccttgacattatttaaaatatttgtgtcactatcaggaattatgtatttctttcttgttaacgtgtatgttttctgtcttttctttactagttgataagctctgtgaatgcagagttaccttttactgttttaatcttccacttctagaatattttctggcacacagttgttcaataagtttttattgcatgagtaaatataattatcttgtgttatttttaaagtaatattctttacattttgagcagcttcctacagtgaacagaaaccaaattaacacgtgtatttaaaatggacctacttaatattagtaatgattgagttaagccctttctcagacacatcattttccatatttcacaatatattatttattacttgaaaaacatttgtaattgtgtttatgtgtttatggcataagacttaaagcacaataccagtgttcatttaaaacaataaaagggaaaatagagcggaggaatttactagctgaaatgccgtaagaagacttttctgagtctaaatgtatttcctgttttattgcttaacattgctaggagttcagcatgtgtgttcttttttatcagaaattttaagtcatggaattataactgaattatatgaaaacaataaaaccaaacatcataataggccataggggaaattttacataagaaatatgttttagcaaaattggatgtaactttaaaaatcacttctgtggcactttagatttaaacatgatctcatttcaaccctatttaaatcttatttcagaggaagcattgtgtaaatggaaagtacaaaagatagggcatcgagaattaaagttctgattgtggctgtgccattggctccccccatcacccggggaaacagctcatctctctagaggtcagttactcagagggtgttaggcttggatcatctccaaggtcccttttcaacttgaagactgactccaattcagcagctaaaattaaataaatggatatgctttgcaaaggttagaatatgattatgtctttgtcattagatgaaaaagttttaatctgacaaaagtgttatataatgatgaaatttatcactagtggtgtttgtaaacttctactgatgcacaattctttcatgtgctttaaaaataggtttgctgcttgtaaaatggaggaaacgtgtatatttattaatgtgtatatttatatattggcatacttactgatatctaagtatataaatcaataaatcttattgttacatgattccatttgtttaaaaaatgtgtgtgcctgtgtacatacttcattgcatttctgactttttacattattctctataaatagaggataactagagttattgagtaactagaagaggtatctttgaagaaatactcaattttgtaaaacacttcttctaagaaaaatcttaaattattaaaaactgtcggccttaagggggagagaaatagatgattccaggaataaacttcaataaatgaagatgattttacactaagtattataaactgttttttttatatccatagagactaaaaaaaaaaggtgttcttcaactactctaagagtcctttagatttttattaagaaataatttccaggcaggactcctaggctataaaattaaacgtggtgaaatgctttttttgatgtctaaaaggatagattaatttttccatctttcttggaataattaaaagtgtgctgtcttcaagataaagtaagagaactgaaggacttcaaatcacgagatagaaaacgtcatgaaaccagtttgcacatgtaactaatccaaaatttcacttttattaaatagaatttgtgttaagaaagccaaatacctattatttcctttgtaagtatgtcattcaataaaggttttattgattaatttagagtggatttcataataaccttgatcataatcatacaaagagttaaattcccctcattatggagcaaagctaatgcatagtgtttataggcgttctagaaggtcagtcctcagactaattcaccgacagccccagatgcctggcttagctgccaacacagttgctttcgagtctgccagaaagtcagctgcagctgcagagaacattctttttttcaccctgccccttgctaagcctgtggattttacaattgccatggaaagaacagaattaaaaaatgtgattcagggtgatgatcacctcacttaccctattaatgggtttcagagtaatttattatgaacagcaaaatattaacagatagaagagtttttccacatgcgcatgttctcaagtaaactatttagtcacattttggaaaccaatctttccaaaatgtggtgagattgtcttccagtttcaaattctatcttattcattttttaaattcctggcaagataataataagaagagctaccgttttatgttgtactgttatctgcaattggaggaatgtaacttcaggttactggtacagagagagctaagatggtgtgattttgaaatctaacaggcatgacctgtgttctttctttgctgcgtgactttaaataactgatgctacctctctgagcttaaggtgtttcaccttagaaatgagaattgtgatatccagttcagaggatatggtgagggttaataagttaacatggtaaaatggctcatatcagatctaaaatctatggaaactcaataaattttggagatactgtgagcagaaacaaaattgttagatccagaatttatattagatcctcagaatcttggatgcaccacactcagtggtattttgtaaaatatacttgattagtaatataggaatttttttttattattatactttaagttttagggtacatgtgcacattgtgcaggttagttacatatgtatacatgtgccatgctggtgcgctgcatccactaactcatcatctagcattaggtatatctcctaaagctatccctcccccctccccccaccccacaacagtccccagagtgtgatgttccccttcctgtgtccatgtgatctcattgttcaattcgcacctatgagtgagaatatgtggtgtttggttttttgttcttgcgatagtttactgagaatgatgatttttaaaggtaatctaatgagaaagaatagaaaatcctgttaataattacagaacatttagaaaggatataccatagtcttccattttaaagtctaagtttgtttggtctagggtgccagagaaaggaggggcacagaagacagaaaagggaggaatctgaattgtacgttactatttataaatctatacatgagtatggagagagaagtggccataaaatcctgaacagcaattcatgttaaagctacattacttgagttttggatcccctatagctataaagacaacttgaagaacacttctgtatttgagtgtagacagcttctacttgcccacttttccttccctatctttctttcctttcctcctctgcctctgtccttcccttctttcctttcttcctccttccctcccttcccattctttcttctttaaatcagaatatactgcaaagagtctttctctttgttggaagtattaaatatattcctggaaagagtcatcttattttggtatagatgggtttgagaaactaaatgaaatcaaatatcaacatcatagccaaaaattgtgccactgaagtgggaactgttgccaaagtctacggggtgatcatattctcttgcttttctagtttcaagtataattacattttagtgaaaagcattaatttagacagcaagagaaaccctgcttatattgtcattttaagtgaggtccacagaaaacaacttttaaactgtgtcttttaaataatctaatcaaaatttaaaattgccagcctggttctttgagctgacaagctatgcatacaattgagataccaggatttgatatcttccctctcacatgacttttgaatagtgtggatttgtttgaccttctgatgtcacattagaaggacactttctcagtgagaaaataattctttttacggttcatcttttcaaggtgatagaatatgtatatagtcaagtgttttttgtaaatgaaatattcatttgtgtttctagatgtagacataaaatggactccaaattttagtatttcaaaataaatataagcctataaattaaaagtagtattttaaacaggtaaaacaatttttatgatgatttatgcagatagtctatatcaacataaactaaatatctggatataagtctaaaaacctaagatcagtatttctacaaagaaggtacactaattacacgtttaggtttttattgttaatattcatacacaattttctttacaatttgagctggaattttaaaaacaatactagtctagagatatgaaaccaataacagacaatacaaaattactttcctaaaaataaaatagattatttagcatgaaaagtatatcaagtactaaaatatgaaatggcaatatattgtattgacatatagattgaaaactataaagcatatatatatatatatatatatatatatatatacattttttgtttttttaattttttttttgagacttagtcttgctctattgcccaggctggagtgcagtgatgtgatctcagctcactgcaacctccccgtccctggttcaagcgattctcctgcaccagcctcccatgtagctgggactacaggcgtccgccaccatgcccagctaattttttttgtatttttagtagagatggggtttcaccatgttagccatgatggtctcaatctcctgaccacgtgatctgcccgcttcagcctcccaaagtcctgggattacaggcctgagccactgcgcccggccaagaatatatatttttaaatgttgtaactttagttaaacaggctatttatggaaccccatttaaaatggtgtatttatattttcatatatcctatttgaatattaaaggctggatatttcattttgcaatgtatcatttttgtactctcactaaaagaccatttaaaatagatataaagtttttttcatctgtttcttatttttgcatgaaatattttggacatcacatcttttaatctgtaagtgttatgctaaaaataaatcccaataaaatcagtttgttttcttctcctggagatttcttgtctatatctgtttttttttttcattgaaaatacagattttattattcccgtgtagtagtttggaatttgactattatgcctagaattccaaagccaatttttaataaaataaattttattataaataccacagataccttttaagagagtgctgatgaaataatacctgcatattgcagggaaagcttttttctgttcaaagttcttagaggtgtcagaaatcattgtctacctccctttatttctgcctggagccaagcggggaattaggaaacgaagagaagtgctctatacacaatggccttcagtgaatattattgatgactagacacctgctaggatgtaaaggcatttaatccatattattttcccttttaacttgtcaactcagacatggcagccagaagaattttctgtcaaacatcagcttttgcattgcattacgatttttatttttcattcttggaatttcaatacacaacacaagtggggctttaaataatatatttagctgcatgatgatgaactggaaaatatgttatctgaatatcaaaacattcagcaagtgtgatatacataggtggacattatcaacttcaagaaattgttttataataaagatgcccagtattttaaatcactttcagactttctattttcacaaatggcttcttcattgtgatatatatatatatatacacacacacacacacacacacacacacacacttattttaaaaggcacaaacaagagcaagagagttagtgctaattaataaactaaatctagatatctacgcctgagctgtttcccatgttgcatctccttattttgaactgcctcccatatttcttcaccataagatgtgtaggcacacaaaagtgtaacatgtccaaagactgaactcattagcttttccagtcagctgcctctctccaggccttctgcatctttgcaattccctagttcagttaatgccctcatagccacctcaagattaagctaaaaaaaaaaaaaaaaaaaaaaaaaaaaacacttgaggctgtccttaacccctccatctcccttacctcccatgttaacttaactcataatctttatatggccttttcttttcacctctattgccataaccttgtttgaatccttgcagtctttcatctttactactgctacattctctctttcaacagctagtccccactgcctctcaccctccacagtctccagctttatattccttaaaaaaagaaaaaaaaaaaaggtcaggttacttttcccttctatgaaaagctctctacaggaccactcttttcaatactaattaaagaacaaactatttagtttgacacagaagacattctcattctgaaaccccaagctggccacttactgctagctactccacccattctctaagggttctatttccattcaatttgtagcattttcaaaagcacacacatcttaatatcactttaagcctttacacatgccaaacattaatgggtaaatgagtgtactaatgatttcaagtgtaattccaagtaaccttgaaaacaagccatatttggtacccagagctttatgagacggtgtttctaatagtgaactttaataggtaataagattgttaatccagttctctatagacagcagtagaagaaaacaagatgaaaccaaaggaaagagattcaaattaatttttggtacgtgggtttatgttttgggctgaagagttattgtcctaaatataattagttttcatgtgattatataactctggtatttaactgaagcccaagttgtgaatttttacagggctatttatatgcatgtagttctatattttaatatattgccaataatattcctttgtaaccttatgaactatattatattaattcagcatttgaagttagtattcaaagatatgtgggcactctggtcagcagatattttaattcttaatcagacttatgaattatcaatcaaaatatggttcattaaacctaagtaatattacaaagttttaacaaatataacttttagttatattaatattcaggtaatatcacaaggatttttaaaatatagcttttattaggttaagctaatgaggtaatatacaaaattttggtttgtactttttcagagagatttgaatcactctggagattaatatttaatcatggcttattaataataatgaagagagaacaagaaacgtgcattcattgatgtttgcgtctttgatgctaaatgattacacataccccatttaaaattatttcaatatatacttcactattccagatgtacacgaaattatcctcaatgtcactaaaagcaagcttttctgtaatattttttgctccttaataaaagcagttatcttagtagaattgctgacctgataattgctagtgggtctaaactgaatgtacttcagttaatgcatcagtaagtgaagtaccttcaatgcaattaaaagattctaatctaaccaaagaaaaaatcttgctcatattgaccactttaaattcagactatgatttcatatttttaaagtggcccatggcttagctgaccccattagtgggatacaactctcctttggcatagccagttgctgctgagtaagcgtttctgaaagcctctcaatgaacttcatcagacaactaccattacccaatttcagaaaaggcaacactaaataaaaagtcatcaagacatttaacatagagaattaggaaaacaccagattgaaatgaaagctaataaataacttatcaagcaacaatagttactgcagtttaagtgaactgggttttaacttttttacttgatattaatgtttttctgcaagacattaaatttgttcaggcatttgtgactcgacttgctgaatacttagaattctttagttgtcctcttgcgattaatttagcgattgacacttttgtgtacctgcccacagaatttaatatatgggggtcatgtcttcctgaatgcagagcaattgcctcactccatctcccactactattatggggaatgcaattctcaaatgaatatagaaagaaggcatggcaatgagtacatctaaggagtagtagctttcttctaattgttaaaaatggaccttgaatttttaaattagagagcagacattgggagaaggataaaaaacttcctacccagaacacatggacacaggaaggggaacatcacactctggggactgttgtggggtggggggagcggggagggatagcattaggagatatacctaatgctaaatgacgagttaacgggtgcagcacaccagcatggcacatgtatacatatgtaactaacctgcacattgtgcacatgtaccctaaaacttaaagtataataataataaaataaaaaaaaaagaagcatactcactttaagaagttagtttgactttgggagcttgaggcgggtggatcacctgaggttgggagttcaagaccaccctgaccaacatggagaaaccccgtctctactaaaaatacaaaaattagctgggtgtggtggcgcatacctgtaatcccagctactcgagaggctgaggcaggagaatcacttgaacccgggaggcggagggtgcggtgagccgagatcgcatcattgcactccagcctgggcaacaagagcgaaactccgtctcaaaaacaaaacaaaacaaaacaaaaaagagtttggacactaactgcatttgcagtccagttcaatggaatgtgttagggagcagagaaatcctcccaggttgtggctatgagtatgtgtatgtgtagcctggcccaggctggagtgcagtggcgcgatctcggctcactgaaagttccatctcccgcagatgccctcttttaggtggtgtcttctgttagcattttccaagaaattgggagagactacacaaggaactcttccagccaaatgccattttcaatgactagtctttgttttgttgtgcaatgcaaggcaaattgcttagtataaaggatttttcttactgcttgtgaagaactaaagttcagctccaattctcttccaaaaatttatctctgacatcctgaattccttttctatagggctctgagtatacttgaacatagtcctcttcctgttagtaatatgaatgtcttgcccaccagatcatagatcttctagaagctagtttttcattttactcctattctgctgctacataatctattcaaatttgataggccttcagtcagtggagtgaactgaattaaaactagctaatctggcccgattttgttgattatgcaaccacagtagtaataactgtgattattgatgtgtgtttattaaaaactatggtgtatatagaacttccaaagcagtcagcaactcatatttgtttatgcctagcccagctgtctccccgacttttcagaccatgcagtaccttgccatctactaatgtaccacaactgttctgggatgcatctgttttcctaattggtggaactgataaggataaatgagcccagttctccccctgcaggggtgtgtatgctgtcataaacttactgaacacagccctcgtatagggggtggaaggatgagaattacccctagggaaggtcccgatttggagctgtggccacagacatggagaaaacaaaacaaaacaaaatgggaacacttgacttgctttagtagcactctcactccccatccactttttgaccaccattcagccagagccagattggatgctgctttttcatgttcaccctgcctgttttggagtgtctgggaaacaaagagagagggagagagagaggcatttgcttctcctgatgaacatttttgttagataccagatcttagtatcctttttctttggcactagcttccaaggtgcacatttttcctacttctatttccttttcctttgcagtatcttctgtgactttggccttaggccaagttctagccagtgctaatttgtgctattttatgtaactttctacttaggaaatgcttctgtgtttatagtctcattgagttccaggttttttagctgttgtattcattgttccatccatgaaacctagcagatagcaaaaaatctgttgtcatcagtaaattcaactctcaataactttagctctcctttcactttgagtaaattcttaggatcacacaatatcattatacagcttgtcttgggttcctcggctttgaaaccctcattggccacctccttttttttcttttatctttcatcctatttattgactcattgtttttagtaaaacttatgtttaattgaattagtttgatcatctggttcctattattcagcatgttagtatgctttaaacattttttcatcctatcttcaacttagcagccttttcccatatttccgtaaatgcaatctcaaaatcatgtattacctataaactgtttatttacttaaataaaagatacagctaatctctccttttactctgcctaaactgttgtaccactaacattttttatttaaaaaattattaatttagaaaatgttttttgaacatctgctgtgttctagatctaattctaggttttggggaatagatgggaacaagaggcaaagtaaagacagaacagtatccagttaaggtgccattcatggctgatctggaattccatttctgcctttgcttcctgcaaatttggagaccaattacctgttttgctgagagtttgcttatatgaaaaagaagtgggtgattgcaccacatctgaagtattttggagctttaaactttagttatctttgtgtgaaatggcagaagatttcttaaaatcatttatacttaataattcacaacaaaaattcacagagcttttaacctagattttgcttcccttcctgccctttggaacaggtttcattatagttgaccttaaacctgcataagtttcccaccagatttatcaggttaacatttaacaatatgtagttatttaaatagataagtctttaacaatagcaatcaaaattaatatattctgtaaacagtttagtagctgttttttgttcatttataatgagcaaactctctctcttgttaatggttagataatttcaggagaatatttatttttctgcttgtgtttttctgtagtatttatgttcatgtatttataaacaagtgcttgcttagctaatgcatagtataaaaactatgacctttttagttgtatgtttccaaattttagtcagaattaaaactcttaataacctgagctgcttctcactaaattgcatgagattttgtgtatacatcttaagttcttcaattgtaaatttggatttaatagaactatcaacctcaaagtgttagagtgagaattaactgaaataatttttttaacttagcaccttgcttgtcacatgataaggactccataaatattaagtattgtgattattttcttttccaacccatatcattcttccacctacaggtttttaaagcaaaaatataaaataaaactgcagtaaaagaaaaaagttatttaaaaatgaaagaaacttataactttgaagaaaattaaatatggttacagattcttaataagacaagtgatgaatatttaagtgtggaacttaattcatgaaatgttgtatatactgacaatattctactaaagaggcatttaatatttaatgatcccattatatttaataaaacatgaaagggtatggatttcaagaatataattctatccattaacaggaagatttcatgtaaatgagtgcctgtataattatccttaaagactaagcgtatttacaatatattataggtacctctaagaaccatatcagagtttcttagtattttaagtaattcaacaaaacattaactggaatgatttatatatttttttaatttgagtgcttgatccaatatatttttatataattttgctttaaagcactgttttgttgaattctaaagaggctacaataactggg

SEQ ID NO: 307 - DNA, 60001 bp, Homo sapiens
atttttagatcttaaacagtaattataggaaaaaatagcaaaggtaaaatcaaagcgaaagttaggtagccctctttggggagttaggggtcacacaaaccaaaaagtatgttaggtaatgatttcaagtgaatttctggaccattcagagggtgagatcacaaatacgtctaacggccccagactttctttttcctagtggccgaagtaccaatgggaattaagctgagcttgggatggtgattaataaaagaaggcactaaaattttggtgggattgaggaggctcgttgataacatctgatgacttgttctgggtaaagaagtaaaactaatatttgttttcaaagaatttcaatgaacagcagctagttaattcttagggatgtattagtaaatgtctaacttttataattttatatttaccagctaatagcttatatttatttcaaaattagggcttcagtgtgtccaggacataaaccagttctttttttttgaggaatgtatacttagcatggatgttttatggtagaaaggctattttatatttttacatttcttctctattttgaacataactggaaatgtatgggatgatgttaaatgatcattatagccaatattttttgagttcttgctttgtgccaggcaatgtgcttgcaatatattatattatttaatcctcataatacactgtaacattggtattatggtaaaccacattttatgaaaaatggaactaaaccgaaagaggttaaaaaataaaccagttatatatttagtaacagataaaggtaatttctgaagaaatatctgccacttgtctatcaatgtcttttcagataaataaatagaaacacagtgaaaattcagtgtttgcaagccagaactaacagtgtattttctttattgtttatagaggtacctattaaagagacttaatttaatatggaatatttattcaactataattcgtgaaaatgtgttggcattacaagatgactacttagctctgtaagtatgttttcagaagtgataattgaataaaatgcattcatattaataggcttccagaagtaataaaataaaatcttcatatctgttattcattgagagattttatatgctattattatttgagaacaatagctcagaggttggtgggctacatgtattctaacagaagttaatcgtttgagatcttaatttacctgcaaagcacgtgcatgtacacataggagcttatagctctatattctcaaagcctagactactggttgaaattataaatgtgtcctactattggtgaagatgtactaagcaaagctagcctataccagtgagttgaagggcgtgggaaagccacaggggaaaaggtcccatctgtattttattattaacagaaattcagtcattatgcaggtaagatgaagtaggttgacagtgatatagatcagtcactgctataggtctgtgagcacaagttagtttcacaaatgactttcatattactggtttggtgaggagagtaagcatattgtcatggtggtctaggaaggaggcaagaggcaaaatggggtggtagtatttctgtcttccctgtgccctaagttttgtgtgtaggatggtctctagatatagggagggactctgtagccaataacggtatagggattatacctacaacttctggtaaacatcaggttcaaatcaattagaccaagcaagaaatacaaaatatacaaagtatgattattctgtctcaatagtactcttctgggagggcagaaattttagtgctaagggatgtgattagaaggacataaaatgtaatgcatgagtaggtggacaatggtaaggactagctgggatcaagaatggttaggcaatctgtatgaatgagtgggaaggcaaaagtgtgctcaatcaggcagcacatttgttaaccagacatttccttggctctcctaaattggactgaagtagcctactttttatagcatcccagggacagttctcttcagagaagctctagggagttagactgcacttccacagaactccagcttgttgctaccggcttgagattgggatgggtgaggagagggggtgagtagagtatgtaaatgaatgcctagaactgtctctcagcggacctccacccttgcacattcctcttcagcttatcagaaggtcaggccaggctgggttgaaactggaggacggagtaacagagatttggcgcttgcgttttctggaaacttatgaccaatttgggtttctttaccctgaccgcaaatctggagtagggaccacaaggcatcacttacctggatttattattggtcttcactgtattcttttgaacttattttgttttgaagtacagtgtacacccctgctcagctgtgaaaacaaatcaaaccaaccaaacacctttattcttttcctgaacatgtatgtaacagccaggaggagtagaagaaacacactaaagcaaaagaaaacaaattgtagaaggagagaaatgaactattccctttccctttcttttatagagaaagaactttattttaaagtctattagattagatactctgaaatcattttttatccataaggcaattgcagtaaaagacaggaaaaataaattgacaacagctgtggagagtgtgtacacccatgtgtgtttaagggagatgaaggatggcagtaatttgtttctaactttcaaaaaatactggctttaggagctctttttggtgcctaagagcctctcagtaaatatttctctgaatcttaaatacatctgtcatccacaaaaacaattttttaaaacaaacctgatgtcattgaaaggatatttaaaaatacccatctttttatgaaacacatattcttggaggcagagaaaatgaaggtggtaatgcaaaataaactgtttttctttgactttttcttcaagaatatcactggaaaaactttttgtaactgcgtgttggttgggccttgaagactgccttcagctgtcaaaagaacttttcgcaaaatgggtggatcatccagaaaatgagtaagagtaatatcataattcctcttgtttttgtcctattttagcaccagcaatttccctttttgatgtactcactgtgggaatgagtgttttgctttcacttggttaggcgctctctcctactattcttttcaaataccttttttaaaaaaccagtgtttaatgtgggtctgtgtataacgatagactagaatttatacaatgaattgtcacctaggacctctcattgccaaagcactcttccaataagcacttactttgagctgtctatgcttgttttgagtcttaataggttgttctttatgattgtttatgattgttatatctatgagtgcagcagagcacctctctctccatctctctcttagtttgttgcctcactgagctctgaaactctcattttggttttattacctttgatatagcacctcggatggactcttaggaaacatgataatcagatacaagaccaacttgtattatcaatatactctatactattctaatttacttctttcttaaagccccttagtttggaatttgatgatctcttctcatggaactaatgctaatgacagttctgataattgcctctctagattcctacttttgacctttatatctgtgactataaatattttttctagattcatacttctaaaatatgataacctgggtaaacataactactatgaaaaatatcattttatgttatattttacagaataccttatccaattaaagatgtggttttatgttatggcattgccttgggaagtgataaagagtgggacatcttgttaaatacttacactaatacaacaaacaaagaagaaaagattcaacttgcttatgcaatgagctgcagcaaagacccatggatacttaacaggtgattatggtcaacttaccttgaaagtttctgttataggaattaaattaataaaggaaaaaaaatagaaatgtgctaatgtaagtattaaaacgttgcgtatttgtgcttcactaccttagaaccatgggattttgattttgtttatttaaattaactctttatgttggatgtttaaaatgtattttttgaaaatgcacttttgcagatatatggagtatgccatcagcacatctccattcacttctaatgaaacaaatataattgaggttgtggcttcatctgaagttggccggtatgtcgcaaaagacttcttagtcaacaactggcaagctgtgagtaaaaggtaagaaggaaagtgagacctttctttcatttaggccactggtttggcactggaagctcagctttagtctagcttggaagctcagctttagtctagctaggccacaaacgtcctttgcattgactagaaaagttatcatttttcctttgtttagtctcactacaaactgcctgtgttatggaagagcaatacatgaacttttaactatggcttgaatatttttatcttttagttgacaacatgccatactcataaaacagttgcctattctacttctggtgaatttgccttagttcacttttcttgcaattctgctacaaaatgtttcagactcaaattaatttgctttctacatcttatgcatttatttttagggcttagtttatattcagcagttttgttcaattttgctaatagttttgtttgaatagactgttacattatttatggattgtaagaaggaaataaaagttcaacttaataactaaaattttatttatagtcaaaatgacacaggaatatttacttagttctttatacatctgaatatttaattatcactaattaaacagacatatttgacatgataatatgtatgtcactagtcctcatgtaatgatgaaggtagtataaaattataagtaaaaaatccttatgccaaattaaattttatattaatggtgtggaaagtatttatactgaatttgctaaaatgtgactgatcactaacaagttagcacttagtttttctgacgcacattccactgcatgctacttacgaagatggggatgataagccttctgggacagatggagacaatagctcagtcagttctgaaattgttttaaccctcacttttgcagactcacagtgcattttagccttataaagtctacaagaagccctgcagaaggaaacctagagttttccatacagtttgactacatagcgtcttctaggtatagttcttccaaactccagcttgggatatgctgatgtaaacaaaacgtcattttgccagtagaccagttgttccagaagaaagactgatgggagaaacaaaattttccaaccctctcatttggttctggaactgtaaaaaaaaacccattagttaacatttaggccttgttttcttctctatagagtaatagatgtatttgataaattctaagattctttctagtaataaaaagttttagtccttctacatcaaggtgcagttcaaattgttattggagatgtaaaaggattaggacttggtatctgataaatgctgtagaggagagatggcaagggcttttggggatttaaggggaagaaagggatgtgcatgtgatttgaacaagcacagttgcaaatctcctccttctacctggaggacagaacaccaggaaatgcctggaggcagagttgggaggccaacttgggactagtcacagtaactggcaagagcttagagcactggagaggagttaggagtgggaaggtaagttgaggctcagagagaaggacaggggttaacaggccttgaatatcatgtgaagcagttttattttgtgtgctcttcattggtgatgtcttgtttctaactggtgtcgtatgtgaagcacacacaggctgtcctgattatgacaatgtgttaacactattggaggtcaattctagaatcggggcatggggatagacttaactagagcagtgtagcaaagtggaggtttcttcctctaagaactatggaaagtgtctcttcattactgtcctttgtccttttatttattgtgtttagtttttcatgtatccactagatatatggtatgtcaaagagttaaggcaatagaatctagaatcagatcaatcttaggatgaggagagtgctaaatatgtaaccttaaacaagatttttaacctaagcttcagctttctcattcataaagtgaggataataatgaataggctttaagataatttaataatgtgctatttaaagtgattggtacataataaatgtttaatgttcattattattatcttactgagataatatgatgtatctgctttattacaagtccctatatcattcactttatttctttttctcaatattgtcagtttctatttttatgaaatttataacatccctcagcagtattagagtctcatgtttagaatgaaacacacattaatgttgttctttaaaataacatgtttagtctaggcatggtggctcgtgcctgtaatcccagcactttgggaggccaaggcaggacgatcactttagcccaggagtttgagaccagcctgggcaatatagaaagactctatttctaccaaaaatttaaaaattaaaataacgtgtttatatatgcaataattacagttttcacagccacccataaaataattgccaattaataaccaagactcagaagttaaattacttaaagtcaatacctagtaaacaaaagaacttgaattaaacccgtatcccctggctctgattcccggttctctatttactttctcctaagtaagaaaatgcatacttcttaattatttattttatgagagtactactgaaaatatttaatcttttaatgtgttcttaactaatgcctcatctacatttccggtggctcacgcctgtaataatcccagcactttgggaggctgaggcaggcagatcacctgaggtcgggagttcgtgaccagcctgaccaacgtggagaaaccccgtcactactaaaaatacaaaagtagccaggcatggtggcacatgcctgtaatcccagctactcaggaagctgaggcaggagaatcgcttgaacccgggaggtgcaggttgcagtgagccgagatcacaccattgccctccagcctgggtaggcaacaagaacaaaactccatctccaaaaaagaaagatatgctatatcttttaaacattttgagatgccaagatttgttcaaatattttaaatttgttttacttagaaagctcatcttatgacgtgatttatttatctcaattccagaaaatgtttaaataaatgaagtgacttttcagttgatttttaagaaattaataaacttaattttttagggtagttttaagttcacagcaaaattaagcagacagagttcccatatatccctctccccacagagacacaacctccccctctatcaacatcctgcatcagagccacacatttacagtcacgagttgattaacaacaggaatacattctgagaaatgcatcctttggtgatttagtcattgtgtgaacagcatagactgtacttacacaaacctagatggtagagcctactacacacctgggctctatggtatagtctattgctcctaggttacaaacctgtacagcatgctactgaatactggaagcagtagtaacacagcgacaagtatttgtgtatttaaacatatctaaacatagaaaagataatgtgctaaaaggcattgtgctacaatgttacaatgactatgacattgctaggggataggaattttgtagctcctttttaatcttgtaggacctccctcatacatattgtccattgttgactgaaacattgttatgtggctcatagctgtactataattgatgaatataaacaggcacatcattatcacccaaagtccccagtttacaacagggttcactcttggtgttgcacattctacgggtgttgatgtattaatgtataatgatgcatattcaccattgtagcatcatacagaatactttcatccttccctctgcccatagtcagttgcttttttatgaaaatgtttgaataatctacttcttattccagaagatttcattttatttttgtttttgctttttaatgtgtagagtttttggttgctagtttggtcttggctgtgggagccagaatcatcatcatgagtacgagcagaggggctttgcgcccctcccataaggtggtatcttgctgggatcttgtgctccatttctacagggtgagagacagactggcagaggcagcttgcctaaatgcaaaaacaaacaaataccatctcaggtccagcttggccctgggcatgaagtgaccagtgctgtggttttgagtacatctctcccttgtctcagagcattcatgggcatatgtctcacagtgacatgcaggcaagctcacagacatcgtctccacaccaaggcacatgttggagttgagtacatcgccaatagcagtgcaggaaccgctgctcctttcagccaggcccagaattcttcctagaaagcctaatctggaaatacattttggaatatttgattaaataaaacaacttttggcttggtcttggtcttgcccctcactctcatgtacagggcattatactggttggtgtgggaaaatttagttaattattgggccaaagatgatctcttgaatactcattccaatgagaaagactccattggtcataaagctactttcaagttacagaaaagtcagtaggtacacatagctatgaataggtcctatgaaagcatgtgaatagtgatgaagcaatagtatttttgtgactttccactggatgtggtagaagcattatttgttccgttatcatctctgttaaatgggcttcacagcatacagaaaaaccacttttatttgaatatagaatacagagcatgatcagttttaaactcaacctgtccaaaatgaatcttaccctcttcactaagcacttgattttttttctccacatgttattatatagcctaaagtcttaagcttaaaaacttggaattgttttcacttctacttggttgtatttcatgatggggaacacagccaaaaaggctaaacaggagcacaagcaaagtgagaagttatcagagtggagggtccaagcactggggggcctgttcccatggcatggatcaggctggatgccttggtgttcccatgctggcctcgtgggcatccttgccagaaggaatctgacatggcagaggacatgaagggaggggtaatgtgagaagaaggagaggcagaaaggtgagccagactggagtacccaaatcactgttcccacactaacgttagatgttatcaactttttagaaaggattactatattgagtcgtattggcttttgacttcatattaattagaatgtatttgaacaccggtgggggtaaactattcgtaatgcaattttgttgagtaatatttgaaagagattgctctctcaacaagaatgataaatcatctctgtttcaaaaataacccctgttgaagttgacaagagcaggaagggatgaagtttgccaggtaatctaataggtgcttccatatacattttctcatttatgcaccagaacaatgcttctaagtatctgttattctccatttttacaatttataaattgcccaaggtaatgtcaaatccagccctgcctcctcgggtaaactttctcctgtgtctggcagaaattcacacatttagcaccataggtaggtttcctctgttttccatttttatttttaaggttggaatttgggttctttggaactcaaatttcttgagtcattttatagatttttgctgcctagctggccagttaaaatagagaactaagaaatgtttcttctttcttcatagaaacagtttcgcttgcctcaattatatgcagagttatattgtccttcacgttgctcaggtagacccagtgtaagttacagctagaaagttagaaaaacagcagcactattttccctcacctttattagtatattatgccagagttaactcttatcatttttaatttcaagtacatatttttgaagtaaatcaattgtatatattaactattcaactgtctcttggtcagtccattataataaccctattttaatttttctttcctttttaatgcacccaaagtcttttatttacttttttaactacagccacactttgagcaggtaagtgtctgctgttttttcatagcaatacttcacagctattttaagatttttttttttctagatattcagggacactaaactagaggggaagtttccatgaccacgcctattgaaacaagcacagggagagccatggtgctcagccttcagggtcaccaacatttagagaacatcagaagatattaatcttctctccaaaaagcacgcataaatacaacatttttaaatacacgttcagggggctttagtcagcagttctgaaatggatcctctatgaactactgttttttaaggggcataatttatatatttatttattcccttagaaattgtattgatttgagacttgtgacatgtattccaactacctcattttaaaagacaattgtttttaagaagagctttttagatttagataatagatttgtgtaacacatataagtatttaacttccttagtgttaataggattctctattaaaagatgaagctaaactagttcatacatgtttttacttagatttgtgacataggaattaataggggccatacacttgaccttcatctgctatataaaatatagctttattttgcaaaatgctttccacccttgattaacatcttattgccttgtaggtatggaacacaatcattgattaatctaatatatacaatagggagaaccgtaactacagatttacagattgtggaggtaagtactttaaatattatgaaatacaatgataatttggaaaccactttttatgcaatttggacttgctaaaattaaaaataatatgcttatctgaattattacattctatgcttctattggtgctgtatcactgtgaaagaagtgtttttaattgtatcctcctctgaaatagagatcacctgttcatggagggtggcacttcatcctctctcacctgaatgcaggggactctggcccagggttcccgtcccagaccgggcttccctccatcccacctttgccatcactgccagtcattgccctgttccagagcttcagtagcttttcatagcttttcaaagcaattttgaaatattgtgattagcacatgaggcccttaatgatctggcccctgccttagtttggcttcatttttgctcacctcaccactaagtgtcagagagcaagagagacggacagacacccctaaacacatttcctctagttatactgtaccacttacaaattttcttgaattattgcattgcttcacattttctggatttcagaaacactctaccttctgtctggagaacactcctcattcctgttcctggctggataattcctaatcatcctttaagatcctgctcctattacctattctaggaactttttaatgaactgatttataccccctcctcgcctatgctttcaggtcatcctgtgaatatatttttaccacagtgcttcctacattatagtgtaatcactggtaaatatgtctaccccatgaggctataatgagctccctgaggactgagataatatcttagttttgtctattctaggttcctaccatttcctggcttttctttcctctaggctgaatttttattaggcagtctttttccttgtggagagaagcatagctccccacttatataatcctcagcactctcagttgcagaaggaaggatactttctcacagcttcaagagttcctgccccgaaaaaaagcactttgattggtcctacttgggtcagatgtaccaatcactgtgtccagggaagatggaatactctaattggtctaaccagggtcctgtggccacactaggagacagccccacccaagtcactggcactgggaaggggaaggggtagttctggaaggaaaaagggctgtaaccagaaagtaaacaaagcaggcaaaagcaaatgtctacaaaaagatacattcacacaaagtaaaacaagaatacaatataaatacaacctctacacacccagtagcataggtaaaattagaaagatttatggtaccaaatggtggcaaagatagggagcaactggaactcttttatcctactgggaggaatgtaacatggcacaagcacatcagaaaacaggcagttttttgaaatgttaactggaaaccatctaaatgcccacccataggtaaaagaataaggaaaagtaatatatccacataatggaatactatactgaaatttttaaaatttgtgtagcaacatggatgaatatcaaggtgattatgtttagtaaaagaaagcagtcacattctgggtaatgcaaatggatctatagtgacaaagggcagatcagtggtttcctgggacagagagagatggactgcaaggacccttttttgggtagaagaaatgtacttgatcgtgtatatggtttcaaaggggtacacagtggtcaaaattcattgacttttacagtttaagtagatctagtttattgtacataaattaaatcccgataaaattgattaaaattaaacaccagggcctgaaactatgttaataagaacaagaagagcctttgtaaataaaggtaaatcaactctccctaggcaaataaacaaatacatatgtgggtcataaaggcctgaaatatgatcctaagcaaaaaaaaaggacaagtagacagtgatatcattgttatcatgagagaaggagaactgctaattcccgaagaaattctctttttttgagttttggcctgcctaaggctgagctgtcaggatctgatttatcaggtattccctggacaagggaaagaaaagcacattacacccagaacatgctggtacaaaagctccgcgaatcaagactcagtgtgtgtttctgtcttctaaaattcgttagttcaatctttgcctctactgaatccagtgaagttttgttgttaatgaatgaataaatgaggttcgtataaatttagcaatctttgaagtttcaaaactctagtcactcacagcttttcgaaattgtaaaaatggatttagcagtaaattattgcaatttaaaaaaatatatgaattagctaagatgactatccttgtcaacaacatcttaaggtccagcggtcctgctatgctgcatcagttcacaggatagtatctaaaataaataataaaaaagaaagtgaaaatgaagtcatttgtctccctcgtccctctccaaaggcacaattttcaaacaccttctgcatctctggctctggtttttatattccccctcctagacatactctcaagcacacgtgaagcccacctacaatcccaaacaccaccaccactcccctcccaccactacaggagcccaatcctgggcacactatccgtgatgtggagttgtgggctgttggttaccacctcccggcaggtgtgagaagggaaggaaagagtgggggaggattgttcctggctctttaacttacttgtccctaaaacatttcttttacattgtaattaggcttgatagcactattactgtgcaatttcgagtatattagggttgaagtgagctgttgtgagctggaatgggcattttcatcttatggctataagcgttcggagttctaatccactgatacaaaaagagactcggtaaaatgaaaattgaaaaaacttataacttatttatattttggaatataacttattattcacttggagtctgacttatacataatattgcaacaaatgttctgataactgaatgcttggcctgacccaatgaggtaattcagccaatgtacaaattcattatctaagtattctaaaataaagaatgacatttgtaaaactgcaaatattatgtaccaattttgagcttcggaagttgcagtttcttttgagatttttaaaaaattgggggggttcactgtatctctgtctgcaaatcttagagaacactctatatgcgttcagtaaatattcattgagactcaatatgtgctttgggaataaggcatagtttctgcttcatgcaccttcctgtctacatctgcttctttggggtaggtgtggtgttcatcacattgtctcagtcacagtctccccagggacacacaacctaggagtatacatttctactcattccaaccatcatcaccaatttacaaactcatgttgctacttagcatttagacatttactttgtccaaatgggaagttggattgcactgatcatctgtctctctgtccttccagctgcagcagtttttcagtaacatgttggaggaacaccagaggatcagagttcatgccaacttacagacaataaagaatgaaaatctgaaaaacaagaagctaagtgccaggatagctgcgtggctaaggagaaacacatagcttgtggctatctttcagcactcctcttgcatattataatgtagtttgttcacagttttgtcttccaatactttgtgagtctggaaaaccacacattttatttgtatttcagtcacatttattactcagagtgccattcttctcatattgtcatgtttggccctgagggtgggtgattgctgacaattttgccaatgctgctgtatttctgggaaagatgtcacttcatgttgggttataatcccacagaatttactttaaatgtcacgtaaaaacaaattcacctaagatagtcttgcttattttgttgcgaaggccagtggaatataaaaatcaatggcattaatgaggagcacattctttgctgagggaaataacagtttttccaggccctagggtttatttagttcaacattgaagattgaaaagactaatgagaagataacatgacaatataaaaagacagaaactcaaaaagtatattcactagaagacagtggagccaaagaaaagcaagttgaaaaagaaagaggagacaatttaacgagccctaaaggcaagaagtgtgtcttctcctgcccatttctctctcccacagtacatcctgcattgaaccacgtgttgctggttactaaactttatggtgtcacaaaaagacaaatgattgtaggatccatggaagtgcacttaggcttgctgtggtggaggccatagtggagatgaaggctctgctctgaagctcttaattgtgtattcaccagtgggatggacaccctttcagcctaagcgtacgagtgaaaacaatgatgtcaaaagacaatagcaagtataggctactatttagggcaaaaggaatcttgaaatgaaagaaacagaactaaaaggctaactggagcataatccttacagttttgcactcaggggattaagtttgaaacatagtgtcttttggccaaattgaacctacttgtaatgtggaccaacttactttacacattttcatcagtcccaatgtatggaattagcttagttttctcatgcttgattaaaacaagacaactaaagctaatcattcctcttctagactttgtgtatatgatttaatcttttatttttatttttgtagaatgggggtaaaactacaaatctcctcctcagggtgatatttttaaagattaaggagtatgacatcaattaacagtctttaaagatgttacatacgctcaaagcaatgtgattaagactttttgcctatttcttgtataagttaaggcagccataaatgaaaatacaaaacaaacgtttgcttttgtatttgattcacaagaggattctccctgagtgtcaggggaggctgtgggacttcaccacgtggacaaacgaaagcacaggctactcagacttggccacaggtcataggtcagagaattttttcttcaaatgtagaaatgtaaattttcagcaataaaatatctgcatgcctacaaagtgttgtagctgagataccttcctgttttttttcttaaacactcattctatatttcccatatttcctctgataatgaatctcatctttcaataactttgtcttcacttgtcctctcaactgcttttctcttcctcttcttcttctgtgtcttagtccattttgtgctgctgtcatagaataccttagactgggtaatttatgaagaacagagatgagtttcttaccattctgaaggctggagattccaaggtcgaggggcctgcatctcactagggccttcctgctgtatcatcccatggtacaaggcaagagggcaagagaaagaagagggaagaggactgaactcatcttttttatcaggaaccctctcccaagacaactagccaactcccatgataacagcactaatctattcatgaaggcagaaccttcatgacctaatcacctcttaaaagtcccacctctcaacattgcattgaggattaagtttccaacacatgaccttggagggacacattcaagccatacatagctctctcctctgtttccactcccgttctttctctatcaagctgcctcttcccttctccccttttctcctttctcctctttccagtaatctctgccttacttctgcctggttgttcttatccttgctccttgatcttcctacccaaccatgctctcagtccaccaagcgtgctttgaggctgacactcagtgtcaagaaggctctgatgcctggtattgggtgatgccaagaactactgatcttgccaaaagagcatgtaggctggtctctccagactgttaaaagttaaactgaatcctattacatcttagcttctgtagtaattaaatagtgctgaaggcgtttctccaaaatcaaattcccaaatatttaattaatagtctttcctctaaatatggggaaaaaatggatgatataccatttttacttacttggatgaagctggctacttaagcactgcattttattatgctttaccttatacaaactataaaaacaagtaattgttgattggtttctgtgatagcaataatgcagtaacaagtcagggagtggtaccgaggctgattttctgtgtggcataaatactttattaaccaataaaaacagcttatctgttagcaccccaactataaaatgatttccctgacccagtccatttattgtatacctttcatcttgaaaataattaacaaaatatacaatatagtcatgattttttccaatttcataattcgaaattaaattttttctcacaatcttatgctttttttttttgcccaaccccattcagtgacttgccattgttgattttaaatggaagaacagatgtcttagtgtgatgttcagcattttttgtaatttagatccctgggaccaatctgtatagcaatttattctggggaaggcatgaagaagcaaagtgagatgagatttaaaaggtagctcgtcttagttacttttcctgtttaatccattctttgctccaataaaagctgtctttttctcatccaaactctagcaggattaccatgttcaaagcaaagccttaggggatgcttacaagtaaatataactgcctcccccacacaaagaatgatttagcacagttagcagcatttgaaaccatacatatgttgcctttggctcattcttctaattcaacaagatttagcaaaggtaatctgtacaacacatatatttaggagttatttggactcttcctcttcccttcccttcataaataagtcagtcctagaggtgaaatagagcaaggtggcatctgaaccagtgggaattgagggggagccatggtggcccatgacctgaagtgggcttaagagtttgaatggggtgaagaaagaatccacacagaggaggggagatcacagtgggatatcagaacccagacagggtgaataaggttaccacacggtggcgaagggagttatgacacggtgacttagagcccagatagggtgagaagagtatctaatgggggttgtgtaacccagaatgggtagttgaagtctttgtggggtaaagaggatgcccatatgttggaaggtggcctagtatgaggtatcagagcctggggagggtaagaagggaatccatatggggaaggacagaggcagatataggaggtgggttaccacagggttatgggtcaaacaagaaaatatatccataataggatccaggcttctcactgttggagaagggagttacagatactcgaagggaacaagaatgaactgttctggtatggaattggaagtatttgtatggactcatggttttcaatatatagatagatttataagtatctgtaaagtatgtaataaatagctgtaatatgtgtagatatattttgctctttatctgtatatacatagatacagatatatttttttgccattacttttagtggcaaaaaccagaattacttttgcaccaacctaatatagctatatctacatcatctctatctctatttatatagagatagagaaagagtaaaagtaatggcaaaacctgcaattacttttgcaccaacctaatggatttagactctagcttccctcctgagagacagtagcagcagtaacacctagttatggactgaatgtatcccccaacaattcatatgttgaagctctaacccccaaggtaatagtatttggaggtgaggactttgggaggtatttaggtttagatgaggtcttaaggttggagcccacatgatgtgataagtgcccttacaagaagaggaagagacaccagagcattctctcaccctccgtgtgcatgcaccaaaaatggcatgtgaacacagagagaggaggcggctgcctacaagccaggaggagtgctctcaccaggaaccgaagctgtcggcaccttgatactggaccttccagcctccagaactgtgagaaataaatgtctactgcttaaaccacccagtctatggtatattgttatggcagctcaaactaagacaaccctaataatgagcacagctattgcccatatcttggcttctagatgccattctccactaaagaacccaaagttccttgaagaaatggctgatttcagggccaggacaggaagggaaaggggcaattaaaagtggaacatcttttgaagcaaaaagcaaggaagtactaaaaaaataattgggacataccaaatgggcacaaaagccagcttgaagagaaccccactggccaaatgtgggaaaatttgagaatcataataataaaggcaataagggaataaaataagaaatcatgagctaaataacaattaaaattttgatgaggaagggtatttacataatttcaaagtactttcccacaaagtacagttgaataatgaaggcaaaatgagtaatttacagtggaaaagcctggcagatgtcaccttcatcaagtgatgaattccaatgatattccattgcagtggaataaatagaaattttattccatttaataagatgaaatgacaaactacattgttactcttgttatacttctaacaaaactgcataacatgaatctaataatgaagaaaaaacaaactgagggacatgtcacaaaaataatatccaagtctcaaggtcatgaaagtcaaggaaagacagaggatctgttctagactgaaggagcttagagacatgacaactgaatgtagtgtgtggtcctgaactggttcctttcgccataaaagactaacattactgggacaattggcaaaacttgggtggagtctgaagattagatgctatcattgttaatttctcaactttgatggcttgttgtatttatgtagaaaatattttggttgtaagaaatatacatgaaggagtgaagcagtaacctattgattcaggaaaaaaaatatttttatagtaactccagcttttctgtaagtttctgaataaattaaacttaagataaataaagtttatcatctatttgttactggaactgcaatgcactttcatttcaagtcacttttttctttcaaatttggtaatggccacagccacaatcctgaagttatctactaagcattttaataattatgcccaagttggaaattcaagttgtccgaaaagacttaatttcttgtttcagtcaacgcttcccatcttcaaccagaggaactaaaaactaaaaattttaaaatgtgttactctaaattaacaaagctatataaatgaaaaataaatgtaagtcattacacttttaaataaaacttgtttgaaacttttatataaaagtctgtagtgtttatacttctaaaaatattaaatcttacaatttcactaagccttttgggaagacttttacatatacatgggtgaatcatgtaacttgaaattattatgctaacaacttgacttagtccatgttacagttatagctaataatattttaccattttgtataatcagtacacgtctagatgtatagtaaagtagtcttcccttagctgcagtttcattttccacagtttcagttactcggggtcaactatagttcaaaaatattacatcactaccctgtgttttggggccactattaagtacaataagggtcacttgaacacaagcactgcaatactgcaacagttgctctaatcgccaaggtgactacgtggtgactcattgccatccagtgggccgaagcaggagggcaagagatttcatcgcaccactcagaacagtgcacagtttgaaacttaagagttgtttatttctggaattttccatctacgtcacaatacctgtgttattgccctcacttcatcccatcacgtagccatttgaccattttacatcatcataagaagcgtgagtacagtacaataagatattttgaaagagaaagataccatatttgcatatttttaattacaatgtattgttataattgttctattttattgttagttactgttgttaatttcttactgtgcctaatttataaattaactttatcttaagtacatatgtacaggaaaaaccgtagtgtatatagagtaggatactatccatggtttcaggcatccactggggaccttggaaggtagcatataattcctgatacatagctgtgtattctgagttttttgttgtggtggtttttgtttttgtttttttgaaacagggtgtcagtctgtcaatgcaggctggagtgcagtgctgccatctccgctcgccgcagcctcgacttcctgggctcaggtgattctcccacctcagcctcctgagtagctgggactacaggtgtgcaccaccatgcctggacaattttttgtatttttagttgagatggggtttcaccatgttgcctgggctggtcttgagctcctgggctcaagtgatccacctgcctcagcctgccaaagtgctgggattccaggtgtgagcccccacacccggcctatagctatgtattcttaattgttacactctagtagaagtgaaataacaactctctgctaggtacatattaccacctccttttactacaggaaatccccgacttaccgtggtttgagttactattttcatactttccagtggtgcaaaagtgatacaaattcaatagtaaccatactttgagtacctacagagctattctatttttttcacttttagtgtagtattccattaattacatgagattttcaacattttattataaaataggctttgtgttagatgatgttgcccaactggaggctaatgtaagtgttctcagaacatttgaggtagactatgctaagctatgatgtttggtgcattaaatgcattttcaacttactataggcttatggggacataacttcatcataaattaagatcacctgtaattttttcactgaagaaaatctaactagatgaataaaattatcttgatttgggtggtacaacatgacttcaaaattctaaatggaatttagaggcacagaatgaaaaaatgaaaaatacaggtagatattatctactctattttaaaaatgtagatccttggatcaagattttcaaaataataagttgcaggctttttagtacaaactctttctacccaagctatattcttaaaagtatattataacttattttgtttgctaaaaagtttgtttcgtgaaaaaaaggctgtgtgtgtatttaaaatagagtatatgtttgtgggaatagtgtgtatgtgaacacttgcctgtcctcagctgaactgcgctttaattattttgattgccatggaaaagaaatagcacgatataaaggcttcctcactttctttgctttctctcacaaacaatgccaagcaatgagatgaggctgtcaccttctctgctctcaggtttctactgaaagtggactattttgatgacgtgatgagtcctagactctcaggattcacagatacacatcagaggattaaaggggctctaagcatggggtttgtgagagttttgggttttctatcctctgtgaaatgatcaccttgtctttgaaaatagttctttagtgttagcatgtcttacttgagatcaacaaaggcggttagtcccatcatttcctttgggtagggacaatccttagtgatgccagggctctcagggttcatttaggagattgtcctgagaatgccccgtaacagagaatacctatggtttcttccagaaagtgttcctttgacttgtcaatagtgagcaggaggcctttctgatcacttagcactagagggtggcctcagtatttatgaactcctgtgagagggcggcaggatgaaagtactagtagtagcactagaaatgaagtattatttatttcttcacaaggttgatgttttccttcacttcccccaacacatacccccatttttagagaaatgttacctccttttataaataagttcagagagaagttttgacctgctcaactagaagtagtacaacgaagtagggaagagatgtgatcagcaggaaaattcttctacctgctgagtgtcttctgtgggtgatataccatttgagctatgtgctatatatgccttgtctcagcctcaaaatacccctatgaggcagtgtgtccagtaggcttcagttagaaaaacagaaaccagactaattttgtttgtttgttttagcaaagagatttcaatgttaaggatttgttaaacaagtattagagaagtgaaaaaacaaaagaagaaccccaagttatagctcaggaactagttctcagtctcaaaacgggggaataatgggcaaaggttaaagttactagaatgtagaagtttggatgaaggagtataagattttcattttgtttgatttcacccagatgtccttattccaaatctcaggatctctctccttcccaatcaatgttctaatgcttgcacttgagccttggcaaggctctgaattcaacttgcattgtaatgatatatcccgcagagcagctagaaaacttaagagactcttttacagctgccttagaagttttctggttctctgaccatgtctcaagctggtcattttcatctcctaagcactccagtgcacacaaaatagctatctcaccatattatcctcacaatggttaaacaaagcagccacttggtccgcgaggacacttgcttcagtaggtacttcatttgtcatcaaccacagtgattgctcattaatcgtgggggtactgggagtcagcactgtattcaaggccaaagccatgatcaagcctaagctcagaatcttatcttgagaatctatttcctagaattctctatagttggtcaggaaatcagaaaccaaatcggcttttttgactgcgaactgattacaaggaatgggtattggagaaccaaaatgacaaaagagtaaggctgagaaaacatcgaggcaggaactacaagaaacagctagcacttctagggtaggggtaacaagggaggaggtggatttattagaacctagaagctggtgtggctgcttcagaatctcagagatagggctcagcccagccaggatccagacctcaaggagagggtcaacttgactggggctgctgcctcaaaaactcagaggaaagccccttggagctggactcagacctctgaggaggaggctctggccagctgccgctggtatctctgtggggaacatactaagctggtctgggagactgagggaagaatcctgagaactggaattcaacagccactgccggaaggaaaaaccattgctggggtgataccgacggaaactggaagcaaacaggaaggagcaagcaagcaccttctttctcttccaaccttccacgtccctcaacacccctgttggcagagctggcaaagccaaaatgtggtttacatagtccgagtcctaacatcacaaagcagagcattaaaaggtggttttggaattgagagacaatggcttactcaccaactcaggtcagtataattgttctaacctcaacacgtggggaaataggggcttaaggtgctagcagaagcagaagctagaatttgagacccatgctctctactgctaaaccccattcacctttgggttttccttttatttattaatttaggacatggttaagataccattacactctgagaagcctctctgaaagcttctaaaacacatacatcttccgtagaccagaaataatacagtgtcaagtgggaagctcctggaaataacaggcagtgcttcgtatagaaatggatgtccaaacaaggaaaatttccaagataattataagaatagttaaatttggactcgttctgacaagaaactttaggtaaatgcatttaaatagattgttgcatctactttgcaaacattatttagacatgtttttaggggcttatagaagctctaaaatgactagcttcatgcggtcaagtcactgtttgggtttctacttgcattgaaaaattatagaatgtgcaggaattacaacctaaggatattttattgatataaataaacttcatttgcaaaaatataacctagaaatatgcttacatgtctcctgaaacctcacattagctgaaatgctgtttcctgtagtttccataaaccattgtaactataaaacagatttaagtgaatccaatgtttaaaataccagaaatttaatatatcataaattccagtttcagatgtcaaatttgtgaaaacatcagtactaaatttattgatgcattttgaatattctttttgatgttttcctttaaaggcaattaaagatttttttttttgctttttatatgtttttccatttttaatttgcaactctcctcctctgagcagcccttttctcagcagtaaaatgaaaccactgcattaggggttttctctagggacctcttggaagtattttatggtttccataattgttgattaagtatagccagttcttgactatgtcaggtacaaggggtggagctactctgggacaaagagaaggcccagcatggctcttgcctcccatcccatcccctgctttaaataggagagattcacttttttggtttcatacattgaagtttatttagaaaaaaatggtaataacaatgtttgaaacacatggactatatggtctccaaagccctctccagatgtgacaccgcattgacacacagcttgtccacttttcgagaatgttctgcatagtccatcttgccctgaagcctctgcaggtcccacacatcctgcatatcacagaggccccttccttacctctgaaatgactcacctttgactataacagagataaacaaatcatacctagtggagacgaagattctggaagcagtgtccattttggctcattcctggtcactaagatacatgcccttcacatggcattcttcaagtaacaagagtttttttgtttgtttgtttgtttttaactgttttaattctggattaggggttttgtgccatctgctggacatagttatttcacacatacaagagagttctacattattcttagaagtatttttaaaatattaataactttaaaaattgtgaaatacatgcttattacaggaaatgggtaaatataggaaatgataaagtataaaaaatccagagatacctatgattactatctaactgttttcttacctgcacacaagaatgtactttgtttggttttagttggtggtttttattttaacaccaatttgagataaacactgcattgatgtaggttatacaatagcaggaagaggggatgcattgcaaatgtaaggttcatggagagaaaatgctctcagtcactgctgtgtttgtgaaccttaaggtttgcattgcctatcatgcacagcaggaatattatgctccaatttaacagggcaaggtaggaggagaggtagggatggcggagtgggttagaacctgaaaaaaaaagtgccttatattgctcagactcctgggaaacagatcactaagttactattcacagtgaaaaatgtgccattgatcctttctattagtgggtatgcatgagtaccaatgtcctagttgctgtggcagatgatgccatagaaatgaagagtcatatagatcctgccttgaagtgggagagggctgatacgggagacaagtgtgtaaataactatgaacaagcttgcaaacatagaaacagaggtgcttattctaactgggcaatggggatgattacacaatggtgattttagacatacactggggaaagcgtaagtgggtcctggaagtgggaacattcttgcactctagctagaatttagtgtcaggctaatggaaggatgcggtgacaacgaggctgggaaggtagaattaggtcatgtcatgcaaggcctaaaatatcatgctgaggaccacaaaggaccacaaaggttttggaggaggaaagtgacacaatgcagacaagaattttaaggagaataacttcagtagcgaagtgtggagattaaaaagactcaaggcagggaaaccaggttaggttagaagttggcctgggaaacatggggtggggagggcgggtgtgaaaaagatgaaaattcaatgcactgaggaaatagagcacattctgaaaagcacgttctatgactaactacttctaaaaaacaaaatttggacccagttgtaaaagaaatctgagagcaaatacatgtttctgtggatctttaatgggaggcagaaccttccaaaattaagtggctcaccatgagaggccaaacctgtaacactttgtaattacaagccccagacagcctttcagggagtccctggggcccaggggtggcggaggaaatgaagcagaatgaggaaatgcacagacaaaccgcccttgctgtctggtagcagggtgggggaagaaggtgggtggcagtcagctctgcagttactggtcttgatccacaagaggacaggaaacattttagactcagttgtaccccaggagggagtgtaagcctggggcagaaggtcaggtcccgaacagggtttggtgggaaggctcccaagtcaacacacctaaccacttgctctcttaaattcatccactcctgaccccaggccctcctcctatcatccttcaacaaataggtgcttggaaaggatggccttcaagcaaagatcacagattaaacagaaagaaccagaatgggatctctacaaaggtatcaggaaaatcaaatagctggtaagggacacatagaagaacaaatatactacaaagcagaataaaagaccaaaaaaacttctccatgaaacaaaaacattaagaaaacacttcttctttgaaacaagtgatcaaatcaaagatagagatatgataaaaggagagatgatacaaagctgggcaggcagggaagaacctaatgagatttatatcccgaaatgctcacattaaggggaaaaaaagaatgaaaactaatgagctaaacatacctcttagaacaacagaacatgaaaatatacccaaagttcttagaagaatatgacatagaaaaaaaaacaagaaagctaaaacttagttctttgagaagatgagaaatctctgagagaaaaggtacaaataaacagtattatgaatacattagataattacagatgctgcagacatcaatgataacatgatgatataatgaacaaatttatgccaataaggttgaaaacttagaagaaatgattacattcctagaaaaatatgatttactaaactgtctgacaaattttaaaactctctacattctcagatctgcttttgtaataataatgtgtattgatcttccttcttaacaaatatgtttccacaacattattttaatgactacttcatatcacattattttgttttgactattaagttgctgccaaactttttactctcccaacttagcaactcgaaacctaggaattaatacaagatttactcttgtagctaaatttttgcgaagatctttgtctttccttagaataaatttcccaaagaggaattgctgggtcaaagataatgtctattttaaagcttttgacatataccaaatggctatatataatttctattataggcatttggtttaatcacttctttaatgccttcccttcactcctgttatataccaaatggctataatagaaattatagaatttatatacaataatagaaattatagccatttggctataatcgaaattaatagaaattatagccgtttggtatataacaggagtgaagggaaggcattaaaggagtgattaaagagtgacgggaaggcatttctggaaaagagaataaaggcacagttagatacagcaagaacaaaatgtgtcctaggactgggacgtagtggacgatattagtaagtcaaagtagtaacacaatattagcatatagttgtgttaaaagtaatagtaaatataatagtaataatagtaaaataaggaaaataatttaattcttttaatataaaacaattaaactgaatattatttcacttataccactctctgtttcaaattagaaattgtgtaaagagtttttatgctgtttgggaggccaaggtgggcggatcacgaggtcatatcgagaccatcctggctaacacggtgaaaccccgtctctactaaaaatacaaaaaaaaaaaaaaaaattagtcgggcgtggtggcgggcgcctgtagtcccagctactcgggaggctgaggcaggagaatcgcatgaacccagaggtggagcttgcagtgagctgaaatagcgccactgcactccagcctgggagacagaacgagattccctctcaaaaaaaaaaaaaagtttttatgctgtgcatcaaaaaacacaatagaatattttttagagaggttttagttttatagtaaaattgaacaaaaagcacagggagttctcatgtattctcttgttatcccccaacagtttccctgattattaacatcatgcagtagtatggtacttttgttataattcatgagccaatattgacaaagttcacaatttattttagggttagttctttgtctattacattctattctatggcttttggcaaacgtataatggcatatatccactgctgaagtatcatatagaatactttcactgctttattattatttttcaatatgtaaaaatatatgtatttatttactggcatataaggcatgccagttctacaaggaagttttgggggaaaacactgaagtagttttatcctatttttttgttttgtttctgtttctttgttttttaaattgctttaatgattttccaaaatggagctgctggaggtcctgaaattgcataactctgcttactctcctctctgttgactttatttcacttacctgctagtcactccatttttgtcactgggaatgatgctcattagagtctatatacacacacagaagctactggagtgcactttgcagtttagccatgtcagagcctagacaacccctgacacccccactagagccctctgaaatctgtagacttctcctaccttcaactcttgctcacagcagctccattcacttagaatgtccttctccctccctctttacctgagtttttccccgtgcatttttcaggattcactaattggcaccttttctagtcagtcttttttaaaacaaatttttttttgagacagggtttcactctgtcatgcaagctggaatgcactgactcaatcacggctcactgcagcctcaacttcccaggctcaagcaatcctcctgccttggcctcctgagtagctgggattacaggcatgagccactatgctcggctaatttttttattttttgtaaagacagggggtctcaccatgttgtctaggctggtctcgaatgtctgggtgcaggcaatcctcccaccttggcctcccaatgtgctgtgattacaggtgtgagccacaatgtctgaccaggagtctttcttgacatcttgattcccagggacagcacactagtccctccgcccgctctgcccctctcagctgcacagtgccttgagtacttgtgatgcacatcttgtgcttatttgattacatatcttcttcttttagacctttgagcactttgaagaaaggaactgtgtcttatttgcccttttatcattggcacattgtctggctcattaagaagtatttatctgaagggcagtgtggatagatacccttgagtacatccagtgaaggagctactggtcctggctcaggtctgtagtattctatatcagtgccatccacttctggacccccatgatgactcccactagaaagtgtaccttttcaaaaatacaactcataacaccttcacagtagaacagcagcttgttaaaacagtaaccacagcaaaccagaagtagtagtacccagacaataagggctattcttcttggagcctttcaattggaggattggagcagcccagtgagagcttgttcagtaagtgctaagaaagatgctaacagcttcaggaagataaagctagagagtttcctactgtagcccctccctggatacttataacttccaaagccagcaactttttaattatttcataaaccagaccctatatcatatagaacttcttaaaattacttggctgcagtaagaattttcttataatccttcttccttacatgaaggatagtatcctataaatactctttgtattctgctttttaaatttaacaatatattttggaaattgtcttatataactctatagagatctcccttactgttttctatttttttacagctgcgtagtactacatgtactatgtactacggtacttggggatgtactatagttttttcaaccactctcctgtgtatgggcatttgaatatttcacagctataaacagtgctgcaatggataagcttatgaattgtgtcacttctaagtacagagtatactccaaattaatatacagatagctaaaaactggtaaaataaatttagtttggtgcaaaagtaattgcgattttgccattgaaagtaatggcaaaaactgcaattacttttgcaccaacctgataataccactcataactcataagcatgaaggttttactttctgagaactaaagggtaaactaaggagtgctttagtatgtgaatccttcatttgaaaaagcaaccaattttacattacattcaacttattctctaagaaacctgagaatatctgaagatgaaaaaatataattttatagcaaaaatcatgtcaaaaggtcaataatttctggacttgcaaatttaatgaggtattattacctttgaaaaatactcttcagtcttttaaaaggaaattatcttttaaaaagtgatataaagttctcctgaagttttattagttaaaccattatttcaaaaactatattaagtgttgcttcagaaacttgtaaataatacaggataattattttgtatgacttagtttcttacttgaattagaaaaataaaaggaagtaaggttcagtgccgtggtgcactgttatttcttggcactttaattttaaaaaaacctctcagttgggacttttcttggttggttacaaaccttatcttttggaaaattttcctctgtctagttttaagagcattactacctttgccttcggcccttgatgtttttgttgtatttcagtgttgctgtagtacattagcaaaactcccttctccagctaattgtctaaaagcaaggtcaaacattggccaaagaatttactgtgtaggaagtgattgactgtggaaaagtctggtaggatttttacaagctttgcattttatcaatctggaactggcaagatggaacacatttttaattatgcaaaatttgctgtgtaatctcaaaaatatagcagtggcttaatacataaacattcaggtcaaatatatttattctgggaccaccttaggatttttgcatcattgccagatgggttgcaagctcttataattgaagattttgtttcctttccttgttctttgcggtaaaagtaattagtaatgaaatagcagtgtttaccctataattcacgagtgaacagagcaagtattaacctgccagtgaagtgggttttaataactcacaacataatatccaaaccctggtggcagaggacaatgtttagagggtggtaatttagagattagtatacgtcttagacactgtttataaacatgctttagttttctcttgggaaaacagcttttacttaaatggttttaacactgaagaaaaacattatatatatatacgtgcgtgtgtatatatgtgtgtgtatatatatatgtatatatatgtagtgctattagtgctatttacactgaagtacaaaatagcaaaggggacaatttggtattagtattagttaaacttttgaagttgacatataacaatagagtaaaagcttaactctagattaactgattattgtgaatggaagatgagagagaaggagaactctcataatccgatttcatatgattttagaatagagtcatggtggaagagtgagttaacatttacatccatcccttccttcattttctacctcccctcgtcccagccattattatacagcattaaactgtagaagcacctttgaggccttctcattttcccttgagggttctatggtttctcagcaaaacaaaggaaagaaggcagtacagttttcctttctttccagtattctttccttctttttcatccaacttaaaggtatgtgttctttctctttaccaccctactagttcgtcttcatgaggcaactcacatgaagaagcagggagtaatagaactgtgaaacttcatcatttgaaaggcgcacctttacaaatgatgcatcctaaacccgatgccctctgaggctagtagagaacgaagaggaaaaacaagccacatcatgtagattctgaatatatattgctatattcgtgtgttatgcttaagagtgaaagataattggagttcctttaattcagtgtaaatgaaaataaaaataaaaactaagaaatgagcataatagggccattgggatttggaagaaagaatctccacacttaaatatttgaggtgagtgcttttgaaggatgtttatcaggaaaatgctgaatatatttaccaggttaatgctgaaaatggcacagtattctggtctcataaaagttttcatccttttccactctccattggtggaggggggtaaacagaaggggttggtttttcacaaaccttaaaattgcaagaaataatttgaatgtataatccaacagatccatagtacaaataaggtgtagtagagaggcccttttagatgctgatctgtcagtgacccagacaggccgtttaagggagttggttttaaagtgatgccagatggtagcattcgtggcattagcaatagcaactatgtggtggcattgtgttccacagatgatgaaattctctgctgagtgcactttcaaattattttaaatatactgtatgtattttcacattgtttcatatagacccacagaagtgtgtgtgtgtgtgtgtgtgtgtgtgtgtgtgtgtatgtgtacgaaaatacaactacaaaagtatggctaggaatctgtggatactgtagataaagttgcttctagagcattaacattgattatctaacaacactctcaaaggcttaaatcaaagtacttttaattctaaaggacaaatggcagtggagattttttagaggttattgtcttgtggttttgaaaacagctgaaacagcttggagagggcagcaagggaatgacttaattgaccacctgcacaggcgtcctttctctctaccagatatgcccctggtgggattgactcacctgtcaattatctcagcgacctataaatttagcaagtataggaactcagactagagacagaatgagattcaaatagcttgactctcttgtcttgtatatatgtgtgtgtatctttcacttctaaatatattccaagagatatcttacagatagtgtccctgaataagtggcattatctgctgtgagtaagaacagagaccaacttttaggctagaatttaaatggaacgtttcttgctttgataatttgctagtgtccataggggtaatgatggaaaaatactcactctaccccatgcaagacacaatcaactgatgaaaattcaactctacctgccacagcatcctaaacataaatggaagtgataaacgtatgagtcattttgcctggagtgtcgctcaatgacctgtgcctcagagtgagtgtgaagatagaggtatggacctggtgccattccctcaagggatgtggttcctgaggcctccacaccttgccagggtgtggtattctgaggcttaaaagtaaacatcatgtatccatcatagataattcagccatcatggctcctatgtataagccagctgcttcatctgatgctgaccctaaggaatgataatctgttccagcgctgaagaaatgcctggctatgttgggttatttcattgtagcattttctgaagggatttttaagggtaatttcatctgtatatgactgctattgacttaactgtgtcctctccaaattcataattgaagtctgaattccagcatgactatatttagagatagggtctttgggaggtaattaagtttaaatgaggtcctagggtgtgggcctaatctgatagaattgctggtcttgtaagaggaaaacagcctgtctttctctgtgtgcataccaagaaaaggccctgtgaggacttactaagaagcaggcagcctgcaagccagaaagagcctgaccaaaagctgactcaattggcaccttgatcttggacatcccagcctctagagatacgagaaataaatgtctgttgtttaagccactcagtctgtgatattttgttatagcagcctgagaagactaatatagtgactttcttcagaatccaatcctgaagtcagatgtggctcatgtgccctaaacgggaggcttttctttcctagtataccctttgagtgttgcgtttctgaagaagagctgaaggaggaaaacttgagattatttaaagtgcatgctttcctattccttccccaggcttctgtgtagagatggtaatcaccaataaaataaatcttggagcagtgttgtatccttaaaaggacatagtactgggggtcacctaaatctgacatccaaacccatgcatcctattagtatctttgtgactcaaatgactctttctgagccttggtttcctcagctgtaaaatacagaaaattgtactgcttaggttcaacaaggtatagacagctgtgtagaactatgattggccagagaatgtatgatctaatgctaaaaggccgagtggggaaacccagcaagtcccttgtctctacattctccctggactctctgagcatgtgttccttccttctgggtataaggcaggaccctctctggaatgggtcttatgacctacagttaaacaaggtaggtcagatattgatgatttctttatggtcagtttctacacagatagggtggaggaaaagttagagtaatattttaaggttttatggctggccttggagaaaaggggtgctggtttctgtaacccaccttggggaagaggaattctagtttctatggccagcctcagaagagaatggggctgagagataagagggcagaagacagagagaaagttttgcttctgaggctatttccgaagccttcattttgagatattgcttttaaaaccccaacactacccaacgtgcttaatgaagcggttgatttctattctgacccaagcctgttttctttccccatacgggtactaaacagttgctccatcttcagatcacactttgactagctctgctctaggagtctgatgcttgggggagcctcttctctttgtgttagaacactttatgggtctttcataggcaatctgacacaatgtcaggacaaatcagtttattaacctgatttcacactttttgtatccccatcaaatgcaatagcttagcatacatatggcttctagcctgcttgaagatgagcatcttgtatagtttaaatgatcctgagctgggaactgttgtttctcatcaccatcatcagtggagatggtggcagtaggttctccctgccttttggcagttcttaatcttatttttgtgtcacggatccctttggcagacagtgatatctatggaccatttctcagaatgttatttttaattttataaaataaaacctgtaagctgagaaaggaaaccaattatactgaaatacgcttatcataatattgtgacagtaatacatgtgcccaactgttaacacatcaagcaagatctagtagcatgtctaagagctactgttatcttgaagaagtgatgaacataagtaaaactttgacatctacggcaactcgagtgggatccctcgaccaaagttactgggatcaggtaactttggtccaagtgtgggtatgacagaagatgagcctataaaggttagagatggctatgatgaaccttcactgatataccagagggatgggatattattggcagagaggagtcattgaagtattttaataggaatgagataaagagattcctgatttcagaatattaacagggctggaatgtattaaatgaattatgatgtctgggagggggagataatacaatgtttctcatttatgatcaggttatgtactgataaacccaaaatattttaaagtagaaagtgcatttttggcatatgatattttcaatttacaatgggtttgtttggacgtagcccatggcaaatcaaggagcatgctttcacaccatcataaagtcaaaaagttctaagtcaaaccatcttcagtcagggaccatctatatgggcaatagttttaccatcagatggaaagactacatggagaaaattatacctacttttcctaccctagtatttcctttaatagcctaatgataaggttcatcagagagcttattaattatgcagaataccagattctttcctgcaaattacaacctcagtaggtctgagattcagaagaaaattagtgatttttgaaacagctccatatgatttttatcttctacaagttgaaaaactcttcataggaatgtttggctgatcaggtctgacattgcatgtgagagtatcaaagcaaaaactgatggagacaaagtgtaattaattaaattaaattaattattttttctttccaacttttattttagaatcaggaagtacctgtgcaggtttgttacagaagcatattgcatgatactgaggtttggattatgatggaactcattagcttggtaaagagctaagtacccaatgggcagtttttcagcccttgccctccttgcccttgtgatcttttaaatgtgtcctttctttcattcataatatgctaagccaacaaatagtttgaaggaccataaaagagagataagttggctatgagagggcagtaagaaactccagcagtgctataaaacaccacatataagtctttatggcagtgtcactgtattttccaattagaaataacagttattataaattacattttttcacagccccaagtatttacttaacgcacccaaaaaaataaattaaaattctccaaaataatggcagtagaaattatggcagcaaatgcaaagactgaaaagttaagataaacaaaattaaattcaccactgagcctttaatgtgtttattttgtatacatatgtatctgcttatgaattctatttatgaatatatgcattttaaaatagctgttatttacttttcctgagaaccattgtttgaattttataaggagaaataacaaggtgatttttaaaagaatgtgaatattttatttctttcaagttttattttagacacatatgcaggtttgttacagggggataatgcacttaggtaatgagcatcatacccaataggtagtttttcaacccatttaccctcacccagtagctcccagtgtctattgttgccatctttctgtccatgtgtagccagcgtttagctcccacctaagtaagaacatgcagtatttggttttcgttttctgtatttgttcacttcagataatggcttccagctgcatccatgttgctgcaaaagagatgatctagttctttttatggctgcgtggtattccttggtgcatacttacacactattggtgagaatgtaaattagtccagccactgtcgagagcagtttggagatttcccactgatagaattggaatttccaattggtcagcagagaggtgatgctaaatgagtcaagccaacatgataacgcctaactcttaagttacttcagtagaaatggcaccctgtagtcagcaatggtagttgatgagaatcagggaaaacagcagggcctgtggaagcctcctctggagagtggtgttttctgatagaacattgcagaccagccctggactgtcactcatgattaccatattgtatgggctccatctctctctctctctctctctctctctctctctcttacacacacacatgcacacacacacacacacacacacacacagacgcacgcaccctgtatatatactactgaagtaatttagaagaagtaagttacaggcattttagcagtggggttttatgaaaacctgattaccatttagcacaagctgcattagaaatttatcagaaaagttgagtgaggagatcaaggctttggggagtcactgtgggaatgatacatgaagaggtgtcagctgaaaccatgagagtggatgagcttttcacaacattactgtgtacatatggcattaacgtatcatactttttctttcaagagtgtgtgtaaagaaggaagaatggagttctaaaaactcagagtcttcttaatcctgcttaagagaggtttatgatgctaaggactgtcaaaggtactattgattttctcctggaacccccggcagaggagagcctcagtagggtggtctgggggagtcagaggcaaggtttaacagtgagtgggagaaaaggttctgggagtacagatacagtctggttttgaataaagtgagacgtgtagggagagtagaaaagaatcaccagatatagttactggagatagatgatattaatatgttttactttttccaattactttttaagtgatcagagatgaatgaacaatcagagaaaaacaattccattcaagagagacacacagatcatagttttcctgagaagaactgtcaaattggacagaaacaactggtatggcacacagattctatgattccatgctactggggagtgccccctcgaggatctctgagatgcccatggatgtgggtgggaaggtgggcccaggcaggacctcacagggaggagctctgccgcccaggctgatagagctttccctcctccccactgctcactgcgggctgctctcgcctcacacatctcctctccacctcctgtgtaccctgatttttagcccagtgttctgtacaataaaattctgctttttgtggagaatatatacaaacgtttttatttttatttttattttttgatttaataaagttttatttttccaaatgtacagctggttggacctattcatgcatcttcaccagcagctggagcatctccacccttggtatttctggtgtaaattacttgagctctgtgctttgaaaccagtttgataagtcctttactaaggagctcctgaagggctgccctggccagggagcctcgaatcttcagtctctcagagaccacagctggggttataagtttatagttgggaacttccttacagagtttgtcataggtagctttgtcaaacaagactaagttattgagcttgtcccgaactttgcctttggaccacttcttctttttggccttgcccccggatttgttcactgggtctttgtttttcttggctgactttccagcgtccttcttctcgtcgtccttgggcggcattgcgaagctcggagagtagcagcagacaccgcagccttgcaaagatgtcggacaaaaaagctacaaatgtttttatttaatgaacctttattttgttattattatgtcacgttatggctctaaaactgtatgtattaactcatctaatccttatcacaccatactattgttaactccattttacaaagagagaaactggggcctagagatgtagcaatttgctcaaggcccaccactagtacgtggcagagccaaggcttgagcacaggcaggtgaccctgggtctctgttcttaacctcttgctgtgctacttagaatagtaatcgcttcgtactaagttgtatgtatatgtcataaccatatctaatgcagaacagtttaaggttaagtttatgaaacaaccatatacaccaagatgaaatttaaaagaaacattatattattttagacttactagactcttattaaactaaataaactgcagaaaagtccatgacattctgttactaatttgttacattgaaattcctacattgaaagcttcccttttgtttccaggtggggtatttcatgtatatgtcagcctatatgtttttgtgcttctgagattattttcttctacaatccttcaaaagagcattttcttccctcatgacatgtgctacatgttcacaataagttatcagtacaatattcgattgaagcattttgttgtttgtcttccagctcaggccccatttaatttctaattgtctttcagctcaggccccatctaatttctaattacagtggctcacacctgtaatcccagaactttgggagcccaaggcagatggtggatccttggagcccaggaattcaaggccagcctgggcaacatggtgaaaccccatctctactgcatatgtacacaaaaattagccaagcatggtggtgcgtgcctgcagtcccacctacatgggaggctgaggtgggaggatcacttgagccccggggattgaggctgcagtaagccatgatcatgccatagcactgcagcctgggtgacagagcgagaccctatctcaaaaaaaaaaagaaaagaaaggaaaaaaaaaaaacctccagagacttttgaaaatgtccccgtatgccctagaaagtcatcctagcaatatttctcttgttccaatctggctttgactgaaagtcgatccttcaggtggctgagttctgaattggagaccccccgcgtggaggccagtcccgggtagggagtagctccgaaatgcatcccagggcactgaaggggagtgccggatctactttgggttctcactgtggtttgagacactacatgggcttctttagctaacagccgaggaagggcctctactccttcatccttacccacatcaaatgctaattctgatgtgcatccccatcagatttggaaagctgagtggcgttttgcggttttaaaaagaattcttctattccccttgattgttttttacatttttattttatgagtgttatactatttctttattcagaaagaatggcccaacttgagaaaatgtacaccatcttttgaaacttaattagattaaatcgtttatgtctttgtgtaaaacatatatactttcatgcctttatggtgaaagttacagaaagttcattttggggaaatgtaaaacagataaaactatctggttcttactattaatacatttatttgtttaatagcaacaaatagagcggcagttaaaatgcttggcatttcgaaaccctggaccacaggtagcagactttaatcctgaaacaaggcagcagaaaaagaaagcccggatgtcaaagatgaatgaatatttttctaccaaatacaagtaagattctgacttattgtatttgatctgtgggattatgaaatgcatgaattctccttgacaaagcaatgaaagattccctctttttattatttattatttaaaaatatctcctctgaaatataatagtacccatgtgtctggacgttagcaaccttaagaaacagaaaaatagactataatcccgaattaggaatcgattttttaaaaaggcttcaatagccgtgtaatagagtaatggctttagtaggaaagatgatttaaaagtaacaaaaatgtatcattagaaggataaataatataaccatgggaatgaactcaggatattaaatgggcacaggactatcatcaagtacaatgattgttagtgcatcgtaagtataaactaagtaaactggctgggcacggtggctcacacctgtaattccaacactttgggaggccaaagtgggtggatcactaggtcaggagatctagaccatcctggctaacacggtgaaaccccgtctctactaaaaatacaaaaaattagctgggcgtggtggcacgcgcctgtagtcccagctacttgggaggctgaggcaggtgaatcgcttgaacccaggaggcggaggttgcagtgagccgaaaccatgccactgcactccagcctggatgacagagcaagactccatctcaaaaaataaataaataaataaataaaataaaaaataataaactaagaaaactataaaggaaaatgataaatttaactacattaaaattaatatgcccattaaaaactccataaaaacagtgaaagacacaccataaagtaggagaagttattaataacataaaaaatcagtatccaaaatatatgaagaatcttacaagtcaataagaaaagtgtaaatatcctaatagacaaattaataaaatgataaacagacatttcatagaggaaacaacaaataaacattcaggataccgaacctgatcagcacatacatagaagtgccatactccccagggagtcagaatttagtctgttgacatcaaagctgatgaagctatgagatatgaattaagtgtaaaaaggtacaaccactatttaaaaacagctcagtgttacctatgtgccttatgacctaacatcttcactcctgagtataaattaatatcttggaaaaagtctaatacatgtatagggagatatgtttaagaagtttcatggcatcactgaaatagcaaagaaaataaactgttaataatccaaatgtccatcaacaatggaaaagataaataacttgtggtatatttatacagtggaatacatatagaagtgaaaatatttgaacagctacatgtaccatcatggaagaatctcaactcatgatcagactaacaaagcaaattacaaaaggaaaatcacaatatgtttagggatacctacatatgtgtcataactaagaccaaaacaaggaagtgactttatatatatacatatatatatataattttttttattatactttaagttctagggtacatgtgcacaatgtgcaggtttgttacacatgtatacatgtgccatgttggtgtactgcacccattaactcctcatttacattaggtatgtctcctaatgctatccctccccactcccccaaccccacaacaggccccagtgtgtgatgttccccttcctctgtccaagtgttctcattgttcaattctcatctgtgagtgagaacatgcggtgtttggtttttagtccttgcgatagtttgctaagaatgatagtttccaacttcatccatgtccctacaaaggacatgaactcatccttttttatggttgcatagtattccatggtgtatatgtgccacattgtcttaatccagtctatcattgttggacatttcggttggttccaagtctttgctattgtgagtagtgccgcaataaacatacatgtgcatgtgtctttatagcagcatgatttatagtcctttgggtatatatgcagtaatgggatggctgggtcaaatggtatttctagttctagatccctgaggaatcgccacactgacttccacaagggttgaagtagtttactgtcccaccaacagtgtaaaagtgttcctgtttctccacatcctctccagcacctgttgtttcctgactttttaatgatcgtcattctaactggtgtgagatggtatctcattgtggttttgatttgcatttctctgatggccagtgataatgagcatttttcatgtgtctattggctgcatcaatgtcttcttttgagaagtgtctcttcatatccttcgcccacttgttgatggggttgtttgtttttttcttgtaaatttgtttgtgttctttgtagattctggatattagccctttgtcagatgagtagattgcaaaaattttctcccattctgtaggttgcctgttcactctgatggtagtttcttttgctgtgcagaagctctttagtttaattagatcccatttgtcaattttgtcttttgttgccattgcttttgatgttttagacatgaagttcttgcccatgcctatatcctgaatggtattgcctaggttttcttctagggtttttatggttttaggtctaacatttaagtctttaatccatcttgaattaatttttgtataaggtgtaaggaagggatccaatttcagctttctacatatggctagccagttttcccagcaccatttgttaaatagggaatcctccctgactcattttatgaggccagcatcatcctgataccaaagcctggcagagacacaacaaaaagagagaattttagacgaatatccctgatgaacatcaatgcaaatatcctcaataaaatactggcaaaccaaatccagcagcatatcaaaaagtttatccaccatgatcaagtgggcttcatccctgggatgcaaggctggttcaacacatgcaaatcaataaacgtaatccagcatataaacagaaccaaagacaaaaaccacatgattatctccgtagatgcagaaaaggccttcggaagtgacttttataacatcaaggtacagttcctttttgaggggagggtagagggatgcaatgggtggggattgaagaggacttcactgctgtaacactcttttgttaagctggacagtgggcacacagaagtttgttttattcttctttatctgtgcatgtagtgtatatattttgcatgatttgatgtgtataattcaggattttaccaaaaaaaaaagcatcaaatgggccggaaaccataaaaccttaccaacacaggagaatatttgagttaaggcaaagggaggacagaatctgacctgtggtataggttgatttcaggaccatctactccatcactcttataatagatttaaaatatcctcttccgctaaatttcctggggttgcttaggaagagtttcattccacaaataaagtacttcaaaagtgaatcttcattagaaggcattcttgctaaagcgtgatcatcaggcagcaagtacacataatgactaatcctttcccttccctgcattcttaggaaaaggaacaggatggaacgatattacttagcgaacagaaggagaggaggcattgtgcctgcttagggacaaagggtgcaggagtattatacataattttgccatactagcttaggacaaccagccttttggacttcagtggtaataacggctatcagttatacagaggtatttttgttgttctcaggttttgaagcaactcagttttgaaggatttatttcaaaatggttgggtttgagaaggtagtaggattcctgtgaaagtcctttgtccctggccatgttgtagaggctgacagagacagtctggactctgggctctcctctgggacagagcatcccaccttcagtcagagcttacgatgtatgatcctccagtcttggtcacctcctttctccctcctcactgggtaaaaagcagaatcagaaaggaacagaagaaatggcacttggagactgttagcaaaggtgcttttctttcttcaaatgattatggtgtaataactgacagttctaattttaggtaacaaaaatgtggtagttgcattcagcatagtgcttttaagaaaaaaataatctgttagggaaaaatctatcaagaatggtaatattttaaagaaaactttgggggcatttgtaggaggaagctttagttagctattcctcataattttcttaggtagattgctgcatttcccagcaatgctggaaaaatgaagtgttactctagatgacaagcctggctgcactggaagttgtttgatctcatattgactgaatttcccgtgacgtcactgccgtacaatattctggagtgtttctggtaatccctggagttctggtccagagtaccaatgtttctggtaatctctggagttctgggtcagggtaaaatggtcatgtgtatgatgttgattgtacattaatttattctcaatgttgaggatgattgcactgtcatcttaatgtcatgcttttcctttgtagaataatgaggaagtatgacaaaagtggcaggctcatctgtaatgacgctgatctgtgtgattgtctagagaagaactgcctgggctgcttctacccatgcccgaagtgtaactccaacaagtgtgggcccgagtgccgctgcaaccgacggtgggtttacgatgccatcgtcactgagtcaggagaggtcatcagcacgctgccgtttaatgttcctgactaggtgctcttgtatatggactgatttgtttcttcttcttacacatttaagttgacctctttcttttgggtgaattttagggcttgggggaaatatcgaaaaaacatactgaagactcatgttctgtcaagccccagaacaatgtagaatgggcaataattctgtaaccttcttaactgtgtcaacaattttcaagtcccttaacttgcaaccaaagaatgtaacaatggagggatcagcatttctcatcagcaccctcatctctactctgccttcaaattaaaactctcttccctctttgctgatatctgagaaaatgtagctttaagattttcaaaactctgtagttgagagcttttcttacatagaacatagaatcttaaatttataatatctagttgtccttagaatcttatacatcactagctgtaaatcagaattgccatttggattttgaagaaaaactgtgactttgcactgtatacccatagcctcatttttttattgttcatgttttaataacattaaaatgaaatttagtaatacttggtagtatttttaatcattaaaatttgtattgtacttgtaaaattgaaaagttaggaatttattatcctaaaagccaggagtttacatatttttgatttcagaagcagtatttcaggatttgtttttcatagagagaaaacaagttatacaaaaatgattttctgtatgtttgctaattgagtgtgttgataagcaattgactagataaatgatgtagtcttttcaactttgatacatcatcagagctataaaatattgaattcagctttctttgaattcatttttttatgacagtcttttttttaaccctaagtcaatggttctcattcatgagaattgcctagagaacttgtcaaaacatagatttttgcagccccacattcagaatctgggacagggctcaaccatctgttccacgttcccaggtgatgttgatgctgctgatgtggggaccacactttgagaaccacttctctaaattattttagatacataatgtaaggaagtatttaaacctcattgactatgatactgccactgcacaaagctggaagtatttaaataaagtaacgtaataaaaatttaaaagtaaataaaagcatttaagttttaaaataaatttgaaatagtataaatagagggttttttgttgttgttgtttctttttcttttttttttagacggagtttccctctgtcacccaggctgcagtgcagtagcgcgatctccgttcactgcaacccccgcctctgggctcaagccattctcgtgcctcagcctctcaagtggctgggattacaggcttgcaccaccactcccggttaatttttgtatttttattagagacggagtttcaccatgttggccaggctggtctcaaactcctgacctcaagtgatcagcccgcctcacctcccaaagtgctgggattagaggtgtgagcaaccgtgaccggccttttataaatagagttttcaggatttatttttccttcataatcagtttaacactcacttctgcacaatctacttgtgccagggaacgtttctgacagttctggatttgttgcttgacgtatgttttaggactaaaataagaaaagtcctaaaagtaatggtgtgactacagtacacctgtccacggagcaagagaacttacattcttctgcatcattctccatagaatttactgggttttccagatttcacttacttttactgagcatacactgtgaactaaacattgtgttaacacggtaatgaattgcatttcctttaaccatcacagcccagtaaggaagacgtaaaatcaaattacccaaatcacattctttgaaatgctcaccaggaatgtgcagccgggaaaccagtaaaaacaagcagggcctttttcagtttatatcttgttttatttttgagaataattattattttgtaattggcagaccaaatgcatttattacttcttcattttagaatcatataatcttagagccaaaaagagccttgcagctcatccatatagtgaattagtcgacaaatactaacagagaggctgctctgtgacaggcagcaggctaggtgcaggggaccaggcagtgaacaaaatctgcagggctcctgtcttcatggggcttatggactaaggccaaactcttttttgttgttgttgtttttgtacctttgcaactgaggagatttagacccagtgagattaagtgactcaggtaaggacacacagaagaattggcagccctggtgttttgaacactaagactaggtcagagctctttcaatgatgccacgtatttcctacactacggtcattaagtgcttttaatataataaacattcctaagacccatccccaacctcaggaatcagaacctgtaggaatgagacctgggattccataattttaaacaagcattgcagttaagtcttatgatctgatacatctgagaaacactgccctatatcatcagttgtccaattttcatgctaaaaaataatcctaggcaaattagcattaaagcctccttcctttctgtctcctcttgtcactcagtcttaaggattagataaaggaatctggtttaaaatgatctggcttaaaaagtgtgttgaaaaattatactggtaaattttccaagtaaggcaaaaaataaagtaaaaaactgcataattaactaagcagacacctaatactgctatcatggaagcctagtaaagcatttgatgaagtacacttttagaaatcaggttatttcatcttgatctaatgccatttcagtgtatttctaaaacttctcttgcaataaataattattacaaaaataaatttatgtgaattgtctaaaacttattttgcaagtgtctaatttttattacaaagtgaataaagctctttagctatttgaactaaattcagattaacaaggaatgcagctgtactatctgattacattacccaaggaaatcgtcttgtcagtgtgacaggacttttttctgcttggctatctttcaatgctgatagcatgtcttcatgaatatgtgtaaaatggaaggaaacctattttacaaaaggttatttaaattaaaccagtacatactgaaggatttagacaaattatcccgtgcccatttatgcaaggattttggactagaatgccatatcacgtcaatttttgtgacaacttttgagtgtaatttgtaagagttaaagaatatctgtacactgtcttagataatccttctgtacctccccttccagctacccccacccaagacacaacatcttggatccattgcaggtatagacgttgggatgctaactcacagaaaaatcatttaacctctatttttataaaagtgaacaatgccattttgtatagtctgtggatgtcgtagatggtagttatgtaatgaatgctttggacatttttaaacatttacacatgcaaggcttcaatgtttggccatgcagggacatttattacttaagtccagaaggtgacttttacatggacagctgtacaatgccaattatgccccctagagttgtacagcaaaatggtcctgcagaaaggtgccatttgatgtgcggatttcttgtttgtccagcatttattgacatttactatgtgttagacattgtgtgctttaggttggttcatattattgtataaaatactttttaaaaatccctatgtgtcctctctcttctatctattttttcttttttccttcattctctgtgatgtctgtaacagcagaagatagtttgaggttacttaggacgatagtccatatatatgatttaacatacacagtttttgtactactttttccttttcagaacctatattttaatcctggacttcgaatattctttttaacattcacagattcctaaaattctgtatttttcgtcactctgtggaagggaaatgactctcattactattcatgtctaataaacaatgtattacttaagacgcatatgcaatttgaaaaatgtttcttttgtgtttataatctgtagttttaacagtttattttttcctcactattgtatggttgtttgtatattctttttaagttggccaaagcttaggtcagatacaataaattcagcgagatcagtgactgagtttaactgtttttccttcagtagtgcattcaataacatagtgcacttaatagatacactacttagtgacccattattcatttattcattcatttaccaagcacctcttatatgccagacactttactaggtgctaaggatacaatgggtaagggaaaaaacactcaaacgtggtctctactcttacggactttacagaatagtcatggggggagagagagatagaataataatatcatgacacaaatgagtgtgaaaagagtaatgggtgagaggagttattaaggacatctttacatagtctgggtggtcacagaagtcttacctaaaggagcgatcacagttctggggcttgaaaagtgagaaaaaaaatagcagagaagaagatgggcgtgggggagaatgtttttggcagagtaaagagcatgctgaagggtctgtggcaggaaagggtacagcatgttccagacactagaagaagcctggatgggtggaggggaaagcatgagaagcctctgcagagcagagagtactcatatcatgggaggccttttaggtaccttgaggaagttgaagccaagcgcggtggctcacacctgtaatcccagcactttgggaggccaaggtgggaggatcacttgagcccagaattttgagaccattctgggcaacatagcaagaccttgtctctactaaaaataaaactaaaaaaattactgggcctggtggtacctgcctgcagtcccaggtactcagggggctgagttgggaagatcgcttgagcccaggaggtccaaggctgcagtgagccatgtttgtgccactgcactccagcctgggcaacagagcgacaccctgtattaaaaaaaaaaaaaaaaaaaatttgttacatgtccaaaacacaacaggaaaccattgaagtgcttgaagccagtggggtggcagtggatgacacaatcatacttgcatttttaaaagaccacactggctgcagtgaggaaaacaaacaaaaggactttgtgatagaagagatatgtggggtgaggaagacagaagccacaggagtctcccactttcttggtttccatcgtcaaacagatggtatggccaatcactgaacactggaacagggaatactggaaaaggaccagggctgaggaatgctcatgtgtgcgattgctggttcatatgttgtaagtttagttttgtaggaaactgccaaaatgttttccagagtggctgtacccttttgcattcccaccagcaatgtatgagggatccactttgtctaatcctcaccagcaattagtagtgttactattttttattttaaccatttggataggtaagtcgtgatatctcattgtggtcttaatttgcatttccctaatggctgatattttcatgtgtttatttgctatctgtatgtaatcctaatgaaatgtttcttcatatcttttgcccattttctaaccagattattttattttttaatactgtgttctgagaattttttatatattctagctacaagttctttgtcagatacgtgtttgcaaatatttttctctctacagcttgttttcatccttctaataaggcctttcacagagcaatagttttaattctaatgaattttgatttataaatttttgtcttttacagattgtgcttttggtgttatgtctaagaactcttatccaagcactttttaccaaagactttctcctatattatcttctaaaggttttatatgatccattttaggttaaattttttttttttttttttgacagagcctcgctttgtcgcccaggctggagtgcagtggcgtgatctcggctcactgcaagctccgcctcctgggttcacgccattctcctgcctcagcctcccgagtagctgggactacaggcgcctgccaccacgcccggctaattttttgtatttttagtagagatggggtttcacggtgttagccaggatggtctcgatcttctgaccttgtaatccgctcgcctcggcctcccaaagtgctgggattacaggcgtgagccaccgcgcctggccttgagttaatttttgtatgacatgtgagatgtgaggtttaggtcgaggttcctttttgcctatggatatccaactgtttttcagcaccatttgttgaaaagactatccttcctccactgaattgcttttgcactgttgtaaaaagtcaggtggccatacttgtgctgggctatttctgggttctctaggctgttacattgatctatgcatctattcatctgacaataccacatagtctttgtgatggcagatatataatacagttggccgttgaacagtgcacaggttaggggtaccaatgcatattttgtatgttatatatttacagagtgtattcttacaataaagtaagctaaagaaaagaaaatgttaagaaaatcttcatgaaggggaaatatatttactattcattaagtggaagtggatcatcataaagatcttcatccttgtcatcttcacattgagtaggctgagaaggaggatggagagaaggggttggttttgctgtctcagggacggctgaagcagaagaaaatctgtgtatatgtggacccagacagttcaaatctgttgttcaatggccaactgcaaattttaaaattaggtaaaataattctccccattttgtttttcttttaaacatcgttttaactactacagttcatttacttttccacatacattttagattaatcttgtctatatccataaaaaaatcttgctagcattttaataggaatgtgttaaatctgtgtatcaatttgagaagaactgacatttctattaccttagagtctcccttccagttcatgaacacggcatgtctttttgtatatttattccattatcattccatccatattccattataggttttttccattatcatttcatagtttttggcttacaagtcttatatgtattttgttagatttacaatcacgtgtctcatttttccggacaattctaaatggtatcatattttaaatttcagtgtttattgatagcatgtagaaataaaatatatttttgtatgttgatcttgtatcctacaactttgttgaagtcccttattagttttagaaggctgttcgtagatttaaaaaaaaatctttgtaattttttttggaattttctatgtagatggaatttgtcatctgcaaatagggacagttttatttcttcctttctaatgtatacgcattttctgtccatttctttcattattactctggcaagacctcccattactctcatagcagtggtgagaacaagcagccttaccttgttcttgatcttggggatctcatttaaaacattttttgctactttcttctagcttccaatgtttctgaagagaaacctgtcctttgaattttttttttcccagaagtaatgctttaaaaaatttgcttttcagctttcagaggttgagttatgatgtgtgttggtgagtatgtgttccgttgttggggtacctcattacagcctggccagggtggaagtccaggttccctattcagcctttgctggtgggagtgagggcacagttttcttctgtgattgttggtggagtagacgggttattgtttaaaacccttctgtcttgctgggctgcctatttcttggttctttggctacagagaccaaggttttgggagctttttccatctgtgcccattggcatttctggattgctgacatctccgttacccagtcttcatacacccaaagatgtatgaagtaaaagaaagtaaaaagaaacccagggtacttactgctctgtccttcctcatgtcccaggtccctaaccagtctgcctccttctctctgcctttcagagtcatcttatatttgttttattcgtaaagtccagagtttgtaactgtatgtagtgagaagaatagcaaaaaagcatccctactccatttttctgcaaatggaagtccttgttgggctttaatgtcaaggtgatgctcgccacataaaaggagatggtgaccactttcttttctctacaagcctttgtttcaagtgaaactattcatcctcacatgtttattggaacttgccagtgaggccagttggacctgaagggatttttttttgttgttttctttctctctctctcttttttttaataggaaggttttcaataacacatttgtttttaaaacagttatattctgttttcttctatttttcttatgtattacatattacatatatatctttctataagttatctattttatataaattttcaaatttgtgaacatagttatataaaatatatacattgtcatttttaaatatcaaccattttcctcaaattttatttataaattatttaaaggacattactaaccagcattctttcagtaaattattttcccccttagttagccagagttggtcagagttggattctcttactcataaacaaaacaccctaactaatacacttattgtccagaaaatggagagacatgtatagtgtagttgcggcaaattgcttttcaataaatttccacaaaaaatctattccttctgttttctgagagatacctagagcctgatttaagaggtgtgagctaaggccctcccgtttcttttcgacacactgctaacaattgtgttctcagcaataggaactgaaaagtgtccatacaactcataaattgttcccacttcaatagaacagaaattactttgcttttcaggagttactacaaaaagtcctagagaaagaaaaaagaaaaaaacaaaaacagaatcccaaaaaagtcctagagagtgagaggaaggaatgctttttcagttgcttcacatttagaatcccattctagctttgaattttccaaacagtacttggcatagagtagcactaaatatatgatttctatgatttttgcatatattcttgaatgatgagggttatttgcattttgtaatttttaatcatacattttcctaaaaacgatatacagaggaaatacatgaatggttttggctccctctgctggccatttatatgcactttaggttttacacagaacaaaatcaagaccactttttcaaatggatttggaattttttcaaaaagattatttaaggctgggtaccatgagatttttatcttttctttggaataaaagatgattttctcaagattttgtttctttttttaaaagtcagggtctcactttgttgcccaggctggagtgcacaatcatagctcactgtaacctcaaattcctgggctcagatgatcctcctgctttagcctcctgagtagctgggactacaggtgagagccaccacgcccggttaacttttaattgtatttaactttttaagatcagggctcgagtgctatgttgcccaggctggtctctaatgcctggcctcaaatgatcctcctgcctcagtcctccaaagccctgggattacaggtgtgagccaccatgcctggcactatttaaacttttcaatttaatttttcaaatttatacttcaaaaaactttaacattataactgttataacattataactttaaaaaaggatacatttagcacaataaatgaagtttagaaaatgttttagataaaaggcctgactcctgctatgtctctttctcaagctgtctgtggtgaaggtacccagttatagagactgatgccattccatattgccataacaatgcctccctcagtccagtcaattcctcggccattctccaaagcagctatttaaacgtttggcctttttaactcccgacttctttatcctcttctcaatattgctgttttcttggaaatgatagagaccatccgatacataactttgacattctgattttttctcctgcccccaatcctactaagagtctctatccatacctcttttttgcctccactcttgtagtttcagtgaaacaactttctctcctgttaaaggacagtcaattgggatggatcccttttccctgggttctttaggaacagcactgtatgaaacattatcatctctctcttttctatatctttgttggcttttaatgatcatgtgatcatacacttattgtttacgtcagctgggatctttcaactgcaaacagctctggctaatttaagcaaaaaaaaaggggggtggggggcactagatctaagaaaatgcagaaaaggttggcctcaggaagaaaaggcaccaggccagttttatgagctgggtagccacacatcatgaagcagggaccaaccatcagaaactttgctgagctgggggagagagctgaactgccaggtgtcagactagttaaaacaacaagacaaatgtgaaagaggtaagggtgtaatcacttactgtgatggtatatgcaagaatctaaaaggagattgctgtgagatttaatgagataatgcttgtaaagcatcagaaacaatcctgggtacacagcaaacataacttgataaatgatggctatcgttacgtattcagagcatccacagtgccctgtattcagatgaatcatgacactttttcacttcactgttgttttgtggcctcatactgatgtgtaagttccttagaagcttaggagaagggattgtgttttttaagcgcaagatccctagcacagagcttggcacaaggtagatattcaataaatgcatgctggataatggtaagagacaacctggattacatgttaagcgcatatgaaagtaaagtaaaataggtgtggttacaaaaggtcctctaggtttcctaaatagtagcataaattatttacattaaaatatttgattattaacaggcatggaggtgcatgcctgtaatcccagctactggggaggcttaggcaggcagactccctgagcttaggagtttgagatcagcctgggcaacatagtcaggccccatctcaaccatatcatcttggttatcatttttactttttcaaatactgactccttgtataaatagaatttgagagtctgtcagacaaaatcttttcctttcctttgttgtcctatgaccaccaccaccagcatcctcatcgccaacataattgtcttcaagtgctttaagcaatcattgaataataatcttcttggttagtttgtccagcaagaaatccctgttgcacgttagattcctcaggaagcagaatctgagatgagattcacaagcaggaagttgagtgctgttgagttgaatgcttagaagggatagaagggaaacagggttgggtagagggagagattgggctgcaatgcagtcacaataagccctcagctggccccccaggagctgcgaattggaaatggctcttcagtgttgttccaagttgatatcaaaaggacacagtggtgtgctagaactgactcattccagcttgggaggtgattgtgtgcatctcttccccaatggccattcattgatcacactttggtacttgatatgggctatagtagaaatatcaacactatagaaactggttaaatgctacaaattagggcatttttctctcttcagagatctggttgttaaatattaccagtcagatacagactgcactgagaagtggacgtggccttgggctaagtggtactctttaggtgaggcaattcctgaagaggactgacagctcagcagtgtcagtcagcacccttcactgcagctgtgagaatacatccttccctcaaagggaggctttgggtggcaccgcatagcattcacaatggtgcctgtgacggatttgtgctgctatggaaagtgtaacggtgataatatttctaagttttgtaagtgtcattttgacagtagtactcctttcataattcaaaaagttgaaaatagttaataggtttaaaataaataaactttatcttctacaactgttttagaaacagaaaaattgtgaagactgtaaaagtggccatatactccacacccaatttcccgtattactgacaaatgagtacggcatatttgttaaaatgaaggaaccaataataagaaattattgttaaccaaagtccatgctttatccatatttcttacttattgcccagtgtcctttttgtgttccaggatcccactgaaaataccacattacatttagtcatcgtgtctctttaggctcttctggactgtgatagtttcttgggcttttcttgtttttgatgaccttgacagttttgaggagtcctagtcaagtattttgtagaa

SEQ ID NO: 308 - DNA, 57282 bp, Homo sapiens
aactgtcattaaaaaataccattgtcatggaacataatgtctcctactgcataattgtaaaaacagatacaatttgtcccttggtatatgggggggattagttccagctctcccatttctgtgtataccaaaatccacgcatactcaagttttcgaagtcagtcctgtggaatctacatgtaacacaaatgggaaaattagtgaggtgtggtgacaagcacctgtagtcccagctacttgtgaggctgaggcaggaggattgcttgagcccaggaggttgaggctgcagtgagccataattgcaccactgcactccagtctgggcaacagagtgagacagaaggttgactttttaatagaattcttctgttcacttgaagatatggtcaggattgtggcatatgaaaattcttcataaaataactatctaatccaattaatgctggaattgggaacagcagaagtgtcatctcagagctactcacaatgaaaggtgatgtttggggctcaggtgtgttgaggtccccatgcctggactatgggtgctgagtgggatttacttgtccatccattttctatattccagcactgggaaactagtatttatcgatcttgataagatgtcatttaaattccacttcgcaagaaccacaaatggaagaaaggccatgaaaccgcaggacagtacttgttctcaagggaatcttcagcttaggtggctctgtaaaagagaaattacattgttgaaagatcgtcgcaggtcaggtgaggtggctcatacctataatcccagcccactgggagactaaggcaggaggattccgtgaggccaggagttcaagaccagcctgagcaacacagtgaaacctcatctctacaaaaaattagaaaatgaactgggtgcggtaaaacattcgtatagtcccagctactctggaggctgaaataggaggatcccttgagcccaggaagtggaagctgcagtgagctctgatctcaccactgcactccagcctgggtgacagagtgagaccctgtctcaagacacacacaaacacacacacacacacacacccaatctcagtctgtccagccttgactaatcaaaacggccttctggttacagaagaggtatgctcttttttaggacagggagagaccagcaagcttgttcacagacttttcctcatcctctgcttagttttccaagaaccctcacagtggaaatggagtctctgggaaaatgacctaaatctttgggttaccaggggagaaatatgcctcctttgtcaattaataaatggaacatctgccttaaaatccagggagttctgctagaatgaatcactccctaagaccctgacctatgcatggaacatgaaaaactgaagtttaactgggcgcggtggatcacgcctgtaatcccagcactttgggaggctgaggcgggcggatcacctgaggtcaaaagttctagatcagcctggccaacatggtgaaaccccgtctctactaaaaatacaaaaattagttgggcatggtggtggacacctgtaatcccagctactcgggaggctgaggcaggaaaatcgcttgaacctggaaggcggaggttgcagttacttctagaagaatttccattagccctttgaaatccttcaacattcatgaaggccaaagagttttcacctaatttaatctgatgggtatgtcaccagagtctttctagggaatagagactcccaaacagttcagctgggaagtgaggagagaatttattactcaaaatcaaagggaaatgaaaagaggccaacatagaatgtcattattctttcttggcggggaatggattccagagtcattctgtgacctttacatgacctccttattagcatctaaaagcttccagtgtaggatgcagccagctaggttctcttctaatgtaataaaatttgcttcagcaaatcttatgcagagccatctccaggctccagaaacaataggctataaattactggatctcccatttgatacaatgaagtataagcacggtcctgaatgactcctctacatactactctgggtggcttgaagtgaatttgatacaagaactggagcaagcgcaaagcagagctagatttaggattaatgtgcttgggcccagctcctcactactcacctatgagtctagttccagaacccaagtagagggtggggaaacaaggctcctgacttttttcccctaatgtctgcatctctttcacatttcttatctccttgcaaagaaactaaacaggctcaactgaaataactaaatgattaaaccctatacagagaatctccaaagactgacaaaatatcattcaagactgttacacagacaaccttgaggatgacttgatgtaccagtgatctacaatatttgggatcattccaaattcccatcaaggatctgcctatatcaacaaaggagccaaggaccaaccattcaaatgggccctgctgccaagcctttttttttttttacaatgccatctcttcatattgttccatttaacaaaactgtagcccctcatctatccttaagtcccttggccaatggtacagagccagagtatgctactccctagcaggaaatcaacaggatgacctactaaacaccattcagaagatgctaagacccatgaattgcaacaggaaagaaaagacagagaattagtcagacaggtacatgctgtgccaaaaatgcactacagcccccacccaattctgcctaatcctagctgggctgacaccaacctgatgagacaggcctataagatctcaaactaaaacagaaactcctgaactgggttctttcgaacccaggaagcagcagcaaatcattaaagaacagataagttcttaaggtgacggagagtttcagataaatggaatgctggtagaacacagggcccaaaggagcaaaagttaacctaagcccaggtagaaccttgtttactagagtattaggcatgggttggggcaactattctaaccagagaaactggcttcagtgagggcaagttggcaatccaaggtatagcatgcatagggctggcaaaattcagggtgactgaagcaaaagcttcagaaccagaaagaccacatctgggagtagagcacaaaactctcaagagatcaatctttgtaagagtgaggcagaactatatagcagttttaggagatctgttggtgcccagcaagagctccaaacgggctatatgcagggatgcaggctgtagtctcaggaaaggaggttcacaaaagtcattcagtccaagacctcaaactgtgttctctactaaaaggaatcaaggttccctagagaaatggctgactccatgtatggtgcagtatattgatcctggaacatcttttttgccagaaagtaaggaagccatcaaagtccaacaggatcacgtcaaaaagacatgaaagtaaacttgaagagataattattaacctagatgagacaatgtaagcatccaaaacaataaagactgcaatggcctgaaatacatcaaatgcaaacaataatctatgagttcataatggtattcagaaaaaaaactactggtcattagagggaaggttactaggtcactaacttactactctgaaaagtgacttaagatgagaggtagggtggagaattagctatttattcagtctttcctgtacaaacataaatttttagggagattgaagcagatgaaacaaatctggaaaaatggaggtaactgcttaatctgcgggttgggtgcatggaggttcaacatatttcgtttgtgtatatttgaaccccctacaaaaaagcacaagacagaatgtgagccaagcagcttagggtttaggcacggcttctgcctacaagagacactaggatatgaggtgtagttttagccctgatgggctgagccaactggaggtatatagggaggtgctaaattgcagaggtatcatgttgcccagcacttgatcaaatcctagatcctaggtctgcttggtagcatgcttcctaggtagtggatctgaggctacctatagaacttcctttgcagtcataattcgctcagaaactacaaaagtgcttgctcttgaaaatggagtctgtctttgtccatttcatgcttctataaaagaataccacagactgcataatttatgaaaaggaaaaaaggaaggaaagaaaaaaggaaggaaggagggaaaaagtgaaggagggaaggaaaggaaggaagggaaggaaggaaaggaaggaagggaaagagagaaagagggaaggaggaagggaaggaaggagggagggagggagggagagagagagggagggaggggaagggaagaaaagggaggagaagggaaaggaggaagaaaaggaaaggaataaattttatttcttaacagttctggatgttaggaagtcgaaggttgaggggcctgcatctggtaagggtcttcttgctgcatcatcccactacagaaggcagaaggaaaagaaagtgcaagaaagcaagagggcaaaaggggctgaactctgttttataataagcccactctgtgattactaatctattaccaccacaacaacattaactcattcatgaaggctattgtattaggcccccacatcccaactgttgcattgaggattgagtttccagcacataaactttgggggacacatttaaaccacagcagagcacttaggttgattcaaccaagaggagctgggaaaatcaaaggcatgagaaagacagcaaaagctagcagagagaaatgcacaggttaaggaaaaatgtcacaatgaatcctgtagtgcaggctactttatcaaaagcacctaaaaaagatctcattaactcccccagctcacctccacccacatctaaagagccacacacagcaccaccaaaggcagcacaatgagaacagcattctcctcaacagacaagctgggagtatctagatacctgacctcaatagctccagaacagccctaaaacagctcctccctaaccaccactcaagtcaccagcttggaaagtattcagaaaacccaaatcctgacacaccactatgaaacaacttaaaacagcaaagaacaacccatttaaacagcaatgccagctgctgggaaaaaaaggaacaatgagtagaggagaaacagacctcttggggtccaccaagacccagtctctcagcttcagcactttcaaatgcagaatccacacccctctggggcctgtggagctccacaaggcatgtcgtcctcaaagataaatgagcaggcaagctggctagaaaaccactaagggtattattctttaaagaatctttataggttcaaagaggaatgggtcttaactggctatgtgaactccccacagattctgaggatgatgtcagcagccctttccagatgtgtttaacactttgcagttacttgtattcctgccactgagtgccagtgctttgctaatttgaactgattccagctcacgctgaccccagctccctggatgttaccattagccaagactgtcacccatactgtaccctttcaaagagtcctaaaaacagctcttcacctactcttccaagacaagtaaaaatgtctgccaaagaaatggggaaaaaagattcagagtgaaaacaattaacatactaacaagagagcaaaaagcaaagggggaggagaaactaggaaaatcatagatgggctcacacctatttccaaagctgggctaatgtccttttgcttgtgtctgaataaggcaccaattttaagctgctaatgaaaaaaaaagaaaaagaggaagaagcaggcccaggctgggtgcggtggctcatgcctgtaatcccagcactttgggaggccgaggcgggtggatcacccaaggtcaggagttctagaccagcctggtcaacatggtgaaacaccatctctactaaaaatacaaaaaattagccaggcatggtggcgcatgcctgtaaatccagctactcaggaggctgaggcaggagaattgcttgaacccggaaggcagagaatgtggtgacctgagatcgcgccattgccctcaagccagggcaatgagaacaaaattcggtaaaaacaaaagaaaagaaaagaaaagaaaacaaaacaaaaccaccataaaataactcagacttaattaaatacaaccctagtggtgaatgactaaagatggattactcataacagagataacagtccaataagaatccaagaatcttaccttttaataacaaaaaaatcctttccgtcgaaagtaatatcctctcaaggccaggaattccattagtagaaagccttcctaaaaaacaaaattcctggcctggcatgggttcacatctgtaatctcagcactctgggaggccgaggcgggaagatcacttgacgtcaggagtttgagactggcctggccaacatggtgaaaccccatctccactaaaaatacaaaaattagcctggtgtggtggtgggcacctgtaatcccagcaacttgggaggctaaggcaggagaatttcttgaacccaggaggcagaggttgcagtgaccagcaaggttgcgccattgcaccccagcctgggcgataagagtgaaaactccatctcaaaaaaaaaaaaaaaaaaattcctttgggaaggccttctacataaaaatcttcaacatgagactggaaaaaagggtatgggatcatcaccggacctttggcttttacagctcgagctataagaacaaaaagaaaaaggggtatcatttaaacacagtatgtagaaaagaataattattgaatctgtactggtctttaacttttacactttgatctgtaattctgttattgtgattgagtccaaagaaaaatagtatgagtaaaataaaaagaacaccaaaaatgctaatattctgtttaccaaagtccgtagtgaaatatcccattaaatcgaagtgcagtgacttacactcataatcccagcactttgggaggctgaggcgggtgaatctcttgaagtcaggagttcgaggccagcctggccaacatggtgaaaccccaactctactacaaatacaaaaatcaggcaggcgtggtggcagaggcctgtaatcccagctacttaggaggccgaggcagggagaattgcttgaacccaggaggtgagcttgccatgagctgagatcataacactgcactccagcatgggagacagaacaaaacttcaacttacaaaaaaacaaaacaaaacaaaacaaaaaaaaacagctagcaggtgacatttgctacggggagactagggatatgatcttgctgcaatccttccattttagtaaatctaaacagtgtgaatccattctgtttcatccccactccactccagagccaaaacaagaaaatcaattatatttctagttctttaaaaacatatctaactaaatcatctaattaaaagataatatgcatggctccatactctaaaagaaaacttatgttctgcatatcatggacatttgatgaatgcttattcagttgactggtgtagacttcaataataacctgttcaatgcattatgccagatgaatcttgcatctcaaaagtagaacaaatattgttctttcagttttctctacccataaatgcaatatttactaataaaaagaaaatgagtttattgttctagagagtatgagaattttgacaacatgaattctcctgtcctaggacataattaatacttagaggcatactatttcatgtggaagctatcattaaatcaacgttaagtgttaattacttcacataatcttctaatctgacttaagactgaagatgtacctcaggaagctgatttatcaagttgtaaatcttcacctgttgaattcattaagttcatgtctgaaaggtgagaataaatacttaatattcactaggcaatattcagcaaagtaatatccactagtacatatttaatatttcatcacgaactgtgggtgtgaagagaaaagacaggctgggcacagtggctcacacctgtaatcccagcagtttgggaggccgaggcaggcagattatgaggtcgggagttcgagaccagcctggccaacatggtaaaaccccatctgtactaaaaatacaataattagctgggcatggtggcaggcacctgtaatcccagctactcgggaggctgaggcaggagaattgcctgaacccacgaggtggaggttgcagaaaccatgatcacgccactgcattccagcctgggcaaaagagcaagattctgtctcaatcaaacaatcaataaaaatgtaaggaggaaggatttactgtgtatttatatgtctggtattatgtgaagcactttactatcttatcaaatcttcgggacagatcttcagttctcatgaccacaaaagaggatactaaagctcagacaggagaagagacatggccagcctgtgtccccagggcctatggtcttaccactaggttacagtgtttccaggtatcacatgttgtgagatttttgctttaaaatgaaccaaaaaaaaccaaaggcgaaaaaggcataagctattaaaaagtgggagaaacactaagagaaccttaagcatgtaactaaaaatattatggaaatgtcattgaattcattagcaaatttaatgctaggttttcattgaggagtaggttatatttcttatgatgaagaaagtatcattttaagtatattaacataaataccatcaatatggtttatcatgtttaaatgttcacttaaagcaattcagttaaaattctgcatatcatacaattttatagtttgctagtaggttacaagtaaatagtcatccaaataaaaacatcatgtgttttccactggttgttgctctttttaggtgagcatttgatgtataccaacagagagaggataataacaaatcgctaatttctttcattatataaaggtggcttcagaatagaacagtataagggcaatgatgaatttgaaatctaacatcaattcagtgatgcatcaagataaaagtagagacaataggggcaccctggtgagtacggaacattttatttatttatttattttgagatggagttttgctctttttgcccaggctagagtgcaatggtgcaacctcggctcaccgcaacctctgcctcctgggttcaagcgattctcctgccttggcctcccgaatagctgggattacagacatgcgccaccacgcccgtctaattttgtatttttagtagagacggggtttctccatgttggtcaggctggtctcgaactcccgacctagatatctgcctgcgttggcctcacaaagtgctgggattacaggtgtgagccaccgtgcccagatgaattccaaatttaacaaagcagactaagagaaacaattcatttaaaaaaataatatttggccaggcatggcggctcacacctgtaatcccagtactttgggaggctgaggtgagtggatcaggaggtcagcagttcaagaccagcctagccaagatcatgaaaccccatctctactaaaaatacaaaaatcagccaggcgtggtggctggcgcctgtaatcccagctgctcgggaggctgaggcagagaactgcttgaacccaggaggcggaggttgcagtgagccgagatcgtgccactgcactccagcctgggcgacagagtgaggctccgtctcgaaaaaaaaaaaaaaaataattcaatgaaatccctaagatccagggctttgcaataaatatgtaaataaatttccaatctccatactgaaagtttaaaagaaatgctaactaataattaaagaaatacaacttttcctcagctttgcagcaatctagaaacagtgtgtagacactacaaagcaccttacaaggagaaacgtctaaggatggcatgactcgccggcagccctgggcttgtccacagtacctccatgatgaacagtaactccattgtgtaaacgcccatgaacataagattacaggacttttccagtttagacttaccatattttctttcagacaattcttcaatttgtttacgtagatgagcgatacaattattccatttctctgaaaagcaaaagttgattctcaataatacgtccctatgtcagagcagcactaacatataatgacttatttcatatattttacattctaacagtccatatcattttactgctttcaaaaaaaaatttcccttttttggtggttcttagaattggtttaatgggagactattagagaagctgaaaagcaggagggcagaaaagttcaatcaaattaaacacaataacagggaggtcacaatgaggaggtctccaggggtctttcagcaaacttcctaaaacatgtctcagctgtgtgaaataagactttacagcagccgggtgcagtgatgcaggcctgtaatcccagcactttggcagcagaggcaggcggatcgctttgatctcagggcaacatagccaaaacccccctccctagccccacccccaccccgtccctaccaaaaatacaaaacagcagggcatggtggtgggcgcctgtagtcccagctactcaggaggctgaggcaggagaatcacttgaacccaggaggcagacgttgcagtgagccaagaccacgccactgccagcctggatgacagagcaagactccacctcaaaaaaacaaaaacaaaaacacaaggttaagagggaccccagaccttacagatacaagtttaagagggacccctaagcaaaaaatgccaaccctttttctcccaatcattgaaacaccaggagggtttaatagttttgcagcctagctgtagcaggctgatgcccccaagatgcccatatcctaatcccgggaactggtgaacatgaccttatatggcaaaaggggctttgcagatataatgaagttaagggtctttggcttttggggttgatgtactcacccggatccttataagagcaaagcaggtgatggagagggtgggaggtgtagtgacagaagcaggaaactccagtcattcgagactggcagcacaagctgaggagtgcaggccacctccacgaccaggaaacggattctcccgcagagcctcagaagccaccgaccctgctcccaccttgactcagtaggacttactgtagaattctggccttcagacctgtaagggaatacattttggttgttttaagtcactaagtgtgtggtaatttgttgcagcagccacaggaaactagtattgtagtgaagcctcaaaacccccctgaaggggctgggctcagtggctcatgcctgtaatcccagcactttgggaggccgaggtgggtggatcacttgaggtcaggagttcgagaccagcctggccaacatggcgaaatgccatctatacaaaaaatacaaaaattggccgggcatggtggcacatgcccgtaatctcaggtactcaggaggctgagacaggagaattgtttgaaccccggggggcggaggttgcagtgaactgagattccaccactgcactccagcctgggtgacagagcgatgctccatctcgaaaacaaaacaaaacaaaaaaaccccacctgaaggttttcagttctgccagcagtctcccacccaacccccagaagcagacattccattgctgtgggccatggacaggcagaaggaagcgcctcctcatggcagaggcctacccaggagaaacccaagggaaggcactgccaggctggcccctctctgccaaggccatattctttttttttttttttttgaggcctagtttcactctgtctcccagactggagtgcaggggcacaatctcagctcacttcgacctctgcctccccagttcaagtgattctcctgcctcagcctcctgagtagctgggattacaggagtgtagcatgcctagctaatttttgtatttctagtagagatggggttttgccatgttgcccaggctggactcgaactccttgcctcaagtagtccacctgtctcagccccccaaagtgctgggatcacaggagtgagccactgcacccagcatttgccaagacctttgatggcaggctttttccaggtgatcagtccttgtctggtctggctctgccccactctccttctcacctagttggaatccctagctacttttcagtagagaagagtgtgtaccccaatcccagcttggttcagatctgcacttaactaatggaacctggctgctccccaggtcctgaaggagaaaagggtctctctgtgggtatgataaaggatgggcctgtccccaggaccctgtgagagggaagcccaatgtcccaccaggttggcagggctgggcaagggaaagtgttatggtagccccaagaaaaaaagaggcagcagagggagcaggacagcgctcacatggaactcatgccactgcctgagtgaggggagggaggagtgcacgccagtgacgtcaggggacagagaggcgcagttccagggcggctttccccctcacttcctgccatgttactctgatcgcctccaggtgagcctgcccactttgtgcccaagggcctgtagaaaaccacagctccccatggttatggccccaggagtggggcagagcagagaggagtcctggacagaggagaggcaggggaaggagggagtgggcctcaaactcgaggagggggcccttctcatgggtcctgctttctggcttctccttccttacccctgggctgatcacttggggaagaaattagacaaagtttctcaccctcaggcccaaggggtttaattactgggcccttagggaggtgtgagccccctgaaaggatgcaaggttttgtttcgttttgttttttgagacagagttttgctcctgtcgcccaggctggagtgcagtggcgtgatctcaccacactacaacctgcgcctcccgggttcaagtgattctcccgcctcagcctccggagtagctgggattacaggtggctgccaccacgcctggctaattttttgtatttttagtagagacgaggtttcgccatgttgggcaggctggtcttgaactcctgacctcaggtgatccgactggctctgcctcccgaagttctgggattacatgagccactgtgcttggccacgatgaaaggttttgtgtggagagcatatacatgcctttctgggaaaacagtctacagctcttattctcagcaggcttcacggtcaaaaaaggttagaactcttgctacagagctgtggaagcagctaggtgaggggcctgccaagggcactctgggcactacctgggcactctcgagcccatcatcccctaggcaggctgcactgcttggtatttgcagagctgagggggtggggcatgtggggactgtgaaatcgccctgagatgacccacagtcctcagctgggaagtgagcggtgcatctcctgcagcgtcctccatccctagagccaaggggccaggagaactggcccttgcagcaagtgaaaagcctattattgactccctccctagccatgtagacagtgaaccaagacactcatatcaggtaaatgccttggtctctgtcaccgaggtgaccagtaggcattcccagatacagtgaaggtcctcacaccaagatatgcacctggccacctgaggaaagagaaaggactatctgaggggatggggctgagctgggtgtggagtggtccttgtgggtcttggtgagtgggagggggagcagcatgagccaggcctcgaggcagaaggacaaccaggagacagcctggaaaaagtgctggacccacaagggctcaaggctggccagaggggaggtgggataggctgcaaagtcccgaggtctgaagattggccctggcaggaagaaaccagctaaggtggggtgttacctacaccctcggggccagatgcaggccagagccagccaattaccaggcccttagggaggtgtgagccccttgaaatgatgcaaggttttttgtttttgttttggagacagagtttcactcttgtcgcacaggctggcacctttgcccagagcaggcaccaagatttctggctctgggtgtgacctcagtctgggtaaaagccccagcccccaccaggaccacctaccccctagactacttcaggtgctgagcccaagccaggggcaggaagctagactgatgcctagggtaatcccaacaaagtccctggttccccgcagctatggggctgatgggaaattacagcccaaaccccagatgctggctgtcaaactaacactgagccctcagtgcccacagggagatacaatcagcgcactttccagatggggaaatgggctcagagaaatgcaacagccttgcccaatgccccagaccagggctccaggcccagagtgttcttttgttactgtgtccagagggcagcagctgctgtgatgtacccacctgagcctggcagctttctccaactttggaagcccaggagcatggcccctgtccacagatgcacctggcatgaggcgtgcccagagggacagaggcagatgagtttcgtctcctccactggattgtgagggcctagaaggagacaacggtctgcttgagaaggcagtgaatagtgagcaacctgaggcagtgcccctctggatggatccacagtgcctggatggaacctggctcagacagagctcagttctgcaggtccctgaggcatggagagttcacagctaccaagtgtaggagtctggattcaaagccaacggtgtgactccaaagtccctgccctagcccctggaccacccttgcaggcccatcagatgcccaggccagcagcacagccggccaagaccagggaaacttggggagcctcagagcacccccaggtattccaacctaatcctggtacccctgcctctcaccacccttcttcctgctttaacctcaatccctacacaaagcctgggccacttaatgtggcatcaaacagatgcctcaataaatcagagtctaatcttgaaaaaaaaaaaaaaagacttaacagatatacaactgcacgttagaatgctaaagaccataaacatataacaacttaaagtacatataaattcaatatatatccaatcattgtgactatgacacagtagaatattaaaatactattttcaaaatgtatacaagcttaatgttctatgtattcaaactatttattcaaaatataaatcatcaacataatttgccactaatattcagtcccttcacaggacacgtgattcactgggagttaataaattagcagctggcaggcagtgacacacagcaaaaatgaaaaccaagaggtgaaatagttctgaaataaaggttttaaagctaacagaaatcactgaattactaagtcattagcactaattttgagccaactaactaattaatatgagatgatacaacgtcctatactttggtatatacagactatgtttaaacaatgtctgaatgtctgtaacgtgactttcaaaatgctcctggctttacaaagatgtgattaagatgtagtaatacatgctaaaccatttccccctgcagagcatgtggtaactttcatcagtcacattgagagtccagaagataaaggaaaaggtcgtggatttcgctgagaacttgccagagttgaactccctcattttccgttccccagcattagcgggttctgggactggtggctgtggtggctcgttggtctttgtgtcctagaaggtggggaataatcatcatcttgaaaaagaaaaaatggtcattactgaaggaaccatcttagtttacagccacctctgggtcaattcccaacattcaaaagctgagcagggctttaaagctatcttaataattatttctgtattgcaaacttcagcaatcttttttctagttacatttgaaatgttattcttttgggatgtgctcaagtgaatactgctttttcctctgtcttgcttcattactttttagtttgcttcaattgaagcatcattgtaagtctccccttctcctcaaataactttaaattgctgccaagaactatgttctattttaaggcttttgagaaaaaattttcaatgaagatagccacctaaagttatacaaatatagaagaaacgggataaaataaagcttagattggaaaaaatatttaagattatacaaaattcaagcataaacaagggaaactgagtaattgtatattcaaatacttttaacaagtgcaaaacatgtaggcttaaagaaatagagctggccaggcatggtggttcacgcctgtaattccaacactttgggaggccgaggcaggcagataacttgaggtcaggaattcgagaccagcctggccaatatagtgaaaccccctctctactaaaaatacaaaaattaggccaggagcaatggctcatgcctgtgatcccagcactttaagaggctgaggaaggtagatcacctgaggtcaggagtttgagaccagcctaaccaacatagagaaaccccgtctctactaaaaatacaacattagccgggtgtggtggcacatgcctgtaatcccagctactcgggaggctgagaaaggagaatcccttgaacccgaaaggcaaagattgtggtgagccgagattgtgccattgcactccagcctgggcaacaacagcgaaactccatctcaaaacaaaaaaagaaaaaattagccaggtgtggtggcacatgcctgtaatcccagctacttgggaggctgaggcaggagaatcgcttgaacccaggaggctgaagttgaggtgagccgagactgcaccattgcactccagcctgggtaacagagcaagaccctgtctcaaaaaaaaaaaaaaaaaaaagagaaagaaagaaagagggctacattatttatgaaacagatactgttaactcagtcaccagaaagcctgtgtataaatgagcagtgagatattcaagcacagcacacacacacttctcaagacagctgtcgtgagagttccaagctcgtttccttctggatacatcagcaactcactctgctatgatcctgcaatacatctcatgttagaattagacacatctgggccaggcacagtggctgatgcctgtaatcctaacactttgggaagctgaggcaggcagatcacctaaggtcaagagttcaagaccagcctggccaacatggtgaaacgctgtctctaccaaaaatacaaaaaattagctgggcatggtggcgtgcccctgtaatcccagctactcgggagcctgaggcaggagaatcgcttgaacccgggaggtggaggctgcagtgagccgagatcatgccactgcactccggcatgggggacagagcaaggctctgtcaaaaaaaaaaaaaaaaaaaaaaagaaaaaaaaaaaaaacagaaacagaaaaagaaaaaagaattagaaacatctgaatcaaattagctgccagtctcgcaaagtgtcgggtaacatcctattaagattgctgcttacacatcatctataaaatactgaaaatatcattttaagaaatcttttttttattttgagacagagttttgcacttgttgcccaggctggagtgcaatggtgcgatatcagctgactgcaacctctgccccctgggttcaagcaattctccttcctcagcctcctgagtagctgggattacaggcatgcgccaccacgcctggctaattttgtatttttagtacagacagggtttctccatattggtcaggctggtctcgaactcctgacctcaggtgatccactgaccttggcctcccaaagtgctgggattacaggtgtgagccaccatacctagccaagaaacccttatttgaaaacaagccaggcgcagtggctcatgcctataatcccagcactttgggaagccaaggcgggtggatcacttgacgtcagtagtttgagaccagcctgggcaacatgttataaccccatctctactaaaaatatatttaaaaaattagctgggtgtggtggtgggcacctgtaatcccgggttctcaggaggctgaggcaggagaatcacttgaacctgggaagtggaggttgcagtgagtggagatcatgccactgcactccagcctgggtgacaatagaaagactccatctcaaaaacaaaacaaaacaaaacaaaaaaccactaaaaaaagactccatttcaaaaacaaaactaaaaccaaaaacacaacacaaatgtagtatacaaatgaaaataattactgtgttaaacacagtttcatagaaaataaaagaccaatcaaatacaataagctgcctttttagatgggtatgttattcttcttttacagctaaagaaaccggctcagagaatgttatttgattggaccgtgttgcatctctggacagtgcagctgagatcagactttgtgtgtaactccactagcctaccagggtgcctctcataaaggtaagaaatgtaaatttggcctaatataaaaagttgccagggcagcactgggtcaattctacatacagtacttctatgttcatcaagggaaaccttaagggaaagtgaaaatgcttctagaaggtgactggacaccagcgcctttgcttgttgcctttgggctcttcttctaaggccaacagtgacctgaaattattgactgacttttccaatcaagtggacaaaatggtaccaaggtcgccaacatcagacaaattcacttgagggccttatctatgtgccttgaaagacaaaactgcttttgtaaaggatactgtatttcagaaaaacataatcatattaacaactaataagactgtaaaatgctgatgtgttgaatgctactttagaaaaacatgctcaaatctagggaaaaaatttgatacaaaactacgtatcaattatctagctagctagctagctatctagagacatgctttcactctattgctcaggatgggaagcagtgggattatcatagctcactgcagccttgagctcctggcctcaagtgatcctcctgcctcagcctcctaactagctagggccacaggtggacacagttactcctgcgtttttgtttgtttgttttgtagagacagggtttcactacattgcccaggctggtgtcaaaactttggagtctcgctatgtcgcccaggctggggtgcagtggtgcgatctccgcccaatgcaacctccgccccccgggttcaagtaattctcttttatcagcctcccaagtagctgggactacaggcatgcgccaccacgcctggctaatttttgtattttttgtagagactgggtttcaccatggccaggctggtctccaactcctgacctcaggtgatccacccgcctcggcctcccgaagtgttgggattacaggtgtcagccactgagcctggcggagcactttcttatgttattaagtagcctaacccaggtggggcgctgtccctcacgcctgtaatcccgacaactctgatggccaaggtgagaagatcgcttcaactcaggagttcgaaactgacccgggcaacatagcgaggccccccccccaccccatctctagaaaaaaaaaatacaaaaattaggccaggtgcacaccgcgcccggctaatttttgtatcttttgtagagacggggtttcgtcatgttgcccaggctggtctcgaactcctgagcccaagccatccatcctcccgcctcggcctcccaaagtgctgggattacagtagggcccagccagcctcatgttttatttagcagtccctccctgttgcacacttggatagttttttaatttttttacacagggtttacctcaatctcgcaggctggaatgctgtgatgggatcatagctcactggagccttgaaccgttgggttcatacttgagggctggggggctgagcccccctcagctggggggagctgaggtaggactacagagatggggttgcgccatgttgctaggctgctcttggcctgaagggtcctcccgcctcggcggcgccagacatagttttctatttttgaccaacataaacactgtgctgggtctgaatttttcagctacccttcttcggctggcaacacacaggacctggcggggaggtcgctcttaccagtccccactctgacgagaagactgcccagctccaggcaccgtagggccccagtgacgtagccgaacacccacgcctctgacgtcgccagaggcccacctctatggtgtcggcgaaggcgcgccattgtgacgtcacggaaggcgcgctcttgtgacgccacggaaggcgcgctcttgcggcgtcacggaaggcgcgctcttgtgaggtcgcaggggaccgccactcacgcggagccaatcggaactcgcggcggggctgctgggtcttccaggagcgcgcttgagcggacgctgcctaccggtggccgggcgggatgtaacccgctgctgagctggcagctctgtgtcgctaggcttcggcccggccgccgccgcacataagctgcgaggaggagctttacgacttcccggtcttcggggccgggcgcagcaagggccagactctgcgctagcaggcgctgcgcgccaaccggccggcacctgtcgcagaaggtgcaaccgatcgcactgtcgcgccgaagctcctcaatggccagcgccagctgcagccccggccgcccactcgcctcacctgagcctgggtacgtgcgccccacaacacctcccccaggcagggcccggggacccccgggagcgtccccggctacctggcgccgctcatcctgggtagggttggccccctctgaggctgcccggcatgagggagctgcacccctgagcttgacctctgacggccctttgtaatagcattaagtctttgaaactttgtagcggggtagaaggggctaggaaacgaagaaaacatctttttaaaaatataagcggtcggctgggcgaggtggcccacgcctgtaatcccagcactttgggaggtcgaggcgggtggatcacgaggacaggagttcaagaccagcctggccagcatggtttcactgaaaccccgtctctactaaaaacacaaaaattagtcgggcgtggtggcgggtgcctgtaatcccagctactcgggaggctgaggcagagaattgtttgaacccgggatgcggaggttgcagtgagcggagatcgcgccactgcactccagcctgggcaacagaccaagactccgtctaaacaaacaaatatatgtgtgtatatatatgcgatcgagcccgggaggttgagattacagtgagctgagattatataagcgatcaagcactggaggttgaggttacagtgagctgagattgcgccattgcactccagcccgtgtaacagagggagactctgtctctaaaaaattatatgcaagtgagcgcttttcttccagcgctcatgctcagactgaagaaagtaattgggccaggcctggtggctcacgcccataatcccagcattttggggaggcggaggcggaggcggaagcgggtgggtcgcttgagctcaggaattccagactagtttgggcaacatggtggaaccctgtctctacaaaaatacaaaaaattagctgggcatggtggcacgcacttgtagtctccgctacttgccgggcttaggcgggaggatcgctcggctgcagcctcgacctcctggggcaatccatttcagcctcccaaagtgctgagattacaggaatgagccatcgtgcctggctttgcactatattttaatactttttttgaaaatggaaacttttacaggcaatttacttcaaactaatgataaggaagtgatgctgttctgttctgttttgttgtttttgtgtttttttttttttcttttttgagatggggtcttgcccaggttggagtgaggtggtgcaaacaaggctcactgcagccttgaccttctggctcaaggaatccttccccgtcagcgtccccggtagctaggactacaggtgcatgctaccacgcttggctaattctttttttgaaatggagtctcactctgtctcccaggagtgcagtggtgcaatctcggctcactgcaggctggtctcaacctctgacttcggatggtccacccacttctgcatcccaaagtgctgggattacaagtgtgacccaccgcgcctggcgattttgctcattttagatactagaactttttaatttaaaattttttttttcctgagatggagtctttgtctccaggctggagtgtagtggcgtaatctcggctcactgcaacctccgcctcctgagttcaagcgattctcctgcctcagcctgccagagttgctgggactacaggtgcgcaccaccacacccaggagttcaaggctgcagtgagccatgatcgtaccactgcactccagcctgggcaacacagcgagaccctgactccacaaataaataaatcaacatcatatgatctgtaccagggtataggcaggtgctatgatccccacttttcatcctcaactctaagttgagtcatacatcaacctctagtaaaaagtggcatgctctcagtcaaaggggtaagcccaaaccacgtggagagaatcttatctcttttgagagctaatataaaaagaattcctcctaggcataaaaatattgtgacatcagttacttaggctaaacatgcctattatgctaagtgagttattaacaataaatactttaactctgtgccatgttacttatcataatctgatttataatttgttttaaccttaggttatatataccttgaagccatttatattttggtatacttgtaataattactatacactggactatgtatattggactaaacacggagagtcaaaaaagagtatgtggtcagagtagaaatcatgccctagcttccttcgtgtctacctcctaccttgagtagaagtggtagaaaaagtaattacctaagattttttggattctggtttgtggagaagcacccttatatttaggctgatgggcggcaaaattagaaagtattttttgtgatttagacttttatacagagatgttcattgtgattaatctttgtattagcagatttttgctttttatagctgcatgatttcttgtttattattcattcattattgtctattaataaagaaaaactttatttcactgaagcagtgatatataatccaacttggatttttaaataatgactgacttttttctttgggaatacattactgttaaaaatgtaattattagatacattacttttaatgaatataagtggtataattagaaggctgaaaagaatccttggaaacgtgagtttaatttgatagctaagaaactgaggacaagatacttattctttgtagcatattttctaatgtcatttcattgtctcaccaagaaatacttgcataaagcaagttcaattacagcatctgttgaatatttaaggttgggtaaagtgggtgagtttaacagatattttcccttatttcttttaggcgaatctggattgggaaagttgacattaatcaactcattattcctcccagatttgtattctccagagtatccgggtccttctcagagaattaaaaagcctgtacaggtctagatattggtatttttaattgatgataagctggaataatattaatacacacaaagcacgtgttgtaacttttattatgcttccttagaggtaagatgcaaatttgccctcagccagtgtaagatggtaaatatgacttcataaaattaaaaaaacagaagaagtacagttaatcgaattatcttgactagaactttccaaatttgtcctaaggattctcctagagatgacactgtgacatagtaaccaattcccctggagttgtgctatgtagtatgatagtcatttgccacatgtttaaatcaattaaaattaattaaattaaaatgcaatttctcatttgctccagatatatttcaagtgctcaacagccatatgtggcaagtggctgccattttgtgcagcacatatatgaagattttcatcattgtagaaaattgcattggacagtggagagaaaacatgattcatagaaaaactattgttatttaaatacagtgttctatattagtcagtgggataataccatatcatagttgaatggcaatagcaattctgtaagactcccaagctatatgtgatctaatttactgcttctcagtctttgctatgcattccaatcctgggtatcctgttaaatttatttcttctagtagttctgagatgggctgcctttctacatttctaacaagatcccaggtgatgctgatgctgctggatggtagatcacactttataaagcaaggggctagactctagatatgcactttttattaaatagtacagcagcctgtagccacatgtggctattaatctttgaaatgtgggtagtctgaattgtgatgttctgcaaatataaaatatgccacagatttctaagactgagcatggaaaagaaaatctccgtaattttttatattgatcgtatactgcagtgataatattttggatgtatcgggttaaataaaattgactgatttcacctttttcctattttaaaagtggctactaagaaaattttaaattacttacatgaccgacatggtatttttatttggcagcgctgctctaagctgttgatgaaaaatattgttggtgagctctgcttaggtaatatataggacacgagcagagaggaggcacgtgaacagttctggctggagtaggcttcattgaggccatgatgcttttagctggatttgaagaagtggtagtgatcatcccagtgcacaggataggaggacagtctatatattctgagcagtaactcatatatatcatactgcaagaccccaaaggagtaattttgtgaagtaaatcttatttctcctttttaatgtttctattttaggaatttttttttttttttttttttttttagtaaccttcagagggcttgagatttcaaattacctgcaaaattctactctaaaaacttgatcctacatgcttatttattttgtgataaatattggaaattttaaacctaagcaagaaaatgaactttgaactttcttaatttgggtatctattatgaataccttcacttaagtatttatgaatttagatatgaaaggtaaaactaaccactgtccaaattaatatacagttcatttccagaaccctagtttcttccatgtgctcactcgcattcagtattacaacccccaaagataaacaccttactgactgccttctccataaatttgcctgttcttgaacgttatatacgtatacttttttgtatctgttttctttcagtgaagattatgtctgtattatttactcatgttgggtgtagttgtttttttcatcgtcgtataatactccattgtgtgaatgtatcagtatatcctttattatttattgtagataagcctttgggttttcagttttttactaacgggaacattcttgtgcatgtcttagtagacttaggcactcattgctgttgtgtgtgcataaagatataaaggtatttgagtttattttatttgatttctagtgaggttgaacatgtcttttgtactcaataacttcagatttcattaaagtcttttggtaatcttaatattttctgtcattttcttgctgatttataggagcttgaaaaatcacatttgagaagaggattggatcctagccataacataaatataagggtaattacatccatgctgagaaagatttaggaatgatagtaagttcatttgagtgagtggtttgggccaaacttgatagagaatagtctaggaagacatttactataaacggtagattaaatgttcttgcctgatgaattacatttgaactctgaatgactgaatcactcaaactgcttatttgtattattaaatgcacatttaagttatgtattacatgtctttagtggtgatcactattttatcagttcctctgtctttctttataccaagtatgactcataaacccagtattaatttgccaagagattggcatactatttgtatatatgcttttctttcaaataatctggatttccaatgcccacaatcattgatcctaaagaaaatgtgggagtaggtaaactcaaacatccctaccatcacccctggtaggaaatcactggtgtaatgtatgatattaacatctgcaccaattactgttataggtggaaccaaagttttaatcaaagaaggtggtgttcagttgctgcttacaatagttgataccccaggatttggagatgcagtggataacagtaattggtaagaaggatttgtcctcacaactttccagtgtatttggggtattggggtggttaaactttctcttcttaacattttaaaactcttcttagcaaaggtcaccaaacttcaagtaacatgacaggtttgtataccaactttgccacttatttgacaaagtttaacttcaaagttaaacaaagaagtttaacttctttgaacccatttacttttcgataaaatggagataatacctatcataaaattgtttttaagacatattccaaaataacgtagctagatagaagaattctcattattgtaagaaatttaaaactgtttgctttaattttatccatttgtataaattctatctcaatcctaatttaaacctgatatttagaccttcagtttttccataagtcctaagtgaagaaaacaactatgaaattttagtctgaagtaattatcttagtattttataaataacttttatttttgtttgaattcacattgtttttgaggtatttttctgtcaactcttaaaactcctaagttcatcatgaagtttttatattatttaaagtaatctctcatttgaaatttgaaactgaatataattgttttcatattatgaagtgtgttattaatacacttactagtgccaataatatgctaataatttcagcaataaatattttctttcatttggaaagttttgaaataatgaataaagatttattcaacataatttatatttttgaatctttatatagaataacttgacatatcttcccttggtaaattcattttgcttatttgaaaatattgattattgtcctttaacagtcatcagttaattcatatgtagaattgcaacttaattgttttgtttatttgcattctatagctggcagcctgttatcaattacattgatattaaatttgaggactacctaaatgcagaatcgcgagtgaacagatgtcagatgcctggtaacagggtgcagtgttgtttatacttcattgctccttcaggacatgggtcagtaacctgatagttctgattcctttttgttgttgttgcttactgttacctttatgtgcatatttgagtaatctttaagtttgtgaagtacatacaactatacccattattaagtaccaaatttcatgtagaaatgtcttagttgaaaagcctttttaagtcctgtgtaagctaacagtgattttactccttagttcttattcataaggattttccctgcttcatggaaataaacagtgttgccaccatggtttgaggtctcaatgtggcaaatttagctttcatgttgaactaccaaataaagagaagcagccaaaccagttagacatattcaaaataaatccaaagatgctatttattataagtctcataagagatggttatcaaaagcacttgcatgccaatgttttcttgtgccatttctttctgcaagaaatctgtttggcttctgtttcaccttagctgtcatagacatgtcgtttaagtatcatattgtcagtactaaccttttgtttattaggacataagacctaagaatctagacattaatctgatgtgattgttctgtttgttatagttagcctgtactccctttttttgttctttgtacttcccctttcattttgagtacatatatgtgtcatttgtaactgcagatttttccaattattcttcctcagtcttttcctttgggtaagtaactcagcatacataattcagccacctggtaattgtaacgccaccatctctccactaaaagaactgtagtagcatcaggctaaatagcattaagttatctaacacattacagtagagtaaaccaattccttcaggtatacttttctcttccatttttggcttctcactctcttttttttgtttgtttttatagatgggtcaatgcccattatcactctagatggataagggagccttaattatatacttatatttttgcactgtcagattggagtggggtaaaaatgtttcttcttttatgtctaatactctttttttttttttttttttgctgtgccgtagaccattacataactgaagactcccaccttcaggcaggattgggtagtacgtgtttgtaactacctggcattgccttttgttgaggtaatttcagtttttattattattagtagtagtagtatactttaagttctacggtatatcttcacaatgtgcaggtttgttacatatgtatacatgtgccatgtttgtttgctgcacccattaactggtcatttacattaggtatttctcctaatactatccctcctccatcccccaccccacgacaggccctagtgtatgatatttcccgccctgtgtccaggtgttctcattgttcaattcccacctatgagtgagaaacacctatgcggtgtttgggtttctgtccttgcgatagtttgctcagaatgatggtttccagcttcatccatgtccctgcaaaggacatgaactcatccttttttatggctgcatagtattccatggtgtatatgtgccacattttcttaatccagtctatcattttatggtgttctcagtttacatatttaaatcactaaactgactatttgacttaaaaggctcaaaaaaagtcatctcaaaaatacaacacactgcataaccttttataagtatttgtgtagcttcttgaatttatatttttaaatcattctcatttaacttgtcagggccttttcctgaaagccagcagagtgaaatcttaacctgcagttaagccaataaaatttgtcagcttataaccaattttattattttagattttctggactctctccaactatagtaattctcatgaaatcacattcctgccatccccttggggaaaattttatttcttaaaattgcatgggaaatgagagcttttttaaaagaaaaaaatttttatattcaaatgagatgtagtggctttgtgccatttcttatttgtcacaaggggtaagatgtttaaaattgctatatcttatatataaaaatgtacctttgaataatttctcagtttaactatttttagaaatggagcaaagttttgcccattggtacatgatattgtggattaagtgaaagaatatgaggctgggcgcggtggctcacgcctgtaatcccagcattttgagaggcttaggcaggcggatcacctgaggtcgagagttcgagaccagcctgaccaacatggagcaaccccgtgtctactaaaaatacaaaattagctggccgtggtggcgcatgcctgtaatcccagctaatagggaggctgagtcaggacagttgcttgaatctgggaggtggaggttgcggtgagccgagatcacaccattgcactccagcctgggcaacaagagtgaaactccatctcaaaaaaaaaagaatatgacacagaattttatgtatagagttccaggtaccctgctcactacggactgaaattctgtgcagtctaacaaatgaatcagagcctttccatcttgtctgggtagtccctagattccctttttagagggttttgtttttagagtgattataaattcgtccaacagtgcactttcagtgccttctacctccctctaccaagtatgaactgcatgcatggctgatttatgatttcggctattatcgcttcatgtgcgttgttcactattttgtaactgttattaaagtaaaatactgacttggaacatgaattttaaaatggtgttttatccttctagtattgattcccagttttagaaaaattggtgtcatccagtgagttttatacagaaggattttttcccttagaaatatatacatacatacaaaaaaaatttgtcattttccctgtagttgtttattatgctgtagaatttgaggctaaatagtcttttctctctactgtgggtttaccttctagaaatgataaaggattttctattgctaaaaaacaagatttaaaaactaaatttgttgatgaaaagactagccaatataaatctaaatggacagagggaaaaaattcacccagaatgtaatacacatgtgaactaaatgttttctgttgctgacgttttgtaggcttctgaaatttaatgagacttttacaaggtttaccttttttcctaaagtttaatttttaaactgacttaaatgttttttgaccctttggttatatttaagaagttgacttctctaatttccttgtcatgtttatttttaaatatctttctctttaaaagttgggatactataataaatattcagcaagtattttgcatttaaatataaaatcttgttatttggattttaatactttatattaaatgcctttaagatttattaaaattttagattaactgaactctgcttttttgtcactggattaataagcaggcttgtatctgacataatagcttaataaggcagtgacaatttaaatttgtcatgagtataaattgaaaaatcataatttagaaatcggagattgaatatttcatggcatttatatttagtgttttatataatgattaatgaaaagaaggaaaacttaaattttttttcaaagatggataggttcaggccagatgcagtggcttactcctctaatcccagcactttggggaccaaggcaggaggattgcttgaggccgtagactaggcaacatagtgagatcctgtctctacaaaaaattaaaaaattaattggggctgggcgcagtggctcatgcctgtaatcctaacactttgggaggctgaggcaggtggatcacctgaagtcaggagttcaagaccagcctggccaacatggtaaaacctcgtctgcactaaaaatacaaaaattagccgggtgtggtggtggatgcctgtaatcccagctactcgggaggctgagacaggagaatcacttgaacccgggaggcggaggttgcagtgagccaagattgtgccactgaactgcagactgggcaataagagcgaaactcaaaaaaaaaaaattagttgggcatgggggtgcactcctgtagtcctagctactcaggagtcgaagtggaagaattggaggctatggtgagctatgactaagccacttcctcaaatataaggaagaatataatctgactaaaggattgtctttaaatttaaaaaacttagccttatgaaaacttattacattgtcctcattttgacatagatcagtaaaaagttcattgaagcctgacatttgcagtccgctggaccagatgacctttaatgttctttctaagattcaattgctatgaatttggaaccttgctacaggatacccagtattcatttgtttgtctgttatagtgcattggagtgtattcttatttttgtttaattaaatgtacattgggcatctctcatatcacaggtgaatctccccagtgatagacaaagacatttaaaatatttaggagtaataatggcccacaaacgaggtaattgtgaaagaagacatgtggatcaatgtgtgttgaaggaagtgttacatatagggacaactttgaggtacatttggggacttaagaagtgaattctggaaataggtagcatttatgtagtagtttaaaaaatatctgatgctgggaaatcactccacctactccctgcaaaatgccccaaaccttttgtttctgatgtacatggtaggcattcagtaagtttagtaaatgtacttttctgaaggtgactgtaagtttactcatctatggctgttacggatttacactagtagtgcttatgaagaccactgaacttctttcttaagatcaggcagaaggttttttcaaggtgatccagagaaggaaattcactttatgttgcatttctgtagtgttctaccaaatccaaatgcatttactctttatgatgaggtagtttgagtttttaatttatatttattgagtgcctactatggccagattttggggatatctcagaaaacaaagttccttttcctatgattgaaactaatagcaaacaaatatgtaatattgttagtagtattacagtaaacaaaaatgaagcaggataaaagggtagagaataataagaataataattcagatagggtcagggtgtctttgacgaggtgatattttagcacaatccagagggggaatagcattccagctagagagaatagtaagcacaaaggcattcttgaattcttcccctgatgagataattgctgcagtgagtgggtccgtaactttttgtgtgttacgcactgtactttcttacattttggactattggcatttgctaaaatattcctttgaccagttccattctctgattttaccttgaaaaacaagcccctgctttttatgatagctctttttcttgttttccttctctgatttttaggttgctaaatgtgatttgcatactttatcacttaatctcgcttagtcttgtcaacaaccttatagtggtaggtgtcttatttatcagatgaagaagtagagtttaagttactttctcaagcttatcaagtattagaaaaactgggattctaatctctctgttgtatcacttttttctgtcttgcatgacttctcttctatcactgtttgtgggcagtatttcctcacggaagtaggccttggccagttcttttcaatcaactgttaatctctgagctctagctccatctatatcttaagtctgggctctaggtctgtgctttggtgtggaattttgaacttctcacatctctactcttagctcatgcctctaaacccaatacatccaaaactgatgtttgttcacaaactgacttcattttataacatttccacttattcaatgggataaccattcttctggtccctgctaaccaaaacactggaatagtctttgatttctctctctttcttcatcctccacatcttatcagttcccaggaactgtggtcttggtttcaagtgtccattctggttgctactattctgatgaatggatttcatcacttgatacctgaactttttcactggtcttctattgagctctatgtattctctcctcatccttcagtccccacactgttttaaccctccaacatcttagagtcatgtgaagtgacttatcaaaaccagagactcaggcagtcacagcccttcatcattttatcttatcctatatatccaagatcatcatgtgcttttaaaactctcccttgtccacaagccaggattctccagccttttcctatgcttctcttcttctctccccgttacaacaacttgaagttcctccaaggccccattggagccccatctccttcaccaagtctttcctctttactccaactcattccagctcatcgttgcattcctatggtgtttgccactgcacctatgtactgacttgtgccattccttagtggtttcccacgtaccttcctgtttagatggtaaatggaggaagatctcagttcaggcttcctaatgtttcttacccttcttagtacatggcatgcagtgggcatctaggcagcacttaaatacttaatttattggctttggtcattttgaatattgctattaactttgaattgaatgttgcaattaaaaatgaaggccaataagatccataaaaatatatctgcatattcaatttagatcctgaactcaacaattttcttctaaactttgtttatattcatatagtgcctagtgcctatacagctccctgagataggtaggtgaggtattactatctttgactttcatattacatttcacatcagacatatttgtgaaataaattttataagtagtctgaagcccagagaggctaagtgactaatccagggtctcttggttagtatttggcatagacagaactacaattttgggcttctttctcattctggttctcatctagtaccttttcatttgagtgctggaaaatgtatcccagtcaactgaattgtggagtcatattgcctcccccttaccaaccaagtgatggcaatactaggaagaggggcaaaagaaaagtcagaaatataagtgataaaataaatggaaatgtttgaaatggatcatcgacctccttttacctattttagcacctcacaaatatcccactctgacagtgctttgttagttatttataaaatattccttaggagattggtcttgcataagacatgcttttaccgtggtccttttcccggtaatagtcactgtcagggacaaaaagtgcctgattgtgttctgtttgtcatgtaggtgggagggaaagagggagagaaagctgagttgaactgaagcagagctttttacagctctattgttctactgtcagagagcaattatactccaacttccatccacctcagacatcccaacctcctcctcctgccaatgcttccccacacacttaacatacagccacacaaccgagttctctggggagaatagggtgcttttaatacctccctctgcccttcagtgagttcagggctctgctttttaactgctaatgtattttagtaaagtttggcaattcaagcttttctagatgtttccttttcggctctggaaaattggaaaaaataatttttaactatatatatttaaaatattcagtggcattatgatattgtctgaaaggcattctgtgacttgatgcaagatcagaagttttttttctttcttggagaagtaataaaaagaaaaaagagatcgaagtttttatctcacaagatacctcatattcagttctacatactgaagacctaatccaagttcttacatgtctatagggcaaatgttaacatttttaaaaagctatatttatttggtaatatgaacatatgtttgtagattagttagtctactctttccatacctaataaaagtttaaattccagacatgtgaagaaaatttgcagtgtgtctctttgccttagctaactgcaaaaattgaaatcacaaccctaccatagacccaaacgtgtttccaattgagaaagtcttctaccttcacagcctctaagtaatatagtggttatttgtttgaaggatgtgagagtattttgttgagaaactgtagaatgacataacaaattttagttaaaatgttagttatggttgactctgtacttctgatatcctggatttgtatatgagagcaatgctagtaagatgcctgcttctgaatgcaagtttggctgggaagacagcagagaaatagaagaaatattataaagtaatggagaaacctcaaaacagtacagcatggatgttgactttgaaaacaacagctgctgacgtgaacttggcagaaatttgtgagtaatagtgggtgactcattgcaagcaggggagtcttgcagcttttgaggtgaacaggcaaaggggagaacagtgatggtggccacccaagggccaagtgtttatgtcctaaatgtcaaaatgtctttgatctcctgttaaactttgcagctgcatcattcacatgaatagttgcatttttttttttctaaaaatgcaacatattttctaaagcatttgtttttaatctgggatgattctgaggtgggaggtaagttggtggcaggacatactacatgatttttgttattgttattatttttaaaaatcacgcattgctggctttcccctatactcctggagatgccatcatgtatgtatagctaattctaaaaagggcttgtgtgactcttcatatgagaaggggtggttatttgtggcttgaaaaaattgcttgggtgattctgatctttctctttcactctgctgaaaaccattgtttcaaagccaataataaatatctaaagaagttttacttcatttctgtggtgttctcagaattgttacagtaggtttaaacctttgcctggtttggaaatcttgactatttgagggagacagccctgttagagtctttattttcttcctgtctgagaattcagttatcatcaatagtgtattcttaggcagagtcagaaagtcacctcatctgagaagccacctgtgtccacagctgggaatttgcagaagtcagtcactgaaggaaggctttaggatatttatgataaaacatagcagtacactgggatccaaaccctgggaaacctcaactattttagagtatgtgttgataacaataggctattggataattgccagactactcgaggagtctaagagttggataaagacttaaaggtgaaaggaacttggaaaaatatcctcttcaggtattttaagggaggcagttctcagaatgagaagcttttctggaaaaggttagcactttgcttcagaagagaagcagggcaaaggtgtaattcttcatttaatgtagtacaacctaaagggtaaaccttaacctctcacttacacacatacccgcacacttacattcttttgatcagatttgtattttagaaggcttcatttgtcgccaaatgtgggtgatacttgagggaccccttggaggagaaggctaattagatattactgtaaccttgctgagaaatgactgaaactaagatggtagaagtgagattggagaaaagagaaccacagaaatgtggcaacacactaggtggctgtcagagatttgattagcaaacaagacagtagatgtcagctgtgttagatgggtgtgtatctcccaagagcatcggggcacagaattcccttttcaactagcttatctatatgggatatcaactattgaaatacagataaagtcccctaatggcatcctgtccatcagagattgaaatttgcttcagtaaatgtgtctatccttttcaataggaatttgcctcttaagtcatctcacatttgtttaagtaggatcactctctttagtaacttaaattgactttttaatatctacgtttattcattcatccatccttttctacccataagtcgaacaggcacaatttatggagtttaaatgaaataaaaattgtttttcatctttatctttcactaggagaagttttattcctgggcctgcattaaaaacctaggcagccctatgatttttctggtcattcaagtaataaatgttttatcagagcctctgagttgcacaactccagggggcaacatttgcattgtaatctttataaatggagtctcctggagcccagcttcaatagattgtaatgggatggtgcccctatagttttgcaacatagtccttgtggcctaagttcactttaatataaaaaaatcagtcttaattcagtatttactatatttgtctaatatattcaaaattaagagttctcctccccagcccactacctagctgtaggcaggccccaagacctggctgtaggcaggccagcagtcttcaaggaagaatatgccataaaccttcatgcttaacccctctaggattggagggtagggtaaagagcagagagttaggggccctgcaaccacccaggctctcagtctaactctccaagtgtggcagtgcctcagtttcagttggccactctctgtgcccttcaatttctgtcttgcaagagtatatcccaaagccatttatttctaggttgcctcagccctcacagactacactcttggacagaaaacctctttaaataaccctaggctgatatttctacctcttgttcttcatctagtccctagaattcacatacttttgacccactattaaaacagcatacactaccttcctggtctcctacctctatcctgctgtcgtaggctgctttatcaggctctgataagggtcaggcattaccttgtatgcccccagtcagggctgtgactagagtggaattagtaatacatgtcttttgagtgcaaaatttaagaaagtaccagaaaactcagtaattaagatgaacatgtcttttttttttttttttttttgagatggaatcttactctgtttcccaggctgaagtgcagtggcacagtctcagctcactgcaaccaccacctcctgggttcaagcgattctcctgcctcagcctcccaagtagctaggattacaggcacaccatgcctaactaatttttgtatttgtagtacagacgggattttgccatgttggccaggctggtcttgaacttgcaacctcaggtgatctgcccacttcggcctcccaaagtgctgggatcacaggtgtgagccactgtgcctggccaagataaacataccttaagaaaatttttaaaaataattattaatataaaaaaccatgatgaacaagataccaaaaatttaaatacaagattgtgcaggaaatacttatggagttcagtgactatcttgaaatgtagtacatacaaccatcatcactgttccttcacagtacatttatttttccactgaaataatcctcacaaaattctctcaattaccataatcttacatatctatgttgtgggtattagaacttaatatcagtcaccatccttgaaatttaggctctctggtccaacgtttcactttgaaatgtattttgtatattgttgtatcagtcaaaatttccaatttaaattatagttatccatccatccatccatccatccatccatctgtccatttatttattgggtttgtgtatgaaggagaaaaaatagaatcttcaaatgctaatgattaatccattttaacgactataaaatggaaatgtgtacagttacaaaggcatactaagttggtctgcctcatcaaataggcctgggcaaaaattggtaggtaaaattaaagggaatcacagtgcattttactctcatgatctctgttagaaatgtcccactaaacatgttacgttaccaactcttctattatgccctcatctctacctctatagatttagcctttgtgagctattctgaaacagcttattccacagcttctggtcaatttttagacaatgtaaatagagatccaccttcagatatagactggtgagtctggtcttgttcagagaacaattaaggaccttcaagctagtgaattgtcaattcctttgtaaaaagtgttttattaaccttcagctaccttggaggtagttgttgacagagcattatattaaaacttgtattaaagaatacagatatgcattgtattagaggctttaggacttttttcaaaacgaaccttgaaaaacttcttcaattttttttttttaaaagctgttctattaaagggataatatagtgaataaatatttgttgtctgtttaacttaccttatgtagagctattggctctaaggattttgaaaggacaacaataattctctaaaaataattcaggcacctttggccatttgtgtaaccaggtacaaattaccacgtttcccagtttcccccttgagtccaactgtaatgtattgttctgtaaagtatagtccagttgtcagctctgtttgccttggtcaattgaatgatcctcctccttaagcttagcctatagtgcatttggcttaataaatgaaactgtaacatgccagccacacaatagaggattttatagaactgtttctgcttggaatactataattggaatttgagttaactataattaaaaaagctttcatagcccatggtatatgaactctgaaaccccaaataccaaaatcctactatataaaaatgatccacatactaaaaaaaaaaaaaaaaaaccagacacacaaatcgagtttaatttcgtatcatgctattttcctaaaatatagtttctaaagttattgcaaattagttcctgctgcttggtaaaataccatatttaaacttaattacaactgccttcctgcaatgaagggccaactttttcaaataatgtgttacagcccagtgactctagggagtctatggtcccattgctgcaaatgagcagatcggtgaaaacaaaaacatattaagaagtccacatttctaacaaacaccttgcaaagaataaaatggtaatttaaggaatatgtccacttaatatacatttcatgtatataggacacataatacaataaataccctttttactacccccaatttaagaagtagactagtataatagaaggcatatctccttggtactcagtatttctaaaaggcagtaatggctgtctcctctaagcacctgagatgatatgcctctgtgcactctagccttagaaatatgcttatctcctgcaggcagagcatgctggaagtgccagggagttaaggttaccaggaacagccctcaactaataatgaggaaaagcttgtggataaatatccaagccccctgccttcaggtaggaacactgatattttattagattggtgcaaaaataattgcggttatatagtctcaaagaggaaacagtctccacgtgaaatcgagccccagttgtccacagtaataacccgcttattaacttagcctatatggatttactttcttctcatctgtcttctctgctttcgcagggaaataagtagttcactagtgtttcctgtgataacctcctgaataaactacttatgctcaaatccttatgttggggttttcttctggaggaattgccaaactgttgaagttccctgtgttcatccccaatctcagctctgtccgtctccccaccaagagttactgttttgattttttgtgtttcttgttcctttcctgtttgtaataattatactaatatattaaaaatattagtaactacactggtttgctataataaggtatatcttcccccagaatataaagtccttggagactttccctaaagagtctagaccttgaccattatgcgcttcccaagctgtggctgctgcatttcacattttctttcaaaattgggcaaggaattactaaaagatgctccagtagatcatctgggtaccaaacatatttctttctgtacccagtgtagaatagcaaccctacttttttatgatgctctgggtcagttactcttgccaggatagtgacttctttccttggtctctcagcacacagaccccaaagtgactgtgtagcagccacagcttaagtttaatggaatttctgctgtgtctgctgaaggaagcatttcctttaaaaaataggatttctaactcacagagcccagagttgagggagcgagaagtgatggcaaaaggacaatttctgctgttaccctttagtttccagatccatgtatttggtctgttgaagacagactaccatataatgattagtaataggtgtatacttcatcttggaggatgcagccctacccttgaagtatatcagctccaatcttgttcttcagctgtcccttcaaaaggccagcttctgggctatgtggcaggttataaatccagtggatcttatgatcatgtacccaggggtgtactgcttttgctctgagttctttggtctgatgtgatgtcacacaggattccataacaatggatcaaacactctgtagcccccagatgctgaggctttgccagcaggaaaggcaaaaccataccctcaaaatgtgtctgttccagtcaagcttaattgcaaccccttctagggtaggacaggctgaaaataatcaacaggccagagatctcctccagggatgatgttattaggagctcatcgttggtctcatttggacatttgacagaggcagcactgtatcagcttggagtgggaatccacggacccatgcatagccttcatccctctatcatgactgtttattcgtgtgacttagttttgtcccagactgaaactctaacagtctagataagaacctgtctttcataatatgagttggatccctattccatactacccctaggcctgccttgatgcatgtctggactgataaattattttctttattaatttatttattgagacaggttctcactctgtcacccaggctgagtgcagtgatcatggctcactgcaatctctgccttctaggctgaggcaatactccacctcagtcccaagtagctggaactataggcacgtgccaccatgccagcctaattttttattttttgtaaagacagggtcttgttctgttgcccaggctggtctcaaactcctgggctcaaacagtcctcccacttcggcctcccaaagtgctgagattacaaatgtgagccatcaggcctggccttatttctttaaatttaatctgcctacaattttaaaaaattatgcattcttgacaaaattgtatttaggcatttttttaaacaaatatttatttctccttcattagcaagataaacactgttaatttatagcttttcctataaatttcatttctcctattctttggaataatcccacaatcattaagccttgtttctgacatggagagatgagggcagattttttttttccttttttagatttgttgtgttaattaaatcttatggtgctataacatgcagtggttaaaagggttggagaaatcaccttgttcaaattatagtagaaaatttatagctaattgaatgacctgaggccggttacttgacctctttggcctccagttttatcatatctaaaggacaataatgtatatctcagagggtttttgcagagattgaaaatgtatgaaatgcctaacacagtagcatatacctggtttggttatttctggttacaaaaccaagcctcacagtgtgtaaccaaatgggaattccatttctattagagcatactttcattttgagagccttgataggccaggggagacaggaaagtcaaagttttgaaattttctttcaccagtgactcccatagacttgattatggtcagagtgtcatacaaatctaggctatacacagacatgtttccaagctaaagtgataagatgtctaaaagaaatatttcttagtctgtgttgaattaatgctgcagaaggtcatgggtgagtgaattactttcagaagggaggaagcaatagcaatagtgagcaaactgtgtatgaggagaccctatgaagcaagggcattctgtattgaatattgcaactcaaggaccaattcaaggttccttcttgggaacttttatagagagacacagaccataaaagaagggtacagaaattaagatgttgagagaaacaatactaccatgccagtttacatgcaaagagctacttctgtcttttggttcagatgggaactatgggaatgaaagctgctagtgttttgtggaatcttttccagaatatttttattgtttttctcctatgctgattatgaaatcaatataggcttatctcagaaaaatcagaatatgtagaaaagcaaaaacaactccaacaaaatcacaaaaaattttctccattcagagatagccattattagcaacttgtctatccaatcatatcctttttttaattaaaaaagttctatataataggattttgtaatctgtttttttcactaaatactgtcatctcaatagagcttatttttacatgattttgaaatatgcctgcatggtattcttctataggaatgtattgtaatttatttaattagtcctctaagggatgggcatttatatcatttgaaacttccattattataactttgtacaggttttttttaatccacatctttaattatttactgatgagaaactcttagagttgatttgttggagaaatagccatggtacagtcagctctctcacagatgagggtgagtgttcctacctctaggatgtgtcagaacaccctggctgcctacaagtgctctcctcctatttcatttcagattgtttgctctgccctggcatgcaataccctgggttaatgttgcctaggaactctgctctgtaggactggattctatcaccaaattgttttgcaaatagcttataaaaagaaagataaaattgtagttgacaaatacaaagtgaggtattctgtaatggttaaataaacccccaatggggaataatagatacatattctaggaagaaaggagtttgtttccacaagggattagtttggctcacttgaaaatgattaaacaaacttcacagaaaatcattctcctgatttagaccatcacaaatgaatgattaactggctgaactatcactgaggttatatatcaagcttgtatatatatcaactctgttatgtatcaagcttgttcagggcaaaggaaagagcacttagaggattatactgaagcaagcagattgctctctgattacctctgtaaaatcagattacctctgattatactgaagcaagcagcaagtgctctctgattacctctgtaaaagggttcaccttagtctttttttccctcatgtaagagataatggaagaacactgatgctggacttctgtttaactgggatgtatggtgatagtatagagaaaggagatttcaatggaaaaagaggaatagacaacataaaaaagggtaattcatgagaaaattcctgactcagctgtctttgttagatgatagaagtgcataacagttctctcttaatacagcataattagtatgtatggtttgcacgctaagaaagatggcacaggtgatgtctacactgtaatctccattgatatctgggtagcaacccacagcaaaagacttaaagtgacttttctctcagagatggccaattagcatatgggccctttctactgtgaacacacagtagttaggagagtatggactttggagccacacccaagttcgtattccagctatgcctcttacaaactgtgtgatttggagtagtaactaaccatctctgccttgttttcctttctaaaaaatgggtgtaaaatcacctacctaatgcagttatcatgaagatcaaatgagttaatgtatggaaaggggtggcacatagttactcctcagtaatgttggcctcattccctctccctgctttctgtaatgcagagaattatcttctggtaacttcattgaaaaggcctctttaggcatgaaatcacctgccagctgtgctgaggacaggcttcacagagctcctggaggctaattaaggtgcagagttcagagcagaaagatgcttcactatacctgtggcaggatggccaccagggcctgttccctggccagagtaagcactctttccctagggatttggaacagccccattctcacctggtgtttaccccaggttttgaagagattccaaactagagcagcaagcaaagtctagagctgactggggaaccagccctaccctggatattggcctctgatgaaagcaccactaaacctcaccttctctcctaaatctcttcagaaatgcttactctctgtgatagacatggaacagattgttttgcctcagggatttattgattgattttgccaaagtctttcccaaggctcctttcaaaactggactgatcccttggttctgggaatgagtggtgaacatcagacctctggaatggtggctggtcaatgtctttgccctctcaagttgctcttgaatgttgattcaactcattaggacatacttggatgatgaattagaaggagcatctttgccctctacttacagatcctaggaacaatttgtggaattatcagtaagcaatatctgtaacagataaaatgtctgctttccctttgcccctcttagcctatgacatgccacatccaatttgtcttcgttccaactgtgagaggtcttaatttcatcattctggccttttgcagttaaatgttctccaaggatatgatctatggggagaggactgatagtggaactaatctttcaaagttctgcttaagcaattgtagataacataggagaagaaactctggaaacaattatgattatcctagttctgcccctgtggaaattcaatccgaaacccttcatgtttttgcttctctcttctctacatggatggaatatgttatacttttttgagctgaaaaatctaaataattagaaaaagacaaagttgtaatgagttttctgtttaaacttataggaccctttctaataaaagtgttattgtaatcattgaatcgttagttaactgctttgtatggttatgtcttgtctctctttaatccagggactgcaagcaactaggcaaaaaactaacaaaaaaaccaatgttttataagagtggttctcaaactttaaagtgctgattaaagcacagattgcccaggcctcaccctcagtagatgggtatggggcccaagaactttcaacaggagatgctgctgctgcagcttgtctaagaactacacttggaaaattactaatttgtgtaataaatacctgaccatttggaatccttagaggatggaaatattttgtaatgctgtgtgcaagatttgatatagaaaaacttgggttcaagtggcaattcagcagattacaagaggtgaaacaactgagtttctgagactcagttttattatctgaaagtcaggaatgaaaataatgcctatgtggcagaactgctataaagatcagacaaggtcgtgtatgggaaaggccttggtaaatggaaaagcacaatctaagtgtaacttattctagatgtgttttcaataggcaagttttatatacctaagactaaaagcttgcattttaatccctgggattgaaatctttcaccatcatcaccatgatggtaataacaacaataacaatactagtgcactatttattgtattttctgcaatgggcacttaatatgttttgattatatatttcaaaaacctcataaaatctattttatcatgtatattatttgcttacctaagagtgtactggacagaatttaaatttttcttgagggcttagggcagtgcagttcttagggtgtgtgatgtctctgtctatatagatgatttgatttaaaaatgtgttatatgtgatacatttataacggaatattttttgctaaaaagaaatgagctaccaagctataaaaagatatagaggaaccttggatgcatttttctaagttaaagaagccaatctgaaaaggctataaaactgtatgatttccaccatatgacactctggaaaaggcaaaactatggagatattaaaaagatcagtggttgtcaggggttaaaggggaggaagggataaataggcagagcacagatgtttagggcagtgaattattctgtatgattcatattggtggatccatggtcattatacatttgtcaaaactcatagagtgtgcaacatcaagagtgaactctaatgtaaactatggactatgggtgataatgatgtgtcaacataggtacattaattataacaaatataccactctggtgcccagtgttaatactgggggaactgatgtgtgtagaggacaatggtatatgggaactttctgtaattttgggaactgaaaactgctcttaaaagaataaagtgtattaaaaaggatcacaccaaaaaatgaattgcaaaattcatgacctcatgtgaaagatagtgactgtggtagatagaataatggcccctaaagatgaccacatcctagtccttggaacctgtgaatctgctactttacttggtaaaaggggctctacagatatgattaagttaaggattttgagatgggaaggtcatcctggattatctgagtgggtgcagtgtaatcacaagggtcctttaaagatggaggcagactgtcagaggaattggcacaaaagcagaggtcacacacacacacggggggatagagagagagagagagagagaggaagatgttacactgctggctttaaagatggaggaagtggctattaagtcaagcaaggcatgcaacctcaaaagctccaaaaaacaaggaaatgaccttcagaaggaattcaaccttatattccttgctgacccattttagacttttgactatctgaactttaagttaataaagtgctgttgttttaagccaataaattggtggttatttgttacatcagcaataggaaactggtataatgatttttcaatgaaaatttagacaagattagaaaaaaaaaagaataaaaaggaacaaacaaagcctccgagaactatgggactgtgtaaatagaccaaacctatgactaattggagtacctgaaagagatagggagaatggatcaaagttggaaaacacactgtaggatatccttcaggagaacttccccaacctagcaagacagacaattttcaaatttgggaaatccagagaaccccaataagatactccttgaaaagatctaccccaagacacataatcatcagattctccaaggctgagatggaggaaaaattgttaaggtcagccagagagaaaggccaggtcacctacaaagggaaacacatcagactaacagcggacctctcagcagaaaccctgcaagccagacgagattggggggcaatattcaacagtcttaaagaaaagaaattccaacccagaatttcatatccagccacattaagcttcataaacaaaggagaaataaaatcttttttcagacaagcaaatgctggggtattttgtcaccaccagagacctgtcttgcaagagctcctgaaagaagcattaaacatggataggaaaaaccattaccagccactacaaaaatacattgaagtacacagaccaatgacactatgaagcagctacattaacaagtctgcagaattaaccagccagcattatgatgacaggatcaaattcacacataacaatattaaccttaaatgtaaatgggctaaataccccaattaaaggattcagaatggcaagctggatacaaagacaagacccatcactgtgctgtattcaagagacacatctcatgtgcaaagatgcacatagactcaaaataaaggaatggagaaaaatttaccaagcaaatggaaagcataaaaaagcaggggttgcaatcctagtttctaacaaaattttttttgactttaaaccaaaatttttttgactttaaaccaacaaaggtcaaaaaagacaaagaagggcgttacataatgttaaagggttcaattcaacaagaagaggtaactatcctaaatatatatgcacccaatacagaagcacccagatttataaaacaagttcttagagacctacgaagagacttagacccccacataataatagtgggagactttaataccccactgtcaatattagatgggtcaatgaggcagaaaattaatagtttagactgatcaatgagacagaaaattaacaaagatattcagggcttgaactcagctctagaacaagtggacctgataggtatctacagaactctccacctaaaggcaacagaatatacattttttttgacgtcacatggcacttactctaaaattaatcacataattggaagtaaagcactcctcagcaaatgcaaaagaactgaaataataacagtctctcagaccacagcacaatcaaattagaactcaagattaaaaagcccactcaaaaccacacaactacatggaaattgagcaatctgctcctgaatgaatgactcctgggtaaataatgacattaaggcagaaatcaagaagttctttgaaatcaatgagaacaaagaaacaatgtatcagaacctctgggatgcaggtaaagcagtgttaagaaggaaatttatagcactaaatacccacataaaaaatctagaaagatctcgaattgacaccctaacatcacaactaaaagaactagagaatgaagagcaaacaaatcccagagctagcagaagacaagaagtaactaagctcagagtggaactgaaggagataagagtcatgaaaaacccttccaaaaaaatcaatgcatcccgtagctgtttttttttttaaatcaatgaaatagaccaccagcgagactaataaagaagaaaagagagaagatttcaaataaacaccatcagaaacgataaaggggataccactactgacgccacagaaatacaaccaaccatcagataataccataagcacctctatgcaaataaactggaaaatctagaagaatggataaattcctgcactcataaacaccctacaaagactgaaccaggaagaagttgaatccctgaatagaccaataacaagtcctgaaattgaggcagtaataaatggcctaccaatcaaaaaaagcccagctcccgatggatttacagctgaattccaccagaggcacaaagaggacctggtaccattctgaaacaattccaaacaattaaaaaggagagatatctccctaacccattttatgaggccagcatcttcctgataccaaaacctgatggagatacaacaaaaaaagaaaactgcaggccaatatccctgatgaacatcagtgcaaaaatcctcagtaaaatactggcaaattgaatccagcagcacatcaaaaaacatccaccatgatcaagttggcttcatccccgggatgcaaggctggttcaacatacacaaatcaatacatgtcattcatcacataaacagaactaaagataaaaaccacatgattatctcaataggtgcacaaaaggtcttcaataaaattcaacatcccttcatgttaaaaactctcaataaactacgtattgaaagaacatacctcaaaataataagagccatttatgataaacccacagccagcatcatactgaatgggcaaaagctggaagcattccccttgaaaactggcacaaggcaaggataccctctctcactagtcttattcaatgtagtattggaagttctggccagggcaattaggcaagagaaagaaataaagcgtattcaaataggaagagaggaagtcaaattttctttgtttgcagatgacatgatcctatatctcgaaaaccccatcatttcagcccaaaagcttcttaagctgataagcaacgtcagcaaagtctcaagatacaaagtcaatgtgcagaagtcacaagcattcctatacaccaacaacagacaagaagaaatgcaaatcatgaatgaactcccattcacaattgccacaaagagaataaaatacttaggaatacagctaacaaaggaagtgaaagacctcttcaaggagaactacaaaccactgcttatagaaatcaaagaggacacaagcagatggaaaaacatccaatgctcatggataggaagaatcaatatcatgaaaatggccatactgcccaaaggaatttatagattcaatgctattcccattaaactaccatcgacattcttcacagaattagaaaagactaatttaaaattcatatggaaccaaaaaacagttcacattgccaagacaatcctaagcaaaaagaagaaagctggaggtatcacactatccaacttcaaactatactacaagtccacagtaaaaaaaaaaaaataaaaccagcatggtactggtacaaaaacaggcacatagaccaaaggaacagcatgcagagctcagaaataaaactgcacatctacaaccatctgctcttcaacaaacctgacaaaaacaagaatggggaaagcactccctattttaaaaatggtactgggagaactggctagccatatgcagaaaattgaaactggatcccttccttacaccctatacaaaagctaactcaagatggattaaggacttaaatgtaaaacccaaaactataagaaccctagaagaaaatctaggcaatactattcagaacataggcatgggcaaagactttataatgaaattgccaaaagcaattaaaacaaaagcagaaattgacaaatggaatttaattaaactaaagagcttctgcacagcaaattaaactattatcagaccagacagacagcctacagaatgggagaaaatttttgcaatctctccatctgacaaagggtgaatatcaagaatctacaaggaacataagcaaatttacaagaaaaaaaacaaccccattaaaaagtgggcaaaggatttgaacagacacttctcaaaaacagatactgcagccagcaaacatgaaaaatagctcaatatcactgatcattagacagaggcaaatcaaaaccacaatgagatactacctcacgccagtcagaatagcaatgattaaaatgtcatgaaacaacaaatgctggtgaggttgcggagaaataggaacacttttacactgttggtgggaatgtaaattagctcaaacattgtggaagacagtgtggcaattcctcaaagatttagaaccagaaatatcatttgacccagtaatcccattacagggtatatacccaaaggaatataaatcattctattgtaaagatccatgcacgcgtatgttcattgcatcactattcacaacagcaaagacgtggaatcaacccaagtgcccatcaatgatagactggataaagaaaatgtggtacatatacatcatggaatactatgaagccataaaaaggaatgagatcatgtcctttgtagggacatggacgaagctggaagctgctattctctgaaaactaatgcaggaacagaaaaccaaacaccgtaagtgggagctgaacaatgagaacacatggacacaaggaggggaacaacacacactggggcctgtcatgggagggtgctgggaggagagcattagggaaaagagctaatgcatgctgggcttaatacctaggtgatgggttgataggtgcagcaaaccaccatggcacacatttacctatgtaataaacctgcacatcctgcacatgtaccccggaacttaaaagaaaatgtagaaaaacgggtagagaagagtgatttacatacttcattttccaattagtgcatgtgaaaataattcatcttggtagtattgtccagatactatctcttcctgtttaggtccaggaacagtctgcttgtgttttttattgtcaaatgagttgttctctaatttcatctctcactgggagaaaaagaataacaatactcatactcaaaatgctgtggctgtttagaatctgtttatatgaaaataatatagatcttgcctctgcagttccctaataccattcattgatgttgtttgtattattcgtgatgctgtttcatccattgtgttgcctgtgaatattggtttccaatgactaaaggtttgttagtgtgctttgttgatggtcatcacaaatgcaagtgttccatggagtaggaagaaaaaaataggaatgataatttctggtcatgttaaatttatttttcagaattttataacttagaaacacatctttcagttatacttttcttgaactcattagatcatattcactgcattcctaaaatgtgatccctttcaatgttgacctctcttctgtcccctattcccccatacagccaccagcagaaaggagagatgagtaagaatgttctcattggcacaaggaatgtttgtccctagaatggcacagcttaagacagaaccaggaaatcacaggtttaccacattgatgagaagcaggagaaggcttgattggaaaggcccattggtgttgctgatcaacaatctagaaagcccttagaggacaggcatagttaacctcagaaaactctgtgacattagctagtgtgctttgtggagagagtcaggtaagtaaggggtttggagaacatgttcaggttcaggaacattctacacttaaatgggcttactcttaccctctgcttcaatccccatcccttctacaggttagatcttgggacagcccacatacctagacaaacttaggctttccagcttgcactggaccagggtggaaaggtaaggaaaagaaacacatccgcaacattttactgcttttttttagatcaacctcacccatttaaggagtgtggactgacggctatcacattacaaacagactgggttgaattagaggtggagaaagaggctgagaatgtcactttaggggtgctcctccatatggagacacaggagtgaggaatcaatgatttctcccaacagcttcaaacagatagatctattgtgtgaatttcttggggatctgatcttagtcttgtgacttctgacttcttacatgttgattgtttcctcgtgtgtcttgaaattatgaattaagaatttttcttaagtagtgtaatttctgtggaaatttgatgggcctgtttgaggatgtgttattccaaagacattctgcctttgcttttgccagatgtacagaggacattactggcatgagacttctttttgtgcttacaatttaatgtgggtagttccagatcatattcaaactcaaatctgtgtgactatgaggataaacccaatgtaaattttttgttaaccagggcccagattaagacagacatgcttcctttatgtttccctgtgaatctgagtgggttcttgcctccccatctcacacatattcattgaggatgtagctcttcagaggtttcagccttactgggagggccattccttaaaggcttcctggggtctcaagaccatgtttcctgtgtgaaagttgtctatacaaaaatggagtcacttctgtcaaaccgtaaggaaagagagcttggagaccatgaagggaggaccttcttacatgtttgcatgataacagaaactatcacaacagattgtcaaaaccacaaccttgtacaaagattacatctataaggatgcctgcccagcagctgtctgtccactaatgaactgatgccactcttgttattaatccttgtagccaaggatatcatttcaaaacaacgaatgtaacctccttcgttttgcctttattttcatattgttttgaattatgtgtaagtaataatataatttctgggttattccaaattcccttttgtaagttatccttaagttatttcgcacactgctaagtttaatttaacctagctagttttgtttaataggttaaaaggaattaaattggttttaaaataaattatgctgtgaataataaaaacgctaataggaaatatattccattaaaaaaaccccttgtcttctttgcttctctggatgcacctatggccctctatagcatgtatatctgattacaatcccctgctattaccagataaactctgatctggaagccagtctctctgctgtttattttaggttgacaccagctggggtgggcattaaaccctttatgatagaggtctgcaaattgtcccaggtctgttatagcatcgcttacatgctttctacttggatatttaattgtctttgttttggcctctgggaatttcccttactttcttaagagctatgtcaaaggatatttgctttattttataaaacataagtatgaaatatttatactttataaatatacttttaatactcatcattcataagtataataattttgtaagtatttaaataagtagtagtagatgtttcaagttctctagtctgctacttttagatctttagatattctaattcttctgcctggaacgctcttttcccttttcacttgactaaaccagaggtcacatccttaaggaagctgtgagcttcaagtttgaattaaataccctccactctttaccctcagtgcatagatctaatggcttgtttgccctcgtgtgtttcctccactgaactgcaagctctgtgagcccatgcctatttagtgtaccctagcttgacacttagtagagaaccaactatttgtgaatgaatgcatgtcttctgttgacatgtttgcttattattattttttttaatcctgcctcttggcttgaagttgtttgtttccatagatttttagccttccgcctttatgaattttcgttggtgtctagcaataaaagctcccactgggagtaacttcacactggttgtcaatttattaatgaaagcctggcaactaacatgtttttcacagtagaaacagaaatatatttttctaaaaacttttttattattcagtcagttttttcatattacatttcagctcttgttcaactgaggattcttttaaaaatgctatattgatttttctattgcccttcactaaaattaccttcttcattataaaaaactcaattttatgtcaggtaagaaacaatgggaatctattcttttactccataggtatttgttgagtcccttcaaagtacaagaaagaatgcagagagatgctggtagttcaggaaggctgtgtaattcaggtggggccggggagaactgaatgtttctcgaggatggagccagagtagaaaaagagcagcagaggctccagaaaacaaagttacagtcctctcctcatcttccaaggagtgttactgatttactgattcttttctataggttttatttttaattgacacctagcaattgacacctagcaattgcacacatttatgggatacagtgtgatatttccatatatatattatatatatatatatatagcataatgatcaaatcagggtaattgtctaatccatcatctcaaacatttatcatttctttgcagtgagaacattcaaaatcctctcttctagttatttggaaatataaagtacaatattgttaactatagtcaccttactgtgcactagaacaccagaacttattcc
